United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 29

SEQ ID NO: 134562 - protein, 69 aa, Triticum aestivum
  unsure (1)..(69): unsure at all Xaa locations
  Clone ID: PAT_TA_28980.pep
LCWPRFKVMNGLRARCRLIXHQNVKEFHWNSHASXMGSGTGXSGAVPLALALLLLXGCTELRGXLDAWT

SEQ ID NO: 134563 - protein, 76 aa, Triticum aestivum
  Clone ID: PAT_TA_28981.pep
HIVHKHETTKCSYRYLARICEHKEQILFKHIKHVFVGLNMFYLKHIYMSSCFLVTSTILTPFTISTHLKDNHHHTS

SEQ ID NO: 134564 - protein, 322 aa, Triticum aestivum
  unsure (1)..(322): unsure at all Xaa locations
  Clone ID: PAT_TA_28982.pep
MASNSTCRAWHCLLALFLLASAAYGQLSPSFYARSCPTLQLIVRATMIKALLVERRMGASLLRLHFHDCFVQGCDGSILLDDVGSFLGEKTAAPNNNSVRGYEVIDEIKRNVELLCPGVVSCADIAALAARDGTFLLGGPSWAVPLGRRDSTTASLTEANADLPAPFXPWDGLVMAFDKKKLNPRDLTALSGAHTIGFSQCLNFRDHIYNGTNIDPAFATLRKRTCPAQPPNGDMNLAPFDVQTQLVFDNAYYRNLVAKRGLLNSDQVLFNGGSQDALVRQYIANPALFASDFVTAMIKMGNITPLTGTAGQIRRNCRVVNS

SEQ ID NO: 134565 - protein, 142 aa, Triticum aestivum; identical to SEQ ID NO: 134541
  Clone ID: PAT_TA_28983.pep

SEQ ID NO: 134566 - protein, 162 aa, Triticum aestivum
  unsure (1)..(162): unsure at all Xaa locations
  Clone ID: PAT_TA_28984.pep
VSIXRPSGTDQLARLAGKSVPCCEGGRCRRRRRCPGQEQLQVLLDLRRSPRSPRTESTFGKGCLLRPTKLTHVIPGEWTRHSLWTKQSWKWSLEEGGAHSAARAEKRLDHCGPHDELQRGAALGVERTGTADYTRKRRGGRGLASNAQALQLELEAMAHKSI

SEQ ID NO: 134567 - protein, 176 aa, Triticum aestivum
  Clone ID: PAT_TA_28985.pep
MAAMKITLLAVATISAVLLGTASAATYGVGEPGGSWTLNTDYSNWVSNKKFHPGDEIIFKYSPAAHDVVEVSKAGYDSCSTASAINTFKSGNDVVPLNATGTRYFICGITGHCSPTAAASMKVVIDVVPSSSSPSSPMPAAGPDASNPPPPSSTASSVGATAGFGLVVLLVASLMV

SEQ ID NO: 134568 - protein, 142 aa, Triticum aestivum
  Clone ID: PAT_TA_28986.pep
MSYLLPHLHSGWAVDQAILAEEERLVMIRFGHDWDETCMQMDEVLSGVAETIKNFAVIYLVDITEVPDFNTMYELYDPSTVMFFFRNKHIMIDLGTGNNNKINWAMKDKQEFVDIVETVYRGARKGRGLVIAPKDYSTKYRY

SEQ ID NO: 134569 - protein, 142 aa, Triticum aestivum; identical to SEQ ID NO: 134568
  Clone ID: PAT_TA_28987.pep

SEQ ID NO: 134570 - protein, 146 aa, Triticum aestivum
  unsure (1)..(146): unsure at all Xaa locations
  Clone ID: PAT_TA_28988.pep
TGERFAVRNSLGQAVVEGTGDHCCEYMTGGCVVVLGKVGRNVAAGMTGGLAYMLDEDDTLVPKVNKEIVKMQRVNAPAGQMQLKGLIEAYVEKTGSTKGAKILSEWEAYLPLFWQLVPPSEEDSPEACAEFERVLARQXTAVQSAK

SEQ ID NO: 134571 - protein, 322 aa, Triticum aestivum
  Clone ID: PAT_TA_28989.pep
MASSSSCRAWHCLLALFLLSSSAYSQLSPSFYAKSCPTLQLIVRATMIKALLAERRMGASLLRLHFHDCFVQGCDGSILLDDVGSFVGEKTAFPNVDSVRGYEVIDEIKKNVELLCPGIVSCADIAALAARDGTFLLGGPSWSVPLGRRDSTTASLTEANSDLPAPSLSLNLLIKAFDKKQLSPQDLTALSGAHTIGFSQCLNFRDHIYNGTNIDPAFATLRKRTCPAQAPNGDKNLAPFDVQTQLLFDNAYYRNLVAKRGLLNSDQVLFNGGSQDALVRQYVANPALFASDFVTAMIKMGNINPLTGTAGQIRRNCRVVNS

SEQ ID NO: 134572 - protein, 103 aa, Triticum aestivum; identical to SEQ ID NO: 107316
  Clone ID: PAT_TA_28990.pep

SEQ ID NO: 134573 - protein, 108 aa, Triticum aestivum
  Clone ID: PAT_TA_28991.pep
NSLVISVVAAEVRELVSRFFFFFFFFFFFFFFFLTRQLFLYGTPYNMCYNIKNLFDISCILLISCSYRYLARICEHNEQFLFKHIKHVFGGLNMFYLKHIYMSKLFLG

SEQ ID NO: 134574 - protein, 83 aa, Triticum aestivum
  Clone ID: PAT_TA_28992.pep
AQASIQPFQHSGERSTNPFGDAHLACHVPAFTPIMMRIRARWGVPCFVYAKHKEQILFKHIKHVFVGLNMFYSKHIYMSCFFW

SEQ ID NO: 134575 - protein, 126 aa, Triticum aestivum
  Clone ID: PAT_TA_28993.pep
MWFSHSGLLSLTLWMCVCPRLACCPWRIVLWCSQQLLFYLQNILPRIPICPPPNPSAQEPQQKGSEMAKSKNHTAHNQSYKAHRNGIKKPKRQRQASTKGMDPKFLRNLRYSRKHNVKAGEGEVEK

SEQ ID NO: 134576 - protein, 103 aa, Triticum aestivum; identical to SEQ ID NO: 107316
  Clone ID: PAT_TA_28994.pep

SEQ ID NO: 134577 - protein, 142 aa, Triticum aestivum; identical to SEQ ID NO: 134568
  Clone ID: PAT_TA_28995.pep

SEQ ID NO: 134578 - protein, 103 aa, Triticum aestivum; identical to SEQ ID NO: 107316
  Clone ID: PAT_TA_28996.pep

SEQ ID NO: 134579 - protein, 60 aa, Triticum aestivum
  Clone ID: PAT_TA_28997.pep
MAKSKNHTAHNQSYKAHRNGIKKPKRQRQASTKGMDPKFLRNLRYSRKHNVKAGEGEVEK

SEQ ID NO: 134580 - protein, 173 aa, Triticum aestivum
  Clone ID: PAT_TA_28998.pep
MAAMKITLLAVAALLGTASAVTYNVGEQGGWTLNTDYSSWVSGKKFNVGDEIVFKYSSAAHDVVEVSKAGYDSCSIDGAINTFKSGNDVIPLSATGTRYFICGITGHCSPTAAASMKVMIDVASGSSSPSSPMPAAGPGASNSPPAPPSSAATSVGATAGFGLVALLAAGLMA

SEQ ID NO: 134581 - protein, 881 aa, Triticum aestivum
  unsure (1)..(881): unsure at all Xaa locations
  Clone ID: PAT_TA_28999.pep
MSASIVADTAQCFSTHQFACLIGYGASAICPYLALETCRQWRLSNKTVNLMRNGKMPTVTIEQAQRNFIKAVKSGLLKILSKMGISLLSSYCGAQIFEIYGLGQEVVDLAFCGSVSKIGGLTLNELGRETLSFWVRAFSEDTAKRLENFGFIQSRPGGEFHANNPEMSKLAAQSQFREKKGIMAITIYQQHLAXRPVNVLRDLVELKSERTPIPIGKVEPATSIVERFCTGGMSLGAISRETHEAIAIAMNRIGGKSNSGEGGEDPIRWSPLTDVVDGYSATLPHLKGLQNGDTATSAIKQVASGRFGVTPTFLVNAEQIEIKIAQGAKPGEGGQLPGKKVSAYIARLRNSKPGVPLISPPPHHDIYSIEDLAQLIFDLHQINPKAKVSVKLVAEAGIGTVASGVSKANADVIQISGHDGGTGASPISSIKHAGGPWELGLTETHQTLIQNGLRERVVLRVDGGFRSGLDVLLAAAMGADEYGFGSVAMIATGCVMARICHTNNCPVGVASQREELRARFPGVPGDLVNYFLFVAEEVRATLAQLGYEKLDDIIGRTDLLKPKHISLVKTQHIDLAYLLMNAGLPKWSSSQIRSQDVHSNGPVLDETILADPEVSDAIENEKEVSKTYPIYNVDRAVCGRVAGAIAKKYGDTGFAGQLNITFTGSAGQSFGCFLTPGMNVRLVGEANDYVGKGMAGGELVVVPVDDTGFVPEDAAIVGNTCLYGATGGQVFVRGKTGERFAVRNSLGQAVVEGTGDHCCEYMTGGCVVVLGKVGRNVAAGMTGGLAYMLDEDDTLVPKVNKEIVKMQRVNAPAGQMQLKGLIEAYVEKTGSTKGAKILSEWEAYLPLFWQLVPPSEEDSPEACAEFERVLARQKTAVQSAK

SEQ ID NO: 134582 - protein, 176 aa, Triticum aestivum
  Clone ID: PAT_TA_29000.pep
MAAMKIALLAVAAMAVLLGTASAVTYNVGDQGGWTLSTDYSSWVSGKKFNVGDEIVFKYSTPTHDVVEVSKAGYDSCSIDGAINTLASGNDVITLNATGTRYFICGVPNHCSPTAAASMKVVINVASGSSSPSSPMPAAGPGASNSPPAPPSNAATSVGATAGFGLVALLAAGLMA

SEQ ID NO: 134583 - protein, 530 aa, Triticum aestivum
  Clone ID: PAT_TA_29001.pep
MQGGNHMLLEEPVRLASVLAPAKPKVFPSLTKIVGTLGPNSHSVEVIEECLTAGMSVARFDFSWKDATYHQETLDNLRKAAQNVKKLCPIMLDTVGPEIQVHNSTGGAIELIGGNHVTITPDLSKAPSADILPIKFGDLAKVVKKGDTLFIGQYLFTGSETTSLWLEVTETSGAEVICYVKNTATLSGPIFTLHVSQVHISMPTLSEYDKQVISTWGLQNSVDIISLSHTRSSEDVRELRAFLKSHDLQDTQIYAKVENAEGLEHFDEILQEADGIIISRGDLGIDLPPERVFMSQKTGIHKCNMAGKPVIITRVVDSMIDNLRPTRAEATDVANAVLDGTDGILLGAETLRGQYPVDAVRTVGRICAEAETVYNQSLHFKKVVRHVGEPMAHEESVASSAVRSAMKVKAAAIVVFTFSGRAARLIAKYRAPMPVLAVVFPREGSDPSKWRSYGTTQARQCFSVRGVYPLMGSTDEAETGGLTKEEYGIKLALNYGRSVGIIKPYDRVIIFEKIGDSSVVKIIECDDSER

SEQ ID NO: 134584 - protein, 174 aa, Triticum aestivum
  Clone ID: PAT_TA_29002.pep
MELELGLAPPTNAGRLLGSGKRGFGEAFEDQERRAAVATTLPGRVGDGSSSSSCDSGSGGGVGGSKKALVGWPPVSSARSRACGRHVKVWKEGAAIGRKVYLPFHGSYADLLATLARMFPDPAGDRAGCLGGAAGKGEGEMVVTYEDADGDWMLVGDVPWEDFARSVKRLKILL

SEQ ID NO: 134585 - protein, 255 aa, Triticum aestivum
  unsure (1)..(255): unsure at all Xaa locations
  Clone ID: PAT_TA_29003.pep
YCSARRRSWWRRRRRTWSPTASPSSTPPRPRACGSPRTCPSSCPQRSSSCPSSRFPRSTFPRGFCCSPRGSTSGAPAPARCRHARRPSTRASRWKALPLPSRSSSSSTGSRRSTTPWASVALTTRGRAPRPTPRTASARSRSARXGRTRQSLPTSASTSPSRPTAPRRLAAAPCGSSTTPSSTSYACTSPPVGNRGQPERSSTRVSPSLAKAPRKPRWLASSPPESAISSSLFVIGTSRWTGSTPMARRRERRGG

SEQ ID NO: 134586 - protein, 92 aa, Triticum aestivum
  Clone ID: PAT_TA_29004.pep
APLVVGAVWGVGDGILNTQLSGLIGLLFENDKEAAFALGKMWQAAATAAVFFLSPGATLQGMLAALAAALVVAVAAFLFLSLVIERSHALKF

SEQ ID NO: 134587 - protein, 30 aa, Triticum aestivum
  Clone ID: PAT_TA_29005.pep
KKQVYLITLSLSERNYSVYIIVAQVFINDF

SEQ ID NO: 134588 - protein, 494 aa, Triticum aestivum
  unsure (1)..(494): unsure at all Xaa locations
  Clone ID: PAT_TA_29006.pep
VRAAVVASASAAAAGDDTYPVRWEVGYMTVAPLGVSQKVIAINNQFPGPLLNVTTNWNVRVNVQNNLDEPLLLTWDGIQMRMNSWQDGVAGTNCPIPPGWNWTYQFQLKDQIGSFFYFPSLGLQRAAGGYGPVTVNNRAIVPVPFNQPDGDITLFIGDWYTKSHTELRDMLDDGKDLGIPDGILINAKGPYRYDTTLVPEGLQYEIVGVEPGKTYRFRVHNVGTSTSLNFRIQNHNMRLVEAEGTYTYQQNYTNLDIHVGQSYSFLVSMDQNASTDYYIVASPRFVSSEARWHDVNGVAILQYSNSKGSASGPLPDAPDDFYDKYYPMILARSIRMHASSGAARPNPHXPSPSGQFTTPPPDAGCDNQPRRAERTRRPSSHRVSYSPPETPLRLADLHNLTGVYKTDFPTMPSNAPPMAASSMLNAFYNGFLEMVFQHNETDVQTYHLDGYSFFVVGMDYGEWTPNSRGSYNKWDAISRSTTQVFPRGWTAVLV

SEQ ID NO: 134589 - protein, 182 aa, Triticum aestivum
  unsure (1)..(182): unsure at all Xaa locations
  Clone ID: PAT_TA_29007.pep
PPGAPPPPARTVNVHLAGGTILPLQQSALTTSRARRTAFHLLVALAEDGTASGDLFLDDGESPEMGGRSDWSLVRXSCATGSDGSIKVRSEVVHNSYAQTRTLVISKVVLMGHRSPAAPKKLTVHVNGAEVEPSSPAGTRYQNAGGLGGVAHIGGLSLVVGEEFELKVAVSYLDLGNLRFGS

SEQ ID NO: 134590 - protein, 194 aa, Triticum aestivum
  unsure (1)..(194): unsure at all Xaa locations
  Clone ID: PAT_TA_29008.pep
TKRKLALIAAATEELGIXPXGDLPWRLPRDLKYFRDVTTKIPKGNSVQNVVIMGRVTWESIPPKYRPLDNRFNIVVSRNPNYDLQTTDPNAILVTSFEEALEKIDATKTNPRVFVVGGAQLYSHAIKRADCTDILLTKIKAKIECDAFFPKIDEHVYRPSTHEELEAYVEESVPEGIQTYKDLEYEFTYYKRMV

SEQ ID NO: 134591 - protein, 242 aa, Triticum aestivum
  Clone ID: PAT_TA_29009.pep
FFNLLSFYFKMKFHFATLLLLAITFVSTVFATSSAASGLVARHVKYPVKANDALIVKIMASIEAQLNAKVLAQISASFSEEISGHLDVDAKVLGGLVSADVSVSAVEKLAIKKLKAELEAELKAKAKVDVYASVEAYLRKKCGSKRLTEKKLLQIIADVEAKAIETLKVELPKIGADLKLNSKAQVDIILKKVSVNIPLIASINVKGAFDIKAAISACVKVGVKVCAKLSATESAKVILKAL

SEQ ID NO: 134592 - protein, 319 aa, Triticum aestivum
  Clone ID: PAT_TA_29010.pep
MTEVIEGDVDSIIARLLEVRGSRPGKQVQLLENEIRYLCQKSREIFMNQPILLDLEAPIKVCGDIHGQYYDLLRLFEYGGFPPDANYLFMGDYVDRGKQSLETICLLLAYKIKYPENFFILRGNHESASINRIYGFYDECKRRYNIKLWKTFTDCFNCLPIAAVIDEKILCMHGGLSPDLQSMEQIRRVMRPTDIPDTGLLCDLLWSDPDKDIVGWSGNDRGISFTFGADIVSKFLQKHDLDLICRAHQVVEDGYEFFAKRQLVTLFSAPNYCGEFDNAGAMMSVDESLMCSFQILKPAEKKAKTGLNNKQRNTRGRVM

SEQ ID NO: 134593 - protein, 203 aa, Triticum aestivum
  unsure (1)..(203): unsure at all Xaa locations
  Clone ID: PAT_TA_29011.pep
MTLFKVVLIGDSGVGKTNLLGRFTRNEFNLESKXIGVEFATRSIQVDNKVIKAQIWDTAGQERYRAITSAYYRGAVGALLCYDISKHSTFESVSRWLKELRDHADSNIVIMLVGNKSDLRHLRAVPTDEAKQFASENGLSFIETSALDATNVELSFQRILTEIPRIVSNKALETSNNAIQPTGGPTILGSPSPDEPKPRGGCC

SEQ ID NO: 134594 - protein, 135 aa, Triticum aestivum
  Clone ID: PAT_TA_29012.pep
MNSLRKLTTPTTQIIRSFHAAYPRFTGKTVEANTKTFDELVRKADHPVIVDFYADWCGPCRVLTPLLSKTVAANPQVTLVKLNVDDCPEIAGEFKVAALPTVSAFYEGKVVDTFVGAQPAKVASFIEKHAELAKK

SEQ ID NO: 134595 - protein, 92 aa, Triticum aestivum
  Clone ID: PAT_TA_29013.pep
YINLPNSSPKHTGQQFEGEHCFPESHERRDARQVSFVHPPSKRKTTSRTHPSRHFLQHWNQKTQELLPYNMYTQLRLRRFLMSPTRSLFPAF

SEQ ID NO: 134596 - protein, 99 aa, Triticum aestivum
  Clone ID: PAT_TA_29014.pep
RRRNAVDFLKRMKQNSVPSTERVSLLETLKLSATEQKKAAKADGRKEPGSSSGSKKAAETASGGRRSVGRPPKRAAAPPTPPPSKRAKDDRPTRKRGKK

SEQ ID NO: 134597 - protein, 247 aa, Triticum aestivum
  unsure (1)..(247): unsure at all Xaa locations
  Clone ID: PAT_TA_29015.pep
GDGSFRYEDANNLPPAVDWRQKGAVTGIKDQGQCGSCWAFSTIVAVEGINKIRTGKLVSLSEQELMDCDNVNNQGCDGGLMDYAFQFIHKKXGSTTESNYPGTGEQGSCDQAKEKAHAVTIDGYEDVPANDESALQKAVAGQPVSVAIDASGNDFQFYSEGVFTGECSTDLDHGVAAVGYGTTRDGTKYWIVKNSWGEDWGEKGYIRMQRGVSQAEGQCGIAMQASYPTKSAPHARAVREGSHTDEL

SEQ ID NO: 134598 - protein, 85 aa, Triticum aestivum
  Clone ID: PAT_TA_29016.pep
WYTRAIEPCTYSTAEWEEFTEESTRNALMEHTATPEFAQWAADNAHRLRVERDDVSEDESIESYSSSSEEAEKGGKASRLLSRFM

SEQ ID NO: 134599 - protein, 158 aa, Triticum aestivum
  unsure (1)..(158): unsure at all Xaa locations
  Clone ID: PAT_TA_29017.pep
SRGNMTTTFAQRFSFANSNVVSNKGSSQVINQTTDAHADVGGGAYAQXVHQSFPLYIFQGGDGSGTSSQRLKRRVEIGFVESCAGAGGAGTSTLRNEQVAEAEVVLRDDQVAGASWRMHQVYNYGASNGGCYLRNVTSVGYDVLFDHNVASCTGTRRR

SEQ ID NO: 134600 - protein, 486 aa, Triticum aestivum
  Clone ID: PAT_TA_29018.pep
PRGPRRPAGWAPEQIAVALSAAPTSAWVSWITGDFQMGGAVKPLDPGTVGSVVRYGLAADSLVREATGDALVYSQLYPFEGLQNYTSGIIHHVRLQGLEPGTKYYYQCGDPSIPGAMSAVHAFRTMPAVGPRSYPGRIAVVGDLGLTYNTTSTVEHMASNQPDLVLLLGDVSYANLYLTNGTGTDCYSCSFAKSTPIHETYQPRWDYWGRYMEPVTSGTPMMVVEGNHEIEQQIGNKTFAAYSARFAFPSTESESFSPFYYSFDAGGIHFIMLAAYADYSKSGEQYRWLEKDLAKVDRSVTPWLVAGWHAPWYSTYKAHYREAECMRVAMEELLYSYGLDIAFTGHVHAYERSNRVFNYTLDPCGAVHISVGDGGNREKMATTHADEPGRCPEPLSTPDAFMGGFCAFNFTSDPAAGSFCWDRQPDYSAYRESSFGHGILEVKNETHALWKWHRNQDLYQGAVGDEIYIVREPERCLLKSSIAAYF

SEQ ID NO: 134601 - protein, 214 aa, Triticum aestivum
  unsure (1)..(214): unsure at all Xaa locations
  Clone ID: PAT_TA_29019.pep
MAAAMSYVHADVENLKATELRLGLPGVEESDKMPSPPSTPRAGTKRALAGEHREEEPKAAPPAAKAQVVGWPPVRSYRKSCFQQASSKTKEAAXGTCGGEAGGGCRCRGAARRRSXGGSLYVKVSMDGAPYLRKIDLKMYKGYRELREALEAMFLGFSGDAGSVNPSDFAVTYEDKDGDLMLVGDVPFGMFMSTCKRMRIMKGSEARGLGSSKE

SEQ ID NO: 134602 - protein, 328 aa, Triticum aestivum
  unsure (1)..(328): unsure at all Xaa locations
  Clone ID: PAT_TA_29020.pep
MAAVAGPVVLGCDLPGPVHGGPMGASPLVLLEVPSRASSPLPARAGGMTVSTAGAGGASVALSWLGLANTRLPTSPPPLGLSARPRNPRNRSAGKFMRLSDFLAFASHLQIRHMAXMLKNLSSIKTFASGILVPXTISAVDDSGYSKQSAQKVMIQSTNSSTLVKLKHLAKYNLVYKIDEVVKDAAPSSLADMKKFADAASVSIKSVYPESSNFLINQTNPLVKSLQSAGLPVYVYLLRNEFFSQPYDFFSDATSQINALVHKGGEGGGVDGLITDFPGTAHRYKLNSCRNMGXTRRPTTCCLPSAAAWLGSYRIKQHCHQQWPQSRC

SEQ ID NO: 134603 - protein, 307 aa, Triticum aestivum
  Clone ID: PAT_TA_29021.pep
MAGGLFDMSHPASALAGIAGNIVSFFVFLAPMATFLQIYRKKTTGGFSSVPYVVALFSCSLLIFYALLKTDSPLLLTINSFGCCIETVYIVAYLVYAPPRARLRTLAYFFVLDVAAFGLVLVVTMYAFAPAHHAVKFLGSVCLAFSMAVFVAPLSIIVKVIKTKSVEFLPVGLSFCLVLSAVAWFCYGLFTKDPFVMYPNVGGFFFSCVQIGLYCWYRKPSNAVLPTTTADAGNGNGGSADQPQVQVIELPVHSVAILSVGPVPILGVHKIEVIAAEQQTVIDVKDAARAAEVDQPEVIEIVPAPAV

SEQ ID NO: 134604 - protein, 122 aa, Triticum aestivum
  unsure (1)..(122): unsure at all Xaa locations
  Clone ID: PAT_TA_29022.pep
IFTDYFNYYLPKMGTSLESICYEKEFASKEKVGRLEREAVSSLFRPPTANQSWRKVLSMGNLLNGHEPVQREIVFSVLANLLYGHYCXLTPLCIDERVETHYMYISGTSNDLWVALSVTSWD

SEQ ID NO: 134605 - protein, 275 aa, Triticum aestivum
  unsure (1)..(275): unsure at all Xaa locations
  Clone ID: PAT_TA_29023.pep
CCCCCCCCCCCXVVGQMKLALQELKDKYNPDRIIIETSGSAFPAPIAWQIREMEAEGFMLDSIITVVDCENFSGYEDTSYTAKLQAQYTDVILLNKYELVNERQLDSVLDAINVLNTDTPKVKCDKEGVSPDLVFGLDTELFKVGYSKSNTLEAMVFDPHHQKNEVDLIQITQDINNNGLTIESLETFLKSMPKDDIYRIKGFVRLNDSQLIIVNHAFGRFSITPVENEETLENTKNVQVKITVMGQDLRMYTERVKGLLNGQDGEVRLTKAHRH

SEQ ID NO: 134606 - protein, 214 aa, Triticum aestivum
  Clone ID: PAT_TA_29024.pep
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDEASFNNIRNWIKNIEQHASDNVSKILVGNKADMDESKRAVPTSKGQALADEYGIQFFEASAKTNMNVEQVFFSIARDIKQRLSEADSKAEGGTIKINTEGDASAAAGQKSACCGS

SEQ ID NO: 134607 - protein, 276 aa, Triticum aestivum
  Clone ID: PAT_TA_29025.pep
DIEVVHIIDDEPKPSTPMEVDIVRTNPQGNGDKWFSIPAHQLELSLRRSDYGRSEDQEKNDTRTLNHSTSSAFSLYNCRPISSFGNAGDAQPCSTSATHADLQNKNGDSAAPFQDKADPICHPIRVVALPVPVGGLTFDGQPFWSGAPVAPLLYPQSGPPIWNGRTPVSQEVDTQATSSQQSDPTEMDCQQTESTQRQEVLPSPTANEKHLHVEIPSDSNPQQVSPMASESGTGSSTCPAAPRNALSGSACGSSSNRIATPTEQCNASDGATENPS

SEQ ID NO: 134608 - protein, 261 aa, Triticum aestivum
  unsure (1)..(261): unsure at all Xaa locations
  Clone ID: PAT_TA_29026.pep
WVGAGNKKRQHEKISGRKMATXTEALCRGYPTEFASYFHYSRALRFEDAPDYQYLQRLFXDLFIRKGXQFDYVFEXRFSRYQQSQMTSAPPRAMAAAAGTRLWRWLPLANRHSAAVEGRRRRCSDGDAMLRLVTPPAINAGSLANQKSPIRHDQSTSKDAMFSSSTLLGRSSGSSRRPAVSSSREPSTDAEQTRSRTTDASPGAFQRSSAPRWSPQVGDSSDTRGRSSSGRHQSSSAKNYESTVRGIQGLNFDGDDTRNHY

SEQ ID NO: 134609 - protein, 272 aa, Triticum aestivum
  Clone ID: PAT_TA_29027.pep
MSDISTGLANLVCIGFTVIYVIGFYVFKTSGSRNHPSVIRARMKAVTVASVLSILIVKSLTPLDLITTLGLTPVFGIFKPLLLSVLLFLGPLSILYFDRELPFQENFDLQRDVVESFTKPLGQRNYFVAPFTEELVFRACMIAVLYQANYSKNYLIFVSPLYFGIAHLHHAWENYHALGKPREGLIQVICGSLFQFTYTTIFGWYASYLFIKTGNLWPPVLCHSFCKKMGFPDFSRITYNKQVILACFPIGVILFICLFNPLTDIGVKSVYF

SEQ ID NO: 134610 - protein, 377 aa, Triticum aestivum
  Clone ID: PAT_TA_29028.pep
QRAYYFSNEYLVDLFSKCGFTLEEICVHNKKVENRSLDLVMNRNWIQATFTLNPAGPLSPNNQHDHNTCEGKDDKLAVDMSQKKSESEEIDLSVDFSNMFGTSHYLNEAQIIRIKAKGHDFKIKMLAKEYQHTCKSTGLMLWESAQFMCSLLAENPSIVAGKRVLEMGCGSAGICSMVAASSAQFVVATDGDAESLDLLRQNTSSNLEAELLNRISIRKLFWGDEDDVKAVRELSGDGAGFDCIIGTDVTYNPDATLPLFKTARALISDGGDAGSKAALILCYIQRRVDEDSVLSAAEAQGFRLVDKWINGGHACIGLWSSWSRGLPVCGPFPCGTLAFSPWDAGVTGVYLHLMVNLQVLFYLPALVYRRMFLYTKR

SEQ ID NO: 134611 - protein, 172 aa, Triticum aestivum
  unsure (1)..(172): unsure at all Xaa locations
  Clone ID: PAT_TA_29029.pep
VINASQEIIIQSDKRVDRRGAQVHVANGGGLTIQHQNNVIINNLHVHGIVHTSGGNVSMTATHSTIRTRADGDGVSIFNATKVWVDHLSMDNCEDGMIDVVAMSTAVTVSNTHLAHHNDVMLFGATDGKEEDKVMQVTVAFNHFGRGLVQRMXXCRYGFFHVVNNXYTXWLM

SEQ ID NO: 134612 - protein, 376 aa, Triticum aestivum
  unsure (1)..(376): unsure at all Xaa locations
  Clone ID: PAT_TA_29030.pep
AVGGSCAKLPSSIHGLHCLETLDLRRTXIKTLPIEAIILYHLAHLFGKFTVDIDDLNNANKMSKAMKFLSGNKSNLKTLAGFVAKEMRGLLQLMVHMRNLRKVKIWCGPVANGSNYASDLSKAIQEFTKVPMDNVGARSLSLDSEECSQDLLSSLAFEPCPEDSKYDVRSLKLRGKLLQLPPFVTLLSGLTELCISSATLTRNLLSSLINLRNLLYLKLIASELEKFEMKSGAFPSLRRLCFAVQSFASSLPAIEQGALPNLVSLHLLCPGLVGLSGIQIRHLRHLKEVMVDSGVPDQTRQDWEQATKNHPNRPRLVLHKSGVRVETEGPGNEEASAVREKRKICVVQPSSDEGLDSSLKKMRLSSDSSSRLQVIV

SEQ ID NO: 134613 - protein, 158 aa, Triticum aestivum
  Clone ID: PAT_TA_29031.pep
HSFGLRARTRHMFSRSFREHGVIPLSTYLKTYKVGDIVDIKANAAVQKGMPHKFYHGRTGIIYNVTKSSVGVIVHKVVGNRYIEKRVNVRVEHIRHSKCRQEFLDRVKSNAQKKKEAKAAGVTFNLKRLPAQPRDARHVSTQNNVPQTIAPIPYETLI

SEQ ID NO: 134614 - protein, 194 aa, Triticum aestivum
  unsure (1)..(194): unsure at all Xaa locations
  Clone ID: PAT_TA_29032.pep
WSEQPAQQQKKKXLWGLIVCHHESPRYVPFPLRYACEFLAQVFAVHVNKEFEVQKQLREKSILRMQTILSDMLFKEASPLTIVSGAPNIMDLIKCDGAALLYGGKVWRLGTAPTESQIRDLALWLSEVHMDSTGLSTESLHDAGYPGASALGDTVCGMAVAKINSSDILFWFRSPTAKEIRWGGAKNDPSDMDD

SEQ ID NO: 134615 - protein, 180 aa, Triticum aestivum
  Clone ID: PAT_TA_29033.pep
PAGPGLESQPSASSLSPFHLPSSPAALAPSSGASRAPRGQRGSRARTSAAREVANTARRRARTSAVRSKCSGGQYGEAQRPLGLREVQGRKQPIRRAVPVRRPYSLRGVLDLAPTPPTRAGHPPVRCPHPHHQAPQRRPRSPSPPRTSREQHRDGDFGSSALMMPSEHNLLVFSMRKKMI

SEQ ID NO: 134616 - protein, 240 aa, Triticum aestivum
  unsure (1)..(240): unsure at all Xaa locations
  Clone ID: PAT_TA_29034.pep
MDDCAASQLLSVAGAPKIVLIPVVVAVDCPFPPSDKIGINSVQRENEEIVPMRAMKMAWVPYVPLEDRLSXIDSLKTKIFTLGCTQRRSALKHLKEERVKKFDYCMPYYMPLSPPEDEDDTVVNIMYPLEPPDICDFDWEMDDMEDFIDEKVKDEVLPEDEKEKFKDFIKERVRERKRELKQAKEARKKAIDDMDPKLKEAFENIRFYKFYPIKTDDTPDVSQVQAKYINRYYRHAHELL

SEQ ID NO: 134617 - protein, 87 aa, Triticum aestivum
  Clone ID: PAT_TA_29035.pep
MRGIELEEFNKAVTAANSSRDAVKLKLLDTYSISSMRPDGHAGPYRMFHPFAQGNKDGSSVQNDCLHWCVPGPIDAWNDLIMKLVLN

SEQ ID NO: 134618 - protein, 134 aa, Triticum aestivum
  Clone ID: PAT_TA_29036.pep
AHHKPVVLFRTWAPDHFENGEWFSGGTCNRVLPYKKGEYGGKYMEHIMRGIELEEFNKAVTAANSSRDAVKLKLLDTYSISSMRPDGHAGPYRMFHPFAQGNKDGSSVQNDCLHWCVPGPIDAWNDLIMKLVLN

SEQ ID NO: 134619 - protein, 149 aa, Triticum aestivum
  Clone ID: PAT_TA_29037.pep
MAPALTSPLPNAPHTLSDPTTTTTKKAPKSIFPDGIRTSGQHEPIYSLLQPYSAFPKEITGPTAWSKTDYASNPERWTHIFSADEVREMSEAADAFIASGTPLTGITKDLFPLPNFSNFLEPLRKELIDGKGFILFKGMPCLEQGGGET

SEQ ID NO: 134620 - protein, 64 aa, Triticum aestivum
  Clone ID: PAT_TA_29038.pep
SGTVYCSFVETPASPALPVGYFRQSSSACPVFAKNVLNSRAAYPLSHSTKSRPCRIPIRALAVA

SEQ ID NO: 134621 - protein, 231 aa, Triticum aestivum
  Clone ID: PAT_TA_29039.pep
LCMCFPNVIGYALAELPSIMPTLETLEIGSEDEVVNTPMLPTKFIHLKHLNIQITESDDYFHLASFLDASPSLETLFLDVSKDKEYVDRESVFGGSSLHLRQLPEDRHVCLKLKRVEIIGFSSAKSLIELTRCIVKKAVSLELLVLDTLDGSDRCCGEYKCRPIGKTVLEENKCRPISETVFKEASRAVVAVRRFIEDQVPPTAKLSVLEPCTRCHSSHELAAGDMAVEGG

SEQ ID NO: 134622 - protein, 60 aa, Triticum aestivum
  Clone ID: PAT_TA_29040.pep
MAKIKPRALLAQSKQKKSPTKIGPTMFAFIVVGALVVSSLYAYRYWMSKGPAGAESVAGN

SEQ ID NO: 134623 - protein, 224 aa, Triticum aestivum
  Clone ID: PAT_TA_29041.pep
MAMRRRLPQFQAILAQQAVRSAIPKPRPLANPHSRLLHCASPPVAASRCPLSHSLWRSPGSAGTLLPVSAAAVASAARAAAKRWLTARAAGSLELFSLQRRRSPGLLSSSSTFLRRVPWGRWLPSADGMVLMLMGANVAVFMLWQMASPDFMRDHFSISLDNLKSGRLHTLLTNAFSHYDSGHLFGNMMSLYFFGSNISSAFGPAFLLKLYIAGALVGSTFFLV

SEQ ID NO: 134624 - protein, 179 aa, Triticum aestivum
  Clone ID: PAT_TA_29042.pep
RCVRGRTGRGDIEVGSIRRTLFKVFGEEASPKIKKFMKVMLAKRQQGQHGGVVGLVGALAQEPPRAKLQGKQEELKPAMEQEVHGVEEVYAGTAARAPHNGVLISGCQTDQTSADATTAKGLSYGALSNAIQAILAEKDGKVSNKELVLRARGLLSKQGYKQQPGLYCSDRHTEVAFIC

SEQ ID NO: 134625 - protein, 383 aa, Triticum aestivum
  Clone ID: PAT_TA_29043.pep
EAASAASTTEEAARPDTVIPPDNRIPATIITGFLGSGKTTLLNHILTSHHGKRIAVIENEYGEVDIDGSLVAAQTAGAEDIMMLNNGCLCCTVRGDLVRMIGELVDKKKGKFDHLVIETTGLANPAPIIQTFYAEDTVFNDVKLDGVVTLVDSKHARLHLDEVKPKGIVNEAVQQIAYADRIIINKTDLVSEPEVSSLVERIRSINRMANLKRAQYGKVDLDYVLGIGGFDLERIESAVTEEPHDEHEHEHEHKHEHEHDHDHDHHHHDHDHKHDHHAHDHTHDPGVSSVSIVCEGEMDLEKADMWLGNLLLERSDDIYRMKGLLSVSGMPQRFVFQGVHDIFQGSPDRMWEPNEPRINKIVFIGRNLNREELETGFKDCLLK

SEQ ID NO: 134626 - protein, 64 aa, Triticum aestivum
  Clone ID: PAT_TA_29044.pep
MENNRSNQQAPPPPPGYPTAAAEQGQAGGKKGRRASTKSRGEKGFIEGCLAALCCCWICEMCCD

SEQ ID NO: 134627 - protein, 64 aa, Triticum aestivum
  Clone ID: PAT_TA_29045.pep
MENNRSNQQAPPPPPGYPTAAAEQGQAGGKKGGRASTKSRGEKGFIEGCLAALCCCWICEMCCD

SEQ ID NO: 134628 - protein, 105 aa, Triticum aestivum
  Clone ID: PAT_TA_29046.pep
GSSQTQRSRSPASSPVAGGHEEIDAADAGKSRDWWTRSNWAFLNEPPQEERPGTAHTYTPQFHVAAGNRLTGHVRRVYAILVPRHAAGMPRLGLLPAPRIGHFPL

SEQ ID NO: 134629 - protein, 119 aa, Triticum aestivum
  Clone ID: PAT_TA_29047.pep
GTKARVTRNRSLTKEEVEAFWRQRGKPAPEDGGDVTSPLGSPGRPMEKSPLGSSQRSRSPASSPVSGVHEETIGAADAGKSRDWWTRSNWAFLNEPPQEERPGTAHTYTPQFHVAAGNA

SEQ ID NO: 134630 - protein, 142 aa, Triticum aestivum
  Clone ID: PAT_TA_29048.pep
MGSLMAGWDSPVLGDDTKARVMRNRSLTKEEVEAFWRQRGKPAREDGGGETLAVDVTSLFASPGRPMEKSPLGSSQRSRSPASSPVAAGHEEIDAADAADAGKSRDWWTRSNWAFLNEPPHEERPGTAHSYTPQFHVAARNA

SEQ ID NO: 134631 - protein, 256 aa, Triticum aestivum
  Clone ID: PAT_TA_29049.pep
MSPPLEPHDYIGLSAPTSSSSCSSSPSPAAEAGPRLTLRLGLPGSESPDRDGSVDVVAPALTLGPASHKAASKRAFPDASPRRGCSATARAEEKPPSAAPPAAKAQVVGWPPVRNYRKNTLAASASKAKGADDGAPHYVKVSMDGAPYLRKVDLKMYSSYEDLSMALQKMFSCFITGQSSLRKPSTKDRLTNRSNVDSLQDQEYVLTYEDKDADWMLVGDLPWDLFTTICRKLKIMRGSDAAGIAPRSLEQTGQNK

SEQ ID NO: 134632 - protein, 309 aa, Triticum aestivum
  unsure (1)..(309): unsure at all Xaa locations
  Clone ID: PAT_TA_29050.pep
MTIIIEQPQFDAAAERKVAGDPAELVLDGGFTVPDSNAFGHTFRDYDAESERKKTVEEFYRVNHINQTYEFVQRMRDAYGRLDKTEMSIWECXRLLNEFIDDSDPDLDMPQIEHLLQTAEAIRQRTTPDEDWLHLTGLIHDLGKVLLHPSFGELPQWAVVXGDTFPVGCAFDECNVHFKYFKENPXYHNPEFNTKFGAYSDGVPGWTNVLMSWGHDDYMCLXLAKENXTTLPSAGLFIIXRYHSFYPLHKHGAYMHLMNXEDKENLXKWLHVFNKYDLYSKSSVRIDVEEVKPYYMSLIDKYFPGKLRW

SEQ ID NO: 134633 - protein, 175 aa, Triticum aestivum
  Clone ID: PAT_TA_29051.pep
MALETCLRGWALHAPQAGIRERLSSGSYAPSRPRTAAPAVVSPSPYKSALVAARRPSRFVCKCKNVVDEVIVADEKNWDNMVIACESPVLVEFWAPWCGPCRMIAPVIDELAKDYVGKIKCCKVNTDDCPNIASTYGIRSIPTVLMFKDGEKKESVIGAVPKTTLCTIIDKYIGS

SEQ ID NO: 134634 - protein, 239 aa, Triticum aestivum
  unsure (1)..(239): unsure at all Xaa locations
  Clone ID: PAT_TA_29052.pep
QLGFEPPSWGDFFIAYASPPPKRVEVWMIARAEKLKGDVNGLFKTWNDTTRRMFLVDTLQHLGRRHHFGXQIHDLLNELLESDFSSSSSLHEVSLRFRLLKENGHWVSLDVFDKYKGEDGSFRKDITNEPKGMRGIPCLYNATDLLIHGEPKLEEAMCFARQHLVSANHSLRAPLAKQVKRAIHRALPRACRRVEALQYISEYEEEEGHNQILLELAKLDFNLLQHVHLKELKDITELG

SEQ ID NO: 134635 - protein, 192 aa, Triticum aestivum
  Clone ID: PAT_TA_29053.pep
KKSPKKAVVFLAEGAEDMEFSISVDVLRRAKIEVTVVGVDISGDYATCARGIKVVPDTKLDKISLKASEYDVAIVPGGAGSAKTLGAHKGVHKILMEFYEHAKLVAFICAGTLVAKEAGIPAHHTVTSFPGVKNQLTGVYTYSEDRVVVSDNVITSRAPGTAFLFALTIAEKLVGSEIVDTVKHDLLTLPEL

SEQ ID NO: 134636 - protein, 199 aa, Triticum aestivum
  unsure (1)..(199): unsure at all Xaa locations
  Clone ID: PAT_TA_29054.pep
NQLFQLKFTAKQLNKQSKRCQKDEQTEKNKLKKSIQDGNMEGARIYASNAIXRKKNEALNLLKLSSRIDAVASRVQTAITMRKVSNSMASVVKGMGRAMETMNLEQISMVMDKFESQFEDLDVQTGYMEGAMAGTTTLNTPQDEVESLMHQVADEHGLELNDTLNELEPSKTLADGSASKQKEKDEDKMLTERLRALRQ

SEQ ID NO: 134637 - protein, 369 aa, Triticum aestivum
  unsure (1)..(369): unsure at all Xaa locations
  Clone ID: PAT_TA_29055.pep
METTSESTANSTVTGATADGGTEREQEHGNGAAAAPAVVQHEEEGEELIGPGPAPARQRQKRPLQFEQAFLDALPSAAMYEKSYMHRDVVTHVAVSPADFFITGSADGHLKFWKKKPSGIEFAKHFRSHLSPIEGLAVSVDGLLCCTISNDRSVKIYDVVNYDMMFMMRLPFVPGAIEWVYRQGDVKPKLAVSDRNTSSVHIYDTHSGSNDPIISKEIHAGPVKVMKYNHAQDXVISADAKGLLEYWSPSTLKFPEDAVNFRLKTDTNLFELAKGKTSVSAIELYLMSXLSQVSNDGTQFVVTSPDRRIRVFWFKTGKLRRVYDESLEVAQDLQKSDVPLYHLDAIDFGRRMAVXKEIXKTENVPQPNA

SEQ ID NO: 134638 - protein, 362 aa, Triticum aestivum
  Clone ID: PAT_TA_29056.pep
MAEQYGKLCIALDVLHECFVTIIEPRTRRDLSEDIVFNRESGLRRLNFRGFYTILLQKDGELISVGTFRVCGKKFAELPLIGTRIQYRRQGMCRLLMNELEKLLSGLGVERLILPAIPQLLETWTGSFGFTAMSCSQRFELAESSILSFQGTTICQKILDATDHNPRDMSIQLVLNAEEIELGKNSIVSFERTTACDTVVNNASNHSEELKVTAQTNYNSLACDTVVNNASNHSEELKVTAQTNYNSLALAENSVFSSWGTTICQKVSSNAFSHPEELNGSDYQLECTSIVPETLESDSQESTSVGVEDRDQPEPELLLEIRSNSSEEGNCAVGVPIITPNPEVNFTVDSHGQPYDRYAFFY

SEQ ID NO: 134639 - protein, 455 aa, Triticum aestivum
  Clone ID: PAT_TA_29057.pep
PRAPRLGTASQGVAGRGRVPVSAVPALGCSLVRCPGAGAGALPRHPAPAGLAGAHADPAPGLPARGGPGRRPPPAAVLRVPPPPPPGRFLREHRSEWADPGVDAYSAAALRASPYAVPGLRASGFMGSQVILPLAHTLEHEEFLEVIRLEGHSLCHDEVVLSRDMYLLQLCSGVDENAAGACAQLVFAPIDESFADDAPLLPSGFRVIPLDAKTDAPSATRTLDLASTLEVGPGGTRAPSDASSTSNTRSVLTIAFQFSYENHLRESVAAMARQYVRTVVASVQRVAMAIAPSRPGGQLEMKNPPGSPEAHTLARWIGRSYRFHTGAELLCTESQSADASLKALWQHSDSIMCCSLKAAPVFTFANQAGLDMLETTLIALQDISLEKILDDDGRKALCSEFPKIMQQGFAYLPGGVCVSSMGRPVSYEQAVAWKVLGDDDAPHCLAFMFVNWSFV

SEQ ID NO: 134640 - protein, 240 aa, Triticum aestivum
  Clone ID: PAT_TA_29058.pep
MVSYVITGTSRGIGLEFVKQISDRGDTVFACARNPDKSEGLQKLVDGKKVYGIKLDTTSEKSIKEAVEEISKLAPEGVDVLINNAGISGSHTTPEQTPKKEILEVFETNVLAVNEVTNAFLPLLRKRGPDRVKKILNMSSLLGSIELADFPEGAAYRIAKGGLNMLTKLQSIQLAKENFVVYSSHPGLVKTDMSVGISKIFPELVINPDESISKQLAKLDSATAADSGKFIDYEGQFLQY

SEQ ID NO: 134641 - protein, 193 aa, Triticum aestivum
  unsure (1)..(193): unsure at all Xaa locations
  Clone ID: PAT_TA_29059.pep
MPRASSPTFRPCPHRCCPPCPSSLQSPPCQAASFPRCPPCRTSRGVPTVPTVPTVPGVPTVPTVPGVPTVPVPGAALPTIPAVPTVPGVPTVPHPAVPGAVVPTVPTAPSVPTVPTVPRVPTLPMPSVPGVPTLPLPPMPSIPDLPNRXVPPPPMPSLPDLPKVPLPPMSSVPGVPKVPVPPAPVVPGRPAAP

SEQ ID NO: 134642 - protein, 141 aa, Triticum aestivum
  Clone ID: PAT_TA_29060.pep
PPPTKPITPTPPTPTTPMPTTTTPPMPPTTPMPPTTTPPKLPSPPNTPKQKPKPKAPVLPNIRSAPPVPLPPPSPISPPSPMPPKPTPPKPLLKRPCHPNARKPRLPCPSKTNSKPKAKSKPKPPCPSSATVSVSTNTSNN

SEQ ID NO: 134643 - protein, 127 aa, Triticum aestivum
  Clone ID: PAT_TA_29061.pep
TIKGTTIGSSKVSSSFSAILDTGTTLLILPNNVASAVARSYGASDNGDGTYTIDCDTSSFKPLVFSIGSSTFEVPADSLVFEQDGSTCYAGFGYGDYDFAIFGDVFLKNNYVVFNQEVPEVQIAPIA

SEQ ID NO: 134644 - protein, 185 aa, Triticum aestivum
  Clone ID: PAT_TA_29062.pep
KLHKTSTVPKRPFESARLDQELKLIGEFGLKNKREIWRVGFTLSKIRRAARELLKLDEKDPRRLFEGNALIRRLVRIGVLDETRMKLDYVLALKIEDFLERRLQTQVFKLGLAKSIHHARVLIRQRHIRVGKQIVNVPSFIVRLDSQKHIDFALTSPYGGGRAGRVKRKRAAAGSGEAADEEDEE

SEQ ID NO: 134645 - protein, 169 aa, Triticum aestivum
  Clone ID: PAT_TA_29063.pep
EDGSGGRIVYVCRDPKDTLVSFWHFHQKTTSVLQQVPGMSASSPAMPTFEEAFELFCQGQTVTGCLKKMASFMGCPFSPEEEAAGVVREVVELCSLGKLKGLQVNKSGSTVLGIKNEAFFRSGTVGDWSSCMTPAMAAQLDGIVAEALRGSTLTFGPLAPPIICEPGFL

SEQ ID NO: 134646 - protein, 171 aa, Triticum aestivum
  Clone ID: PAT_TA_29064.pep
RGTSDSDGDKHGKDRYDDGHNDDANPEEPGPGQATPTSSTETIRGPKRVRCILANRQSAPSPRVRKLQYISELERCVTTLQNEVSVLSPRVAFLDQQRPILTVGNSHLKQRIAALAQDKLFKDAHHEALKEEIERLPQVYQQQNLRMSSGAGAASDHGGPPPVRAEKELMS

SEQ ID NO: 134647 - protein, 118 aa, Triticum aestivum
  Clone ID: PAT_TA_29065.pep
KHRCIEATEDLAVPLNVSQCVNGLSTVKLLDDFKHVLYTYGNESLQSWISGAFPYGKIWFQGCRPLNNALALVEPGGILIEGNRQNYRAITNQGMESMMSTIIKRFDYYLTNLTRSNE

SEQ ID NO: 134648 - protein, 331 aa, Triticum aestivum
  unsure (1)..(331): unsure at all Xaa locations
  Clone ID: PAT_TA_29066.pep
MSSLENWDGFIDVDCPRARMCAAIALRCTDAEEYNRPTLHEIICELNKVESMVSQFPINQLLHPVGTSFAVLAAYALLLMISTNYIQIAAIPAIILVFIGVLXGNFWVKGRLQHRNNNGTAANQGSGSGQAWRMLLPTVLLSYCLQLIQLACAQVTNGQQSDNFLFSHSLLFLSSALGALAVMIAALPIRANQCVAQGQQLIHRIFIVVFMIAVHMMATEWMMVEVMPLVCMPEFIASLVWLTTGNFDHARCMVLIDKVTSRRSTVTFLTAAVALLAFMFAFENEMVLASYWYRGIMYSCTSSGLLSCLCVWMILQWRPDISANVPLDWPS

SEQ ID NO: 134649 - protein, 151 aa, Triticum aestivum
  Clone ID: PAT_TA_29067.pep
RKLDPRVRVQLAAELGLDTKQVAVWFQNRRARYKSKLIEEEFSKLRAAHDAVVVHNCRLEAELLRLKERLAETEEEKNKAMAASAAATGGGGGSSPSSSSFSTVTAMVGGQQFGMEEVETDLTYMSEYAYTNYMMDLAAGGYLGGVYDQFS

SEQ ID NO: 134650 - protein, 289 aa, Triticum aestivum
  Clone ID: PAT_TA_29068.pep
MMQSQHSEKNIIPHSNRDFHKEETSTYWLPKDQEEQYRLTGQHFAVKELYQGNILKDVCEKLDFKKGISVLDVGCGSGAWILDMVSDYPNCTYEGCDIEDVTNKRLSLKQTHFRTGNVLQGLPYPDNSFDFVHMRLLILAFKVEEWPMAIDEILRVTKPGGMIQLLEFDLKMTGNEAVQRILNEIHAVCQSRGQDPRIALKLKNMVAENKHARSVKADYRSVDMASNSMAAKRFIWDWIETVKSMLPVVGSRMGLESKKDQDAYFRELQYGLTHSDAYTYMNAVVAEKA

SEQ ID NO: 134651 - protein, 196 aa, Triticum aestivum
  Clone ID: PAT_TA_29069.pep
MTYFDTLARSYVDVDTSKGVDTEQFLEATEGLVKLFDLLGSAAFSVVQNDMNGNIKKIRERYLSNPTANNTLEELMKNESPEKKRVATEGLLWLTRGLDFTAQALRRSLDNPTEELNTSFTKSYEQTLRKHHSIVIRPVFGLAMKACPYRKDFYEKIGVLTEDGLAQMRAWLEALENIISIIQNVFKANPAYIKGM

SEQ ID NO: 134652 - protein, 280 aa, Triticum aestivum
  Clone ID: PAT_TA_29070.pep
LKKFLSKRNKTLYLFLLLSILGTYLGDFVTAAPIISGDGNSATLTFAGHTVTVHGIVFSVMVFVTGGYLCFLGGVFQNFTMFIIGFYVGANIAYIVLSNAKADYGSNTDTILLVVSIVAGILCGGLLCCCFFLAVYLLGALLGYLAALWLLSWSTNGLIQSNWGRAVLIICFVIAGVLLMAFLERPVFVVGSAFIGSFAIMCGADVYVKSGFLELVNQFIHAKNLDILVDATPTLRGMLAGCLGLTIVGSLIQWCMIRRDSSVYRGWNERYPYRAGWRRV

SEQ ID NO: 134653 - protein, 148 aa, Triticum aestivum
  unsure (1)..(148): unsure at all Xaa locations
  Clone ID: PAT_TA_29071.pep
AVRLPPEFLEATKGRCLVASWCEQEAVLRHQAVGVFLTHSGWNSALVXISAGVPMLCWPFFAEQQTNARYACVEWGVGMEVGDDVRRDEVEARIREVMGGEGAGREMKRRAAEWEEMCVRATAQPGGRSMANLDSLIKDVLLTATPTN

SEQ ID NO: 134654 - protein, 99 aa, Triticum aestivum
  Clone ID: PAT_TA_29072.pep
SSVFSRTMQQSLFFLTMQQSLLFQPREKNEQEKGKIIHPCPRDNKTSSIDPTSFPPVDRLISLTSHNRQETHQCQKHDQHRSRGVGGGRRSRWWRLLPA

SEQ ID NO: 134655 - protein, 78 aa, Triticum aestivum
  Clone ID: PAT_TA_29073.pep
FCQTQCLSVEGYPQLKANCVYFTDDDGFISSYQNSKRDIGVINLENDTREEIVPQIYCSWTNSTWITPSLRMMHSGLM

SEQ ID NO: 134656 - protein, 429 aa, Triticum aestivum
  unsure (1)..(429): unsure at all Xaa locations
  Clone ID: PAT_TA_29074.pep
MGRHSCCYKQKLRKGLWSPEEDEKLMNHITKHGHGCWSSVPKLAGLQRCGKSCRLRWINYLRPDLKRGAFAQDEEDLIVELHAVLGNRWSQIAAQMPGRTDNEIKNLWNSSLKKKLRQKGIDPNTHKPLTEADRSGAAPTISTERTSGSSDVNPSSAGAQGNFGHLLSETAQSSMLLPVYDKKHPETPSLARPKVPAKELFLDQLTAGHESPSSCRSSGPTLYFPFQQQLGYXNECGSGDGANMNSLSLCQEXSSCNTISTVMPTVSPSSPLDAXGTEPXQDNHHHGGTGIGSAPFYWDGVNPSSSGSTGSSGSNSMGFEPQSTNSILENSVFPWTDIGVGQEKDTRVQLVEELKWPDLLHGTFAEATTAMQNQSQSLYDDVIKAESQFNMEGICASWFQNQQPQQQLQAASDMYDKDLQRMPLSFEHI

SEQ ID NO: 134657 - protein, 941 aa, Triticum aestivum
  unsure (1)..(941): unsure at all Xaa locations
  Clone ID: PAT_TA_29075.pep
MAANTGASGWLRGKVKAVTSGDCLLIMGSTKAEIPPEKSITLSYLMAPRLARRGGVDGQFAWESREYLRKLCVGKEVTFRVDYTAHNIGLAIGTVYLGDKNVAYLVVDAGWAKVTKGGPNGGEPLPNVYEVLMLVDVGRQHCSERCGDETAAAIDPQLAIVPDEVGELSGAYAKGYAVIVLAXLASPTPGNGLMSLLYPPELVEFGNDAFELFYSVFGKQEVGPXARIHLADPSVCTSNRLAQLGDLGDTTAPGLKEQSGAAAAEYTSVCPESSSRQYRAMIEERVTTRGRVKXGGTEPVLMVSHVVAELQSSVKCYQLLLGRAEHDLKGAGELRPQGEEDELLEKLKKVQXKAKKERLRLWHGGDVESRRGRSSSRREETPAASVDERRHWRSHGLDMKVLDTERNSVESLYMKTSEREKTIFMQLEENYIHFYGSVFLGSPSPADGDDTSSAPSTGTQPKINVAELLLSRGFAEISKHRDYEERSHYFDALLAAHSRAEKAKKGIHSDKLPPVMHITDLTMVNSKKAKDFLPFLQRNRRHTAVVEYVFSGHRFKLTIPKETCSIAFSLSGVRCPGKDEXYSSEAIALMRRMILQRDVEIEVETVDRTGTFIGSLWESKTNVGSVLLESGLAKLSSFGLDRIPDAHVLTRAEKLAKQQKLKIWENYVEGEEVTNGSASESKQKEILKVVATEVLGGGKFYAQTVGDQRVASIQQQLASLKLKEAPVIGAFNPGKGEIVLAQFSLDNSWNRAMIVNGPRGAVESVDDKFEVFYIDFGNQEVVPYNRIRPADPSVSSSPPLAQLCSLAFIKVPGLEDDNGQEAAEYLSECLLSSSKQYRAMIEERDTTGGKVKGQGTGPVLIVTLVDPETESSINAAMLEEGLARLERGKRWDTKERKTALENLEQFQEKAKKERLRLWQYGDVESDEEDQAPGGRRPPPRR

SEQ ID NO: 134658 - protein, 228 aa, Triticum aestivum
  Clone ID: PAT_TA_29076.pep
RLFIFIYNKQAIWYKKLSIRILTTIPARTKLLGKPAWRGGVPLGKHAFKQLSCSPSRRPRRSPPPGRGHPRRPPPPPPPPPARPEKPPQPADAAAAVDSRGHRNCGSGPRRRAAPRCRHGARGGRLARPRRARHRRGPTRLRPRRRRARAAGDRRRPSARPDSQHPRTPIRQPGAHHRYTTVRSLRRRTTRPRRRVERSHVRERIGGGRRRFGLEEGEWGRDWGNWTR

SEQ ID NO: 134659 - protein, 426 aa, Triticum aestivum
  unsure (1)..(426): unsure at all Xaa locations
  Clone ID: PAT_TA_29077.pep
MPGYSLLDLRPPPRLPSGFHKEESFLDLHPXSSLLRGEQMEEATNPRKASSDGSTLEGLGVPPSQDDYNAAKIKVVGVGGGGSNAVNRMIEYSMNGVEFWIVNTDVQAIRMSPVHSQNRLQIGQELTRGLGAGGNPDIGMNAAKESCESIEEALHGADMVFVTAGMGGGTGTGGAPVIAGIAKSMGILTVGIVTTPFSFEGRRRAVQAQEGISALRNSVDTLIVIPNDKLLSAVSPNTPVTEAFNLADDILWQGIRGISDIITVPGLVNVDFADVRAIMQNAGSSLMGIGTATGKSRARDAALNAIQSPLLDIGIERATGIVWNITGGNDLTLFEVNAAAEVIYDLVDPNANLIFGSVIDPSLNGQVSITLIATGFKRQDEAEGRTAKGGQQMQGDNGRHPSSTGGSKVEIPEFLRRRGPSRFPRI

SEQ ID NO: 134660 - protein, 160 aa, Triticum aestivum
  Clone ID: PAT_TA_29078.pep
DKIAHSWVTIPLESNKEEWFVKQGAMVKQVVGSSPVHFQSKYKESMGEDKIVFCGSELFYVPRQFVEDFGDLVGLVGSLDLHHKIAVPMFFLAMDSPQNFDSEALAGTVFKTNLAANETFSSIYTAQSPAVFPVKVMNEIDFIKVIRLMSKGDPLLMELV

SEQ ID NO: 134661 - protein, 224 aa, Triticum aestivum
  Clone ID: PAT_TA_29079.pep
IVGAQVPLGAGVAFSQKYLNNPSVTFALYGDGASNQGQVFEAFNMAKLWDLPCVFVCENNKYGMGTSDKRSSASTEYFKRGDYIPGIKVNGMDVLSVYRACQYAKEWTTTGKGPLVMEISTYRYGGHSMSDPGTTYRTREEIQHMRSTSDPINGLKQRLIDIGMATEADLKAIDKECRKIVDEALKKAEAAPEPPLSEFHTQIYQPGTEPPVVRGREPNEVYHY

SEQ ID NO: 134662 - protein, 102 aa, Triticum aestivum
  unsure (1)..(102): unsure at all Xaa locations
  Clone ID: PAT_TA_29080.pep
MDSSSTRRPAAFSVRYARQQHPWRVVPAAAGGCLLRWEFECEPVRGTPKEALEARLQAGLDGMAARVHEHLMSARGAVAAAXAVAAGLEAADELKLDSSIAA

SEQ ID NO: 134663 - protein, 103 aa, Triticum aestivum
  Clone ID: PAT_TA_29081.pep
VAQSPTPVSPWPPPPICPSPALSGRFLPQPRQPQPPPPPASARAAGPSRRRPPRRRPRPPARPVRGRVHQRTATPRSLNWEIENIFLIDWFGGPKPISPSQYA

SEQ ID NO: 134664 - protein, 277 aa, Triticum aestivum
  Clone ID: PAT_TA_29082.pep
FNNPLATESQPPVNRHEALLPTCDSLDILDACNGLLLCRCWKAADPLELDYVVCNPTTEKWVSFPATDWSSKVSVARLGFDPAVTSHFHVFEFIDEEAWGIAEDEQSECYGRIQTLAIYSSKAGAWKYQTVEHGPFAIPKNSPGSFLNGILNLAAYNNLIVAVDVEGDNWSLVHIPKPPYYADDINGIFPSQGQLYFANSPADSDGSELSIWVLDDLVTGKWTLKHNVSHLQLFGTKYSSYANDYSVISMHPEHSLIFIVGGHDKTLMSYDMDSRQL

SEQ ID NO: 134665 - protein, 36 aa, Triticum aestivum
  Clone ID: PAT_TA_29083.pep
YRSTSGCTGPTYFRGCLSRDVDKGGVVIPTLSMPVY

SEQ ID NO: 134666 - protein, 141 aa, Triticum aestivum
  Clone ID: PAT_TA_29084.pep
FTDVFAFGIFLLEVACGQRPVNSNARANQPLLVDWVLEHWNKGSLAEAVDTRLQNDYNVDEACLVLKLGLLCAHPFTNARPNMQSIMRYLAGESQFPELTDTDMSFSLLSQMQGQGFDRYALSYLSLNTSIGTISGLSGGR

SEQ ID NO: 134667 - protein, 258 aa, Triticum aestivum
  unsure (1)..(258): unsure at all Xaa locations
  Clone ID: PAT_TA_29085.pep
AICRENADAEPSPAQVHYLPCLRKSPRLLWGSPRLSGKSTKSNSTKPKDLPAKAANSNGYTAGKEPESSDNSPLISEPVLVSSHNVSEISNLPNGRAIENMVRVGSDTQSNRVGLTRELAAVNSQAAFRGYLARRAFRALKGIIRLQALIXRGHLVRRQAVSTLHATWLIVKFQALVRGRNVRISSAAMQLAVKFGQHKYGGDKSSDAWKEKLSSHPYVRKLLSSPVLVQALHVQYDETNPNSALNWLERWTISCIWK

SEQ ID NO: 134668 - protein, 95 aa, Triticum aestivum
  Clone ID: PAT_TA_29086.pep
DLQNRKKGSHTGGNGNDNGNRSREHDRDRYYERSRDRERPYEQGGRGSDYRGGSYNSRRDSERARPRDRNGGDFSRRGDPGRMRSRSRSPGRHGY

SEQ ID NO: 134669 - protein, 223 aa, Triticum aestivum
  Clone ID: PAT_TA_29087.pep
MGRASQLTELLHQQWQLLVFILPLISLLFLRRRWDRSGGLRLPPGPWKLPVVGNLHQIGPLPHRSLSKLARRHGPVMMLRLGTVPTVVLSSPEAVREALKVHDAECCSRPPAAGPRLLSYGYKDVAFSPYSDYVRDMRKLFIVELLSRRRVQAACYARDTQMANLVKNLTNTGRKPVAVADHIFATLDGIIGSFAFGENYAAEQFKGQFVPVLNETMDMLSGF

SEQ ID NO: 134670 - protein, 168 aa, Triticum aestivum
  unsure (1)..(168): unsure at all Xaa locations
  Clone ID: PAT_TA_29088.pep
MGSSTESRSRMGSIKPMGIQLIECVRGGPLSFRSSQALVLVLTFLSYASYHATRKTTSIVKSVLDPKTTNLGLLHWPSHMYLQELKGAANNTALQSGWAPFNGEDGTGLLGEIDLAFLGVYAIGMFFAGHLGDRXDLKILLTIGMVGTGLFTAAFGAGYWLNIHRDYY

SEQ ID NO: 134671 - protein, 319 aa, Triticum aestivum
  Clone ID: PAT_TA_29089.pep
MATTTTLFHPLSVPIAGGRVRRCPLTLLAPARTAPRRPTPLLVARAKRTNNSTAAPKREADEEVEVEEELPWIQDKALDLVEFTGTVTQAIPGPRVGSSPVPWLLAVPLAYVGVSFALAAVRTFRRFTSPRTQKKKRVTKNIFLLKSLDELFQKGREAVDFPALQELMQKTGFDMDDVVRKYIRYTLNEKQFNPDVVVDLIHLRKASMLADNEVAEILNEISRRIVREKGPIVMDLSGFTEQGFKRKLAVQTLFGKIMYLSELPEFCSRDGSLVVKEIFGVTDEDADSLRSRTLSEAGDIESLERMVDDSDEHGTPSSS

SEQ ID NO: 134672 - protein, 207 aa, Triticum aestivum
  Clone ID: PAT_TA_29090.pep
MDSAASVAGAPPAVPPAVLCAAEEALAATESVGDHLAEMLAAAAEDPDAIAELPPLQRARAFLAVAHAATSLFSVRLRCSGINPDEHPIKKEFERLSLWQEKLNRLNEWDKAPLRPSTTVNTQAAARFIGRSLSHLTDDQKRGMQAISKGEGAGWSGRKRKSQPLPERKSVRAAAEEFLAKASQELIGYNGSGVKGPVRTVFDEDED

SEQ ID NO: 134673 - protein, 153 aa, Triticum aestivum
  Clone ID: PAT_TA_29091.pep
MAMQQTRDPTAKLPSASPFASASPPPPYHHHHYGTFSPPPPPPVAAAAYDPSLKGRSAQGVVAFPCTIQQQVFVEGLPVREPRLPFCGVGVGWALFLLGFFLAAIPWYIGAFLLFFVALDHREKPGLIACTVAGIFAVVPFMLNGVRMRPFFF

SEQ ID NO: 134674 - protein, 231 aa, Triticum aestivum
  Clone ID: PAT_TA_29092.pep
GSTSRGCRCAELHGRFEEITFQAADEEESGLHDSGGSSDDGGAQKEQHVKDKEPIRLNGFPKMGRRGLSDRLCFSSFQERSCPTENYESDAQSKGFDIKHEVKMAKYKARKMAHLKRAIHPSLDFDNTTNGASRTKPTLSKLESFHVGKHHNFRVPTCQRSPGTASSPGTASTDQHPGMSNQVCPSPGAQRALRTESSPDCMFTARNYYTGAQLPPNLPRTKSVPLSAIDA

SEQ ID NO: 134675 - protein, 208 aa, Triticum aestivum
  Clone ID: PAT_TA_29093.pep
MAFALNASCYPSSFQSSLLPRRMAAAVMIPRRRNVLPVIRAVAVAPPAPAPAKPAAVRSRPVSVTMAKLMAKGKTALIPYITAGDPDLATTAEALHLLDACGADVIELGVPCSDPYVDGPIIQASSARALAGGATMDGVLAMLKEVTPELSCPVVLFSYYRPILCRGLAEIKEAGVHGLIVPDLPYVAAHALWSEAKKNNLELVLLTT

SEQ ID NO: 134676 - protein, 169 aa, Triticum aestivum
  unsure (1)..(169): unsure at all Xaa locations
  Clone ID: PAT_TA_29094.pep
MFEGMERAGYGVGAGVVLSRDPKPRLRWTPDLHERFVEAVTKLGGPDKATPKSVLRLVGMKGLTLXYHLKIIFKKYRMGKQEQERHRFRNQQTFRPHKDHFSSAILPTSVPPGNNTTGETHRTIEISNRPKDFTNTLGQELQIARARECRHPGEGKTSYEQGPTNTPHD

SEQ ID NO: 134677 - protein, 192 aa, Triticum aestivum
  Clone ID: PAT_TA_29095.pep
RTRGRTRGYTSGGSLDPITGVNQRSFFIYINNQTAQEQMDVIAWSGGIGVPVYTDYLVVTTGSGQMDMWVALHPDLSSRPEYYDAILNGLEVFKLQTYGSNNLAGANPPIPQKQFYQGESKRKSAVAAAVGGTVAGGLLAVLIGCLCACAMCRRGRKATSVVVCEPEAIPDKQAHGPPSPTKSSALFKSGQT

SEQ ID NO: 134678 - protein, 159 aa, Triticum aestivum
  Clone ID: PAT_TA_29096.pep
MASPNGALNPSLIFGLLNSIEHLNGTNFPTWKEQISINLGVMDLDYALREKAPVPLSSDDENLTERTKVYEANKEKWERSNRLSLMIMKSTITLGIRGAIPDSECAKTYLASVEEQFKGSTKVYASTLIMKMLTTKYDGTSGVREHIMTMNDMAAKLKG

SEQ ID NO: 134679 - protein, 160 aa, Triticum aestivum
  Clone ID: PAT_TA_29097.pep
GITPPRTHLVHAFCGAAGQFSPKSTTVALGNRRNSGRRREKGRRGEGRKRATPCDCQNDDGMRAGSPYARGNQQAEEGGDRCRSPGDQQAKSRGDSVVCAPRPPSGEELDRGRCRRQVVEESGSKVPKKRWSWRGRWGGGNLHSNAGGAGREVLSGYDRG

SEQ ID NO: 134680 - protein, 175 aa, Triticum aestivum
  Clone ID: PAT_TA_29098.pep
MGREVSESCVDGVVMEMVAAYCGRFYAAKPELAAGRIEAIGFQVGHQLSERYTMERPRFTDHLEAIKFICKDFWSELFKKQIDNLKTNHRGTFVLQDNHFRWLTRVSLDPAVESTDATENDSGSLGDSAAQTTSMLLYFPCGLIRGALTNLGIPCAVSADMSNLPACSFVVRIKT

SEQ ID NO: 134681 - protein, 165 aa, Triticum aestivum
  Clone ID: PAT_TA_29099.pep
AKRIGFVGLPPIGCVPSQRTMGGEPRPERNAAAQLYNARVQELIRRLAEEDPAGFPTLVFIDIYTVIQDLVDNGVRYGFSETKKGCCGTGTAEVAVLCDARFMPVCDDVSEHVFFDSYHPTQRAYKVIVQYIFDHYMQLLQLRHCIIYIIIFSMHKNFHWCLFQY

SEQ ID NO: 134682 - protein, 168 aa, Triticum aestivum
  Clone ID: PAT_TA_29100.pep
MAAASSATSVHDFTVKDASGKDVDLSVYKGKVLLIVNVASQCGLTNSNYTELSQLYPKYKDQGFEILAFPCNQFGGQEPGTNDEIVQFACTRFKAEYPIFDKVDVNGSNVSPLYKFLKSSKGGLFGDSIKWNFSKFLVDKEGHVVDRYAPTTSPLSIEKDIKKLLGSS

SEQ ID NO: 134683 - protein, 209 aa, Triticum aestivum
  unsure (1)..(209): unsure at all Xaa locations
  Clone ID: PAT_TA_29101.pep
LLCPGDPRRSHRRRLRQLARRTPNLSTPPASSATSANSLSMECASGKTXLIVYKGKVLLILNVAVPSECDLTKSNYTELSLAVXKYEDQGXELLVFHIANHVWWARLVTTIDXEIVQFACTRFKXARVPHFFDKVDVXGNNVSPPRQNFLKSSKSGLFGDSIKWXNFSTSLVDKEGXALCDRYAPTTPPPXCIEKDIKKMLGKLLIPAC

SEQ ID NO: 134684 - protein, 141 aa, Triticum aestivum
  Clone ID: PAT_TA_29102.pep
VKLVFPIDFVTADKFAPDAKTGYATDADGIPDEWEGLDCGEQSSKLFREEILKSKTIVWNGPSGVFEFDAFAKGTKSVLEAVIEATKEGATTIIGGGDTATAALNWDAADKVSHISTGGGASLELLEGKELPGVTALSSKN

SEQ ID NO: 134685 - protein, 113 aa, Triticum aestivum
  Clone ID: PAT_TA_29103.pep
PPPRGNNRHAGVHVLGGEERHVADQGPSPLHVHRRSGKRRNGGDDRQAVLPWSRRLQDGVPSGDRLARLLHVSPWWKVRCLIWGQMRQTLKLTIMLPASFLRTSRCHLSCIYV

SEQ ID NO: 134686 - protein, 238 aa, Triticum aestivum
  Clone ID: PAT_TA_29104.pep
VRGRVGGRVGAVRVGAAAGYFQVLVIIAGLLPNPEIALDSLSVCMTIYGWVFMISVGFNAAASVRVSNELGAGNPKSAFFSVWVVTGLSATISTILAVVILCLRNHISYLFTDGEAVSDAVADLCPLLAVTLVLGGIQPVLTGVAVGCGWQQFVAYVNVGSYYVVGVPLGVVLGFFFNLGAKGIWGGLIGGTALQTAILLWVTIRTDWTKEVEEAQKRLNKWDEKKEPLLAGFKDNNK

SEQ ID NO: 134687 - protein, 192 aa, Triticum aestivum
  Clone ID: PAT_TA_29105.pep
MNAQQQMQQLQQLQQQQQQLQQQQQLQQQQLQQQQLQQQQLQQNPQQQQQHQQQQQQQQQQLQQQQQQQQQHQHQHQQQQQHQHQHQHQQQQQMGSPLQQAAQVGSPAGSQQSLVMQQQQISPQQMAAMSPQLSSGALQQVNNNVVNPVGTPGPPQSPQLSSHSQTQGSVSSIANSPMEQLQSANMGGPGSM

SEQ ID NO: 134688 - protein, 132 aa, Triticum aestivum
  Clone ID: PAT_TA_29106.pep
MAGGKMAAATAAKWAEGYPWKEKLAKYKGELSKGVWGYWELGAWKPLGISGRQRARLRKEVLLAGEDWTYDPPRGEMRTKRKGHKVDRIAAEKRANTVELMKKMPQMLLDYKKRRWDKKVEEGRTAAAAKAT

SEQ ID NO: 134689 - protein, 164 aa, Triticum aestivum
  Clone ID: PAT_TA_29107.pep
SQYLYHVPRCIRRSTGNVLTIFEEEGGRPDAIMILTVKRDNICSFISETNPGHVRSWETKDSQLTMVADDLKPRAVLTCPEKKMIQQVVFASYGNPLGICGNYTVGKCHTPKAKEIVEKACVGKRSCVLAVSHEVYGGDLNCPGTTATLAVQAKCSKRQRTAEQ

SEQ ID NO: 134690 - protein, 181 aa, Triticum aestivum
  Clone ID: PAT_TA_29108.pep
MALRVVFSNRIPLVRAMENLLAASSGSALRPAAVAGGVRGYNAGAPLRSYDRRRALAGSDGGAWSMASGRDVGVPSFFSDVFRDPFSAPQSLGRLLSMLDDVAAASPDGAARAAPLRRGWNAREDADARRLRVDMPGLGKEHVSRWAEPRTSSRSTWTRKNQDHAQVSRHGIAESSRVSRV

SEQ ID NO: 134691 - protein, 81 aa, Triticum aestivum
  unsure (1)..(81): unsure at all Xaa locations
  Clone ID: PAT_TA_29109.pep
LPCVGWKKMEEXEEEIFGKKGEIFIASDGFNYRPVCELICVYVVCDVLESFSPQPFPTVEESLIRRGEPSLHPLFHSVHAS

SEQ ID NO: 134692 - protein, 166 aa, Triticum aestivum
  Clone ID: PAT_TA_29110.pep
PHDDDTFQGPQISQLQFDRIMGYIDIGKKEGATCYMGGKRWGNEGYYVEPTVFTDVNENMTIVKEEIFGPVVTVSKFKDIDDVMHMALDTEYGLAAAVFTQNTARAVDVSNRLQAGTIWVNCYNELDYNTPFGGFRQSGIGRENGEYALDNYIQVKTVKINVNRKP

SEQ ID NO: 134693 - protein, 320 aa, Triticum aestivum
  unsure (1)..(320): unsure at all Xaa locations
  Clone ID: PAT_TA_29111.pep
MGEEGELAAEKHVRYIVTAEKKKDSFESLVMEHLRASGAYWGLTTLDLLHKLHGVVAAEVVDWIMSCYHPESGGFGGNVGHDPHVLYTLSAVQVLCLFDRLDVLDADKIADYITGLQNEDGSFSGDIWGEVDTRFSYISICTLSLLHRLHKINVDKAVEYIVSCKNLDGGFGAMPRRGSLMPGQIFCCVGALXITGSLHHIDRDLLGWWLCERQCRDGGLNGRPEKLADVCYSWWVLSSLIIIDRVHWIDKEKLAKFILNCQDKENGGISDRPDNAVDIYHTYFGVAGLSLMEYPGVKPIDPAYALPLDVVNRIFLTKQQ

SEQ ID NO: 134694 - protein, 202 aa, Triticum aestivum
  Clone ID: PAT_TA_29112.pep
ILTKADTRGPSPPIAAIARPSTDRRVIRGRRFPLGIVPRPVHGHRHAPSPRPPLEKPHSSTPPPSSLRSTCLSVTASAPRNSTHVPPPPRRRPLRWKPRRRRWVEDAAGSRSLLKVQLAAAGAGEGTPTSSPFVIELGTRHLHFVDCHGQEHIHTRRVIVTPMLMIVSFWYKILLVLTNEIKLSIGMPLGMTNCCWFMQLVE

SEQ ID NO: 134695 - protein, 130 aa, Triticum aestivum
  Clone ID: PAT_TA_29113.pep
MATITTMAFMATFPAPRTVAQPSATLPSRPDVVSFAARAMRAHGRRLVAVAGSPSTPPELAQKVTESIKQAEETCAGDPEGGECVAAWDEVEELSAAASHARDRKKEHSDPLEEFCEDNPETDECRTYDS

SEQ ID NO: 134696 - protein, 168 aa, Triticum aestivum
  unsure (1)..(168): unsure at all Xaa locations
  Clone ID: PAT_TA_29114.pep
PPARRRPPPPPLPRPRAGRPPPAPPPPRPSRPPPPALPRPTTAPPPSTPPSTRPSPPPLATTPGATNTSPPSSPRSRRPTPPXNPKNPKIRLXPMRPPWSRPSSPWLPSPPPPLPRPPPLPVATKAELVSSPYLCCICIRAYVNVAAAFLIDNQYQFLFFVSCTRDRD

SEQ ID NO: 134697 - protein, 162 aa, Triticum aestivum
  Clone ID: PAT_TA_29115.pep
GKELTALYSSFASKYPIVSIEDAFDQDDWEAWTHLNETSEFQLVGDDLLVTNPKRIATAIEKKSCNALLLKVNQIGTLTESIQAAKDSQAAGWGVMVSHRSGETEDTTIADLVVGLRTGQIKTGAPCRSERLAKYNQLLRIEEELGENCIYAGENFRNAHEL

SEQ ID NO: 134698 - protein, 271 aa, Triticum aestivum
  Clone ID: PAT_TA_29116.pep
VAEQMGVVGEKLAADFVISTGDNFYNDGLAGDNDTAFFMASFTDIYTASSLQKPWYIVLGNHDYTGDALAQQSPAIREVDSRWTSVNKSFIVEADIVDFFLVDTSPFVLKYWNESKFDWRNVAPRDTYIATLLQDLDDALAASNATWKVVVGHHPVSSGCEHGNTTELREHLLPLLKAHGVDMYLNGHDHCLQRISSIDSPVEFVTSGGGSKAWAGKFKATSDKMEFLYDGQGFLSMKLTATEAHLAFYDVSGAVLHSWGLTKSADARIIS

SEQ ID NO: 134699 - protein, 121 aa, Triticum aestivum
  Clone ID: PAT_TA_29117.pep
MASAVVCKGEGAAPASLLKSAAPVAFCPLRSPAVTAARCPYNTQVKEVSRYDDDNDDDRDLVIPSFFSQDVLDPLGAPTSMARLLSLMEDVATKTGGLSSTAGAGASRLGRWVAKEDDDAV

SEQ ID NO: 134700 - protein, 208 aa, Triticum aestivum
  Clone ID: PAT_TA_29118.pep
MASAVACKGKDIAPAGRLKSGAPLAFCAPDCPAVNAVRRPYNTQVKEVNRYDDDDYSDRDLVIPSSFSQDVLDPLGALTSMARLLSLMEDVAAQTGLSTAGASRLGRWVAKEDDDAVYLKVPMPGLTKEHVKVRADKNILVVEGEGEKQPWDGDDDSAVPRYNRRIEMPADAYKLDKIKAEMKNGVLWVTLLKVKEEERKDVFHVKVE

SEQ ID NO: 134701 - protein, 239 aa, Triticum aestivum
  unsure (1)..(239): unsure at all Xaa locations
  Clone ID: PAT_TA_29119.pep
QESKIITDHGNESKEEREKGEKTRERDRRGTAKAVATASAVASAAPGASRAAGPLAAAAPPASSAPHAPAVTRANDPDDNHGDDDTAVPGRLPRVLRDQLLEPLGAARALPLLEAVLYDTAGLSAGAGLGASRRGRWVARGDDDAEDLEVAMPGLTKEQVEVHAEKDSLVIKVEGEKEPGEGDADDSAVPEXNRTIGGPAADADKMDKIKAEMKNGVLWVTLLKVKEEERKDVFHVKVE

SEQ ID NO: 134702 - protein, 119 aa, Triticum aestivum
  Clone ID: PAT_TA_29120.pep
MAETAAIAPPPQPMAPPQPVEENATAAPSQPMAPPQPMAENATAAPPQPMAESATVVVVVPPPPPDGTTTFLCLILAFFIPPLGVFLKYKCEIEFWICLILTFLAYAPGIIQAVRVIVK

SEQ ID NO: 134703 - protein, 125 aa, Triticum aestivum
  Clone ID: PAT_TA_29121.pep
MAETAVIAPPPQPMAPPQPVEENATAAPSQPMAPLQPMAESATAAPPPPNATQQPMVENATVVVVVPPPPPDGTTTFLCLILAFFIPPLGVFLKYKCEIEFWICLILTFLAYAPGIIYAVWVIVK

SEQ ID NO: 134704 - protein, 199 aa, Triticum aestivum
  Clone ID: PAT_TA_29122.pep
KSVTLELPLALHILEAVISENKYIASNDKATEADVTVAKALGSAPAAEFTNLNKWFSEVKPAEAAPAAEAADEDDIDLFGSDEEEDAEAERIKAERVAEYNARKANKPKTIAKTTITLEIKPWDDETDMEAMTKAVKDIAMDGLLWGGHQLVPIGYGIRKLQINCVVEDDKVLLDDLTDQITELEDYVQSVDIAAMQKI

SEQ ID NO: 134705 - protein, 209 aa, Triticum aestivum
  Clone ID: PAT_TA_29123.pep
PRVRSFTLEAPLAYKILDSYFENVSYVKGVELSEADVSVFNALTEGVSAEAYPHLARWYSHIAAVKGLATKEAAAPAAAAEEEEDIDLFGSDEEEDAEAERIKAQRVAEYNAKKANKPKTIAKTTITLEIKPWDDETDMDAMTKEVKDIAMDGLLWGGHQLVPIGYGIRKLQINCVVEDDKVLLDDLTDKITELEDYVQSVDIAAMQKI

SEQ ID NO: 134706 - protein, 299 aa, Triticum aestivum
  unsure (1)..(299): unsure at all Xaa locations
  Clone ID: PAT_TA_29124.pep
RNSDEGEFRRWRYQPRPHRHLVSLVGYXISEDHRLLVYDFVANDTMHHNLHGRGRPVMDWPTRVKIAAGSARGLAYLHEDCHPRIIHRDIKSSNILLDDNFEAQVADFGLARLAENDVTHVSTRVMGTFGYLAPEYASTGKLTEKSDVFSFGVVLLELITGRKPVDSSRPLGDESLVEWSRPLLNRAIDEQEFEELVDPRLDGNYDDVEMFRVIEAAAACIRHSAARRPKMGQVVRILDSLTLNDVDLTNGVRPGKSQMFNAANTADIRQFQRMAFGSQDFSSSEYTQSKASLSGRRDL

SEQ ID NO: 134707 - protein, 210 aa, Triticum aestivum
  Clone ID: PAT_TA_29125.pep
PASAHASAIMQYNGGSVVAMVGKDCVAIAADKRLGAQFMTVSTDFQKIFKATDKTFIGLPGLATDVLTLADRFRFKTNMYKMREEREIEPKTLAHMVSSTLYERRFGPYFVEPVVAGLGKDNKPFICAMDLIGCINFAKDFVVSGTAGPNLYGMCESLWEPDLEPEDLFETISQALLNAQDRDALSGWGAVVYVITPTEVTVRSLKARQD

SEQ ID NO: 134708 - protein, 371 aa, Triticum aestivum
  unsure (1)..(371): unsure at all Xaa locations
  Clone ID: PAT_TA_29126.pep
MAAQAPAIEVPTDAELLQAQADLWRHTLYYLTSMGLRCAVKLGIPTAMHKLGGVTSLPDLAAALSIPASKQPFLGRLMRALVTSGVFAAGGKDDSGAELFRLNPLSRVLVDDVVADEHHSQTSFVLAGTSPHYMEAALGMADWFKKDVTGPVPSVFEDVHSASLFDETTAALDPELDALVTEGLEAHDNLGIGTIMRECHDLFKGLESLTDCCGGDGKTARAITKAHPHVKCTVLDLPKVIQKTPSDCVVNYVAGDLFHTVPKAQAVMLKLVLHHWSDDDCVKILTQCKNAIPSREARXGTVIVIDIVXSEPSLGPVMFEAQTLMDLLMLVFTRGRQRSENDWRELFMKAGFTDYKIIKKLGARGVIEVYK

SEQ ID NO: 134709 - protein, 164 aa, Triticum aestivum
  Clone ID: PAT_TA_29127.pep
GPDIRVDTDCDFLEQENIMDYSLLVGVHFRDKRVIMTEGSFDSDSSRGSSPHLSPHLSRGDTDPNRLSKIKLGSNMPTKAGLTIRKSDCEPQLIGEPTGELYDVILYFGIIDILQDYDISKKLEHAYKSFQYDPTSISAVDPKLYSRRFKDFVYKAFQEDKVDI

SEQ ID NO: 134710 - protein, 156 aa, Triticum aestivum
  Clone ID: PAT_TA_29128.pep
GSTGCAFWARLLRTVGVKVGGNPNVYASLLGVLWSSVANRWHLEMPDIIDGSISIMSRTGLGIGMFNTGLFIGLQDKLVVCRPGLTALGMAMRFVAAPAATAVGALLLGLRGDLLRVAILQAALPQSVGAFIFALEYDLHADVLSTVVIVGTLASL

SEQ ID NO: 134711 - protein, 259 aa, Triticum aestivum
  Clone ID: PAT_TA_29129.pep
MHPYPLKGSKGASLPPRPTLVFLIALFGLYVCYLSFNQIRMESKHVEENGAQEQDEHVCTRPYVPSEELPYVHFPKPKGYSRAECSCNPVRFFVIVSMQRSGSGWFETLLNSHPNISSNGEIFNRVDRRREVAAEVQTLDKLYDLDWLTSAAKNECTAAFGFKWMLNQGFMDHHDDILSYLNKKGVSVIFLFRRNTLRRLISVLANNYDRDAKQLNGTHKSHVHSEEEAEILAKFKPELDVSTLVSNIRDVEKYLPGRP

SEQ ID NO: 134712 - protein, 117 aa, Triticum aestivum
  Clone ID: PAT_TA_29130.pep
PKNCPPCTNTHRHQSLRFIPFHNLMVQKNQSSGDSRCTDHRHSASFERAQAIDLDPAAELLARHITESVSSSMRAHAVTVDQLSTSCQCLARSGGVRISVSSRLLTCFNVPTRSTAS

SEQ ID NO: 134713 - protein, 157 aa, Triticum aestivum
  Clone ID: PAT_TA_29131.pep
ATQKTVDGPSNKDWRGGRGAGANIIPSSTGAAKAVGKVIPELNGKLTGMAFRVPTPDVSVVDLTVRLEKGASYDQIKEAVKKASENELKGILEYTEDAVVSTDFVGSAASSVFDASAGIALNSNFVKLVSWYDNEMGYSNRVVDLLIHAAKVDGRLA

SEQ ID NO: 134714 - protein, 145 aa, Triticum aestivum
  Clone ID: PAT_TA_29132.pep
IDIPIGSGSGYLTACFAMMVGPEGRAVGIEHIPELVVASTENVERSAAAALMKDGSLSFHVSDGRLGWPDAAPYDAIHVGAAAPEIPRPLLEQLKPGGRMVIPVGTYSQDLQVIDKSSDGSTSVRNDASVRYVPLTSRSAQLQDS

SEQ ID NO: 134715 - protein, 111 aa, Triticum aestivum
  Clone ID: PAT_TA_29133.pep
GAKKEGGDGGDAKKEGDGKKDGDGKKDGDKKEEGDGKKDDQKKPAAVAPLPYPHHMPLPHHMPPPYMFNADYMMNQYRPAPPAYPPPYVPPQHYYVRNMSMEENPNSCVIC

SEQ ID NO: 134716 - protein, 268 aa, Triticum aestivum
  unsure (1)..(268): unsure at all Xaa locations
  Clone ID: PAT_TA_29134.pep
RATLTSPPRRHAPPSHPSSPAVAAPPGRPLRPTTPTHPPSPSRARPYRPSPTQPLYLRSAVHLHSPGRSAKRIAVQLELQDNREKHKARRTVSVLVGMDAISMDLASRQMASGPHRVRRPPEAAGREGGEGWAAYIESVGPAKEPGKKEETAEEAKKESGAGAKKEGGDSGDAEKEGEGEKERDGATRKEGAKEGGXQKKPAAVDPLPFADHMPLPHHMPPPYMFNADYMMNQYRPAPPAYPPPPVPPQHYYVRNMSMEENPNSCVIC

SEQ ID NO: 134717 - protein, 178 aa, Triticum aestivum
  unsure (1)..(178): unsure at all Xaa locations
  Clone ID: PAT_TA_29135.pep
MGCFGCFAPAARRGAGDLKPSKLAHHXTDDDSVADAQRKVAPDXGRGCPHSFTFKDLLVATGYFNEANFIGEGGFGKVYKGKISKTNSQGASDAQMVAGTRLARESVQGRKEFLVEVLMLTVLSHPNLVSLVGFCAQGDERLLVYEYMPFGSLESHLFDVPHGKPPLDWNTRVKIAVG

SEQ ID NO: 134718 - protein, 213 aa, Triticum aestivum
  Clone ID: PAT_TA_29136.pep
TLAVSSVPDTIPPRAQVQIPVEVTNLRASRDVAVLDFSYKHGAALVNAKLRLPIVLHKFLQPITLSPEDFFAHWKTWNVQSLKVQEVVRGVKPLPIPEMASLLLSLHLADTPGLDTDPNNMVACATFFSGTTNSALGLVRVETDPQDRSQLRLTVASGDQNLTFELKEYIRGQLIDISRARVAPPPAPRQPQPLPAAPATPHRHTRAAGGGYP

SEQ ID NO: 134719 - protein, 405 aa, Triticum aestivum
  unsure (1)..(405): unsure at all Xaa locations
  Clone ID: PAT_TA_29137.pep
MPDLLGDSIGDDLVSIMAAVETDNPDLRDRAYIYWRLLSTDPEAAKDVVLAEKPVISDDSNQLDSSLLDELLANISTLSSVYHKPPEAFVSRVKAAPRVDDEXFADAGETGYSESPSQGLDGASPSSSTGNSSNVPVKQPAAAAPAVAAPIPDLLGDLMGXDNALVLVDEPTASSXLHCLVAGIEVLPADKPVISDDSXPDGLLYYDISFENGTQGVLDGFMIQFNKNTFGLAAGGPLQVPPLQPGSSARTLLAMVFSQNVSPAAPNLLLQVAVKNNQQPVWYFSDKGSLHVFFGEDGKMERTGFLEAWKSLPDDNEFSKEYPNSVISSIDATVEHLAASNVFFIAKRKNANMDVLYLSAKIPRGIPFLIELTAAVGVPGAKCAVKTPNREFVPLFFEAMESLIK

SEQ ID NO: 134720 - protein, 199 aa, Triticum aestivum
  Clone ID: PAT_TA_29138.pep
GRVGEDEKGIVVRFIVGRSANRGDRFDREIDDENRSTNDFVILDDHIESDEELPKKTKRYFANAAETFDAEFYAKVNDDIYINVDTLSAMLETHWDKPRVYIGCMKSGEVFSEATHKWYEPDWWKFGDGKSYFRHASGEMFVVSRAVAQFISINRSVLRTYAHDDVSVGSWMIGLAVKHVNEAKLCCSSWPSGAMCSAL

SEQ ID NO: 134721 - protein, 328 aa, Triticum aestivum
  Clone ID: PAT_TA_29139.pep
RHWFYCINNKERSCLETGEVLIRVAASGICGTDLHICKGETPQATKNVVVGHEFCGYVEEIHPETMAVVKVGDLVAIDPNMPCNQCTFCRNKKYHLCLNLFCIGVTVDGGMSQYVAVPARAAITVPAHVPPEVACLSEPLSCVVHAVDKGHVKSGDSVLVIGAGPIGLMTTALVNASGGKVTVIEPNEFRRKEALEIFGAAAAYGPGELGPVNGALGEGYDVVFECVGRPNTADDAVKFAKAGGTVVWVGVAKVEDRVSISPYDVYRRELTITSTFTNPYGIDRAVKILAEGRVNWRALVSHSFKLSEFDKAWEVFTAGTGLKVVVKP

SEQ ID NO: 134722 - protein, 144 aa, Triticum aestivum
  Clone ID: PAT_TA_29140.pep
DADRRLEEIRRKTEVESQCYKDDLRRLQDQLSRLQKSMGANAPTVPSAYPPAMTDRNTARAPKQPNQKAPPASNRQQEPIQNTGRRRGCIICKREEACVMLLQCAHQVLCVGCNKQHEEKGAVRCPSCNAKIEERIRVFGASSN

SEQ ID NO: 134723 - protein, 155 aa, Triticum aestivum
  Clone ID: PAT_TA_29141.pep
SADAWADAWADAWVAFNREVLGPVMFPGLRIRKEGKHRWDTLEDIWNGLCAKVVCDSLGYGVKTGLPYVMRSDAEAGKALESLKEWEGVKVMDDVLPFFESLKLSRTAVTVDDCVKELAGVVRQKLAPKNAIFAKAADAMEEWTKLWKSHGAQNA

SEQ ID NO: 134724 - protein, 348 aa, Triticum aestivum
  Clone ID: PAT_TA_29142.pep
MSLEVHDSEVDIVIAALQPNLTSFFQAWQPFFSRFDIIVVKDPELTADLQIPSGFNVKVYTKSDIDGLLGATSINFSGHSCRYFGYLVSRKKYVISIDDNCLPAKDPAGMTVDAVTQHMINLKTPATPFFFNTLYDPYRKGADFVRGYPFSLREGVECMLSCGLWLHNADYDPMTHVVKRNQRNTNYVDAVMTVPLGAMFPVSGINVAFNREVLGPVMFPGLRIRKEGKHRWDTLEDIWNGLCAKVVCDSLGYGVKTGLPYVMRSDAEAGKALESLKEWEGVKVMDDVLPFFESLKLSRTAVTVDDCIKELAGVVRQKLAPKNAIFAKAADAMEEWTKLWKSHGAQNA

SEQ ID NO: 134725 - protein, 170 aa, Triticum aestivum
  Clone ID: PAT_TA_29143.pep
MRPGAEYPMAHGPAAAPRSTWQTPVPYLFGGLATMLALIALSLLTLACSYWKLSGGLAGPDEDQPPGSDGEKGSAAGPAREWLGHVVVIMAGDEQPSFLATPASMTSSAADGGAETAAGAAACCAACRSEERKMEDAREAGAQPAGSEDDARPASPSELPSSSTSSVISS

SEQ ID NO: 134726 - protein, 285 aa, Triticum aestivum
  Clone ID: PAT_TA_29144.pep
SNPHSEKAHQALSELKQLASTTDGWNLTQEKEGVKLYNKTVDGNPIPIVRGDIVLEGDYTVQQVLTVCTLPGCRKIWDDKFDASEVKAWYSRYETLFWTKLKAPWPISPRDIAGTSLREFSEDEGYIVMISVTDPAVPVMSGNVRANLMVSGWKVTKTSTGAISLIYITQIDLAGSLPLSFLKAVQQQVPLCARKVVDYIKDHGYPPLLISSTAQFKEESFDHAKGLYEVHLEGEGEAKWSISGKMYPGGFRAELVGTGTCEAVSVHELVVKGISGPVTVKILKK

SEQ ID NO: 134727 - protein, 237 aa, Triticum aestivum
  Clone ID: PAT_TA_29145.pep
RRERERERERERERERERERGRVILTSSDAGVSRRPLQGGGHLLDEGSWSDVEYLRANKPPTWEYAVSKVLLEKAASKFAEENGISLVTVLPVFTLGAAPVSKARTSVPVTLSLLSGDETQLNIMIGLQSVTDSVSICHVDDLCRAQVFVAENKSSVGRYICCSHNTTVVQLARLLAEKYPQYNVKLERFAGSQEKPRACLSSQKLIGEGFEFKHDDLSEIFDDLVEYGKTTGILPY

SEQ ID NO: 134728 - protein, 60 aa, Triticum aestivum
  unsure (1)..(60): unsure at all Xaa locations
  Clone ID: PAT_TA_29146.pep
IVTLGTSRRYNNSQAILVVYSYSLLSCERTFEPISPGEPTAYISRPRKTHASADAGRXRE

SEQ ID NO: 134729 - protein, 322 aa, Triticum aestivum
  Clone ID: PAT_TA_29147.pep
MKTKCWEWQPDACDLPRFDAKLLLEKLRNKRMMFVGDSLNRNQWESMVCLVQSVAPWDKKKLVKNGSLNVFRLNEYNATIEFYWAPFLVESNSDDPDIHSITDRMITPTSIAKHAANWIGVDYLIFNTYIWWMNTPKMKIVPDGSFTRKPVKYDELDRVVAYRQILETWSGWVEENVDPKRTMVLFMSVSPVHMQSEGWGSPDNIKCFSETQPVLNYTKTLDVGTDWDLFTESHEVTKAMKKVPVHFINITALSEIRKDAHTSVHTLRQGKLLTKEQQANPRKFADCIHWCLPGLPDTWNEFIYGHIVSSPLQRQIENQSAR

SEQ ID NO: 134730 - protein, 152 aa, Triticum aestivum
  unsure (1)..(152): unsure at all Xaa locations
  Clone ID: PAT_TA_29148.pep
PDLEXAASSKWLPLHTLAASGDFYLLDNLLKHKVDVNALDKDGLPAIHKAIISKKHAIINYLLRNSANPSVYDRDGATLMHYAVQTACNQPIKGLEGRREASRRPDGNGRPAGHEAGPTRRPDLERPDIQAGWLDSTGGGRPAGSKPPEVYY

SEQ ID NO: 134731 - protein, 152 aa, Triticum aestivum
  Clone ID: PAT_TA_29149.pep
PRSRALVKAYPHIKCTVLDLPKVIDKAPTDGVINYIAGDLFHTVPPSQAVMLKLVLHFWSDEDCVKILAQCRKAIPPREEGGKVIIIEIVVGPSLGPVMFEAQLLMDMLMMVNTRGGQRDENHWSELFKKAGFTDYKIVKKLGARSVIEVYP

SEQ ID NO: 134732 - protein, 225 aa, Triticum aestivum
  Clone ID: PAT_TA_29150.pep
RSSLRQRDDFPSKSRADGGIDFPAGGAVAESDSDEEDQIQVNGKAPSIGSRCSVKKLHDLISSFDEEKRQYVAEMEFGGLLELPKITRTDRHFLMSILSHIDEEASSITIDHKRDMQFFDEDVKLVIGIPCGTAPVRPPDHAVPEAVVTQIREMFGIGPGEHSILPIVEAVKQTYGRPMTTHEKNRFKVGLVICACTYLLAPTMKNDYFCTDYWGALATAELIHM

SEQ ID NO: 134733 - protein, 109 aa, Triticum aestivum
  Clone ID: PAT_TA_29151.pep
PTRVTRPPTRAAHASVEGAIMYPTITSRTQKVELAKDDVDGIQSLYGGNPNFKGVTPPATSSEETHSAAPSALFGPWSGLRGHGGCARTSSVVLCSWVDRFTTIFFNLF

SEQ ID NO: 134734 - protein, 368 aa, Triticum aestivum
  Clone ID: PAT_TA_29152.pep
MASIRRSVSPLLALLAAAATVLAALSPASARSLPEGLPDIKPLLSNPWSAFQNLSGCQFGDERQGLARLKDYLSRFGYLPAPPAKFNDMFDADMESAIRTYQQNFGLEVTGQLDAATVTKMMSPRCGVADIINGTSAMGKTVHGRNLYSYFPGSPSWPRSKKSLRYAITAATETTIDRATLSKVFASAFARWSAATTLNFTETASAYDADITIGFHAGAHGDGEAFDGPLGTLAHAFSPTDGRFHLDASEAWVAGGDVSRAALDAAVDLESVAVHEIGHLLGLGHSSVQGAIMYPTIRTGTRKVDLEADDVQGIQSMYGTNPNFKGVAPTSPSTSSREMDSSAGAGSRPGGRFVAVVVAVGLLLLLSL

SEQ ID NO: 134735 - protein, 56 aa, Triticum aestivum
  Clone ID: PAT_TA_29153.pep
MGHSNVWNSHPKNYGPGSRVCRVCANPHGLIRKYGLMCCRQCFRSNAKDIGFIKYR

SEQ ID NO: 134736 - protein, 71 aa, Triticum aestivum
  Clone ID: PAT_TA_29154.pep
MGHSNVWNSHPKNYGPGSRVCRVCGNSHGLIRKYGLMCCRQCFRSNAKDIGFIKVCDATLSMDFLNLMAAE

SEQ ID NO: 134737 - protein, 340 aa, Triticum aestivum
  Clone ID: PAT_TA_29155.pep
MSQYPHILLRAEEKPLEHRSFSPSIIKTLVDAGYPVSVERSSTDPKFKRIFEDSEYEAAGARLVNEGTWPNAEAGTLILGLKEIPEEDFPLKNDHISFAHCYKNQGGWEKVLGRFPQGGSVLYDLEFLVDEQGRRVSAFGFHAGFAGAALGIKTLAHQLQDPSSKLPSVETFTDGRGYYLNEEELVNQIREDLAKAEKSLGRKPTALVLGALGRCGKGAVDLFLKAGMPDENITRWDLNETKDRDGPYEEIAQADVFLNAIYLSKPIPPFINEELLAKSGRNLAVVIDVSCDSTNPHQAIPIYSINNTFHEPTAPVEIENEQNSLPLSAIMIDHPPLNDA

SEQ ID NO: 134738 - protein, 151 aa, Triticum aestivum
  Clone ID: PAT_TA_29156.pep
RSTGPKTQETYLPSKMLHFWCKTVKDELNNLRGDGTTRKYEEWDRVYRYNYNNDLGEPDKGYPRPVLGGTQELPYPRRCRTSRPPTKTGESSAVYMFVLFHMLTTMSPCNWTHIGDLIFLPDPRSKRRIPHYKIQEALDITVPRDGIYASS

SEQ ID NO: 134739 - protein, 139 aa, Triticum aestivum
  unsure (1)..(139): unsure at all Xaa locations
  Clone ID: PAT_TA_29157.pep
MNDLRLRASYLRYDLKTVISSKTTKEEKKDLKDLTGKLFATLDGLDHAAKIKSPTEAEKYLEKSKLNKELNDKKRAATSGANLARAYTVQFXSCKFPYNFTGCXDLAKQKKVPFITDDLEIECEGXEKFKCGSNVFWKW

SEQ ID NO: 134740 - protein, 67 aa, Triticum aestivum
  Clone ID: PAT_TA_29158.pep
MGHSNVWNSHPKNYGPGSRVCRVCGNSHGLIRKYGLMCCRQCFRSNAKDIGFIKVYNKNIIVAPGTI

SEQ ID NO: 134741 - protein, 85 aa, Triticum aestivum
  unsure (1)..(85): unsure at all Xaa locations
  Clone ID: PAT_TA_29159.pep
XCXQXLALXGTXLEHISPYFXSVLGVSTTRFPNYKLGSVXSLVSILVHHITSVIDCTPDKPSNPCISVCYRTAPEECLLSNQIXF

SEQ ID NO: 134742 - protein, 83 aa, Triticum aestivum
  Clone ID: PAT_TA_29160.pep
RGRGRGPKDEDDSGGEEEEGEEHEKALCGACNDNYGQDEFWICCDACETWFHGKCVKITPAKAEHIKHYKCPNCSSSSKRARA

SEQ ID NO: 134743 - protein, 190 aa, Triticum aestivum
  Clone ID: PAT_TA_29161.pep
MHRAGWMRVRNAFKPAAVRRQSTKASVGDGGAKAGICDGGGGEAGNGSGESTEGPPVVIPVTLAGIAMWTWQKQSEISSRTRRTQRRGWLGTLLPLPFHRRRSPSRHGTLERLELAPQELRPRIQGLPCLRQLAWPDPQVRADVLQAVLPQQRQGHRLHQVPLRMETSKEARARKLSTNCGASSSLIFIL

SEQ ID NO: 134744 - protein, 75 aa, Triticum aestivum
  Clone ID: PAT_TA_29162.pep
ARDQELNDKKRAATSGANFARAYTVQFGSCKFPYNFTGCQDLAKQKKVPFITDDLEIECEGKEKFKCGSNVFWKW

SEQ ID NO: 134745 - protein, 196 aa, Triticum aestivum
  Clone ID: PAT_TA_29163.pep
VLGIALIVTVIQIVRIPNLKVGSVLLGCSFLYDIFWVFISKMLFHESVMIVVARGDNTDEDGVPMLLKIPRMFDPWGGYSIIGFGDILLPGLLVAFALRYDWAARKTLQSGYFLWSMVAYGSGLLITYVALNLMDGHGQPALLYIVPFTLGTFISLGKKRGELRNLWMKGQPPRVCTHSHPPPKDSADSAAHVISS

SEQ ID NO: 134746 - protein, 91 aa, Triticum aestivum
  Clone ID: PAT_TA_29164.pep
VLVIGYIEFQRNAERRLYPGGSYFDPLGLAADPEKKETLQLAEIKHARLAMVAFLGFAVQAAATGKGPLNNWATHLSDPLHTTIFDTLGSS

SEQ ID NO: 134747 - protein, 253 aa, Triticum aestivum
  unsure (1)..(253): unsure at all Xaa locations
  Clone ID: PAT_TA_29165.pep
MGRKFFVGGNWKCNGTTDQVEKIVKTLNEGQVPPSDVVEVVVSPPYVFLPVVKSQLRQEFHVAAQNCWVKKGGAFTGEVSXRCSVNLGVPWSFLGHSERRALLGESNEFVGDKVAYALSQGLKVIACVGETLEQREAGSTMEVVAAQTKAIAEKISDWSNVVVAYEPVWAIGTGKVATPAQAQEVHXSLRDWLKINVSPEVAESTRIIYGGSVTAANCKELGAQPDVDGFLVGGASLKPEFIDIINAATVKSA

SEQ ID NO: 134748 - protein, 43 aa, Triticum aestivum
  Clone ID: PAT_TA_29166.pep
ALLERAPEKAFILTITNQFQALVGISLMEILSKHSSDAVYMMA

SEQ ID NO: 134749 - protein, 255 aa, Triticum aestivum
  unsure (1)..(255): unsure at all Xaa locations
  Clone ID: PAT_TA_29167.pep
AWRDPSSPHKVRLLLEDYPYAVDGLAIWTAIEQWVTEYLAIYYTSDSVLQSDVELQAWWKEVREVGHGDLXKDAAWWPKMKTVAELVKACATIIWTGSALHAAVNFGQYPYAGYHPNKPSASRRPMPEPDTEEYALLARDPEKVFIRTITNQMQAIIGISLLEILSKHSSDEIYLGQRDTPEWTSDAKALEAFKRFGTRLEGIESQVVALNGNPQLKNRNGPAQFPYMLLYPNTSDHTGKAEGLTARGIPNSISI

SEQ ID NO: 134750 - protein, 342 aa, Triticum aestivum
  Clone ID: PAT_TA_29168.pep
RPRTRGSAWSAREALIEQEKLLKDGHESSVNIEAEGSTGMVDITMTSAMLFIVVASLFLVMLYKLMSHWFVELLVVIFCIGGVEGLQTCLVALLSRWFKPAARSFVKVPFFGAVSYLTLAVCPFCIGFAVLWAVYRRMPYAWIGQDVLGIALIVTVIQIVRIPNLKVGSVLLGCSFLYDIFWVFISKMLFHESVMIVVARGDNTDEDGVPMLLKIPRMFDPWGGYSIIGFGDILLPGLLVAFALRYDWAARKTLQSGYFLWSMVAYGSGLLITYVALNLMDGHGQPALLYIVPFTLGTFISLGKKRGELRNLWMKGQPPRVCTHSHHPLKDSADSASHVISS

SEQ ID NO: 134751 - protein, 214 aa, Triticum aestivum
  unsure (1)..(214): unsure at all Xaa locations
  Clone ID: PAT_TA_29169.pep
DGVLRADKXELEEWWKEVREVGHGDLKDADWWPNMVTVHELAKTCTTIIWVASALHAAVNFGQYPYAGYLPNRPTVSRRKMPEEGEEEYKQLQKGGKEADKVFIHTITSQFQTILGITLIEILSKHSSDEVYLGQRDTPEWTSDAKALEAFKRFGTRLMEIEKRILDMNKDPALKNRNGPVKMPYMLLYPNTSDAGGEKGLGLTAMGIPNSVSI

SEQ ID NO: 134752 - protein, 306 aa, Triticum aestivum
  unsure (1)..(306): unsure at all Xaa locations
  Clone ID: PAT_TA_29170.pep
RNSARGLLVAPAGYRADRLPRKYAMEMSSVTYKDWNFNEQALPDDLIKRGMAVRDPSSPHKVRLLLEDYPYAVDGLAIWTAIEQWVTEYLAIYYTSDSVLQSDVELQAWWKEVREVGHGDLKDAAWWPKMKTVAELVKACATIIWTGSALHAAVNFGQYPXTQGYHPNKPSASRRPMPEPDSEEYSLLARDPEKVFIRTITNQMQAIIGISLLEILSKHSSDEIYLGQRDTPEWTSDAKALEAFKRFGMRLEGIESQVVALNGNPQLKNRNGPAQFPYMLLYPNTSDHTGEAEGLTARGIPNSISI

SEQ ID NO: 134753 - protein, 125 aa, Triticum aestivum
  Clone ID: PAT_TA_29171.pep
TIYEVVTGTAKKQVKEKHPKSSSKISKSGTKPSRQPEPNSRGPKMPPPPKDEDDSGGEEEEGEEHEKALCGACNDNYGQDEFWICCDACETWFHGKCVKITPAKAEHIKHYKCPNCSSSSKRARA

SEQ ID NO: 134754 - protein, 138 aa, Triticum aestivum
  unsure (1)..(138): unsure at all Xaa locations
  Clone ID: PAT_TA_29172.pep
FGCVCSAGTDNSDEARDFDLPLKNRFYLQPLPPAEAAVRAKESAQDILNLKPLIDKKQWPYVMNDLRLRASYLRYDLKTVISSKTTKEEKKDLKDLTGKLFATLDGLTMQPRXKSPTEAEKYYGETKTVLGDVLAKLG

SEQ ID NO: 134755 - protein, 191 aa, Triticum aestivum
  Clone ID: PAT_TA_29173.pep
DVGHGDLKDAAWWPEMKTVAELVKACTTIIWTGSALHAAVNFGQYPYAGYHPNKPSASRRPMPEPGTEEYAMLAREPEKVFIHTITNQVQAIIGISLLEILSKHSSDEIYLGQRDTPEWTSDAKALEAFKRFGTRLEGIESEVVALNGNPQLKNRNGPVKFSYMLLYPNTSDHNGDATGLTARGIPNSISI

SEQ ID NO: 134756 - protein, 56 aa, Triticum aestivum
  Clone ID: PAT_TA_29174.pep
MGHSNVWNSHPKNYGPGSRVCRVCGNSHGLIRKYGLMCCRQCFRSNAKDIGFIKYR

SEQ ID NO: 134757 - protein, 259 aa, Triticum aestivum
  unsure (1)..(259): unsure at all Xaa locations
  Clone ID: PAT_TA_29175.pep
MGRKFFVGGNWKCNGTVEQVESIVNTLNAGQIASTDVVEVVVSPPYVFLPTVKGXKLRPEIQVAAQNCWVKKGGXAFTGEVSAEMLVNLGXVPWVILGHSERRSLMGXKSSEFVGEKVAYALAQGLXKVIACVGETLEQREAGSTMAVVAEQTKAIADKIKDWTNVVVAYEPVWAIGTGKVATPAQAQEVHANLRDWLKTNVSPEVAESTRIIYGGSVTGAXSCKELAAQPDVDGFLVGGASLKPEFIDIINAATVKSA

SEQ ID NO: 134758 - protein, 113 aa, Triticum aestivum
  Clone ID: PAT_TA_29176.pep
GPYIHTITIQIQTIIGISLLEVLSKHSSDELYLGQRDTPEWTSDPKALEVFKRFSERLVEIESKVVGMNHDPQLLNRNGPAKLPYMLLYPNTSDHKGAAAGLTAKGIPNSISI

SEQ ID NO: 134759 - protein, 183 aa, Triticum aestivum
  unsure (1)..(183): unsure at all Xaa locations
  Clone ID: PAT_TA_29177.pep
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILXGHSERRSLMGESSEFVGEKVAYALAQGLKALHVLGETPEQREXGSTMAVSLNRXKTIAGQXKDWTMWLSPTTMWANPVNPVKPRIHAI

SEQ ID NO: 134760 - protein, 97 aa, Triticum aestivum
  unsure (1)..(97): unsure at all Xaa locations
  Clone ID: PAT_TA_29178.pep
MGRKFFVGGNWKCNGTVEQVESIVNTLNAGQIASTDVVEVVVNPPYVXPPTVQGKLAPKIQVVAQNCWGEEGRAFTGEISGXKAGHPGVPVVILGHF

SEQ ID NO: 134761 - protein, 277 aa, Triticum aestivum
  unsure (1)..(277): unsure at all Xaa locations
  Clone ID: PAT_TA_29179.pep
VIYKDWNFTEQALPDDLIKRGMAVADPSSPYKVRLLVEDYPYASDGLAIWHAIEQWVTEYLAVYYPNDGVLRADVELQAWWKEAREVGHADLKDAPWWPKMQTVAELVKACTTIIWIASALHAAVNFGQYPYAGYLPNRPSVSRKPMPAPGSDEYAELERKPEKVFVRTITSQFQALVGISLLEILSSHSSDEVYLGQRDTKEWTSDAKAQEAFKRFGARLTEIEKRVVTMNADPRLKNRNGPXAEFPYTLLYPNTSDTKGDAAGITAKGIPNSISI

SEQ ID NO: 134762 - protein, 335 aa, Triticum aestivum
  Clone ID: PAT_TA_29180.pep
FVISTNRQLSVTHPVHKLLSPHYRDTMTINALARQTLINAGGIFEMTVFPGKFALGMSSVVYKDWKFTEQGLPDDLIKRGMAVEDPSSPYKVRLLVSDYPYAADGLAIWHAIEQYVSEYLAIYYPNDGVVQGDVELQAWWKEVREVGHGDLKVAPWWPRMQAVGELAKACTTIIWIGSALHAAVNFGQYPYAGFLPNRPTVSRRRMPEPGTEQYAELERDPERAFIHTITSQIQTIIGISLLEVLSKHSSDELYLGQRDTPEWTSDPKALEVFKRFSERLVEIESKVVGMNHDPQLLNRNGPAKFPYMLLYPNTSDHKGAAAGLTAKGIPNSISI

SEQ ID NO: 134763 - protein, 473 aa, Triticum aestivum
  Clone ID: PAT_TA_29181.pep
VDPRVRANRTGLLIADPFDCCTPLKEKVAGEVLLVQRGDCKFTTKAKVAEDAGASAIIILNNRHELYKMVCDQNETDLDINIPAVLLPKDAGTILQGLLSLGKVSVQLYSPDRPLVDTAEVFLWLMAVGTILGASYWSAWSAREALIEQEKLLKDGHESSVNIEAEGSSGMVDITMTSAMLFIVVASLFLVMLYKLMSHWFVELLVVIFCIGGVEGLQTCLVALLSRWFKPAARSFVKVPFFGAVSYLTLAVCPFCIVSAVLWAVYRRMPYAWIGQDVLGIALIVTVIQIVRIPNLKVGSVLLGCSFLYDIFWVFISKMLFHESVMIVVARGDNTDEDGVPMLLKIPRMFDPWGGYSIIGFGDILLPGLLVAFALRYDWAARKTLQSGYFLWSMVAYGSGLLITYVALNLMDGHGQPALLYIVPFTLGTFISLGKKRGELRNLWMKGQPPRVCTHSHHPLKDSADSASHVISS

SEQ ID NO: 134764 - protein, 145 aa, Triticum aestivum
  Clone ID: PAT_TA_29182.pep
MAGVNTSVVGLKPAAAVPQSASPAAAKRVQVAPAKDRRSALLGLAAVFAVTAATAGSARASVFDEYLEKSKLNKELNDKKRAATSGANFARAYTVQFGSCKFPYNFTGCQDLAKQKKVPFITDDLEIECEGKEKFKCGSNVFWKW

SEQ ID NO: 134765 - protein, 178 aa, Triticum aestivum
  Clone ID: PAT_TA_29183.pep
LRKTTEGDEKDWLSLVAVHSDAWLLAVAFYFGARFGFDKESRKRLFSMINNLPTIYEVVTGTAKKQVKEKHPKSSSKINKSGTKPSRQPEPNSRGPKMPPPPKDEDDSGGEEEEGEEHEKALCGACNDNYGQDEFWICCDACETWFHGKCVKITPAKAEHIKHYKCPNCSSSSKRARA

SEQ ID NO: 134766 - protein, 306 aa, Triticum aestivum
  Clone ID: PAT_TA_29184.pep
HEALINAGGVFEMTVFPEKYALEMSSIVYKNWKLTEQGLPDDLVKRGMAVPDSSSPYGVRLLIKDYPYAVDGLVIWWAIERWVNEYLAIYYPNDGVLRADKELEEWWKEVREVGHGDLKDADWWPKMVTVQELAKTCTTIIWVASALHAAVNFGQYPYAGYLPNRPTVSRRKMPEEGEEEYKQLQKGGKEADKVFIHTITSQFQTILGITLIEILSKHSSDEVYLGQRDTPEWTSDAKALEAFKRFGTRLMEIEKRILDMNKDPALKNRNGPVKMPYMLLYPNTSDAGGEKGLGLTAMGIPNSVSI

SEQ ID NO: 134767 - protein, 164 aa, Triticum aestivum
  Clone ID: PAT_TA_29185.pep
RAPTAATDQRPTGENAPRRLDARSQRIQAGGCAPAEHQGERRRRRRQGGHRRRRRASAHQGRRRRRRRGREWFWRVHGRPTRRHPRDPRGHRHVDLAEAVGDFIKDAPYATEGMVGYVAPASLPQKEVPEPPNWADFSAYYLPAETASIVVVICIHVIRLGFHI

SEQ ID NO: 134768 - protein, 258 aa, Triticum aestivum
  unsure (1)..(258): unsure at all Xaa locations
  Clone ID: PAT_TA_29186.pep
MGRKFFVGGNWKCNGTVEQVESIVNTLNAGQIASTDVVRXLLSSPPYVFLPTVKXAKLRPRDPSLLLQNCWVKKGXVLSTGEVSAEMLVNLRRSLGSFLGHSERRSLMGESSEFVGEKVAYALAQGLXKVIACVGETLEQREAGSTMEXVAEQTKAITGKIKDWTNVVVAYEPMWAICTGKVXTPAQAQEXHCNLRELLKDHVKPXEVLHPHRSFIGGSGTGAXCKDWAGQPQXQGFLCWGSFLLNLGLYDIINGPHR

SEQ ID NO: 134769 - protein, 226 aa, Triticum aestivum
  unsure (1)..(226): unsure at all Xaa locations
  Clone ID: PAT_TA_29187.pep
MGRKFFVGGNWKCNGTVEQVESIVNTLNAGQIASTDVVEVVVSPPYVFLPTVKGKLXRPEIQVAAQNCWVKKGGAFTGEVSAEMLVNLGVPWVIXLGHSERRSLMGESSEFVGEKVAYALAQGLXKVIACVGETLEQREAGSTMAVVAEQTKAIADKIKDWTNVVVAYEPVWAIGTGKVASPAQAQEVHANLRDWLKTNVNPEVAEITRFIYGGSVTWRKLAGNCA

SEQ ID NO: 134770 - protein, 186 aa, Triticum aestivum
  unsure (1)..(186): unsure at all Xaa locations
  Clone ID: PAT_TA_29188.pep
SPGLRNSDEAEIEVVDGPNDEGEMXTRPGKLSDRFPQPYPNEQAARFANGGAYPPDLSLITKARXHDGQNYVFALLTGYHDPPAGVQIREGLHYNPYFPGGAIAMPKMLMDGAIEYEDGTPATEAQMGKDVVSFLSWAAEPEMEERKLMGVKWIFLLSLALLQAAYYRRMRWSVLKSRKLVLDVVN

SEQ ID NO: 134771 - protein, 334 aa, Triticum aestivum
  unsure (1)..(334): unsure at all Xaa locations
  Clone ID: PAT_TA_29189.pep
SARGHRQLSVXHPVYKLLHPHYRDTMNINARARGLLINAGGVIEMTVFPRKHAMPMSSMVYKNWNFTEQALPDDLIKRGMAVEDPSSPHKVRLLIEDYPYAADGLAVWHAIEQWVTEYLTIYYPDDGVLQGDVELQAWWKEVREVGHGDLKDAAWWPKMQTVAELIKACATIIWTGSALHAAVNFGQYPYSGYXPNKPSASRRPMPAPGSEEYALLERDPEKAFILTITNQFQALVGISLMEILSKHSSDEVYLGQHDTPAWTSDAKAQEAFRRFGARLEGIEKQVVAMNGDPRLKNRTGPAKFPYMLLYPNTSDHTGQAEGLTARGIPNSISI

SEQ ID NO: 134772 - protein, 56 aa, Triticum aestivum
  Clone ID: PAT_TA_29190.pep
MGHSNVWNSHPKNYGAGSRVCRVCGNSHGLIRKYGLMCCRQCFRSNAKDIGFIKYR

SEQ ID NO: 134773 - protein, 878 aa, Triticum aestivum
  Clone ID: PAT_TA_29191.pep
MLLHGLVDRLTGKNKQAWKEGKIRGTAVLVKSDVLNLGDFHASLLDGVHDILGTDDGVIFHLVSATAPDPQNPRRGKVGRPAHLEEMVVTMKSKAAGESVFKVTFEWDDSQGIPGAVLVRNTYRSEYLLKTLTLQGVPGKGTVVFVANSWIYPNVDRVFFANDTYLPSKMPALLVQYRQDELNNLRGDGTTGKYEEWDRVYRYDYYNDLGEPDKGHPRPVLGGTQELPYPRRCRTGRPPTKTDPRSESRIPQYKIQEALNIYVPRDERFGHLKLSDFLGYSLKAITEAILPVIRTYVDTTPKEFDSFQDIYDLYDGLLKVPDNQHLKELKKKIPLQFIKSLLPVAGDDLLNLPLPHVIRSNDYAWRSDEEFAREMLAGVNPVCIKRLTEFPVKSTLDPSVYGDQSSTITEDQIQQNLEDGLTVKQAMEKNRLFILDHHDNFMPFLDRINKLEGNYIYASRTLLFLKADGTLKPLAIELSLPHPDGIQHGAKSTVYLPADIDSGVDGQIWQLAKAYASVDDSAWHQLISHWLNTHAVIEPFVIATNRQLSVVHPVHKLLSPHYRDTLNINALARTTLINAGGVFEMTVFPEKYALEMSSIVYKNWKLTEQGLPDDLVKRGMAVPDSSSPYGVRLLIKDYPYAVDGLVIWWAIERWVNEYLAIYYPNDGVLRADKELEEWWKEVREVGHGDLKDADWWPRMVTVQELAKTCTTIIWVASALHAAVNFGQYPYAGYLPNRPTVSRRKMPEEGEEEYKQLQKGGKEADKVFIHTITSQFQTILGITLIEILSKHSSDEVYLGQRDTPEWTSDAKALEAFKRFGTRLMEIEKRILDMNKDPALKNRNGPVKMPYMLLYPNTSDVDGEKGLGLTAMGIPNSVSI

SEQ ID NO: 134774 - protein, 56 aa, Triticum aestivum; identical to SEQ ID NO: 134756
  Clone ID: PAT_TA_29192.pep

SEQ ID NO: 134775 - protein, 132 aa, Triticum aestivum
  Clone ID: PAT_TA_29193.pep
PSLKGTKAGAPPAVAAALELVDPPGCRNSARGAKGRVSSCKPRRRRRRHGTLERLELAPQELRPRIEGLPCLRQLAWPDPQVRADVLQAVLPQQRQGHWLHQVPLRMETSKEARTRKLSTNCGASSRLIFIL

SEQ ID NO: 134776 - protein, 56 aa, Triticum aestivum; identical to SEQ ID NO: 134772
  Clone ID: PAT_TA_29194.pep

SEQ ID NO: 134777 - protein, 254 aa, Triticum aestivum
  Clone ID: PAT_TA_29195.pep
MDGGGTHRTPEDVFRDFRARRAGMIKALTTDVEKFYQQCDPEKENLCLYGLPNETWEVNLPAEEVPPELPEPALGINFARDGMDEKDWLSLVAVHSDAWLLAVAFYFGARFGFDKESRKRLFSMINNLPTIYEVVTGTAKKQVKEKHPKSSSKINKSGTKPSRQPEPNSRGPKMPPPPKDEDDSGGEEEEGEEHEKALCGACNDNYGQDEFWICCDACETWFHGKCVKITPAKAEHIKHYKCPNCSSSSKRARA

SEQ ID NO: 134778 - protein, 863 aa, Triticum aestivum
  unsure (1)..(863): unsure at all Xaa locations
  Clone ID: PAT_TA_29196.pep
MILGGLIDSLTGANKNARLKGTAVLMRKNVLDLTDFGATIMDGIGDFLGKGVTCQLISSTLIDHDNGGRGKVGAEAELEQWVTSLPSLTTGESKFGLTFDWEVEKLGVPGAIVVNNYHSSEFLLKTVTLHDVPGRGNLSFVANSWIYPAATYTYSRVFFANDTYLPSQMPAALKPYRDDELXRNLRGDDRQGPYQEHDRVYRYDVYNDLGEGRPVLGGSAEHPYPRRGRTGRKPNASDPSLESRLSLLEQIYVPRDEKFGHLKTSDFXXYSIKAITQGILPAVRTYVDTTPGEFDSFQDIMNLYEGGIKLPMVPALEELRKQFPLQLIKDLLPVGGDSLLKLPVPHIIQADQQAWRTDEEFAREVLAGVNPVMITRLTEFPPKSSLDPSKFGDHTSTITAAHIQKNLEGLTVQQALESNRLYILDHHDRFMPFLIEVNNLPGNFIYATRXTLFFLRGDGRLTPLAIELSGPVIQGGLTTAKSKVYTPVPSGSVEGWVWEFAKAYVAVNDSGWHQLVSHWLNTHAVMEPFVISTNRQLSVTHPVHKLLSPHYRDTMTINALARQTLINAGGIFEMTVFPGKFALGMSSVVYKDWKFTEQGLPDDLIKRGMAVEDPSSPYKVRLLVSDYPYAADGLAIWDAIEQWVTEYLTIYYPDDGVLQGDVELQAWWKEVREVGHGDLKDAAWWPKMQTVAELIKACATIIWTGSALHAAVNFGQYPYSGYHPNKPSASRRPMPVPGSEEYALLERDPEKAFILTITNQFQALVGISLMEILSKHSSDEVYLGQHETPAWTSDAKAQEAFRRFGARLEGIEKQVVAMNGDPRLKNRTGPAKFPYMLLYPNTSDHTGQAEGLTARGIPNSISI

SEQ ID NO: 134779 - protein, 145 aa, Triticum aestivum
  Clone ID: PAT_TA_29197.pep
GRSRRQAGVFSLNIIRYSKETKEFLIDSFRSFRTVATMSQYPHILLRAEEKPLEHQKTLSSSHAHPSNRRRQAEGEQEGGDDGALQRLELPPQELRARLPRLPGLWKLPWTDQEVWADVLQAVFPQQRQGHWLHQVPLIHLFLVP

SEQ ID NO: 134780 - protein, 145 aa, Triticum aestivum
  Clone ID: PAT_TA_29198.pep
MAGVNTSVVGLKPAAAVPQSASPAAAKRVQVAPAKDRRSALLGLAAVFAVTAASAGSARASVFDEYLEKSKLNKELNDKKRAATSGANFARAYTVQFGSCKFPYNFTGCQDLAKQKKVPFITDDLEIECEGKEKFKCGSNVFWKW

SEQ ID NO: 134781 - protein, 145 aa, Triticum aestivum
  Clone ID: PAT_TA_29199.pep
MAGVNTSVVGLKPAAAVPQSASPATAKRVQVAPPKDRRAALLGLAAVFAVTAASAGSARASVFDEYLEKSKLNKELNDKKRAATSGANFARAYTVQFGSCKFPYNFTGCQDLAKQKKVPFITDDLEIECEGKEKFKCGSNVFWKW

SEQ ID NO: 134782 - protein, 56 aa, Triticum aestivum; identical to SEQ ID NO: 134756
  Clone ID: PAT_TA_29200.pep

SEQ ID NO: 134783 - protein, 106 aa, Triticum aestivum
  Clone ID: PAT_TA_29201.pep
AWSRPRYKNISFTVWDVGGQDKIRPLWRHYFQNTQGLIFVVDSNDRERVVEARDELHRMLNEDELRDAVLLVFANKQDLPNAMNAAEITDKLGLHSLRQRHWSRAR

SEQ ID NO: 134784 - protein, 304 aa, Triticum aestivum
  Clone ID: PAT_TA_29202.pep
MAVGRGINQLLRKTLQSQSAGSSLLSSFRGKHEESSAGLRALALLGVGASGLLSFGTIASADEAEHGLAAAEYPWPHAGILSLYDHASIRRGHQVYQQVCASCHSMSLISYRDLVGVAYTEEETKAMAAEIEVVDGPNDEGEMFTRPGKLSDRFPQPYPNEQAARFANGGAYPPDLSLITKARHDGQNYVFALLTGYHDPPAGVQIREGLHYNPYFPGGAIAMPKMLMDGAIEYEDGTPATEAQMGKDVVSFLSWAAEPEMEERKLMGVKWIFLLSLALLQAAYYRRMRWSVLKSRKLVLDVVN

SEQ ID NO: 134785 - protein, 253 aa, Triticum aestivum
  Clone ID: PAT_TA_29203.pep
MGRKFFVGGNWKCNGTVEQVESIVNTLNAGQIASTDVVEVVVSPPYVFLPTVKAKLRPEIQVAAQNCWVKKGGAFTGEVSAEMLVNLGVPWVILGHSERRSLMGESSEFVGEKVAYALAQGLKVIACVGETLEQREAGSTMEVVAEQTKAITGKIKDWTNVVVAYEPVWAIGTGKVATPAQAQEVHANLRDWLKTNVSPEVAASTRIIYGGSVTGASCKELAGQPDVDGFLVGGASLKPEFIDIINAATVKSA

SEQ ID NO: 134786 - protein, 214 aa, Triticum aestivum
  Clone ID: PAT_TA_29204.pep
MAQTMASMTGLSQGVRLPGPAGRRASRFIVRASSAEAEAAGRRAVLGLMASGVVGSAFAQVVHAGTVAAIKVGPPPPLSGGLPGTDNSDEARDFDLPLKNRFYLQPLPPAEAAVRAKESAQDILNLKPLIDKKQWPYVMNDLRLRASYLRYDLKTVISSKTTKEEKKDLKDLTGKLFATLDGLDHAAKIKSPTEAEKYYGETKTVLGDVLAKLG

SEQ ID NO: 134787 - protein, 286 aa, Triticum aestivum
  Clone ID: PAT_TA_29205.pep
MASSVAAAASAFLGTRLADPAPQNGRIVARFGFGKKKAPPKKAKAPPTTDRPLWFPGAQAPEYLDGTLVGDYGFDPFGLGKPAEYLQYDVDSLDQNLAQNLAGEIIGTRFEDADVKSTPFQPYAEVFGLQRFRECELIHGRWAMLATLGALTVEWLTGVTWQDAGKVELVDGSSYLGQPLPFTLTTLIWIEVLVIGYIEFQRNAELDPERRLYPGGSYFDPLGLAADPEKKETLQLAEIKHARLAMVAFLGFAVQAAATGKGPLNNWATHLSDPLHTTIFDTLGSS

SEQ ID NO: 134788 - protein, 781 aa, Triticum aestivum
  unsure (1)..(781): unsure at all Xaa locations
  Clone ID: PAT_TA_29206.pep
RHEAAFITTGENKFAVTFDWSVDKLGVPGAIIVKNNHAAEFFLKTITLDNVPGRGTVVFVANSWVYPQAKYRYNRVFFANDTYLPHQMPAALKPYRDDELRNLRGDDQQGPYEDHDRVYRYDVYNDLGDTRDVLGGSKDLPYPRRCRTGRKPSATKPDHESRLLPLVGNVYVPRDELFGHLKQSDFLGYTLKALVDGIIPAIRTYVDLSPGEFDSFADILKLYEGGIKLPDIPAXLQEMRKRFPLQLVKDLIPMGGDYLLKPPKPQVIKQDEIAWMTDEEFAREILAGVNPMMITRVTEFPPKSTLDPSQYGDHTSTITEAHIRNSLEGLTAQQAMASNRLYILDHHDNMMPYLVRLNNLDDTFLYATRTLFFLRGDGTLAPVAIELSSPLIQGDLTTAKSTVYTPQHAGVEGWIWQLAKAYASVNDYGWHQLISHWLNTHAVMEPFVIATNRQLSVTHPVYKLLHPHYRDTMNINARARGLLINAGGVIEMTVFPRKHAMPMSSMVYKNWNFTEQALPDDLIKRGMAVEDPSSPHKVRLLIEDYPYAADGLAVWHAIEQWVTDYLTIYYPNDGVLQGDVELQAWWKEVREVGHGDLKDAAWWPKMHTVAELIKACATIIWTGSALHAAVNFGQYPYSGYHPNKPSASRRPMPSPGSEEYALLERAPEKAFILTITNQFQALVGISLMEILSKHSSDEVYLGQHDTPAWTSDAKAQEAFRRFGARLEGIEKQVVAMNGDPRLKNRTGPAKFPYMLLYPNTSDHTGQAEGLTARGIPNSISI

SEQ ID NO: 134789 - protein, 253 aa, Triticum aestivum
  Clone ID: PAT_TA_29207.pep
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAGQPDVDGFLVGGASLKPEFIDIINAATVKSA

SEQ ID NO: 134790 - protein, 253 aa, Triticum aestivum
  Clone ID: PAT_TA_29208.pep
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 134791 - protein, 286 aa, Triticum aestivum; identical to SEQ ID NO: 134787
  Clone ID: PAT_TA_29209.pep

SEQ ID NO: 134792 - protein, 214 aa, Triticum aestivum
  Clone ID: PAT_TA_29210.pep
MAQTMASMTGLSQGVRLPGPAGRRASRFTVRASSAEAEAAGRRAVLGLMASGVVGSAFAQVVHAGTVAAIKVGPPPPLSGGLPGTDNSDEARDFDLPLKNRFYLQPLPPAEAAVRAKESAQDILNLKPLIDKKQWPYVMNDLRLRASYLRYDLKTVISSKTTKEEKKDLKDLTGKLFATLDGLDHAAKIKSPTEAEKYYGETKTVLGDVLAKLG

SEQ ID NO: 134793 - protein, 214 aa, Triticum aestivum
  Clone ID: PAT_TA_29211.pep
MAQTMASMTGLSQGVRLPGPTGRRASRFTVRASSAEAEAAGRRAVLGLMASGVVGSAFAQVVHAGTVAAIKVGPPPPLSGGLPGTDNSDEARDFDLPLKNRFYLQPLPPAEAAVRAKESAQDILNLKPLIDKKQWPYVMNDLRLRASYLRYDLKTVISSKTTKEEKKDLKDLTGKLFATLDGLDHAAKIKSPTEAEKYYGETKTVLGDVLAKLG

SEQ ID NO: 134794 - protein, 260 aa, Triticum aestivum
  Clone ID: PAT_TA_29212.pep
FAHASAHAFEIFLYTVPPTMMLFATLEGPISHSERKKSACCKVLYFSIWNVFFVNVLSGSAINQLNALSRPKDIPMELPTRPPTRPTFFTTYVLTSGWASLSSEVMQLFGLIWNFVRKYILRMKEDSDFILSFPYHTELPKVLLFGLLGFTCSVLAPLILPFLLLYFFLAYIVYRNQFINVYCTRYETGGLYWPIAYNATIFSLVLTQIICLGVFGLKESPVAAGFTVPLIIITLLFNQYCRMRLVPFFRTFPAPALFDM

SEQ ID NO: 134795 - protein, 65 aa, Triticum aestivum
  Clone ID: PAT_TA_29213.pep
SAARAASPRGRGAAATWPPSTARSPRASTAPAATGRASPPPATRPPAPPPAPSRSPPPAPSCDVV

SEQ ID NO: 134796 - protein, 355 aa, Triticum aestivum
  unsure (1)..(355): unsure at all Xaa locations
  Clone ID: PAT_TA_29214.pep
MAPLLKDELDIVIPTIRNLDFLEMWRPFFQPYHLIIVQDGDPTRTVMVPEGFDYELYNRNDINRILGPKASCISFKDSACRCFGYMVSKKKYVYTIDDDCFVAKDPTGKDIDALAKHIQNLLCPSTPLFFNTLYDPYQEGADFVRGYPFSLREGVPTAVSHGLWLNIPDYDAPTQLVKPRERNGRYVDAVMTIPKGSLFPMCGMNLAFDRELIGPXMYFGLMGDGQPIGRYDDMWAGWCVKVICDHLGLGVKTGLPYIWHSKASNPFVNLKKEYKGIFWQEDIIPFFQAAKLTKECDTVQKCYISLSQQVKEKLGKIDPYFVKLADAMVTWIEAWDMLNSKDSKEADANGKLKGR

SEQ ID NO: 134797 - protein, 76 aa, Triticum aestivum
  Clone ID: PAT_TA_29215.pep
SAPLAASPRGRAAAATSPPCTGRSPTASTAPAATGRASPPTPTPPAPPPAPSRSPPPASSCDVRRESPSAVPVAVR

SEQ ID NO: 134798 - protein, 415 aa, Triticum aestivum
  unsure (1)..(415): unsure at all Xaa locations
  Clone ID: PAT_TA_29216.pep
MRPRTRVAARERPPPPPPPPAPAPTPTSRKHASIQGSRIEDPGQAAMAGTVTVPGSSVPSTPLLKDELDIVIPTIRNLDFLEMWRPFFQPYHLIIVQDGDPSKVIKVPEGFDYXELYNRNDINRILGPKASCISFKDSACRCFGYMVSKKKYVFTIDDDCFVAKDPSGKDINALEQHIKNLLSPSTPFFFNTLYDPYREGADFVRGYPFSLREGAPTAVSHGLWLNIPDYDAPTQMVKPRERNSRYVDAVLTIPKGTLFPMCGMNLAFDRQLIGPAMYFGLMGDGQPIGRYDDMWAGWCVKVICDHLSLGVKTGLPYLWHSKASNPFVNLKKEYKGIFWQEDIIPFFQNATLSKECDTVQKCYISLSEQVKEKLGKIDPYFVKLADAMVTWIEAWDELNPSDTVVAAGNGKAAAM

SEQ ID NO: 134799 - protein, 66 aa, Triticum aestivum
  Clone ID: PAT_TA_29217.pep
FYLYIEQMDVVVLFSWNLVDRGHKTLLVTVQQPHLRLGWPVNPRPTTCSSRTSTLVNARSVGSSRG

SEQ ID NO: 134800 - protein, 129 aa, Triticum aestivum
  Clone ID: PAT_TA_29218.pep
PRVRDTMEENLKRQLFGLPSRYRDSVRAIRPGLPLFLYNYSTHQLHGIFEAASFGGANIDPAAWEDKKCNGESRFPAQVRVATRKICDPLEEDAFRPILHHYDGPKFRLELSITEALSLLDIFEDKDEA

SEQ ID NO: 134801 - protein, 61 aa, Triticum aestivum
  Clone ID: PAT_TA_29219.pep
LQFATIDELQVRVATRKICDPLEEDAFRPILHHYDGPKFRLELSITEALSLLDIFEDKDDA

SEQ ID NO: 134802 - protein, 353 aa, Triticum aestivum
  unsure (1)..(353): unsure at all Xaa locations
  Clone ID: PAT_TA_29220.pep
MAMEGYDREFWQFGDQLRLQTASFSGLSLGDSIWSPADAAPRARNADLFSPSPAPDNNNAAKMNGNGLNGPGLIGSGKLAFGATTTSKADRYNNVSLPAAADANAKPYGNANGLYGAKPNNTNNNGFGLNKMAAGGGGYGNFNGGNDGVKSYFNKSIGRPASNNSSNNNFSGYGGKKGAADGKKKHAKNERGDNNHGAASEKRFKTLPASEALPRNEPIGGYIFVCNNDTMEENLKRQLFGLPSRYRDSVRAIRPGLPLFLYNYSTHQLHGIFEAASFGGANIDPAAWEDKKCXAESRFPAQVRVATRKICDPLXEEDAFRPILHHYDGPKFRLELSITETLSLLDIFEDKDD

SEQ ID NO: 134803 - protein, 54 aa, Triticum aestivum
  Clone ID: PAT_TA_29221.pep
GLNLLGGRFFFFFFFFFFNFFFFFFFFFFFFFFFFFFFYYMHIYNELDNVIIVG

SEQ ID NO: 134804 - protein, 109 aa, Triticum aestivum
  unsure (1)..(109): unsure at all Xaa locations
  Clone ID: PAT_TA_29222.pep
CRAGTRPNVPNDPPVTPGPHPKPGSQPPAPXPAPPKPIPTARSPPDRRTATGAVPPVANQSKGPPESPLQAPYTTGDPAVPSTSCNTSRTTTALLVGLRDDVSANIIST

SEQ ID NO: 134805 - protein, 149 aa, Triticum aestivum
  Clone ID: PAT_TA_29223.pep
KTGVVLFAGLGDVYDLRFFDQLRQIRTFGAWPVATVSERERKATVEGPVCGGSPSAVTGWFSTADATPTVRAARPPAGTVDVARFAFGSALLWNPHRWDRFPVSEPDASQDSVKFVQRLAAEEYNESRGMPDPDCSEIMVWRGDQLVAT

SEQ ID NO: 134806 - protein, 242 aa, Triticum aestivum
  unsure (1)..(242): unsure at all Xaa locations
  Clone ID: PAT_TA_29224.pep
QAAAALRHDPGLSREWTPEEQAILDELLVKYASDAPVIRYAKIAMKLPEKTVRDVALRCRWMSKKESXGKRKKEDHSSSKKSKDKKEKVADSSSKPPVHIAGRPSVPPYSLPALPVDDDEISSKAIGGPTGELLETNAQDFSHLAPSVGGKQIEEPTXVPSQAGEGEDGAPGELEEAPXIMKQMPPLPVKINEELVNSILPEANWYLCSSDSEWNVFSIVLKSPLDKAAKNNTPKKNAQPWP

SEQ ID NO: 134807 - protein, 193 aa, Triticum aestivum
  Clone ID: PAT_TA_29225.pep
VRPDVLVGDRSGSGATAVTAAKVSHLLCFATCWGAALWATFIGGIIMFKNLPRHQFGNLQGKMFPAYFTLISACAAVSVAAFAYLHPWKAASAVERYQLGFLISALGFNLSNLLVFTPMTIEMMKKRHKIERELSIGNEVGWSKNVKTAKSNPTLAAMNKKFGMIHGLSSLANILSFGSLAMHSWYFASKLEL

SEQ ID NO: 134808 - protein, 244 aa, Triticum aestivum
  unsure (1)..(244): unsure at all Xaa locations
  Clone ID: PAT_TA_29226.pep
MAWATRFLSAVCFFAAGVLFAPDVLIGDRSGSGATAVTAAKVSHLLCFATCWGAALWATFIGXIIMFKNLXRHQFGKMFPAYFTLIXSALTSPCAAVSVAAFAYLHPXWKAASAVXERYQLGFVFTAPSFLVFNXMTTPTMTIKMMKKRDKIERELSIXGDKVGXSKKVKPAKSNPTLAVRNETFSLIHGQSSLANILSFARLAMHSWYLACKVDMRSVQAPTLASIYYHRCMSFLRNKTCYML

SEQ ID NO: 134809 - protein, 133 aa, Triticum aestivum
  Clone ID: PAT_TA_29227.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAKSPKKKVAAKE

SEQ ID NO: 134810 - protein, 172 aa, Triticum aestivum
  unsure (1)..(172): unsure at all Xaa locations
  Clone ID: PAT_TA_29228.pep
MATETETFILQAEINQLLSLIINTFYSNKEIFLRQLISNSVEALXDKIKVQSLTDKSKLDAQPELFIHIIPDKATSTLTIVDSGIGMTKSDLVNNLGTYRRAGTKEFMEALAAGADVSMIGQFGVGFYSAYLVDERVVVTTKHNDDXQYVWESYAGGSVTVTRDTFGEQLRT

SEQ ID NO: 134811 - protein, 109 aa, Triticum aestivum
  Clone ID: PAT_TA_29229.pep
CRLRPTAALRVQRGCHHFVPLFLAPLRRHPHTAAIFPRRGGLVPPPPSHRCQQWRFLFIRKCPLMPPLTSLSWLHCRIPDQLDLCGSMSLHSHSSGPRRPTPASSASGD

SEQ ID NO: 134812 - protein, 153 aa, Triticum aestivum
  Clone ID: PAT_TA_29230.pep
SVCRWLFKSAVKSQGSTLDRRWKLPSWSTVGAEGISGGAVKCIEIGKNTNGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 134813 - protein, 162 aa, Triticum aestivum
  unsure (1)..(162): unsure at all Xaa locations
  Clone ID: PAT_TA_29231.pep
EVLFMVDAIDEYAVGQLKEYDGKKLVSATKEGLKLDEETEEEKKRREEKKAAFEGLCKTIKDILGDKVEKVVVSDRIVDSPCCLVTGEYGWTANMERIMKAQALRDSSMGAYMSSKKTMEINPENGIMEELRKRADADRNDKSVKDXVMLLFETALLTPXST

SEQ ID NO: 134814 - protein, 168 aa, Triticum aestivum
  unsure (1)..(168): unsure at all Xaa locations
  Clone ID: PAT_TA_29232.pep
LTSLKDYVTRMKEGQNEIYYITGESKKAVENSPFLEKLKKKGYEVIYMVDAIDEYAIXGQLKEFEGKESLSLPPKEGLNLMKSEDELRKRADADKNDKSVKDLVMLLFETSLLTSGFSLEDPNTFGTRIHRMLKLGLSIDEDDEAPENDTDMPPLEDDAGESKMEEVD

SEQ ID NO: 134815 - protein, 103 aa, Triticum aestivum
  Clone ID: PAT_TA_29233.pep
EALAAGADVSMIGQFGVGFYSAYLVAERVIVTSKHNDDEQYVWESQAGGSFTVTRDTTGEPLGRGTKITLYLKDDQLEYLEERRLKDLVKKHSEFISKMEEVD

SEQ ID NO: 134816 - protein, 104 aa, Triticum aestivum
  Clone ID: PAT_TA_29234.pep
LSGHCSGEIPYSAITKALEINDDEVEYWIVKAISSKILDCKVDQLNQLVIVSRHTVRVFGMPQWQSLRSKLGVWRGNIANAINTIQANKVTEDGGQGMQGLMIR

SEQ ID NO: 134817 - protein, 153 aa, Triticum aestivum
  Clone ID: PAT_TA_29235.pep
EDLPLNISRETLQQNKILKVIRKNLVKKCIELFFEIAENKEDYNKFYEAFSKNLKLGVHEDSTNRTKLAELLRYHSTKSGDELTSLKDYVTRMKEGQNDIYYITGESKKAVENSPFLEKLGLSIDEDEEAAEADTDMPPLEEDAGESKMEEVD

SEQ ID NO: 134818 - protein, 93 aa, Triticum aestivum
  Clone ID: PAT_TA_29236.pep
SVVAAEVLELAGNAAKDNKKTRIIPRHLLLAVRNDQELGRLLAGVTIAHGGVIPNINSVLLPKKSPAAAEKEAKSPKKKTSTKSPEKKVAAKE

SEQ ID NO: 134819 - protein, 135 aa, Triticum aestivum
  Clone ID: PAT_TA_29237.pep
RRSPHQAAGSSTLGNEIPSPHPFPPILLSRIGCCVALRWDSGVGGGEIRSRGLPVAALIRAGSVVGAGISWRGEVNSGGGFGEFDAIAVDCGAGAPRLGIRSLSKGGPLILGAYYVSPRTLVPHCGNKKISSSAS

SEQ ID NO: 134820 - protein, 89 aa, Triticum aestivum
  Clone ID: PAT_TA_29238.pep
MAGRKGGDRKKAVTRSVKAGLQFPVGRIGRYLKKGRYAQRVGSGAPVYLAAVLEYLAAEVLELAGNAAKDNKKKTTAKSPKKKVAATKE

SEQ ID NO: 134821 - protein, 65 aa, Triticum aestivum
  Clone ID: PAT_TA_29239.pep
GQREFPVELGKLLAGVTIAHGGVIPNINAVLLPKKSPAAAEKEAKSPKKKTSTKSPKKKTAATKE

SEQ ID NO: 134822 - protein, 89 aa, Triticum aestivum
  Clone ID: PAT_TA_29240.pep
RTRPHGRRTLPCRLGAARPPPLPSRSGQRLVLLGGDYTFLPGGGTLPLSCVTPSGCALRPLPRINRSGNREMKLQRSMIRKKRVSTLDI

SEQ ID NO: 134823 - protein, 184 aa, Triticum aestivum
  Clone ID: PAT_TA_29241.pep
MMARAALLPVALLLCLALAGGANAARKSTAGFYELKNKKGDFSIKVTNWGAALVSAIVPDGKGNLADVVLGYDTVAEYANGSASFGATVGRVANRIANARFVLDGKTYHLLRNDGNNTIHGGPKGFGKVIWTVKEHVSHGDSPYITFYYHSLDGEQGFPGALDVYVKYQLSRPYDLSIRMNVTA

SEQ ID NO: 134824 - protein, 63 aa, Triticum aestivum
  Clone ID: PAT_TA_29242.pep
FFFFFFFLEHQTFFIPLTNWHIHTLQPVLNKTTKKPYIRFTKGQPKDASMRHQLYKMKAKTSS

SEQ ID NO: 134825 - protein, 147 aa, Triticum aestivum; identical to SEQ ID NO: 113042
  Clone ID: PAT_TA_29243.pep

SEQ ID NO: 134826 - protein, 301 aa, Triticum aestivum
  unsure (1)..(301): unsure at all Xaa locations
  Clone ID: PAT_TA_29244.pep
MASSADPWVREYGEAARLADDVAAMVADRAALPQSGPEVMRHTSAIRRKITILGTRLDSLEGMLARLPPKSITDKELHKRRDTLSNLKSRAKQMAESFNMSTFANREDLLGQSKKAADDMSRVAGLDNQGIVGLQRQIMKEQDEGLEKLEQTVLSTKHIALAVNEELDLHARLIVSFLLQSHLFLCSLDSVFTALSSXLQDDLDDHVDGTNSRLQVLFQTLVSVPYPXTLKKVSLLFDTNSSQALHELNFDANTFLMQRVQKRLAVLNKRAKGGCSCMSLLLSTVGIVMLVVIVWLLIKYL

SEQ ID NO: 134827 - protein, 247 aa, Triticum aestivum
  unsure (1)..(247): unsure at all Xaa locations
  Clone ID: PAT_TA_29245.pep
MASETETFAFQAEINQLLSLIINTFYSNKEFEGKKLVSATKEGLKLDDSEEEKKRNDELKEKFEGLCKVIKEVLGDRVEKVIVSDRVVDSPCCLVTGEYGWTANMERIMKAQALRDTSMGGYMSSKKTMEINPXNAIMEELRKRADVDKNDKSVKDLVMLLFETSLLTSGFSLDDPXTFGTRIQRMLKLGXNIDXDEEAAEADTDIPLXEDPAKQDGVKLCNCYPIQNLLGTAPLPLWLRCWARELL

SEQ ID NO: 134828 - protein, 170 aa, Triticum aestivum
  Clone ID: PAT_TA_29246.pep
PIQRNRRQHHSSRVLAAGEAASKMAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTAAKSPKKKTAATKE

SEQ ID NO: 134829 - protein, 80 aa, Triticum aestivum
  Clone ID: PAT_TA_29247.pep
RERALAPSLVSRHPGAATTAATPGASSDLRSLVCLKKDLAVDCWCFPSPGASNVLDVSSSSSRASKTGALSANGAADNAV

SEQ ID NO: 134830 - protein, 157 aa, Triticum aestivum
  unsure (1)..(157): unsure at all Xaa locations
  Clone ID: PAT_TA_29248.pep
MSIFEYNGSAVVAMVGKNCFAIASDRRLGVQLQTIATDFRRVFKVHDKLYIGLSGLATDAQTLYQRLVFXRHKLYQLMEEXRDMKARNFATLXTLLYEKXFGPYXCQPLLLAXETTMTVYISMDCIGAKELQKFVAPVCSNHLRACDHTNMEPFRNS

SEQ ID NO: 134831 - protein, 255 aa, Triticum aestivum
  unsure (1)..(255): unsure at all Xaa locations
  Clone ID: PAT_TA_29249.pep
MAETTENEYHTGEEEDLVGEEEGGVGAEGEKGGGAGKKRKRPLNKKSLGGFSKRGVCYLSRVPPHMNPSHVRQIFSKHGEVQRIYLVPEGQGHRKHSNVKAKAYSEGWVEFAKKSVAKRVANLLNGEQIGGKKRSSFYYDIWNIKYLRKFKWDDLVGEIAEKTHIREQKLTLEITAAKKQRDHYLSNXEKSRTQKFIRERIKKKQKPEGKESNDVGETNNDCPIPRQNRAVEERGPNKKAKLSKNILAGVFGGSS

SEQ ID NO: 134832 - protein, 99 aa, Triticum aestivum
  Clone ID: PAT_TA_29250.pep
PRVRQEKLPPTDSRLRPDQRCLENGEYERANAEKLRLEQRQRQARKMQESGWKPRWFAKDKGSDTYRYLGGYWESREKSSWEGCPDIFGQLPNDLMITD

SEQ ID NO: 134833 - protein, 232 aa, Triticum aestivum
  Clone ID: PAT_TA_29251.pep
MASSADPWVREYGEAARLADDVAAMVADRAALPQSGPEVMRHTSAIRRKITILGTRLDSLEGMLARLPPKSITDKELNKHRDTLSNLKSRAKQMAESFNMSTFANREDLLGQSKKAADDMNRVAGLDNQGIVGLQRQIMKEQDEGLEKLEQTVLSTKHIALAVNEELDLHARLIDDLDDHVDGTNSRLQRVQKRLAVLNKRAKGGCSCMSLLLSTVGIVMLVVIVWLLIKYL

SEQ ID NO: 134834 - protein, 370 aa, Triticum aestivum
  unsure (1)..(370): unsure at all Xaa locations
  Clone ID: PAT_TA_29252.pep
NIERSYQICLPVYFNEPLSSLQKCFEDLEYSYLIDRAYEWGKRGDSLMRILSVAAFAVSGYASTDGRSCKPFNPLLGETYEADYPDKGLRFFXSEKVSHHPMVVACHCEGNGWRFWAYSNLKSEFWGRSIQLDPVGVLTLEFDDGEVFQWSKVTTSIYNLILGKLYCDHYGTMRIQGNREYSCKLKFKEHSIIDRNPHQVQGVIQDRSGRTVATLFGKWDESMHYVMGDCFGKGKRSENFSEAHLLWKRSKPPKFPTRYNFTSFAITLNELTPGLKEKLPPTDSRLRPDQRCLENGEYERANAEKLRLEQRQRQARKMQESGWKPRWFAKDKGSDTYRYLGGYWESREKSNWEGCPDIFGQLPNDLMITD

SEQ ID NO: 134835 - protein, 147 aa, Triticum aestivum
  Clone ID: PAT_TA_29253.pep
MAGRKAGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTTTKSPKKKTAATKE

SEQ ID NO: 134836 - protein, 136 aa, Triticum aestivum; identical to SEQ ID NO: 106789
  Clone ID: PAT_TA_29254.pep

SEQ ID NO: 134837 - protein, 367 aa, Triticum aestivum
  Clone ID: PAT_TA_29255.pep
QINKQKPIWLRKPEEISKEEYASFYKSITNDWEDHLAVKHFSVEGQLEFKAVLFVPRRAPFDLFDTRKKMNNIKLYVRRVFIMDNCEELIPEWLGFVKGVVDSDDLPLNISRETLQQNKILKVIRKNLVKKCIELFFEIAENKEDYAKFYEAFSKNLKLGVHEDSQNRAKLADLLRYHSTKSGDDLTSLKDYVTRMKEGQKDIYYITGESRKAVENSPFLERLKKRGYEVLFMVDAIDEYAVGQLKEYDGKKLVSATKEGLKLDEETEEEKKRKEEKKAAFEGLCKTIKDILGDKVEKVVVSDRIVDSPCCLVTGEYGWTANMERIMKAQALRDSNMGAYMSSKKTMEINPENGIMEELRKRADADK

SEQ ID NO: 134838 - protein, 136 aa, Triticum aestivum
  Clone ID: PAT_TA_29256.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLIGLFEDTNLCAIHAKRVTIMPKDIQLARRIRGERA

SEQ ID NO: 134839 - protein, 200 aa, Triticum aestivum
  Clone ID: PAT_TA_29257.pep
NVDLVIHYELPNNSEIFVHRSGRTGRAGKKGTAIVMYSYNQSRAVRGIENDVGGKFTELPKINVEGSDLTMASGYDSFGGGGGGGRSRGGGFGGRGGGFGNSSSRGGGFGDSGFGRSGGGFGRSGGGGGGGFGDSGFGRSGGGGGFGDSGFGRSGGGGGGFGSSGGFGSSGSGRSGGFGSNSGSSGSSWGGFGSFGGKSS

SEQ ID NO: 134840 - protein, 254 aa, Triticum aestivum
  unsure (1)..(254): unsure at all Xaa locations
  Clone ID: PAT_TA_29258.pep
APFDLFDNKKKANNIKLYVRRVFIMDNCEELIPEYLSFVKGIVDSEDLPLNISRETLQQNKILKVIRKNLVKKCIELFFEIAENKEDYNKFYEAFSKNLKLGIHEDSQNRTKIAELLRYHSTKSXGDELTSLKDYVTRMKEGQNEIYYITGESKKAVENSPFLEKLKKKGYEVIYMVDAIDEYAIGQLKEVEGKKLVSXTKEGLKLDESEDEKKKEELKEKFEGLCKVIKEVLGRQGGERHWLLTVLWTSLGCL

SEQ ID NO: 134841 - protein, 234 aa, Triticum aestivum
  unsure (1)..(234): unsure at all Xaa locations
  Clone ID: PAT_TA_29259.pep
MASSSDPWMKEYNEASRLADDISSMIADRGSLPQSGPEIMRHTSAIRRKITILGTRLDSLGVIVWARIPPKSITDKEMHKRQDMLSSLKSKAKQMATXFNMSNFANKEDLLGQSXKADDMSRVAGLDNQGIVGLQRQIMKEQDEGLEKLEETVLSTKHIALAVNXEELTLHTRLIDDXLEDHVDITNSRLQRVQKRLAILNKRTKGGCSCMCLLLSVVAIVILAVIVWLLVKYL

SEQ ID NO: 134842 - protein, 264 aa, Triticum aestivum
  unsure (1)..(264): unsure at all Xaa locations
  Clone ID: PAT_TA_29260.pep
CLASQKTKPIQLNVPKPSNFDTKETISGNQALETESDSDSESLVEIQGGRCKRSGKSSDTRRIRRMVSNRESARRSRRRKHAQLTDLELQVEQLKSESATLFKQLTEANQQFTTAVTDNRILKSDVETLRIKVKMAEDMVARGAVSCGLGQQLGLAPFLNSRKMXQSLGERSHRHRVELEREPCTLQRFLALALQVQTSAVRSTASLECSNNQMPACPARRPDVWMPCGPEIHTKAGPLCIVTNTGCCIPDICACLAGCKGTKL

SEQ ID NO: 134843 - protein, 173 aa, Triticum aestivum
  Clone ID: PAT_TA_29261.pep
LEGMLARLPPKSITDKELHKRRDTLSNLKSRAKQMAESFNMSTFANREDLLGQSKKAADDMSRVAGLDNQGIVGLQRQIMKEQDEGLEKLEQTVLSTKHIALAVNEELDLHARLIDDLDDHVDGTNSRLQRVQKRLAVLNKRAKGGCSCMSLLLSTVGIVMLVVIVWLLIKYL

SEQ ID NO: 134844 - protein, 120 aa, Triticum aestivum
  Clone ID: PAT_TA_29262.pep
QEDFPYIRTIKPNRLPGLPSAPIKNLLGYGGLINQELLPPKLPNPPQLEPELPEPLPNPPDRPEPESPNPPLEPNPPPPPDRPNPESPNPPPPPERPNPPPERPNPESPNPPPLLEELTK

SEQ ID NO: 134845 - protein, 194 aa, Triticum aestivum
  Clone ID: PAT_TA_29263.pep
MASSSDPWMKEYTEASKLVDDISSMIADRSSLPQSGPEIMRHTSAIRRKITILGTRLDSLVTLLSRIPPKSLTDKEMHKRQDALSNLKSKAKQMGTSFNVSNFANREDLLGQSKKAADDMSRVAGLDNQGIVGLQRQVMREQDEGLERLEETVLSTKHIALAVNEELTLHTRLIDDLEDMLTVQLPLKLCKELA

SEQ ID NO: 134846 - protein, 237 aa, Triticum aestivum
  Clone ID: PAT_TA_29264.pep
MASSSDPWMKEYTEASKLVDDISSMIADRSSLPQSGPEIMRHTSAIRRKITILGTRLDSLVTLLSRIPPKSLTDKEMHKRQDALSNLKSKAKQMGTSFNVSNFANREDLLGQSKKAADDMSRVAGLDNQGIVGLQRQVMREQDEGLERLEETVLSTKHIALAVNEELTLHTRLIDDLEDHVDVTNSRLQRVQKRLAILNKRAKGGCSCMCLMLSVAAIVLLAVIVWLLIKYLGRDHA

SEQ ID NO: 134847 - protein, 198 aa, Triticum aestivum
  unsure (1)..(198): unsure at all Xaa locations
  Clone ID: PAT_TA_29265.pep
RFNTLIATDVAXRGGFPNVDLDPMNCKQLEIFVHRSGRTGRAGKKGTAIVMYSYNQSRAVRGIENDVGGKFKELPKINVEGSDLTMASGYDSFGGGGGGGRSRGGGFGGRDSGFGRSGGGFGRSGGGGGFGDSGFGRSGGGGGFGDSGFGRSGGGGGGFGSSGGFGDSGSGRSGGFGGGSGSSGSSWGGFGSFGGKSS

SEQ ID NO: 134848 - protein, 582 aa, Triticum aestivum
  Clone ID: PAT_TA_29266.pep
QLGVGLYSAYLVADRVVVTTKPNYDEQYVWESQAGGSFTVTRDTSGEQLGRGTKITLFLKDDQLEYLEERRLKDLVKKHSEFISYPISLWTEKTTEKEISDDEDDDSAEKKEGEVEEVDDDKDKDESKKKTKKVKEVSHEWAQINKQKPIWLRKPEEISKEEYASFYKSITNDWEDHLAVKHFSVEGQLEFKAVLFVPRRAPFDLFDTRKKMNNIKLYVRRVFIMDNCEELIPEWLGFVKGVVDSDDLPLNISRETLQQNKILKVIRKNLVKKCIELFFEIAENKEDYAKFYEAFSKNLKLGVHEDSQNRAKLADLLRYHSTKSGDELTSLKDYVTRMKEGQKDIYYITGESRKAVENSPFLERLKKRGYEVLFMVDAIDEYAVGQLKEYDGKKLVSATKEGLKLDEETEEEKKRKEEKKAAFEGLCKIIKDILGDKVEKVVVSDRIVDSPCCLVTGEYGWTANMERIMKAQALRDSSMGAYMSSKKTMEINPENGIMEELRKRADADKNDKSVKDLVMLLFETALLTSGFSLDDPNTFAARIHRMLKLGLNIDDQDAEEEDADMPALEEEGAEESKMEEVD

SEQ ID NO: 134849 - protein, 204 aa, Triticum aestivum
  Clone ID: PAT_TA_29267.pep
MSIFEYNGSAVVAMVGKNCFAIASDRRLGVQLQTVATDFQRVFKIHGKLYIGLSGLASDAQTLYQRLVFKHKLYQLREERDMKPETFASLVSSMLYEKRFGPYFCQPIIAGLGQDDEPFICTMDCIGAKELAKDFVVSGTASESLYGACESMYKPNMEPEELFETISQALLSSVDRDCLSGWGGYVLIVTPTEVQERVLKGRMD

SEQ ID NO: 134850 - protein, 382 aa, Triticum aestivum
  Clone ID: PAT_TA_29268.pep
MKRVMMEYLEEHPISLWTEKSTEKEQFGVGFYSAYLVAERVVVTTKHNDDEQYVWESQAGGSFTVTRDTSGEQLGRGTKMVLYLKDDQMEYLEERRIKDLVKKHSEFISYPISLWTEKTTEKEISDDEDEEEKKDTEEFKVEDVDEEKEEKEKKKKKIKEVSHEWNLVNKQKPIWMRKPEEINKEEYAAFYKSLTNDWEEHLAVKHFSVEGQLEFKAVLFVPKKAPFDLFDNKKKANNIKLYVRRVFIMDNCEELIPEYLSFVKGIVDSEDLPLNISRETLQQNKILKVIRKNLVKKCIELFFEIAENKEDYNKFYEAFSKNLKLGIHEDSQNRTKIAELLRYHSTKSGDELTSLKDYVTRMKEGQNEIYYITGESKMEEVD

SEQ ID NO: 134851 - protein, 146 aa, Triticum aestivum
  Clone ID: PAT_TA_29269.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKSTTKSPKKKVAAKE

SEQ ID NO: 134852 - protein, 180 aa, Triticum aestivum
  Clone ID: PAT_TA_29270.pep
MVVAEQTQSIPIQRNRRQHHSSRVLAAGEVARRMAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTSTKSPKKKTAATKE

SEQ ID NO: 134853 - protein, 147 aa, Triticum aestivum
  Clone ID: PAT_TA_29271.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINAVLLPKKSPAAAEKEAKSPKKKTSTKSPKKKTAATKE

SEQ ID NO: 134854 - protein, 204 aa, Triticum aestivum
  Clone ID: PAT_TA_29272.pep
MSIFEYNGSAVVAMVGKNCFAIASDRRLGVQLQTVATDFQRVFKIHGKLYIGLSGLATDAQTLYQRLVFKHKLYQLREERDMKPETFASLVSALLYEKRFGPYFCQPIIAGLGEKDQPFICTMDCIGAKELAKDFVVSGTASESLYGACESMYKPDMEPEELFETISQALLSSVDRDCLSGWGGYVLIVTPTEVQERVLKGRMD

SEQ ID NO: 134855 - protein, 204 aa, Triticum aestivum; identical to SEQ ID NO: 134854
  Clone ID: PAT_TA_29273.pep

SEQ ID NO: 134856 - protein, 147 aa, Triticum aestivum
  Clone ID: PAT_TA_29274.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTAKSPKKKVAATKE

SEQ ID NO: 134857 - protein, 148 aa, Triticum aestivum
  unsure (1)..(148): unsure at all Xaa locations
  Clone ID: PAT_TA_29275.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELRRLLAGVTIAHGGXVIPNINSVLLPKKSPAAAEKEAKSPKKKTAAKSPKKKTAATKE

SEQ ID NO: 134858 - protein, 147 aa, Triticum aestivum
  Clone ID: PAT_TA_29276.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTAAKSPKKKTAATKE

SEQ ID NO: 134859 - protein, 204 aa, Triticum aestivum; identical to SEQ ID NO: 134849
  Clone ID: PAT_TA_29277.pep

SEQ ID NO: 134860 - protein, 147 aa, Triticum aestivum
  Clone ID: PAT_TA_29278.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTATKSPKKKVAATKE

SEQ ID NO: 134861 - protein, 204 aa, Triticum aestivum
  Clone ID: PAT_TA_29279.pep
MSIFEYNGSAVVAMVGKNCFAIASDRRLGVQLQTVATDFQRVFKIHGKLYIGLSGLASDAQTLYQRLVFKHKLYQLREERDMKPETFASLVSSMLYEKRFGPYFCQPIIAGLGQDDEPFICTMDCIGAKELAKDFVVSGTASESLYGACESMYKPNMEPEELFETISQALLSSVDRDCLSGWGGYVLIVTPTEVQERILKGRMD

SEQ ID NO: 134862 - protein, 351 aa, Triticum aestivum
  Clone ID: PAT_TA_29280.pep
MKSRRRTRKHAPTQPCTLPPSRPYEDPSQPASLSIHAAAIIFISPNGAFHVPFPRPIKAVAGDAVTPRNGGLAKKDRQTDAQSDDNTTTVTNRRRGRQPSEMKKCASELEFEAFIRQHIAAAEAEAQRGRPGHGNDDGGFCLRPRRQSGRVLPRQRPAGASALGDSQNALELEGSNPGHLWWSEGLRAPPHHAAPAPTQSQTPAVSASPRETISGNQALETESDSDSESLVEIGGGRCKRSGKSSDTRRIRRMVSNRESARRSRRRKHAQLTDLELQVEQLKSESATLFKQLTEANQQFTTAVTDNRILKSDVETLRIKVKMAEDMVARGAVSCGLGQQLGLAPFLNSRKM

SEQ ID NO: 134863 - protein, 232 aa, Triticum aestivum
  unsure (1)..(232): unsure at all Xaa locations
  Clone ID: PAT_TA_29281.pep
MASSSDPWMKEYTEASKLVDDISSMIADRSSLPQSGPEIMRHTSAIRRKITILGTRLDSLVTLLSRIPPKSLTDKEMHKRQDALSNLKSKAKQMGTSFNVSNFANREDLLGQSKKAADDMSRVAGLDNQGIVGLQRQVMREQDEGLERLEETVLSTKHIALAVNEELTLHTRLIDDLEDHVDVTNSRLQRVQKRLAXLNKRAKGGCSCMCLMLSVAAIVLLAVIVWLLIKYL

SEQ ID NO: 134864 - protein, 147 aa, Triticum aestivum
  unsure (1)..(147): unsure at all Xaa locations
  Clone ID: PAT_TA_29282.pep
MAGRKGGDRKKAVTRSVKAGLQFPVGRIGRYLKKGRYAQRVGSGAPVYLAAVLEYLAAEVLELAGNAXAKDNKKTRIIPRHLLLAVRNDQELGRLLAGVTIAHGGVIPNINSVLLPKKSPAAAEKEAKSPKKKTTAKSPKKKVAAKE

SEQ ID NO: 134865 - protein, 353 aa, Triticum aestivum
  unsure (1)..(353): unsure at all Xaa locations
  Clone ID: PAT_TA_29283.pep
MSSPPNPSARVPGASGAGGAMASETETFAFQAEINQLLSLIINTFYSNKEIFLRELISNASDALDKIRFESLTDKSKLDAQPELFIHIIPDKATNTLTLIDSGIGMTKSDLVXNNLGTIARSGXPKDFMEALAAGADVSMIGQFGVGFYSAYLVAERVVVTSKHNDDEQYVWESQAGGSFTVTRDTTGEPLGRGTKITLYLKDDQLEYLEERRLKDLVKKHSEFISYPISLWTEKTTEKEISDDEDEDEKKDTEEGKVEEIDEEKEEKEKKKKKIKEVSHEWNLINKQKPIWMRKPEEITKDEYAAFYKSLTNDWEEHLAVKHFLVEGQFEFKAVLFGFKKALFDLXFDTRKK

SEQ ID NO: 134866 - protein, 700 aa, Triticum aestivum
  Clone ID: PAT_TA_29284.pep
MATETETFAFQAEINQLLSLIINTFYSNKEIFLRELISNSSDALDKIRFESLTDKSKLDAQPELFIHIIPDKATSTLTIVDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMVLYLKDDQMEYLEERRIKDLVKKHSEFISYPISLWTEKTTEKEISDDEDEEEKKDTEEGKVEDVDEEKEEKEKKKKKIKEVSHEWNLVNKQKPIWMRKPEEINKEEYAAFYKSLTNDWEEHLAVKHFSVEGQLEFKAVLFVPKRAPFDLFDNKKKANNIKLYVRRVFIMDNCEELIPEYLSFVKGIVDSEDLPLNISRETLQQNKILKVIRKNLVKKCIELFFEIAENKEDYNKFYEAFSKNLKLGIHEDSQNRTKIAELLRYHSTKSGDELTSLKDYVTRMKEGQNEIYYITGESKKAVENSPFLEKLKKKGYEVIYMVDAIDEYAIGQLKEFEGKKLVSATKEGLKLDESEDEKKKQEELKEKFEGLCKVIKEVLGDKVEKVIVSDRVVDSPCCLVTGEYGWTANMERIMKAQALRDSSMAGYMSSKKTMEINPENAIMDELRKRADADKNDKSVKDLVMLLFETSLLTSGFSLEDPNTFGTRIHRMLKLGLSIDEDDEAPENDTDMPPLEDDAGESKMEEVD

SEQ ID NO: 134867 - protein, 413 aa, Triticum aestivum
  Clone ID: PAT_TA_29285.pep
MATIVNTTEEEPMLAVVRSTAQLAWADAGQEVADPEVARLCAEAQQHLLAARWLDMATLMLASADLLLLSPSAPDKAADLECSLTVVCNLVTKAGSEDEALEIAKLICAKLTHQPGEKPTLRIKVLFSLYNLLPSLSGKALVYRKALELAAAAGKAAADCVVPTFKNIDAFVAYWGIGKPEQRDLFLAVTRILKDQKGMTKEYFKFLNKYLATFDGSADEADAIGAAKEEAAAAIIEFVKSSDLYQCDLLDMPAVAQLEKDEKYQPVYELLKIFLTLRLDSYLAFQTANSSLLQGYGLVHEECITKMRLMSLLDLSGHCSGEIPYSAITKALEINDDEVEYWIVKAISSKILDCKVDQLNQLVIVSRHTAWASSDLRSLVCLKKDLAVDCWCFPSPGAMTWDSTSIQQATFWM

SEQ ID NO: 134868 - protein, 372 aa, Triticum aestivum
  Clone ID: PAT_TA_29286.pep
MMARAALLPVALLLCLALAGNVNATRKSTAGFYELKNKKGDFSIKVTNWGAALVSAIVPDGKGNLADVVLGYDTVAEYVNGSASFGATVGRVANRIANTRFVLDGKTYHLLRNDGNNTIHGGPKGFGKVIWTVKEHVSHGDSPYITFYYHSLDGEQGFPGALDVYVKYQLSRPYDLSIRMNVTARNKATPVNLANHAYWNLAGHGSGDILKHELQMFASHYTPVDSSMIPTGEVAPVAGTMYDFGRRIPVGTNMKIVPGGGGGYDMNYAVDGQHGQQNAMRPVARVRDPKSGRAFELWANQPGVQFYTASWLINEKGKAGKVYGQYGALCLETQAYPDAVNHPNFPSSIVRPGQVYKHDMVFRFSYQATYDA

SEQ ID NO: 134869 - protein, 279 aa, Triticum aestivum
  unsure (1)..(279): unsure at all Xaa locations
  Clone ID: PAT_TA_29287.pep
MVKDHLMLNVDRLMVPEPIEITGAPKSSSSRDTTALPITGHSFFAVGDSMVPEEEPLLQITECRICQEEDDIKNLXESPCACTGSVKYAHRXCVQRWCNEKGDVTCEICHEPYEHGYTAPPRPHPDETTIDISGGWTITGTAFDLRDPRILAVAQNHIMEAEYDDYSATNASTAAFCRSAALVLMALLLLRHALTLTDEDDDDTSAMFSLFLLRAAGFLLPFYIMAWAISILQRRRHRQEAAALAATEVAFILQSGQGRGVHFTIAPDSPATPQHEPQP

SEQ ID NO: 134870 - protein, 700 aa, Triticum aestivum
  Clone ID: PAT_TA_29288.pep
MASETETFAFQAEINQLLSLIINTFYSNKEIFLRELISNASDALDKIRFESLTDKSKLDAQPELFIRIIPDKATNTLTLIDSGIGMTKSDLVNNLATIGRSGTKDFMEALAAGADVSMIGQFGVGFYSAYLVAERVIVTSKHNDDEQHVWESQAGGSFTVTRDTTGEPLGRGTKITLYLKDDQLEYLEERRLKDLVKKHSEFISYPISLWTEKTTEKEISDDEDEDEKKDTEEGKVEEIDEEKEEKEKKKKKIKEVSHEWNLINKQKPIWMRKPEEITKDEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISRETLQQNKILKVIRKNLVKKCIELFFEIAENKEDYNKFYEAFSKNLKLGVHEDSTNRTKLAELLRYHSTKSGDELTSLKDYVTRMKEGQNDIYYITGESKKAVENSPFLEKLKKKGYEVLYMVDAIDEYSIGQLKEFEGKKLVSATKEGLKLDDSEEEKKRKEELKEKFEGLCKVIKEVLGDRVEKVIVSDRVVDSPCCLVTGEYGWTANMERIMKAQALRDTSMGGYMSSKKTMEINPENAIMEELRKRADADKNDKSVKDLVMLLFETSLLTSGFSLDDPNTFGTRIHRMLKLGLSIDEDEEAAEADTDMPPLEEDAGESKMEEVD

SEQ ID NO: 134871 - protein, 700 aa, Triticum aestivum
  Clone ID: PAT_TA_29289.pep
MASETETFAFQAEINQLLSLIINTFYSNKEIFLRELISNASDALDKIRFESLTDKSKLDAQPELFIHIIPDKATNTLTLIDSGIGMTKSDLVNNLGTIARSGTKDFMEALAAGADVSMIGQFGVGFYSAYLVAERVVVTSKHNDDEQYVWESQAGGSFTVTRDTTGEPLGRGTKITLYLKDDQLEYLEERRLKDLVKKHSEFISYPISLWTEKTTEKEISDDEDEDEKKDTEEGKFEEIDEEKEEKEKKKKKIKEVSHEWNLINKQKPIWMRKPEEITKDEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISRETLQQNKILKVIRKNLVKKCIELFFEIAENKEDYNKFYEAFSKNLKLGVHEDSTNRTKLAELLRYHSTKSGDELTSLKDYVTRMKEGQSDIYYITGESKKAVENSPFLEKLKKKGYEVLYMVDAIDEYSIGQLKEFEGKKLVSATKEGLKLDDSEEEKKRKEELKEKFEGLCKVIKEVLGDRVEKVIVSDRVVDSPCCLVTGEYGWTANMERIMKAQALRDTSMGGYMSSKKTMEINPENAIMEELRKRADVDKNDKSVKDLVMLLFETSLLTSGFSLDDPNTFGTRIHRMLKLGLSIDEDEEAAEADTDMPPLEEDAGESKMEEVD

SEQ ID NO: 134872 - protein, 700 aa, Triticum aestivum
  Clone ID: PAT_TA_29290.pep
MATETETFAFQAEINQLLSLIINTFYSNKEIFLRELISNSSDALDKIRFESLTDKSKLDAQPELFIHIIPDKATNTLTIVDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMVLYLKDDQMEYLEERRIKDLVKKHSEFISYPISLWTEKTTEKEISDDEDEEEKKDTEEGKVEDVDEEKEEKEKKKKKIKEVSHEWNLVNKQKPIWMRKPEEINKEEYAAFYKSLTNDWEEHLAVKHFSVEGQLEFKAVLFVPKRAPFDLFDNKKKANNIKLYVRRVFIMDNCEELIPEYLSFVKGIVDSEDLPLNISRETLQQNKILKVIRKNLVKKCIELFFEIAENKEDYNKFYEAFSKNLKLGIHEDSQNRTKIAELLRYHSTKSGDELTSLKDYVTRMKEGQNEIYYITGESKKAVENSPFLEKLKKKGYEVIYMVDAIDEYAIGQLKEFEGKKLVSATKEGLKLDESEDEKKKQEELKEKFEGLCKVIKEVLGDKVEKVIVSDRVVDSPCCLVTGEYGWTANMERIMKAQALRDSSMAGYMSSKKTMEINPENAIMDELRKRADADKNDKSVKDLVMLLFETSLLTSGFSLEDPNTFGTRIHRMLKLGLSIDEDDEAPENDTDMPPLEDDAGESKMEEVD

SEQ ID NO: 134873 - protein, 700 aa, Triticum aestivum; identical to SEQ ID NO: 134872
  Clone ID: PAT_TA_29291.pep

SEQ ID NO: 134874 - protein, 307 aa, Triticum aestivum
  Clone ID: PAT_TA_29292.pep
MANAAVDPESKRARLTSSMSSVDTILRLPPSLPSTSATRAPAGHPLEEPPARRRPARRSKPVRIFQSMFRSLPVLTVPRCGGILTAAPTAASASASPARSDSLLSQIISPSTTLNGGGGVGASSRRHMTGTLFGCREGRVSLALQENPRCRPALVVELALPTHTLLRELGGTAGTRIVLEAEKKHVEEHSSSGGGEHGDAAARQHDDDGWLLHEPIWTMFCNGKRVGYAVRREPTDGDIAVLETLWAVSMGGGVLPGRAGSAASDGELAYMRGCFDNIIGSEDSESLYMLGPHGGDSPELAVFFVRL

SEQ ID NO: 134875 - protein, 78 aa, Triticum aestivum
  Clone ID: PAT_TA_29293.pep
PRVRKMLDNMLSYSGGIVGLIILILDLIVIFEVMNSNRAISGKLGWSLLVFFFPIVGLILYFLFSNRLEHNARYETLV

SEQ ID NO: 134876 - protein, 422 aa, Triticum aestivum
  unsure (1)..(422): unsure at all Xaa locations
  Clone ID: PAT_TA_29294.pep
MEVDPWTLLEDGTSCPSTSSGSNSASGIAPDHSNLKACSWLKGGGRGSNINKYVTEKAFAELMLPCIDRSSPEFRSIFAGELIKQMGTVSEHIKAISRNGAKHVGLVPSGNDVSSNKSSGRKGIRGGSPNIGRRVTVGNDPTPPSASALQAIVWLRLQFIIRLLQVILADRGMRHTLAPAILSLLAARIIYEDADSPLPPASLIASRREVDSLLEPPMDVLLDRPSESLFERLLCVFHALLGNCKPSWMKSKPVSKPTVRASRDIPAFDNEAAVALQSALDHMELPGAIRRRIQAAMPILPAARHPSIQCQPSQLSLAALSPLQSTPSTSGPQQKSTSHSWVPTNISGRXKAVLPPQDPEMEVDPWTLLEDGTSCPSTSSGSNSASGIAPDHSNLKACSWLKGAVRVRRAELTYIGSLDDDS

SEQ ID NO: 134877 - protein, 123 aa, Triticum aestivum
  Clone ID: PAT_TA_29295.pep
MSDFEHRILPVTEDGLVGAERRQLIVDVSVDHTVARNGRRWQLRAEPAPLLRVLRRLGVPRLARLVLERIAHQAAGRLCRPGGEQRAHEHHGEHQRHARGWRHGHGGCTMHVGWCGGGRAAGP

SEQ ID NO: 134878 - protein, 63 aa, Triticum aestivum
  Clone ID: PAT_TA_29296.pep
NKGDRVLMLTFGAGFKCNSCVWTVERPSADAGVWADCIHEYPPKEIRNPFMEKYGFVKDMSAL

SEQ ID NO: 134879 - protein, 175 aa, Triticum aestivum
  unsure (1)..(175): unsure at all Xaa locations
  Clone ID: PAT_TA_29297.pep
MNAWETHADEYSFVQCGMLYSLEPGLQKRFERHGAYEMFEELKMVFQAHARVERYEASDKFFSCKMEENSSVSEHILTMSGLHNRLTQLGVNLPDDAVIDRILQSLPSSYKSFVMNFNMXGMEKTIPPSTPMVKSAEVEVKKDHQVLMVNKTTKFKKGXGKKNFXKDDKGVAAPW

SEQ ID NO: 134880 - protein, 94 aa, Triticum aestivum
  Clone ID: PAT_TA_29298.pep
LEASDCFDDDDSLPADSCEDEGQSVDPLDSAVSYSSVMILVQNMLKLDYSMQEKIVKALCLKTPSSELDGYCLMWDLRPYIDDNVMQLAWKFIL

SEQ ID NO: 134881 - protein, 165 aa, Triticum aestivum
  Clone ID: PAT_TA_29299.pep
MEETAAVAAATETVTAAETGTPEKSSYRYWVRQATGEAAPPPVPRKLDPSAANGGGGNPNALGSVWNQAGTWEEKNLNSWANGRIKDLLGSLGSLDFSTGKASIDEVSKCSGDAFLVTGRNKKRVGYNYELSLRFKGEWVVKEEKKKVTGHIDTPEFSFGELDDP

SEQ ID NO: 134882 - protein, 208 aa, Triticum aestivum
  Clone ID: PAT_TA_29300.pep
MEETAAVAAATETVTATETGTPEKSSYRYWVRQATGEAAPPPVPRKLDPSAANGGGGNPNALGSVWNQAGTWEEKNLNSWANGRIKDLLGSLGSLDFSTGKASIDEVSKCSGDAFLVTVRNKKRVGYNYELSLRFKGEWLVKEEKKKVTGHIDIPEFSFGELDDLEAEVRFTDTLEWDDKSRICKDVKLFLSPIKEKLRTFELELKDR

SEQ ID NO: 134883 - protein, 116 aa, Triticum aestivum
  unsure (1)..(116): unsure at all Xaa locations
  Clone ID: PAT_TA_29301.pep
MSSPTSQIGVCAICPAIAVKIAPQETQASGWFIPLWVAFAILIGGLLLDVLISVSLGVSAPPVNIIIGVLIVLGLGTALXRLALECCQEFGSRRSMPRMENMAPSGYLPPEYSLGL

SEQ ID NO: 134884 - protein, 256 aa, Triticum aestivum
  unsure (1)..(256): unsure at all Xaa locations
  Clone ID: PAT_TA_29302.pep
MATASLSALSSAAAAAGKRFVISSPSLSFASRRIAAPARLRAAAVPGARRFAASAASASTVVATIAVGDKLPDATLSYFDPXADGEXLKKVTVGEADCREAASCSSLVPGPRLSPALAADGRAAECMDQEVVFAVPGAFTGGCSQKHLPGFIANAGELRAKGVDTVACVSVNDAFVMKAWKESLGLGEDVQLLSDGNLELTRALGVEMDLSDKPMGLGVRSRRYALLADDGVVKVLNLEQGGAFTTSSAEEMLKAL

SEQ ID NO: 134885 - protein, 511 aa, Triticum aestivum
  Clone ID: PAT_TA_29303.pep
MTATPALIGLSAGNRLLSTSFGPPNDLLSDKVNCHMSSAAGDAHGSSSLQFAPPAASKLTVAAHRLKLSPHGRAQVMRALRQSAPALAPQPPPLLPADEFSLDAIILLQRSMLEKQWQLPFEEEDDDDGGGDGHHVEAIGSAEDDDGKGRSSSVVVARSGVSARQRRMSGRRRGRSKKGSGAVHLSISPELLQSRNRIYLRGTVSKELLTHKQVVHLSKKIKDGIWLQQQRSKLKEKLGNEPSYKQMAQSLRISTPELRSRMRESFLAREVLTMSNIRLVISIAQKYDKLGVELSDLIQGGLIGLLRGIEKFDASRGFRISTYVYWWIRQGVSRALADNSKTFRLPTYLHERLIAIRGAKYALEDQGVSPTTQNIAKLLNISEKKVHNATEAVNKALSLDQQAFPSLNGLPGDTLHSYIEDQNVANDPWHGFEEWYLKEEVNKLLNSNLTERERDIIQLYHGIGKQCHTWEDISRQFGLSRERVRQVGLIAMEKLKQRARRKKLDALLQDY

SEQ ID NO: 134886 - protein, 207 aa, Triticum aestivum
  Clone ID: PAT_TA_29304.pep
MTFYGTQDKCKACDKTVHFIDLLTADGIPYHKYCFKCSHCKGTLSMCSYSSMDGVLFCKTHFEQLFKETGSFKKNFPTCAKANNEQSKVPNKYGSVFCGTQDKCAACKKTVYPLEKMTLEGEPYHKTCFKCAHGGCILTTASYASLNGILYCQNHFWQLFKETGSYSNLLKPASKNADEPEAAKEEEQAPEAVEDQVPEAVEDQEHS

SEQ ID NO: 134887 - protein, 158 aa, Triticum aestivum
  unsure (1)..(158): unsure at all Xaa locations
  Clone ID: PAT_TA_29305.pep
MVAYALKSEGGYVWACKNYDGDVQSDFLAQGFGSLGLMTSVLMCPDGKTIEAEAAHGTVTRHFRVHQKGGETSTNSIASIFAWTRGLAHRAKLDENARLLEFAQKLEEACVXGTVESGKMTKDLCXLVHGFLQXLQEAITWNTEXSIDAVAADSNQRL

SEQ ID NO: 134888 - protein, 104 aa, Triticum aestivum
  Clone ID: PAT_TA_29306.pep
MVRKAKVEFDEQPPDNFDPKNPYGDPVAMLEYREHLVREKWIQIETAKIIRERLRWCYRIEGINHHQKCRHLVDQYLESTRGVGWGKDARPPEFHEPKKTVEAE

SEQ ID NO: 134889 - protein, 111 aa, Triticum aestivum
  unsure (1)..(111): unsure at all Xaa locations
  Clone ID: PAT_TA_29307.pep
SNHHQTLPPAMAMNIASASRLLSPRGKELHTPQEQFPQQQQFPQPQQFPQQQIPQQHQIPQQPQQFXPTTTIPSXNNKIPQQQXPQQHQIPQQPQQFPQQQQXPNNTNSPN

SEQ ID NO: 134890 - protein, 105 aa, Triticum aestivum
  Clone ID: PAT_TA_29308.pep
MVRKAKVEFDERPPDDFDPKNPYGDPVAMLEYREHLVREKWIQIETAKIIRDRLRWCYRIEGVNHHQKCRHLVDQYPESTRGVGWGKDHRPADLHEPKKVVEVEE

SEQ ID NO: 134891 - protein, 179 aa, Triticum aestivum
  unsure (1)..(179): unsure at all Xaa locations
  Clone ID: PAT_TA_29309.pep
MAEGKKDNPKLNQRVVSSLSKRTVAAHSWHDLEIGPEAPQIFNVVVEITKGSKVKYELDKKTGMIKVDRILYSSVVYPHNYGFVPRTLCEDGDPLDVLVLMQEPVIPGCFLRAKAIGLMPMIDQGEKDDKIIAVCVDDPEYRHFNDLKELSPHRLAEIRRFFEDYKKNENXXXAVNDFL

SEQ ID NO: 134892 - protein, 138 aa, Triticum aestivum
  Clone ID: PAT_TA_29310.pep
LVRGRLLCGQASPAGTDGPAAGACFRRRRRQKSRLWRRRASNHRDHLGRRRGRLGVAPAALLGGLGGRGEGVEMHPVGERVVGSEHRRRHRLVGAGLDRLDPLAAWRRRRDLRIGPRRGRPNPNEREEGICGRKKTMG

SEQ ID NO: 134893 - protein, 205 aa, Triticum aestivum
  Clone ID: PAT_TA_29311.pep
MAEGKKDAPKLNQRMVSSLSKRTAAAHSWHDLEIGPEAPLIFNAVVEITKGSKVKYELDKKTGMIKVDRILYSSVVYPHNYGFVPRTLCEDGDPIDVLVLMQEPVIPGCFLRAKAIGLMPMIDQGEKDDKLIAVCVDDPEYRHLNDLKELSPHRLAEIRRFFEDYKKNENKEVAVNDFLPPETAQAAIKHSMDLYAEYILQSLKN

SEQ ID NO: 134894 - protein, 153 aa, Triticum aestivum
  Clone ID: PAT_TA_29312.pep
KSEGGYVWACKNYDGDVQSDFLAQGFGSLGLMTSVLVCPDGKTIEAEAAHGTVTRHFRVHQKGGETSTNSIASIFAWTRGLAHRAKLDDNARLLDFALKLEAACVGTVESGKMTKDLALLVHGSASVTRSHYLNTEEFIDAVATELRSRLGAN

SEQ ID NO: 134895 - protein, 221 aa, Triticum aestivum
  Clone ID: PAT_TA_29313.pep
MEWTTVEAADGAKLSVRVFKPAAPVEGAEDVSVVLVHPYTILGGVQGLLRGMAQGLAERGHRAVTFDMRGAGRSTGRASLTGSSEVGDVVAVCRWVAYTLKPRAVLLIGSSAGAPIAGSAVDKVDQVVGYVSIGYPFGLMASILFGRHHDAILKSEKPKLFIMGTKDGFTSVKQLQNKLRSAAGRVDTHLIEGAGHFQMEGPAFDAQMVDLIVNFIKSLPK

SEQ ID NO: 134896 - protein, 205 aa, Triticum aestivum
  Clone ID: PAT_TA_29314.pep
MAEGKKDSPKLNQRMVSSLSKRTAAAHSWHDLEIGPEAPLIFNAVVEITKGSKVKYELDKKTGMIKVDRILYSSVVYPHNYGFVPRTLCEDGDPIDVLVLMQEPVIPGCFLRAKAIGLMPMIDQGEKDDKLIAVCVDDPEYRHLNDLKELSPHRLAEIRRFFEDYKKNENKEVAVNDFLPPETAQAAIKHSMDLYAEYILQSLRN

SEQ ID NO: 134897 - protein, 252 aa, Triticum aestivum
  Clone ID: PAT_TA_29315.pep
TSIITKPETHSLATRSSSSPTPRLTTYLTTSRRTKQQQRANLKQPPPNPTAGPPLPRMTLPLKKYRKGSIGTELPGSDPPDRTTHQPSADKILPSFSQGELLPPLLLLAVASRGDEARRGGGGRRAERRSHGGGAHAAAGGGAVIMRARRCGAGTGGRGWPLPLRAGRRIPAGAGSSALGPRQRTPGRRSLVAMATGTIFLVGTTEGCCGPIRLVVRSALLSAGGACARADAIGAEAGGGDRTRLSAGGVWG

SEQ ID NO: 134898 - protein, 214 aa, Triticum aestivum
  Clone ID: PAT_TA_29316.pep
MSGEADGKTYQVSRMPPAALNERILSSMSQKHVAAHPWHDLEIGPGAPAVFNCVVEIPRGSKVKYELDKATGLIKVDRVLYSSVVYPHNYGFIPRTLCEDNDPMDVLVLMQEQVVPGCFLRARAIGLMPMIDQGEKDDKIIAVCADDPEYRHFRDISELPPHRLQEIRRFFEDYKKNENKEVAVNDFLPAEDAINAIKYSMDLYGSYIMEGLRK

SEQ ID NO: 134899 - protein, 214 aa, Triticum aestivum
  Clone ID: PAT_TA_29317.pep
MAGEADGKTYQVSRMPPAALNERILSSMSQKHVAAHPWHDLEIGPGAPAVFNCVVEIPRGSKVKYELDKATGLIKVDRVLYSSVVYPHNYGFIPRTLCEDNDPMDVLVLMQEQVVPGCFLRARAIGLMPMIDQGEKDDKIIAVCADDPEYRHFRDISELPPHRLQEIRRFFEDYKKNENKEVAVNDFLPAEDAINAIKYSMDLYGSYIMEGLRK

SEQ ID NO: 134900 - protein, 300 aa, Triticum aestivum
  Clone ID: PAT_TA_29318.pep
MATAVLRSHDALANRMHLDAFAASPQAAKQRRRRHPKPASPPPKVVAGSSPPKPALLASPALKQAPAAGRRSPPAKPARKQPSPTKEKPRQQPIVMEAVRILKRGEEPPVPSPAPAPVQARAQAPPADRRLRSPSPASPPVVKARPQAPPADRRVRSPPPASAPIASARAQAPPADKRALRTTSRDRPAATRRRANQEDGAARRRSQLRRPGVLGRGPGAELSPPPWVLLPPRRGRGHPRPPLPAPHRRALMMTAPPPAASCAPPPRPRRSALLPPPPRLASSRRKQQEEEVVVVITLPD

SEQ ID NO: 134901 - protein, 105 aa, Triticum aestivum
  Clone ID: PAT_TA_29319.pep
MVRKAKVEFDERPPDDFDPKNPYGDPVAMLEYREHLVREKWIQIETAKIIRDRLRWCYRIEGVNHHQKCRHLVDQYLESTRGVGWGKDHRPADLHEPKKVVEVEE

SEQ ID NO: 134902 - protein, 652 aa, Triticum aestivum
  unsure (1)..(652): unsure at all Xaa locations
  Clone ID: PAT_TA_29320.pep
MQNNLRAQLHQQSLTRGYLLRKILFWLRTTVIQLLITSKKYDNDWSPQDDPPAGNQSSIPETSGDPSLFEAPLHPSTHVADAVYLHENSYLDDNISAAMRSGNASERHLDHYGGNSEYNDGLLQNSSTYLAQTHSHIEDQAEESNADVSAAANFQGLSLHDEELAATKFAEDNPAVIIPDHLQVANTGCAGLSFGSFGSGAFSGLLPPPKSTENNVELPIVEESEPIDHTDTRDQDFYEIPPNSPPNENLEEIMGANTENLDVPSVQQPDVLRQEILDDPSGVQYNLPSVSSHAYANPAQPNAMDAMQGSNQAHTLSHLSSLLQSNTLQQHNLLGSNMAPLRDLDFGLSPLLAAQAQSMGARYNSAAPTTTGMQEPMKPGVFSNTQSTQNLPSTSIQMAPSLPQQLVHPYSQPTLPIAPFANMIGANMIGYNPYLAQNYPAYLPSTAFQQAYSSNGQFHQSAAAVPGAGMKYSMPQYKNNMSAANLQQQQQASSVISGYAGFGSSSNLPGNFALNQNAAPPSANLGFDEALSAQYKEANQYMALQQQGDNSAMWLHGAGSRTASALPPTQFYGYQGQSQQQGAFRQAQQPQQPSQYGGHGYPAFYHSQGGMAQEHHPQNPADGALNGYQAXPQQQQQQQQPSHQSWQQHANY

SEQ ID NO: 134903 - protein, 105 aa, Triticum aestivum; identical to SEQ ID NO: 134901
  Clone ID: PAT_TA_29321.pep

SEQ ID NO: 134904 - protein, 105 aa, Triticum aestivum
  Clone ID: PAT_TA_29322.pep
MVRKAKVEFDERPPDDFDPKNPYGDPVAMLEYREHLVREKWIQIETAKIIRDRLRWCYRIEGVNHHQKCRHLVDQYLESTRGVGWGKDHRPADLHEPKKVVEVED

SEQ ID NO: 134905 - protein, 411 aa, Triticum aestivum
  unsure (1)..(411): unsure at all Xaa locations
  Clone ID: PAT_TA_29323.pep
MAFEKIKVANPIVEMDGDEMTRVFWQSIKDKLIFPFLXDLDIKYXFDLGVLHRDATDDKVTVEAAEATLKYNVAIKCATITPDEDRVKEFNLKQMWRSPNGTIRNIINGTVFREPIICKNVPKLVPGWTKPICIGRHAFGDQYRATDAVLKGPGKLRLVFEGKDETVDLEVFNFTGAGGVAMAMYNTDESIRGFAEASMAIAYEKKWPLYLSTKNTILKKYDGRFKDIFQEIYEAGWKSKYEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDENARLLEFAQKLEEACVGTVESGKMTKDLALLVHGSSKVTRSDYLNTEEFIDAVAAELKSRL

SEQ ID NO: 134906 - protein, 409 aa, Triticum aestivum
  Clone ID: PAT_TA_29324.pep
MAFEKIKVANPIVEMDGDEMTRVFWQSIKDKLIFPFLDLDIKYFDLGVLHRDATDDKVTVEAAEATLKYNVAIKCATITPDEDRVKEFNLKQMWRSPNGTIRNIINGTVFREPIICKNVPKLVPGWTKPICIGRHAFGDQYRATDAVLKGPGKLRLVFEGKDETVDLEVFNFTGAGGVAMAMYNTDESIRGFAEASMAIAYEKKWPLYLSTKNTILKKYDGRFKDIFQEIYEAGWKSKYEAAGIWYEHRLIDDMVAYALKSEGGYVWACKNYDGDVQSDFLAQGFGSLGLMTSVLMCPDGKTIEAEAAHGTVTRHFRVHQKGGETSTNSIASIFAWTRGLAHRAKLDENARLLEFAQKLEEACVGTVESGKMTKDLALLVHGSSKVTRSDYLNTEEFIDAVAAELKSRL

SEQ ID NO: 134907 - protein, 156 aa, Triticum aestivum
  Clone ID: PAT_TA_29325.pep
PAKVKNVGSVVRAICLLTHPIPSTNDSDSCQIVIPQSQVGRKHDIYIACVSDAHMVCPKGHYLAIVSTIVETQDPAKEIDEGLKLLGPVKDMFVHVSPLEEPIEDGPKDKVYISRSYDATSHFETVCEDVHDIWRRITGEALVLKKRENEENVNAA

SEQ ID NO: 134908 - protein, 186 aa, Triticum aestivum
  Clone ID: PAT_TA_29326.pep
FVEYIHRRTGKIASVVPPPPPEPPKEEEPPAPAADAEPPKDEAPADGKKEEAGDNKAAEDGKGAAEAGEEKKEGAGEEDQKPGKQEGVAVDGFPPEEMMKRMVYWPYGGAPGGGIHYKLHPADAEDAMMARRMAMHAMPPPMPPPPHHHHHNPYAMMHQQWAPPPPPPPPGMPMYNSYNYGSSYMM

SEQ ID NO: 134909 - protein, 118 aa, Triticum aestivum
  Clone ID: PAT_TA_29327.pep
ERCNDTFCLPKTPQVVHGLKGASADMFLDNAEYRKFLFREFAVSTIDEESAAVVMTTTSPGVPVIVFRGVSDLAGGEPTWSSTSLMNLASINALKVAVEFIATIGRQMSTPLAQSSKN

SEQ ID NO: 134910 - protein, 132 aa, Triticum aestivum
  Clone ID: PAT_TA_29328.pep
TRARRDSIVGLGAPPSTLGRWSHRSTTKRQRAAHTALISGSHQESMRDEALKMRCRGLVTVDVRRGVPAMAPCDLRGRSSSSCARTEHAPLKNMDFFFEREEFLLKSVADFAFVFLFFVILVAYIALKDSDF

SEQ ID NO: 134911 - protein, 230 aa, Triticum aestivum
  unsure (1)..(230): unsure at all Xaa locations
  Clone ID: PAT_TA_29329.pep
MPKNKGKGGKNRKRGKNEADDDKRELVFKEDGQEYAQVTRMLGNGRCEAICVDGTKRLCHIRGKMHKKVWIAAGDIVLVGLRDYQDDKADVILKXYMNDEARLLKAYGELPDTLRPQRGRGTCNGPEEGVGRHSDYIQFEVRGTSTRSKLFSSPPPSLGYTLVFYSVLIASVSVCVGRSVGCCGLMDLVTRNRCDLRCLNNCRIIVFVVLLCFATSHLMIIMLLILFCSP

SEQ ID NO: 134912 - protein, 140 aa, Triticum aestivum
  Clone ID: PAT_TA_29330.pep
MTAPAEDKSVIIGERNRVATEKIKGAINRGYKRIAVLYGGGHMPDLGRRLREELNMVPSNVQWVTAWSIRSRELDKKSLPFLKTMAEVSGWPLNRYETLALLIFSSVLAVDLWFWEFLVESSLNWASLAGSWIDQCSAPF

SEQ ID NO: 134913 - protein, 147 aa, Triticum aestivum
  Clone ID: PAT_TA_29331.pep
SPPPPQEDECNIEEEEIHWIDDCECQENLATLLPLSPEECIIDQENHIQTTDHYLFFEELGCFTEEPEPIDPNRDYEAEAKALLEEREKTRKKHIDLQIPSLDQDTQPSGISSTCSSFHAHDLYTPHHPIYTTEKVQSYIYAHPLPI

SEQ ID NO: 134914 - protein, 390 aa, Triticum aestivum
  unsure (1)..(390): unsure at all Xaa locations
  Clone ID: PAT_TA_29332.pep
DDPPCRQTPRRRTERVPARHETGLGLEAHHGAADALGGAGPPPPLGTRAAXITCTLPTDHQRTGELPGGVTHHTGAALGLARNNSNVGQLDDLTTLKETLRVKDEELQHWTXDIRPRDATIQEIAEKLTDTAXAAEAAASAAHTIDEQRRLLCSEIERLKKAMETQMEQSMLKLRQSEEKVISLSKENDQLLKERDAAFQEAYMWRTELGKAREQAVIQEAAIARAEEKVRVSEADAAVRIKEAAENLHAAEKEKEELLALIGVLQSQVQREQSSTKQVCEERSESCSGADNSPPLTKHVDASDDDVDKACVSDSRSVLVSSESTEVQLAVDGVDIRPIGDPEWGGFQQPEALIADVREVSPEAEGSSLDIPVVNPAPANDHMQGGATHP

SEQ ID NO: 134915 - protein, 71 aa, Triticum aestivum
  Clone ID: PAT_TA_29333.pep
PAGSLGGVLIYQSFAANEEVAVSAGSPRSVFHCFEAESVQSHPLVKEGKLANLLAWRAEEDSLEEGAVLCE

SEQ ID NO: 134916 - protein, 175 aa, Triticum aestivum
  Clone ID: PAT_TA_29334.pep
MAVLSAADAPPVSAIGFEGYEKRLEITFSEAPVFADPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHIYY

SEQ ID NO: 134917 - protein, 155 aa, Triticum aestivum
  unsure (1)..(155): unsure at all Xaa locations
  Clone ID: PAT_TA_29335.pep
RTAPKSDDVYLKLLVKLYRFLVRRTKSQFNAVILKRLFMSKTNRPPLSMRRLVRFMEGKEDKIAVIVGTITDDQRVYEIPXNEGGECLTFDQLALRAPLGQNTLLLRGPKNAREAVRHFGKAPGVPHSHTKPYVRSKGRKFEKARGRRNSRGFKV

SEQ ID NO: 134918 - protein, 199 aa, Triticum aestivum
  unsure (1)..(199): unsure at all Xaa locations
  Clone ID: PAT_TA_29336.pep
MGIDLVAGGRNKRTKRTAPKSDDVYLKLLVKLYRFLVRRTKSQFNAVILKRLFMSKTNRPPLSMRRLVRFMEGKADKIAVIVGTITDDQRVYXIPAMKVAALKFTETARAKDCNAGGECLTFDQLALRASVGQNTLLLKGPKNAQETVRHFGKALEVPHNHTKPYVPVKGXRKFLRARGRREQAGPSRFKLGKFWAHLV

SEQ ID NO: 134919 - protein, 109 aa, Triticum aestivum
  Clone ID: PAT_TA_29337.pep
CTKHPPATALKTFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPAK

SEQ ID NO: 134920 - protein, 67 aa, Triticum aestivum
  Clone ID: PAT_TA_29338.pep
TNPCQSPPILLGRGLTEQSLRASGRDDFAVISYPSTYLQATADKLYNYIVLRKMISTFAILSVECIC

SEQ ID NO: 134921 - protein, 167 aa, Triticum aestivum
  unsure (1)..(167): unsure at all Xaa locations
  Clone ID: PAT_TA_29339.pep
MGIDLVAGGRNKRTKRTAPKSDDVYLKLLVKLYRFLVRRTKSQFNAVILKRLFMSKTNRPPLSLRRLVKFMDGKDNQIAVIVGTITDDKRVYEVPAIKVAALRFTETARARIVNAGGECLTXDQLALRAPLGQYTVLLRGPKNAREAVRHFGKAPGVPHSHTKPYVR

SEQ ID NO: 134922 - protein, 76 aa, Triticum aestivum
  Clone ID: PAT_TA_29340.pep
MESKGGKKSSSSSSLMYEAPLGYSIEDVRPAGGFSGGGRGAVRVICCPNVQSVELALTVCLLSFGYCEAAGQAIAL

SEQ ID NO: 134923 - protein, 181 aa, Triticum aestivum
  Clone ID: PAT_TA_29341.pep
KAVVAAQNWKVGDPFDVATNMGPQVDKEQFERVLRYIEHGKSEGATLLTGGKRAGDKGYYIEPTIFADVKEDMKIAQDEIFGPVMSLMKFKTVDEAIEKANCTKYGLAAGIITKNLDIANRVSRSVRAGTVWVNCYFAFDPEAPFGGYKMSGFGRDQGMMAIDKYMQVKSVITAVPDSPWY

SEQ ID NO: 134924 - protein, 112 aa, Triticum aestivum
  Clone ID: PAT_TA_29342.pep
EPTIFADVKEDMKIAQDEIFGPVMSLMKFKTVDEAIEKANCTKYGLAAGIITKNLDIANKVSRSVRAGTVWVNCYFAFDPEAPFGGYKMSGFGRRPARTWCSWPSLSPHRPS

SEQ ID NO: 134925 - protein, 172 aa, Triticum aestivum
  Clone ID: PAT_TA_29343.pep
ASGSLLPVTAGTAGASSAAAAGWTASGSATLASVSASLVSAGTASGSFASSVTAGAAASSFAASSAATTAGSTASTAATSTVATAGSTISTAATVVSSTATTAGSTASTATVVSSTATTAGSTASTATVVSSTTTTAGSTASTTAGAGAGASSTGIAWVAACTWTAAIGEEF

SEQ ID NO: 134926 - protein, 244 aa, Triticum aestivum
  unsure (1)..(244): unsure at all Xaa locations
  Clone ID: PAT_TA_29344.pep
NLKTVSLELGGKSPLIIFDDADVDMAVELSRLAIFFNKGEVCVAGSRVYVQEGIYDEFVKRAVVAAQNWEXSGDPFDVATNMGPQVDKEQFERVLRYIEHGKSEGATLLTGGKPASDKGYYIEPTIFADVXEDMKIAQDEIFGPVMSLMKFKTVDEAIEKANCTKYGLAAGIITKNLDIANRVSRSVXRAGTVWVNCYFAFDPEAPFGGYKMSXGFGRDQGMMAIDKYMQVKSVITAVPDSPWY

SEQ ID NO: 134927 - protein, 110 aa, Triticum aestivum
  Clone ID: PAT_TA_29345.pep
KFFYRAPKIKSPGRGLKTWEREKPGGTQIKSLGKKSPFPQWGKNQKGPPQSPFQKFAHPKGKREPPLKGPINPGGGGGSPQGNRYICKALSPRSFGFFPFFFGKVRGFPP

SEQ ID NO: 134928 - protein, 187 aa, Triticum aestivum
  unsure (1)..(187): unsure at all Xaa locations
  Clone ID: PAT_TA_29346.pep
MGIDLVAGGRNKRTKRTAPKSDDVYLKLLVKLYRFLVRRTKSQFNAVILKRLFMSKTNRPPLSMRRLVRFMEGKADKIAVIVGTITDDQRVXKIPAMKVAALRFTETARARIVNAGGECLTFDQLALRAPLGQNTLLLRGPKNAREAVRHFGKAPGVPHSHTKPYVRSKGRKFEKARGRKNSTGFKV

SEQ ID NO: 134929 - protein, 187 aa, Triticum aestivum
  unsure (1)..(187): unsure at all Xaa locations
  Clone ID: PAT_TA_29347.pep
MGIDLVAGGRNKRTKRTAPKSDDVYLKLLVKLYRFLVRRTKSQFNAVILKRLFMSKTNRPPLSLCRLVKFMDGKDNQIAVVVGTITDDKRVYEVPAIKVAALRFTETARARIVNAGGECLTFDQLALRAPLGQNTVLLRGPKNAREAVRHFXKAPGVPRSHTKPYVRSKGRKFEKARGRRNSRGFKV

SEQ ID NO: 134930 - protein, 184 aa, Triticum aestivum
  unsure (1)..(184): unsure at all Xaa locations
  Clone ID: PAT_TA_29348.pep
KWHIYYATEQPEQPMVTLEMCMTGLDKKKASVFFKTQADGHVSXCAKEMTKLSGISDIIPEMEVCDFDFEPCGYSMNAINGSAVSTIFGGRGHAATWGKKLEAEAYDCNNVVEQELPCGGVLIYQSFAANEEVAVSAGSPRSVFHCFEAESVQSHPLVKEGKLANLLAWRAEEDSLEEGAVLCE

SEQ ID NO: 134931 - protein, 233 aa, Triticum aestivum
  unsure (1)..(233): unsure at all Xaa locations
  Clone ID: PAT_TA_29349.pep
KWHIYYATEQPEQPMVTLEMCMTGLDKKKASVFFKTQADSHVSCAKEMTKLSGISDIIPEMEVCDFDFEPCGYSMTAINGSAVSTIHVTPEDGFSYASYEVMGMDASALAYGDIVKRVLRCFGPXSEFSAAVTIFGGRGHAATWGKKLDAEAYDCNNVVEQELPCGGVLIYQXSFTVNEEXAVSAGSPRSVFHCFXEAETVPTPPLVKEGKLANLLAWGGEEDSLEKGPVLCE

SEQ ID NO: 134932 - protein, 187 aa, Triticum aestivum
  Clone ID: PAT_TA_29350.pep
MGIDLVAGGRNKRTKRTAPKSDDVYLKLLVKLYRFLARRTKSQFNAVILKRLFMSKTNRPPLSLRRLVKFMDGKDNQIAVVVGTITDDKRVYEVPAIKVAALRFTETARARIVNAGGECLTFDQLALRAPLGQNTVLLRGPKNAREAVRHFGKAPGVPHSHTKPYVRSKGRKFEKARGRRNSRGFKV

SEQ ID NO: 134933 - protein, 92 aa, Triticum aestivum
  Clone ID: PAT_TA_29351.pep
LFSPTNLSGLLLHLFLSALLSDSKLQQWLPLIYQSFAANEEVAVSAGSPRSVFHCFEAETVESHPLVKEGKLANLLAWRAEDSLEEGVVLCE

SEQ ID NO: 134934 - protein, 187 aa, Triticum aestivum
  Clone ID: PAT_TA_29352.pep
MGIDLVAGGRNKRTKRTAPKSDDVYLKLLVKLYRFLVRRTKSQFNAVILKRLFMSKTNRPPLSMRRLVRFMEGKADKIAVIVGTITDDQRVYEIPAMKVAALRFTETARARIVNAGGECLTFDQLALRAPLGQNTLLLRGPKNAREAVRHFGKAPGVSHSHTKPYVRSKGRKFEKARGRRNSRGFKV

SEQ ID NO: 134935 - protein, 108 aa, Triticum aestivum
  unsure (1)..(108): unsure at all Xaa locations
  Clone ID: PAT_TA_29353.pep
LFSPTIFGGRGHAATWGKKLDAEAYDCNNVVEQELPCGGVLIYQSFTVNEEVAVSAGSPRSVFHCFEAESVHSHPLVKEGKLANLLXAWAGGGGFSGKEGAVLCELKT

SEQ ID NO: 134936 - protein, 253 aa, Triticum aestivum
  Clone ID: PAT_TA_29354.pep
GPSSLSFTMPSAASRLVRIGRAARSAAATTSRFAQFVEAATLSTKAVATKPHAILGSDRAASVDLRMNQSTVHAPPRAMAPASLTLSHPEEQRQEGKVKFVVEEKDLESEAALWALYERWCKDFNQKRDHDEMVHWFNTFKETVLLVHRRNNANLPYKLGINKFADGKLRKLCRCHDPILKKIDEEFGDKPGEFILGDGDKLLKRVFADYKVVHGRLYVHLPKGVDVETITTNPEWVELEATTNPPYRYPTYI

SEQ ID NO: 134937 - protein, 205 aa, Triticum aestivum
  Clone ID: PAT_TA_29355.pep
LDIVRSYVAYNTRPDDDDRPLTKYAHTYGPNNKRTRYGAMACQGTRTEASQRPAEEARSDPRASTHSVALLAAAAAAGASAGTASAAVGASTGASAGASAAGSLTSASASPAADGASVSTGAASTATATSTGASAVAASSCTATTASGAAASSTAGVSSATGSLASASAAAGSATLVSVSAGAASCSGSLVSTSAGAASRSTTSV

SEQ ID NO: 134938 - protein, 187 aa, Triticum aestivum
  Clone ID: PAT_TA_29356.pep
MGIDLVAGGRNKRTKRTAPKSDDVYLKLLVKLYRFLVRRTKSQFNAVILKRLFMSKTNRPPLSMRRLVRFMEGKADKIAVIVGTITDDQRVYEIPAMKVAALRFTETARARIVNAGGECLTFDQLALRAPLGQNTLLLRGPKNAREAVRHFGKAPGVPHSHTKPYVRSKGRKFEKARGRRNSRGFKV

SEQ ID NO: 134939 - protein, 226 aa, Triticum aestivum
  Clone ID: PAT_TA_29357.pep
MQFYSDSFSPTNLSGLLLHLFLSALLSDSKLQQWLPRPLRSDLRATRSALRSPSLRHQSLLTLMVVACAPSPGPRLTLFLILHGAPLCPSSPTRTLTRTCYPSRACLSTLRRLTLFLIFGPSEFSVAVTIFGGRGHAATWGKKLDAEAYDCNNVVEQELPCGGVLIYQSFAANEEVAVSAGSPRSVFHCFEAETVESHPLVKEGKLANLLAWRAEDSLEEGVVLCE

SEQ ID NO: 134940 - protein, 162 aa, Triticum aestivum
  Clone ID: PAT_TA_29358.pep
IDCNILQLVTQYHHCFPCHKTRRASIYDLNTLTTTAHEPSSRHTIFVNLSTFNDNEIANFYQRIATKLTLQLPGHHHAHRCQSDQPAGSQHHLHDLSRLYHRLCLQNQIDSCCTHSNYQTLMRPVLLFIVTTSPCQDWVICAPAAFLGCGSRFSGSLSGIEP

SEQ ID NO: 134941 - protein, 353 aa, Triticum aestivum
  Clone ID: PAT_TA_29359.pep
MSRHAHGSQPARQRLAHGARSHPRASTHSVALSAAAAAAGASAGTASAAAGASTGASAGAASSCTDDASAAVAAGAASSWTGASATGSLTSASASAAAAAGASVSTGAASTATAGSTGASAVAASSCTATTASGAAASSSAGVSSATGSLASASAAAGSASLVSVSAGAASCSDSLVSTSAGAASRSTTLVSVPSAGAASGSLVSVTAGTAGASSAAAAGWTASGSVSLASVSASLVSAGAASGSFASSVTAGATASSFAASSAATTAGSTASAVATSTVSTAGSTIATAATVVSSTVTMAGSTTSTATVVSSTTTTAGSTASTTAGAGAGASSTGIAWVAAWTWTAAIGEEF

SEQ ID NO: 134942 - protein, 189 aa, Triticum aestivum
  unsure (1)..(189): unsure at all Xaa locations
  Clone ID: PAT_TA_29360.pep
MGIDLVAGGRNKRTKRTAXPKSDDVYLKLLVKLYRFLVRRTKSQFNAVILKRLFMSKTNRPPLSMRRLVRFMEGKEDKIAVIVGTITDDQRVYEIPAMKVAALRFTETARARIVNAXGGECLTFDQLALRAPLGQNTLLLRGPKNAREAVRHFGKAPGVPHSHTKPYVRSKGRKFEKARGRRNSRGFKV

SEQ ID NO: 134943 - protein, 343 aa, Triticum aestivum
  Clone ID: PAT_TA_29361.pep
TNWVRCHGHARTRARKPGQRLAHGARSHPRASTHSVALSASAAAAGASAGTASAAAGASAGASAGAASSCTDDASAAVAAGAASSWTGASATGSLASASASAAAAAGASVSSGAASTATAASTGASAVAASSCTATTASGAAASSSAGVSSATGSLASASAAAGSASLVSVSAGAASCSGSLVSTSAGAASRSTTSVSVPSAGAASGSLVSTTAGAAGASSAATTGWTASGSASLVSAGTASGSFASSVTAGAAASSFTASWGATTAGSTASTAATSTVATAGSTISTAATVVSSTTTTAGSTASTATAAVSTASTAAGAGASSTGMAWVAAWTWTAAIGEEF

SEQ ID NO: 134944 - protein, 223 aa, Triticum aestivum
  unsure (1)..(223): unsure at all Xaa locations
  Clone ID: PAT_TA_29362.pep
MAAPTSAIGFEGYEKRLEITFSEASIFADPHGRGLRALSRAQIDSVLDLARCTIVSELSNKDFDSYVLSESSLFIYSQKIVIKTCGTTMLLLTIPRILELAEELCMPLAAVKYSRXGMFIFPGAQPAPHRSFSEEVDVLNRYFGHLKSGGNAYVIGDPAKPGQKWHIYYATEQPEQPMVTLEMCMTGLDSGRTYESKSLLESSDTMVHRARSRTESIWALERA

SEQ ID NO: 134945 - protein, 391 aa, Triticum aestivum
  Clone ID: PAT_TA_29363.pep
MAAPTSAIGFEGYEKRLDITFSEASIFADPHGRGLRALSRAQIDSVLDLARCTIVSELSNKDFDSYVLSESSLFIYSQKIVIKTCGTTMLLLTIPRILELAEELCMSLAAVKYSRGMFIFPGAQPAPHRSFSEEVDVLNRYFGHLKSGGNAYVIGDPAKPGQKWHIYYATEQPEQPMVTLEMCMTGLDKKKASVFFKTSADGHVSCAKEMTKLSGISDIIPEMEVCDFDFEPCGYSMNAINGSAFSTIHVTPEDGFSYASYEVMGMDASALAYGDIVKRVLRCFGPSEFSVAVTIFGGRGHAATWGKKLDAEAYDCNNVVEQELPCGGVLIYQSFAANEEVAVSAGSPRSVFHCFEAETVESHPLVKEGKLANLLAWRAEDSLEEGVVLCE

SEQ ID NO: 134946 - protein, 393 aa, Triticum aestivum
  unsure (1)..(393): unsure at all Xaa locations
  Clone ID: PAT_TA_29364.pep
MAAPTSAIGFEGYEKRLEITFSEASIFADPHGRGLRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPAKPGQKWHIYYATEQPEQPMVTLEMCMTGLDKKKASVFFKTQADGHVSCAKEMTKLSGISDIIPEMEVCDFDFEPCGYSMNAINGSAVSTIHVTXPEDGFSYASYEVMGMDASALAYGDIVKRVLRCFGPSEFSVAVTIFGGRGHAATWGKKLEAEAYDCNNVVEQELPCGGVLIYQSFAANEEVAVSAGSPRSVFHCFEAESVQSHPLVKEGKLANLLAWRAEEDSLEEGAVLCE

SEQ ID NO: 134947 - protein, 392 aa, Triticum aestivum
  Clone ID: PAT_TA_29365.pep
MAAPTSAIGFEGYEKRLEITFSEASIFADPHGRGLRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPAKPGQKWHIYYATEQPEQPMVTLEMCMTGLDKKKASVFFKTQADSHVSCAKEMTKLSGISDIIPEMEVCDFDFEPCGYSMNAINGSAVSTIHVTPEDGFSYASYEVMGMDASALAYGDIVKRVLRCFGPSEFSAAVTIFGGRGHAATWGKKLDAEAYDCNNVVEQELPCGGVLIYQSFTVNEEVAVSAGSPRSVFHCFEAESVHSHPLVKEGKLANLLAWRAEEDSLEEGAVLCE

SEQ ID NO: 134948 - protein, 91 aa, Triticum aestivum
  Clone ID: PAT_TA_29366.pep
MARVASSCATLVAQRRWVSSAITAIGVSAKKVEEKAVKLGTVATEDTTEDKTAFWKPDPKTGDYRPVTSTKEVDPADLRAEMLKRRLLQQQ

SEQ ID NO: 134949 - protein, 60 aa, Triticum aestivum
  Clone ID: PAT_TA_29367.pep
CQKCSYIMGQREYYLYIIELRYYNILSRVIRVFSSKLNPRCLTFSLKSIKNIKFTKKKKK

SEQ ID NO: 134950 - protein, 260 aa, Triticum aestivum
  unsure (1)..(260): unsure at all Xaa locations
  Clone ID: PAT_TA_29368.pep
MAAPVVDAEYLRQVDRGRRALRALIASKGCAPIMLRLAWHDAGTYDVNTRTGGANGSIRYEEEYTHGSNAGLKIAIDLLEPIKAKHPKITYADLYQLAGVVAVEVTGGPTVEFIPGRRDSSVCPREGRLPDAKKGAPHLRDIFYRMGLTDKDIVALSGGHSLGKAHPERSGFDGAWTRDPLKFDNSYFLELLKGESEGLLKLPTDKALLDDPEFRRYVELYAKDEDAFFKDYAESHKKLSELGFTPRISGAASTXSDVST

SEQ ID NO: 134951 - protein, 144 aa, Triticum aestivum
  unsure (1)..(144): unsure at all Xaa locations
  Clone ID: PAT_TA_29369.pep
DKCIVALSXGGQSLGKAHPERSGFDGAWTRDPLKFDNSYFLELLKGESEGLLKLPTDKALLDDAEFRRYVELYAKDEDAFFKDYAESHKKLFELGFTPRISGLASTKSDVSTAVVLAQSAVGVAVAAAVVIAGHTCTRLPKRSK

SEQ ID NO: 134952 - protein, 332 aa, Triticum aestivum
  Clone ID: PAT_TA_29370.pep
MATEPVEFQVVVLRVSIHCEGCKKKVKKVLLHIDGVYRCDIDARRNRVAVTVSPKIDAGILVARLRKSGKLAEPWPEEPKQQQEPPPPAESQSQEAKNQADDASKPNEAAEYGAPPPSTAQPPAPEPEKTAEETPPPAEESKGPDEAKAETGPHQQPSEANGKAKQQQQHQEQHDHHDKPMDARVTMEYDDARSRGVYGYGGPHQYMPATRQPPVHVMSYNVARPMASSSYYAAAPTPAAMPTPMARPGPSHGGYIDEYAPPNYYSRPAPSAYEPYYYPDPQPSPYQHQRSAAEDYYYGAPPPPPQRSAFSPPREAYGDMFNDENANSCSVM

SEQ ID NO: 134953 - protein, 98 aa, Triticum aestivum
  Clone ID: PAT_TA_29371.pep
RTRGFVNGDWNTGGSCGNSVPFSNGSEVLQDHSSDLPAERAVNGTQVKLLDITSTSQLRDEGHISNRTFRAPTGIHDCLHWCLPGIPDMWNELLFAQI

SEQ ID NO: 134954 - protein, 136 aa, Triticum aestivum
  Clone ID: PAT_TA_29372.pep
WSRTRRDSNHRRSSAERTAPPRSTHVQPGDVSHALIQQGERERLRKTPSSSSTTAWWWWRSVAIQQGFAKHRGRGGVGREVGLYQEGENSCVWQPQTSSIYRGKGGCAPFRVSHPQGVRPALDGKGAAAKGGFSPP

SEQ ID NO: 134955 - protein, 207 aa, Triticum aestivum
  Clone ID: PAT_TA_29373.pep
MAPEESTVSSRWGEVKRVTKETNVHVKINLDGTGVANSSTGIPFLDHMLDQLASHGLFDVYVKATGDTHIDDHHSNEDIALAIGTALLQALGDRKGINRFGHFTAPLDEAAVEVILDLSGRPHLSCGLSIPTERVGTYDTQLVEHFFQSLVNTSGMTLHIRQLAGNNSHHIIEATFKAFARALRQATEYDLRRQGTIPSSKGVLSRS

SEQ ID NO: 134956 - protein, 278 aa, Triticum aestivum
  unsure (1)..(278): unsure at all Xaa locations
  Clone ID: PAT_TA_29374.pep
MVESPYRLRHRRLMDTAPATAGGDPAPGHGSSGMPIMVSILVVVIICTLFYCVYCWRWRKRNAVKKAHLERLRPLSNSDLPVMDLPTIAAATNGFSKENKLGEGGFGPVYRGVLDGGAEIAVKRLSARSRQGAAEFRNEVELIAKLQHRNLVRLLGCCVDMDEKMLVYEYLPNRSLDAFLFGTRKTAHLDWKMRQSIVVGIARGLLYLHEDSCLKIVHRDLKASNVLLDNKMNPKISDFGMAMIFEXKEIEVVNTGHVVGTYGYMAPEYAMGGIFSVK

SEQ ID NO: 134957 - protein, 145 aa, Triticum aestivum
  Clone ID: PAT_TA_29375.pep
GIISLSKGFDLSGLFEKDQEQKSNSRFMTQKPASAIVSKLEQIAETESFKVKKQDGLVTLQGSKEGRKGQLAIDAEIFEVTPSFYVVEVKKSAGDTLEYERFCKMGLRPSLKDICWNGPSEEKLPSVSESVPPTPSSKSTKRNVI

SEQ ID NO: 134958 - protein, 102 aa, Triticum aestivum
  Clone ID: PAT_TA_29376.pep
SARPTQHHQRQAGGGAPDRGGLYFRRPDSTGGAGIAEGGAGAGEAALSGGDRLSVHVCVYFLSCVSNTLSPTRRSSCTLYAVATCITWSVIVRCTVLFSPSE

SEQ ID NO: 134959 - protein, 191 aa, Triticum aestivum
  unsure (1)..(191): unsure at all Xaa locations
  Clone ID: PAT_TA_29377.pep
MSAKAGKPLVQTDAGAYIAWSGADQPELATEGLGCGLLVLRPLGFALPHYADSNKFGYVLGGSGVAGVLPVDAKERVVRLKAGDVIAVRTGDVSWWYNDNDGHADDLSILFIGDTGRALSPGDISYFFLAGGNSVLSGLDAGLLXRAWPGVTEEQAATAFRSQPAXLLTRLSAKLPGVCPREHDRKGLVVN

SEQ ID NO: 134960 - protein, 122 aa, Triticum aestivum
  Clone ID: PAT_TA_29378.pep
APVFFFLYFFFFFFFFFFFFFFFFFFFFFFFFFFFFLWYLTLLFGEEIKGQVQRIITDRVIHDAAAYKRARRSSCWRKRISHRRQKVNAHVHRDSVTTAQSSFTSSGATFSDACTHASAHAS

SEQ ID NO: 134961 - protein, 241 aa, Triticum aestivum
  Clone ID: PAT_TA_29379.pep
NDNDNEGSADDLSILFIGDTARAVSPGDISYFFLAGGNSVLSGFDAGLLTMAWPGVTEEQAATAFRSQPAVLLTRLSAKLPGVCPREHDRKGLVVNAGHVAAGTLKMLTASDLDALGGFGFSAVLGRLEPGAARAPWVLREGAAQAVYVARGSARVQVSSAVGGDTLLLDEDIAAGSLFVVPRFAVALVAAGADGVEWVSLIKSARPAVEHLIGEGSIFGGLTPQVVQASLKVAPELVKLL

SEQ ID NO: 134962 - protein, 202 aa, Triticum aestivum
  Clone ID: PAT_TA_29380.pep
PRVRRRELVKLRRDLAMPVFDIGPLHLFSPAAAAESSLLRQDRSCLKWLDARPAASVLYVSFGSLACMSARDLVETAWGIAGSGVPFLWVVRPGLVAARRLTRLPCRFEEATRGRGMVVEWATSSKVRRHAAVAGFWTHGGWNSTTEGVCEGVPMLCRPHFGDQMGNARYVEHVWRVGFAFAGALKSGGVEGATVAISPLSI

SEQ ID NO: 134963 - protein, 317 aa, Triticum aestivum
  Clone ID: PAT_TA_29381.pep
MPPSQKPAGHVVSMPPAPKPVERVVSMPPSQKPAGQVVSVPPPPPKPVERVVSMPPSQKPAGNVVSMPPASKPVERAVSMPPSQKPVGRVASMPPSPKPTEQHVSLPPSAKPAAQVAPPPSPKPSGYEAPPPSPPKPAAHVAVPPSPKPSSHYTVPPSPTPAGHVATMPSSSPKPPVHAVPPSSKTSTHVTAVPPSPKPSGGHVSMPPSPAPYGQVVSMPPSPAPYGQVVSMPPAPKPAAPVVVSPPPKPANLPADHNPSMEFGWGLGAGLVSGAISGMLAGGNKGEPTAYAPQVAPLARSRQVSVSKTYGRDVYTH

SEQ ID NO: 134964 - protein, 115 aa, Triticum aestivum
  Clone ID: PAT_TA_29382.pep
YQSKRQSHKAYFEKSDLFFVCILRPHSFDITKQESEIEDAQWMPVEEFAAQPFVQKHELVKYILEVGLAKTDKEYAGFSPISIKSAFSEKQSLFYMNRRDLEKASGPIINTQKDS

SEQ ID NO: 134965 - protein, 255 aa, Triticum aestivum
  Clone ID: PAT_TA_29383.pep
MPDMQPLISDFVLKLKRRKVEGSHAVARQTAELLRSVVSQHRMGSTNQAAALADAIHAVGEHLIAANPIELAVGNTVRRVLHIIKEEDISFTAVGIEGLSVTAVSDDECDSGNDDRPTLSAAVLASHARNALRAPSLQTLLDDIPVSTALTHSSSSAGDSDGKTGDKSLKTRKLKHDVIAAIGDLIEEIDTCYDQISEQAVEHIHQNEVILTLGRSRTVKEFLYAAKEKKRSFRVFVAEGAPRYQGHALAKELVE

SEQ ID NO: 134966 - protein, 236 aa, Triticum aestivum
  unsure (1)..(236): unsure at all Xaa locations
  Clone ID: PAT_TA_29384.pep
MNVKKKWMDESHLQIKSKTKSWVNEEDEXKEXISIEIDAKVVEKEEVSSYGSKYAGKVKETKKEGKNKDSAKKQDEHKEIGDKDEQGNKKDTEKKDKKKDKTDRKGGGKKKDGDDEKEEGKKDKEAKEKKKDKTGKEETKKKKKDGEDGEEEGKKKDKEKKKDKGGKEKTNDPAKLKKKLEKIDAKLQDLHAEKEDILRQLKELEEGMTTEEKKPVQIVEASGKAKSKEDDLVTAP

SEQ ID NO: 134967 - protein, 180 aa, Triticum aestivum
  unsure (1)..(180): unsure at all Xaa locations
  Clone ID: PAT_TA_29385.pep
LSEGQLNAYXEESYFTGMVDVELSAIKKACASLDPCYSPRVTFVVVQKRHHTRLFSDNYDVVSTIYGSGNVLPGTVIDKEVCHPTDFDFYLCSHAVTKGVSRPVRYHVLWDENKFTANALQTLTNHLCYTYARCTSSVSVVPPVYYAHLLASRGRLYIKRGHEGSFPVLSENVKGVMFFC

SEQ ID NO: 134968 - protein, 201 aa, Triticum aestivum
  Clone ID: PAT_TA_29386.pep
AGKVHDYGAPSAYSPPGNAYPPQSAYPQAAKADGAATAGAYPPPSGYPPAGKTGEPSTAYPAPAGYPPAGPSGKPAKAGEPVTAYPAAAAGPSTGAPYGAPPPQYGYGYPPQQPAGYGYPPPPPQGGYGGYGYPPQQPAGYGYQQQAVKPPKKSGMGMGLGAGLLGGALGGLLIGDMISDSAGGYDGGYDGGFDDGGGFDF

SEQ ID NO: 134969 - protein, 228 aa, Triticum aestivum
  Clone ID: PAT_TA_29387.pep
VFLEQRCKIDYSTCDREVLLISLRLILSEYSLENAFTDEELNTLCTTWFKLQPFQDSTSSLQKIKQLDGMFAVSISCGFKLCTLMKVARHAGLNWHAQLTGDVFAACIARDNFTDIRSTSTTVLSNAAMLCCLKDPSELAVVSSNPEILQAAKQNGAKTVLIDRQESIPAQDFDIHFDGLDIFAESYEAFVETKAVTKVEAPVTRSWFQRVVATVADAAETVTNAVIG

SEQ ID NO: 134970 - protein, 86 aa, Triticum aestivum
  Clone ID: PAT_TA_29388.pep
FITHRDFRLFDFHLIQLNGEKRIKGGWTPAGVHHCRFVTCRFLRTSGDHLGGQERHRKAEALSFAVHPDPASALKSHVDARAMRLP

SEQ ID NO: 134971 - protein, 167 aa, Triticum aestivum
  Clone ID: PAT_TA_29389.pep
LPLPDEITDLGNGIRPSHSIIIRLAFVQLQLQYDPGGGGGEGAAMVKDTAYYDTLGVSTDAPAAEIKKAYYLKAKLVHPDKNPGNPDAARKFQELGEAYQVLSDPAKRESYDKHGKEGLSQDNMIDPTAVFGMLFGSDYFEDYVGQLALASVASVESEEDSDTPEAR

SEQ ID NO: 134972 - protein, 172 aa, Triticum aestivum
  Clone ID: PAT_TA_29390.pep
MMRKKRSGGGMDATVDELSAAYKEFVAAAVAVMEAREQSGGQKTAATDAALEAFKQRWELFRVSCDHAEELVESIRQRIGSECLVDEATGSSSSSSAPASVALAAPGIKPISAVRLEQMSKAVRWLVIELQHGAGGPSAAGPGGGVSTPAAGAGGQHVHGGVGSRFPEDGTQ

SEQ ID NO: 134973 - protein, 128 aa, Triticum aestivum
  unsure (1)..(128): unsure at all Xaa locations
  Clone ID: PAT_TA_29391.pep
LSIPEGVKVNIKSRQITVXGPRGVLTKNLRHLAIEITVVDKKIRFVVHHGLRKHVACIRTVRSLVNNMIVGVTKGFQYKMRXVYAHFPIDVIINDQGNAVEILNFLGQKVVFNVPLREGVKALSLPRL

SEQ ID NO: 134974 - protein, 76 aa, Triticum aestivum
  Clone ID: PAT_TA_29392.pep
NVKMKSNRGHRRELIHRRWLKKKKKKKKKKKKKKNKKKKKKKKKKKKKKKDGKKEEKKKKKGGPPKGSKFYFPVKE

SEQ ID NO: 134975 - protein, 139 aa, Triticum aestivum
  Clone ID: PAT_TA_29393.pep
DACDYSPAAAELAITVGASTIKDERAYFSNYGKCVDVFAPGYNILSIWKGSRYATNTISGTSMAAPHVAGLAAYYLSLEEDATAEKIKEKILSTATKDILDGIPSDTPNLLINNGAENNTKKKIIHGIDSVLKDFFGDI

SEQ ID NO: 134976 - protein, 76 aa, Triticum aestivum
  unsure (1)..(76): unsure at all Xaa locations
  Clone ID: PAT_TA_29394.pep
LKSYENPKNKVTAVPADEEEICGAXPSWWKGLPLSRHFSRRFSRLRRWAKQATPFVWWWCNIMQQGACATLLCDLM

SEQ ID NO: 134977 - protein, 82 aa, Triticum aestivum
  unsure (1)..(82): unsure at all Xaa locations
  Clone ID: PAT_TA_29395.pep
SNPXQSTSSHCKINRSSWPNKTQISEKKYEAISNHAYKRSKKFQITFMNKNIDLIINSKFIGSQQTHRKKTYIIWISKRPLY

SEQ ID NO: 134978 - protein, 116 aa, Triticum aestivum
  Clone ID: PAT_TA_29396.pep
SQEINTKRSPNVVKLFVDFFGPKDIQWAEEAPGGCSKGSTTHQGAPGGPGAPWWVVPTSDAPRTASLLYKYPNIPETIGESMKITSSPESRTTRSNLDTITEGFTTSIGASPMMRE

SEQ ID NO: 134979 - protein, 234 aa, Triticum aestivum
  Clone ID: PAT_TA_29397.pep
MKPCVAFVQHQCSPVRTPFPQTRGEQHSSCQTVQHQCCRQLVQIPEQARCKAIQSVEEAIIQQQPQQQWNEPQQEAHLKSMRMSLQTLPSMCNIYVPVQCQQQQQLGRQQQQQLQEQLKPCATFLQHQCRPMTVPFPHTPVQKPTSCQNVQSQCCRQLAQIPEQFRCQAIHNVVESIRQQQHHQPQQEVQLEGLRMSLHTLPSMCKIYIPVQCPATTTTPYSITMTASYTDGTC

SEQ ID NO: 134980 - protein, 292 aa, Triticum aestivum
  unsure (1)..(292): unsure at all Xaa locations
  Clone ID: PAT_TA_29398.pep
SGCSWFEPGVLGVWSGEVVGVPAEXAGPGAWTPSPKTRASVAAXNARPQPDADPAVSVWLGIAXGNHAYSHXANQSLLLPRSFXAAYDEIFWVFEGXVLDNLGRFSQAVLASPRGGNEVLLVIEAYKTLRDRAPYPAXFMLSQLTGSYAFRALXHKSTSSLLVGIRAPEGKGANCFWGITRLTAPVRLSPDILXTLLQGTFGGKSLAPFPVKVGFYXWKASLGXGLKFGAENPKNMVTAGPAXEEEMRGVPFMWKDLPLVAAFFMGGDLPSPVAGQKQAATGFSCIGWLRVI

SEQ ID NO: 134981 - protein, 166 aa, Triticum aestivum
  unsure (1)..(166): unsure at all Xaa locations
  Clone ID: PAT_TA_29399.pep
LSCALPCQVTLSGLLNMVDGLWSSSGHERILIFTTNHKDRLDPALLRPGRMDMHVHMGYCGFVAFRELAANYHGIQDHRLFPEIEALLREVXEVAPAEVAERLLMTDDAXPAVEMAAKLLRDRKAGTXEDGGYIKQNLHVGPKRPRRPPAARQAVLDREFGGGPHD

SEQ ID NO: 134982 - protein, 302 aa, Triticum aestivum
  Clone ID: PAT_TA_29400.pep
MRMEGGGAGAGGGGHGGGHGLGGEAQIKGTLTHGGRYVQYNVYGNLFEVSAKYVPPIRPVGRGACGIICAAVNAQTREEVAIKKIGNAFDNQIDAKRTLREVKLLRHMNHENVISIKDIIRPPRRENFNDVYIVYELMDTDLPHLLRSNQPLTDDHCQYFLYQVLRGLKYVHSAKVLHRDLRPSNLLLNAKCELKIGDFGLARTTTETDFMMEYVVTRWYRAPELLLNCSEYTAAIDIWSVGCILGEIAMREPLFPGKDYVHQLRLITEVWPLTTTRVKILFFPFCSFSSFGYSPALFFLGV

SEQ ID NO: 134983 - protein, 260 aa, Triticum aestivum
  Clone ID: PAT_TA_29401.pep
MHSNGFSGFLPPSLSSLSSLRELNLRNNSMSGPIARVSFSDMPLLASLDFSTNSLTGWIPTSLAGCGELKSLNLANNILVSTIPSWIGEFDNLWYLILSNNSFVGEVPKSLLRLKGLATAGRSSGMVFINMPSFVNHERRALDEQPNTITGTNNTVRSGRNNTMSGNDNIVMSGDSNTVSGSFNTLVCGNNNILSGDHHVVSGSNHIVTNSFNKVTGCTNNVSGSNHTVSGSNNTVTGSSNTVSGNNHVVSGSNRVVTGD

SEQ ID NO: 134984 - protein, 163 aa, Triticum aestivum
  Clone ID: PAT_TA_29402.pep
MAGIRRAPALLLLLALACTPALAARDVSSSAAKAKTKYPSGPAPGKKPAKPYVPPATKPPGSGAVDGGGMPAIPGFGTIPGFTVPGMGGGWGGGYGGPDGGYSRGGVAASTTVCSEKGPCYKKKLTCPKKCFSSYSGAGKGYGGGGGGGGCTVDCKTKCIAYC

SEQ ID NO: 134985 - protein, 160 aa, Triticum aestivum
  Clone ID: PAT_TA_29403.pep
MAGVRRAAALLLLLGLACTPALAARDAAQAKPKHPSGPAAGKKPAKPYVPPATKPPGSGGVGGGGGMPNIPGIGTIPGFTVPGMGGGWGGGYGGPDGGYSRGGVVASTTVCSEKGPCYKKKLTCPKKCFSSYSGSGKGYGGGGGGGGCTVDCKTKCIAYC

SEQ ID NO: 134986 - protein, 399 aa, Triticum aestivum
  Clone ID: PAT_TA_29404.pep
AGGHIDIVNLLLETDASLAKIARNNGKTVLHSAARMGHVEVVRSLLNKDPGIGLRTDKKGQTALHMASKGTNAEIVVELLKPDFSVSHLEDNKGNRPLHVATRKGNIVIVQTLLSVEGIDVNAVNRSGETALAIAEKMNNQELVNILRDAGGVVTAKEPVHPANPAKQLKQTVSDIRHDVQSQIKQTRQTKMQVQKIKSRLEKLHIGGLNNAINSNTVVAVLIATVAFAAIFTVPGNFVEDMSQAPPGMSLGQAYVASEPAFIMFLVFDSLALFISLAVVVVQTSLIVVEQKAKRRMVFVMNKLMWLACLFISAAFIALTYVVVGRGDWWLAWCTMAIGAVIMLTTLGSMCYCIVAHRMEEKSMRKIRKASASQSRSWSMPVDSDPDLINTEYKKMYAL

SEQ ID NO: 134987 - protein, 253 aa, Triticum aestivum
  unsure (1)..(253): unsure at all Xaa locations
  Clone ID: PAT_TA_29405.pep
LLLLCFASLPSHPRIASLLSSPLAGDDSPFFTPRRKKKEKERKKMADSGGGSDWEVVSLTASTYAAAPGPIQVSPLLHAAHKTAESPLLLLPNPPAPPAHFFMSQHFNLPPLFTSTHPGNNKGGQELQESGPAVPDGDASDDADGLNMPISPENYCHSESEREDVLLLASPAGNGLGLQVEGGGDQLQPTTTPCSLPDVAAGSDAAAPAPASGGVAGNAAXAQKIGCAATEPLGQAKVSMLGGGGPVSQQGVN

SEQ ID NO: 134988 - protein, 193 aa, Triticum aestivum
  Clone ID: PAT_TA_29406.pep
LVQLRSAGNAAPGSPPLPPPPSPRRSAPRAGSRTRSEGGNCRTAAAPPTAGGSRSRRAQTTKHPAHPNPCPPSPPPPNHLSPPPSSFAANPSIASLLPLAGDDSPLPAGKKERERKWRTAAAATGRWCRSRPPPTPPPQDQSRPSTTPLTKQSRLFFSSQILPLPLHISSCPSTSICHRFSVPILRIIAEAKN

SEQ ID NO: 134989 - protein, 130 aa, Triticum aestivum
  Clone ID: PAT_TA_29407.pep
RHPLTLAPGQAARPPAQARDGRLGHRLRGRRVRRPGSHHRLRDGRVLAAHGAHIIMAVRNLAAAEAVRQVVLAETPVASLNLIELDLSPLTSIRNFAANFADRGLPLNILMTIQHTPALSEREGFPLMDT

SEQ ID NO: 134990 - protein, 214 aa, Triticum aestivum
  Clone ID: PAT_TA_29408.pep
LQWAMANLVTRPDIQAKLRAEINSVADRTFREEEHLEINRVADGEVREEEHLPRFILPHAAAGENGTVLDGFLVPKAVSVNFTLGDMFIDKKVWPDPTQFRPERFLPEGEGENLDLTGSKEIKMMPFGAGGEGENLGLTGSKEIKMMPFGAGRRMCPGIDVSLLHVNLLVATMVRAFQWSEVPGEPVDFTETLELTIVMKRPLRAKVVPCHATS

SEQ ID NO: 134991 - protein, 147 aa, Triticum aestivum
  Clone ID: PAT_TA_29409.pep
MASKRIQKELKDLQKDPPTSCSAGPVGEDMFHWQATIMGPSDSPYSGGVFLVTIHFPPDYPFKPPKVAFRTKVFHPNINSNGSICLDILKDQWSPALTISKVLLSICSLLCDPNPDDPLVPEIAHMYKTDRHKYESTARTWTQRYAM

SEQ ID NO: 134992 - protein, 107 aa, Triticum aestivum
  unsure (1)..(107): unsure at all Xaa locations
  Clone ID: PAT_TA_29410.pep
MASKRIQKELKDLQKDPPTSCRXGPVGQDMCHXQARIMGPTDQPIFLGWSFPYVTIHFPPSFFPFKXPPKVAFXTKVFHPKHQPARGLAFCLVKYLKAAPIGRSPDC

SEQ ID NO: 134993 - protein, 150 aa, Triticum aestivum
  Clone ID: PAT_TA_29411.pep
MLGKELKRGDGTDTLEAKYLLSKVSEFEKIIANKFTCKPSVIIAGDFNSTPGDKVYNYLLSASAESTDEALVKLRSLYAENGGEPEFTNCTPGFTGTLDYIFLSDGGSIKPSSLLRIPRGGSPDVEGGLPNFHHPSDHLPIGADFQVLSS

SEQ ID NO: 134994 - protein, 201 aa, Triticum aestivum
  Clone ID: PAT_TA_29412.pep
MVDKAQSVLQACDIRPLPLTVHRPTLKEAKRVYNNLTQLYYETECSIMGEVLPLVENVTKFEQSTEAREEISVAPEEPILDSSSSHEAMAIPSNNATTPLHEAAKAGNVEQTMELLEQGLDPCIKDERGKTPYLLASDKEVRNTFRRFMALNLDKWDWHAAEVPSALTKEMEESQAAKQAEKDAKKKARAKELKKQKKARE

SEQ ID NO: 134995 - protein, 169 aa, Triticum aestivum
  Clone ID: PAT_TA_29413.pep
SAFAPTVIRCLSFSANSHLIFAGSSSGYAHCWDLRTLRPLWETRVSPNVIYSAHHLPGDTSMLVLGGIDGVLRLVCQRTGETIRSFIMDAGYPAQSSSRPQAEQKNVRPAESGPRQQVEKKRVREIAPDARLDNIPMHLRPPITGLSVGMKKIVTTHGENYIRVWKFHS

SEQ ID NO: 134996 - protein, 120 aa, Triticum aestivum
  Clone ID: PAT_TA_29414.pep
MAIVKAFELRNKNKAELLKVLDEQKQALANLRVQKVAGGKSQEVGEARKNVARVLTVINQTQREQLALFYHKKKYVPLDLRVKKTRAMRRALTPFEKSKKTLRQQKKEAHFPLRKYAVKA

SEQ ID NO: 134997 - protein, 226 aa, Triticum aestivum
  Clone ID: PAT_TA_29415.pep
FGINPFPVHVEKGRLLGDAGRSTSPLPDRRVPHPPAAALAAGGWGGPDLRRVYSVGSIWQLAGGVGEWAARPEWRFATEVFLSGGGGPRSSAADLPSSPCSGLGGAAGCTFPSPESAGRRIRDLEILNRAGGAVQGVGFDDAGWRSSGAELRRLSVRGGSVPNPRLVWSSSGGAPAIRFRRRLRQRGAGGFNVIFFVLGPFCKNPVLNINSSFPAKKKPPFHSSSA

SEQ ID NO: 134998 - protein, 79 aa, Triticum aestivum
  Clone ID: PAT_TA_29416.pep
HPLPLLSLKLPVALAISQKEPWFALILLHLRQPSQKLMSSKSKKKCSINLLIQLFIFLKKLLNPRLPLVLLSITSLTIN

SEQ ID NO: 134999 - protein, 183 aa, Triticum aestivum
  Clone ID: PAT_TA_29417.pep
HASEKLQMLKRGMRLVIASLGPADRLSVVAFSGAAKRLMPLRRMSRQGQRSARQIVDRLVVCAAAQGQEQAQSACAGDALRKATKVLEDRRDRNPVATVMLLSDTQQQQDARKHGDHHHSLRRPQAAPAAATRFTHVEIPIAGPADNAPARSPLAPKEEHLESSAPAEHAFAKCLGGLVSVVM

SEQ ID NO: 135000 - protein, 375 aa, Triticum aestivum
  unsure (1)..(375): unsure at all Xaa locations
  Clone ID: PAT_TA_29418.pep
WWFIPVNVLIATAVGCALGYAVALVCRPPPRFFRFTVIMTGFGNTGNLPIAIIGSVCHTADHPFGPGCHREGIXYVSFAQWVAVXPRLHXSSYHMMEPXPCKYYEIVGEGHEIEEEPQLKQTSAATLLHEAEWPGMPDKETEHXKTPFIARIFASISGSSQNTFPDIDFTEEGGISGAGPSSPKSLRCFAEPKVVRRMRVVAEKTPIQHVLQPPTIASLLAIIIGMVPVLKAFVFGADAPLSFFTDSLEILAAAVVPSVMLILGGMLAEGPNDNALGMRTIFGITVARLLILPCIGIGIVMLADRLHLLVENDHMYRFVLSLQYSTPSAILLGAIASLRGYSVKEASALLFWQHICAXFSLSIYLVVYFKLLSYI

SEQ ID NO: 135001 - protein, 36 aa, Triticum aestivum
  Clone ID: PAT_TA_29419.pep
GEKMVAALSLILVQCCTKLSRPVRQARFHNPLPCQT

SEQ ID NO: 135002 - protein, 51 aa, Triticum aestivum
  Clone ID: PAT_TA_29420.pep
YFTSLFRNIPMISKLHYIYILLPFDCAIIAQMMFPRAHMMLIIHKYNPICM

SEQ ID NO: 135003 - protein, 206 aa, Triticum aestivum
  Clone ID: PAT_TA_29421.pep
AGPRPLYAKPGPRRHARAHAFAPRPGGGRSGPPRSTPTKNAAPGSARRGRRRTRRRSCTRARSSSRRRRGRGARSRAAPSSRRPRATARAASSAATPTTPTTGPARSRSPPRRGRRARPSSGRCTISPGPCGRRRRTRSRRGRRRGRGRRRRRPCTPGSPTRPTPAPAGWTGSACPSSTESCRHVSFVESRVQVSVHVPETPTRAK

SEQ ID NO: 135004 - protein, 129 aa, Triticum aestivum
  Clone ID: PAT_TA_29422.pep
SRPAFPTLSESRGVGASKAIRCRGAPSAEARQGRPRSRGGCSATSDCLRRRTSCHAASLTARWSSRARPPPPPPRIWTRTCPAPSARPPSPTSATAWLVISAYGSGRRAADSLCDSAMFSDWIARARLP

SEQ ID NO: 135005 - protein, 191 aa, Triticum aestivum
  Clone ID: PAT_TA_29423.pep
TRELRAPLGAHPHSLSVRCAYRDPASQETVRGAEQPLLLPPLHDGGGGGSSTSSQQRLHDLFVATRAVAESRRLAELSDFSTATHLLSSARRLVLQSPPTQQQQDLLGGLDTELSDMRWRRGQQQPPTPTSRSATPSGTPRASSGGGGGAGGEPLTPTSAWRAAEQLAKVAIMRKSMNRVSDLHGFENARF

SEQ ID NO: 135006 - protein, 190 aa, Triticum aestivum
  unsure (1)..(190): unsure at all Xaa locations
  Clone ID: PAT_TA_29424.pep
RPAASSRPPPAPPPPAARPRDRVGGETTGEEDGRREGRRQEQGGGPGRRRPGPAPRAGRAGRPLPQGGNARPPGPGXPPPSPPPPRPSTSAPRPRAAPATPENKQTRTPTPPALPRXPPARRARRPAPRPPARPRARRPHHRPRRPPPHPPPRPGPRRRPPRGQAAQPHPRPKEPPGGNRPQSITVAINH

SEQ ID NO: 135007 - protein, 146 aa, Triticum aestivum
  Clone ID: PAT_TA_29425.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTSTKSPKKKVAAKE

SEQ ID NO: 135008 - protein, 146 aa, Triticum aestivum
  unsure (1)..(146): unsure at all Xaa locations
  Clone ID: PAT_TA_29426.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEXHKSQKAAAKSPKKKTAATKE

SEQ ID NO: 135009 - protein, 147 aa, Triticum aestivum
  Clone ID: PAT_TA_29427.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKISTKSPKKKTAATKE

SEQ ID NO: 135010 - protein, 148 aa, Triticum aestivum
  Clone ID: PAT_TA_29428.pep
MAGRKGGERKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKAAGAAEKESTKSPKKKAATKSPKKKTAATKE

SEQ ID NO: 135011 - protein, 164 aa, Triticum aestivum
  unsure (1)..(164): unsure at all Xaa locations
  Clone ID: PAT_TA_29429.pep
APCASACAAPSCRGARRRFGARSLPAPGRRALVVRAQTEGPSAPPPNKPKASTSIWDALAFSGPAPERINGRLAMVGFVTALPREPRGAGAVPSRSGGAPTPWXVLSVAAGVVSGAAGAPALQGESAEGRAGNAGALDTAASPVLGLVALAATEIITGAPFINV

SEQ ID NO: 135012 - protein, 223 aa, Triticum aestivum
  unsure (1)..(223): unsure at all Xaa locations
  Clone ID: PAT_TA_29430.pep
PPRPHPHRDPGRLLLCGGPGLLQELGVPPHGRRGVAPGGGAPGPGRPPGVLQLPVRRATRTRCICPPGAAASATASTAAPSTAAAAKRPAVVQNCRLVPDQKLFADRLKIPSSLGRPWKEFSRLVIMESMIADFIKPEGYMPWNGDFGLKTLYYADLQNSRNVCTYGVMTDPGPGAXTFTAPFSPSVLFIWFVSGDLFSSGTYIDGATWLKFTGMPNYLGFKV

SEQ ID NO: 135013 - protein, 236 aa, Triticum aestivum
  Clone ID: PAT_TA_29431.pep
AAAAATTTAAASVPLLFPVRRPRRRQEEWGPVRLVLFFLGFCFSGGIDEVVATMACWNKVSPVSPYLDDVRSGAGEGPVRVGVPRSVGSLQILAVGVSFKEYFGLAFGVATTTSSSVLFCGLTRFLQPSDLVVVDCKFVLLGVMLQPMLLQRLLDLVSRGEWLLRSSKPCVARAFAGFAFLCCWFSAIFNHRRAAYNQRKKKTSMLFIVILFFTGRSTSSCLSFVLAFVFLDDNQI

SEQ ID NO: 135014 - protein, 149 aa, Triticum aestivum
  Clone ID: PAT_TA_29432.pep
MLRSFPQARRLLKRLGFEKGDAYFFKQMGKGMLCTYALFGAAWFWNETSPLGWWTLKPRPKVEKEMAHLYVRRGFPHPGHEPAVAQFIMCAGPLGHPAAPKGFADANMDSDNMQKQLQSKKFDQEARKLWFRMRNEVVQELQEKGFDVE

SEQ ID NO: 135015 - protein, 112 aa, Triticum aestivum
  Clone ID: PAT_TA_29433.pep
PRVPPSGGALTIEPITNIPYPEYYEFFMDWKTPVVIATLYAGTIHLLNPSSATAKLSRVEAKNRGVNNASCSSKLFTTFVLSSQLGLVHLFWCDIRKYGSSLTQVIQQLLCT

SEQ ID NO: 135016 - protein, 169 aa, Triticum aestivum
  Clone ID: PAT_TA_29434.pep
MANTLRLYLTCIRNTLEAAMCLQNFPCQEVERHNKPEVELKTSSELLLNPVLICRNEAEKCLVETSINSIRISLKVKQADELENILAKKFLRFLSMRAEAFQVLRRKPVQGYDISFLITNYHCEDMHKHKLIDFIVQFMEDIDKEISELKLSVNTRGRLVATEFLKQFI

SEQ ID NO: 135017 - protein, 129 aa, Triticum aestivum
  Clone ID: PAT_TA_29435.pep
GTRVLLVGLSVAGMTREAEGLAQRMMKTGVQLSPLAGSAMARELCQRKMWLHACCWLRLMDENGVLCDSDVYAGVLLGLCQEGHVLEASALVRKVMDRGIRIDASCADCLVQLLKQHGDEELASHVLQY

SEQ ID NO: 135018 - protein, 88 aa, Triticum aestivum
  unsure (1)..(88): unsure at all Xaa locations
  Clone ID: PAT_TA_29436.pep
MAKCLAAALLATRWVLAYCDGRELNQKDQALATARGAGAGAGAGGGVGEEKVLGLPELPXLVGTVTGTSTVPGPVVVVPAFPGIPAHP

SEQ ID NO: 135019 - protein, 160 aa, Triticum aestivum
  unsure (1)..(160): unsure at all Xaa locations
  Clone ID: PAT_TA_29437.pep
NTGYAFLWNVRPGLVQGDVKAALPPEFYAATEGRSMLSTWCPQQXVLEHEAVGVFLTHSGWNSSLEGICGGVPMVCWPFFAEQQTNCRFKCTEWGIGMEIGDDVRRTEVEAMIREAMEGEQGREMRRRVLELRQSAVASARHGGRSMRNVDRLIKEVLLA

SEQ ID NO: 135020 - protein, 68 aa, Triticum aestivum
  Clone ID: PAT_TA_29438.pep
LLEVTIVTEDSDGWYRKFSDWGSRIMLLLEQFVQFLTFFTEHKGIGRPPWMQVYTCGCLCVTIIVFRV

SEQ ID NO: 135021 - protein, 136 aa, Triticum aestivum
  Clone ID: PAT_TA_29439.pep
RNPSEPLLLPGESLLLPEHPKCEMSKVSSPGGGALTLGTKRPPGAPGLGRGREFLVPIAGALAVFVILYGLGCFRSLKIRPASRRWAGPRLQIEQRCKRQPFALLFHVVHLSTSPDFSLSGQQARRSMDDYQGVTV

SEQ ID NO: 135022 - protein, 109 aa, Triticum aestivum
  Clone ID: PAT_TA_29440.pep
SCMSHAWLHLDHLDRAGKVHRHHLLPRRRRLSSASPGDVHGASHLSDRAHLSARALVGLADVDHDDLVLCRHLPCLLHLLHIACHHGRRVHVEHVEDHLDHPEGEAKDV

SEQ ID NO: 135023 - protein, 100 aa, Triticum aestivum
  Clone ID: PAT_TA_29441.pep
LQSQQQQQQQSPSHAADQQRGPLLREAMSTPVLMVTAEQALVEVESHFQLVSGLPVVDSARRCVGVIRQERSREGFTWVKDVYCRCDDISKQSRYLAIKQ

SEQ ID NO: 135024 - protein, 199 aa, Triticum aestivum
  unsure (1)..(199): unsure at all Xaa locations
  Clone ID: PAT_TA_29442.pep
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNITGFGLNFLLTLFAFHGETRVVSLGWICVGFSVCVFVAPLSIIGRVIKTKSVEYMPFTLSLTLTLXAIVWFLYXLLIKDKYVALPNIL

SEQ ID NO: 135025 - protein, 113 aa, Triticum aestivum
  unsure (1)..(113): unsure at all Xaa locations
  Clone ID: PAT_TA_29443.pep
HPWRASIPCRAAPCSKGPRLRPGGARASGGGSFGCRASTFMDGSGLRLRARRRTPTPSSPGSGPKNFSLLNYDDLRALLQSQATTSNSSRLPTLPIKQXGGAPCAEGKSTPVA

SEQ ID NO: 135026 - protein, 172 aa, Triticum aestivum
  unsure (1)..(172): unsure at all Xaa locations
  Clone ID: PAT_TA_29444.pep
HPWRASIPCRAAPCSKGPRVRPEEVEPVAGPLSAGRPRSWTGAGLRLRAPTKNPDAIISGEVGPEELLPPQATNDLPAHTSSQQQASKQQRQPSHAGDSARGALPAXRHVRPRSDGTAEQAWWRFKGIPLRSSSGFXXPADFPVLLKXITLXFTWAKXXCNXMNSTSXTCIT

SEQ ID NO: 135027 - protein, 96 aa, Triticum aestivum
  Clone ID: PAT_TA_29445.pep
KHLVAISGGTVIDGVKVVPDLVEPLDAQADTKRTRLKIVVHEGRNHEVRELVQNAGLKVYALKRVRIGRFRLPSDLGIGKMVELKEADIKALDGNS

SEQ ID NO: 135028 - protein, 183 aa, Triticum aestivum
  unsure (1)..(183): unsure at all Xaa locations
  Clone ID: PAT_TA_29446.pep
LRELSSPYLSLRSTRSLGLERERERDEQKQSLAPLLYQVRIHLTVIHPCITMGGLSMGAPLGHSAFRPTRQRDLFLRASWAPIPTFYRIFKEQIHGGVPVRVPYVRGPVQARCCGSSTTXQNRLRAPHQXQRCRCVIXTXNLMYSSTPQEXKFHSKXVVLSTRRFGXLLXTLASWGKXCPLGG

SEQ ID NO: 135029 - protein, 123 aa, Triticum aestivum
  Clone ID: PAT_TA_29447.pep
ARGQKVSHPSSNITKEYVVTIDGAVHKKHLVAISGGTVIDGVKVVPDLVEPLDAQADTKRTRLKIVVHEGRNHEVRELVQNAGLKVYALKRVRIGRFRLPSDLGIGKMVELKKADIKALDGNS

SEQ ID NO: 135030 - protein, 141 aa, Triticum aestivum
  unsure (1)..(141): unsure at all Xaa locations
  Clone ID: PAT_TA_29448.pep
ELSSSDLSLLPTRSLGLERKSERRAKTTSSPTVDLICQQACCQLHIYPISLQYLHITMGGPIHGSTLGAFRLRPTRQRDLFLRAPGPRYQHSTGFQRANHEGFIRCLSXGLFNACCGSSTHWXNRLRLLNXIKLPVRHXDV

SEQ ID NO: 135031 - protein, 265 aa, Triticum aestivum
  unsure (1)..(265): unsure at all Xaa locations
  Clone ID: PAT_TA_29449.pep
MAPNPPPHQACGHRSPKERADRHLLFHPWRAPGQIKKLDPVTKKVTTIAGTGRAGYNDDDALSAQLSEPAGLVEVGEGRFLVADTNNSAIRSIVLNERGAEVRTLDLTGVQAPSPKPKALRRLRRRXSADTKXINVDGGSSMEGYVSLAISVPDGYHFSKEARSKFDVETEPANAIEIEPVNGSLNSDGQASLKFKRTSSSSSTGRINCKVYYCKEDEVCLYQSVAFDVKFQEGVPSPAPITLAYTVVPRDNSGSSQLMAAGKNL

SEQ ID NO: 135032 - protein, 177 aa, Triticum aestivum
  Clone ID: PAT_TA_29450.pep
DLQASCSNTLNRRCVMLEQEAGMNILLWKVERLRQRMILVGGSTWERCAELLKKRDSHHWPMHILRHEKHLKELLFPRWAEFRDGSSSTTDGVACKLDVLIVLLALIGSSEKENTRRSGSVSGMCSLARKICSLPSTHRGSTSSPLVDSHQIRPPHSPSGPRRQIPQLSRKAAISGD

SEQ ID NO: 135033 - protein, 105 aa, Triticum aestivum
  Clone ID: PAT_TA_29451.pep
SLVARLMHKPCMQSLHACVNLDHVDRTGKVHPRRRRRLSSASSGDVDGGGHLGDRAHLGARALVGLADVDHDDVVLCGRLPCLFPLLDLACHRRLVHVEHVEDHL

SEQ ID NO: 135034 - protein, 217 aa, Triticum aestivum
  Clone ID: PAT_TA_29452.pep
MACINTLQSCSMFKGAKSKARRGRASGGTFECRASTFMDGSGLRLGLDENPDAIISGEWPENFSLLSYDDLRAYLQSQQQQQQQQPSHAGDQQRGPLLREAMSTPVLMVTAEQALVEIEGHFQLVSGLPVVDSARRCVGVVVKSDRVRASHGPKTKIADVMTSPAITLSCDKTVTDAAALMLRKKIHRLPIVNQDNQVIGIVTRDDVLRALEAMLKF

SEQ ID NO: 135035 - protein, 86 aa, Triticum aestivum
  Clone ID: PAT_TA_29453.pep
GTTIKVTLILVLIPIRSLFYTREGKHSTIWLCLRYMLPRPQDPLSPIYASATALQLLLWILTRSGHLTHLQSVVMDKVKIPTKSAF

SEQ ID NO: 135036 - protein, 116 aa, Triticum aestivum
  unsure (1)..(116): unsure at all Xaa locations
  Clone ID: PAT_TA_29454.pep
MAGLSLEHPWAFAFGLLGNIISFTSLLAPIPTFYRIFKSKSTEGFQSVPYVVALFSAMLWIFYALGQDRWRASLIXASTLPGCVIETVYIVMYSSTPPRKARFHKQDRRRPQRRVG

SEQ ID NO: 135037 - protein, 73 aa, Triticum aestivum
  Clone ID: PAT_TA_29455.pep
SSCYLLQQSKTKIADVMTSPAITLSCDKTVTDAAALMLRKKIHRLPIVNQDNQVIGIVTRDDVLRALEAMLKF

SEQ ID NO: 135038 - protein, 270 aa, Triticum aestivum
  Clone ID: PAT_TA_29456.pep
IRHEAQEDPSFHFSRDEETNQTVIEGMGELHLDIIVDRLKREFKVEANVGAPQVNYRESISKIAEIQYVHKKQSGGSGQFADIIVRFEPMEAGSGYEFKSEIKGGAVPKEYVPGVMKGIEESLPNGVLAGYPVVDLRAVLVDGSYHDVDSSVLAFQIAARGAFREGLRKAGPRLLEPIMKVEVITPEEHLGDVIGDLNSRRGQVNSFGDKPGGLKVVDAFVPLAEMFQYVSTLRGMSKGRASYTMQLAKFDVVPQHIQNQLFAAKEEAAA

SEQ ID NO: 135039 - protein, 233 aa, Triticum aestivum
  unsure (1)..(233): unsure at all Xaa locations
  Clone ID: PAT_TA_29457.pep
NQLRELSSPDLSLLSTRSLGLERARRAKTISRPTVIPSSHPPHCYTSLYHNGWPIHGAPLGHSAFGLLGNVISFSSLLXPMPTFYRIFKSKSTEGFQSXPYVVALFSAMLWIFYXTGSRPVEGLLISINAAGCVIETVYIVMYLVYAPRKAKIFTAKIVVLLNIAGFGLIFLLTLFAFHGETRVVSLGWICVGFSVCVFVAPLSIIGRVIKTKSVEYMPFSLSLTLTLSAVVW

SEQ ID NO: 135040 - protein, 318 aa, Triticum aestivum
  unsure (1)..(318): unsure at all Xaa locations
  Clone ID: PAT_TA_29458.pep
MAGLSLEHPWAFAFGLLGNIISFTSLLAPIPTFYRIFKSKSTEGFQSVPYVVALFSAMLWIFYALVKTGEGLLISINAAGCVIETVYIVMYLVYAPRKAKIFTAKIVVLLNVAGFGLILLLTLFAFHGXTRVISLGWICVGFSVCVFVAPLSIIGRVIKTKSVEYMPFSLSLTLTLSAVVWFLXGLLIKDKYVALPNILGFTFGMIQMVLYMFYMNATPGGERSEGGERGAEDVGGGARGGDQRWQERKELWRRGSPGHRRWSKPSRRRRGQQVMALDSARSVGCGVNSRMQACLMHEFVQALIFVQLFWRVTPAGHA

SEQ ID NO: 135041 - protein, 175 aa, Triticum aestivum
  unsure (1)..(175): unsure at all Xaa locations
  Clone ID: PAT_TA_29459.pep
HASADNIHHTRQGRVASMACINTLQSCSMFKGAKAEARRGKATGAGSFGCRASTFMDGSGLRLGLDEEPRRHHLRRVARELLPPQATTTSAPTSSPKQAAAAAATFPRCRSATGGPLLREAMSTPVLIVTAEQAWWRFKHFNSCQAPGFHNARKSSGXPEXHFPXVTWAXXKIQM

SEQ ID NO: 135042 - protein, 788 aa, Triticum aestivum
  Clone ID: PAT_TA_29460.pep
MTTDQPVISLRPGGGGGGPRGGRLFAPAFAVAASGSGDFLRPHGGGASGVSRIGDLHSESRERVRYSRDQLLDLRKITDVTEQILRLQQEIEAELNGDDQSWVRNDSNVQLQTQAQPQVQAQNRFTETDNRDWRARTEKPPAPAVQEEKSWDNIREVKEQYNASGRQQEQFNRQDQSSSQKAQVGPPPALIKADVPWSARRGNLSEKDRVLKTVKGILNKLTPEKFDLLKGQLLDSGITTADILKDVISLIFEKAVFEPTFCPMYAQLCSELNDNLPTFPSEEPGGKEITFKRVLLNNCQEAFEGADSLRVEIASLTGPDQEMEKRDKERIFKLRTLGNIRLIGELLKQKMVPEKIVHHIVKELLGSDKKACPDEEHVEAICQFFNTIGKQLDENPKSRRINDTYFVQIRELVANPQLTPRSKFMVRDLIDLRSNNWVPRRAEIKAKTISEIHTEAEKNLGLRPGATANMRNGRNAPGGPLSPGGFSVNRPGTGGMMPGMPGSRKMPGMPGLDNDNWEVQRSRSMPRGDPLRNQGPLINKVPSINKPSPINPRLLPQGTGALIGKSALLGTGGPPSRPSSLTASPTPLPAQTTASPKPSSATPASVPIPDKAASSAKVIPAGLQKKTASLLEEYFGIRILDEAQQCIEELQSPDYHPEIVKEAINLALDKGASFVDPLVKLLEHLYTKKTFKTEDLENGCLLYGSLLEDIGIDLPKAPTQFGEVVARLILSCGLRFEAAEGILKAMEDTFFRKAIFTSVTKTLGADPAGQAILSSHAAVVDACNSLSI

SEQ ID NO: 135043 - protein, 94 aa, Triticum aestivum
  Clone ID: PAT_TA_29461.pep
FNLPAGLLSTSYLSHLPSISSYHNGWPIHGSTLGAFAFGLLGNIISFTSLLGPRYQHSTGSSKSKSTEGFQVGALRRGPVQRDAVDLLRASEDR

SEQ ID NO: 135044 - protein, 107 aa, Triticum aestivum
  Clone ID: PAT_TA_29462.pep
LASMACINTLQSCSMFKGAKSKARRGRASGGTFECRASTFMDGSRAPGSGLRRRTPDAIISGELARRTLPPQAYERPPAHTSSHSSKQQQRQPSPCRRLSTGGLSCL

SEQ ID NO: 135045 - protein, 787 aa, Triticum aestivum
  Clone ID: PAT_TA_29463.pep
MTTDQPVISLRPGGGGGGPRGGRLFAPAFAVAASGSGDFLRPHGGGAFRALQDWCLHLSHERVRYSRDQLLDLRKITDVTEQILRLQQEIEAELHGDDQSWVRNDSNVQLQTQTQTQVQAQNRFTETDNRDWRARTEKPPAPAVPEEKSWDNIREVKEQYNASGRQQEQFNRQDQSSSQKAQVGPPPALIKADVPWSARRGNLSEKDRVLKTVKGILNKLTPEKFDLLKGELLDSGITTADILKDVISLIFEKAVFEPTFCPMYAQLCSELNDNLPKFPSEEPGGKEITFKRVLLNNCQEAFEGADSLRVEIASLTGPDQEMEKRDKERIFKLRTLGNIRLIGELLKQKMVPEKIVHHIVKELLGSDKKACPDEEHVEAICQFFNTIGKQLDENPKSRRINDTYFVHLRELVANPQLTPRSKFMVRDLIDLRSNNWVPRRAEIKAKTISEIHTEAEKNLGLRPGATANMRNGRNAPGGPLSPGGFSVNRPGTGGMMPGMPGSRKMPGMPGLDNDNWEVQRSRSMPRGDPLRNQGSLINKVSSINKPSPINPRLLPQGTGALIGKSALLGTGGPPSRPSSITASPTPLPAQTTASPKPSSATPASVPIPDKAASSAKVIPAGLEKKTASLLEEYFGIRILDEAQQCIEELQSPDYHPEIVKEAINLALDKGASFVDPLVKLLEHLYTKKTFKTEDLENGCLLYGSLLEDIGIDLPKAPTQFGEVIARLILSCGLRFEAVEGILKAMEDTFFRKAIFTSVTKTLEADPAGQAILSSHAAVVDACNSLSI

SEQ ID NO: 135046 - protein, 112 aa, Triticum aestivum
  unsure (1)..(112): unsure at all Xaa locations
  Clone ID: PAT_TA_29464.pep
MGGLSMEHPWAFAFGLLGNVISFSSLLAPIPTFYRIFKSKSTEGFQSVPYVVALFSAMLWIFYALXKTGEGLLISINAAGCVIETVYIVMYLVYAPRKAKIFTAKIVVLLNI

SEQ ID NO: 135047 - protein, 290 aa, Triticum aestivum
  Clone ID: PAT_TA_29465.pep
MGGLSMEHPWAFAFGLLGNVISFSSLLAPIPTFYRIFKSKSTEGFQSVPYVVALFSAMLWIFYALVKTGEGLLISINAAGCVIETVYIVMYLVYADRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASQVKEGKEAWKAPAEDHVVVINVGKADKSSCAEVRPVTEMAGAVDVPRRCAAEAAAAPGVDFARSVNVV

SEQ ID NO: 135048 - protein, 285 aa, Triticum aestivum
  unsure (1)..(285): unsure at all Xaa locations
  Clone ID: PAT_TA_29466.pep
MAGLSLRSTLGAFAFGLLGNIISFTSLLXPIPTFYRIFKEXKSNGRGSKSVPYVVALFSAMLWIFYAXVKELGEGLLININAGRLRHRDVYIVMYLVYAPTKAKIFTAKIVLLLNIASFGLILLLTLFAFHGETRVVSLGWICVGFSVCVFVAPLXIIGRVIKTKSVEYMPFSLSLTLTLSAVVWFLYGLLIKDKYVXALPNILGFTFGMIQMALYMFYMNATPAVSNLKEGKEGLKKPAEEHVVVINVGKIEKSSGAVVRPGHRDAQRHPQADALLRRRHQGNK

SEQ ID NO: 135049 - protein, 284 aa, Triticum aestivum
  unsure (1)..(284): unsure at all Xaa locations
  Clone ID: PAT_TA_29467.pep
MGGLSMEHPWAFAFGLLGNVISFSSLLAPIPTFYRIFKSKSTEGFQSVPYVVALFSAMLWIFYALVKTGEGLLISINAAGCVIETVYIVMYLVYADRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNIXGFTFGVIQMVLYVFYMNKTPVASQVKEGKEAWKAPAEDHVVRDQRRQGRQSCAEVRHRDGAAVDSPRRCLLKRRRPWVALPCRLG

SEQ ID NO: 135050 - protein, 134 aa, Triticum aestivum
  Clone ID: PAT_TA_29468.pep
RAEFGTSIHHTRQGRVASMACINTLQSCSMFKGAKAEARRGQSHRRRELRVPGVHVHGRERAPARARREPRRHHLRRSGPENFSLLKLRRPPRLPPVPSSSSNNDNHPMPAIRFFFLLILWSLLISSLDASSSC

SEQ ID NO: 135051 - protein, 290 aa, Triticum aestivum
  Clone ID: PAT_TA_29469.pep
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNITGFGLIFLLTLFAFHGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASEVKEGKEAWKAPAEDHVVVINVGKTDKGSCAEVRPVTEMASAVDVPRRCAAEAAAAPGVDFARSVDVV

SEQ ID NO: 135052 - protein, 448 aa, Triticum aestivum
  unsure (1)..(448): unsure at all Xaa locations
  Clone ID: PAT_TA_29470.pep
TRPELLKQKXVPEKIVHHIVKELLGSDKKACPDEEHVEAICQFFNTIGKQLDENPKSRRINDTYFVQIRELVANPQLTPRSKFMVRDLIDLRSNNWVPRRAEIKAKTISEIHTEAEKNLGLRPGATANMRNGRNAPGGPLSPGGFSVNRPGTGGMMPGMPGSRKMPGMPGLDNDNWEVQRSRSMPRGDPLRNNQGPLINKVSSINKPSPINPRLLPQGTGALIGKSALVGTGGPPSRPSSLAASPTPLPAQTTASPKPSSATPASVPIPDKAASSAKVIPAGLQKKTASLLEEYFGIRILDEAQQCIEELQSPDYHPEIVKEAINLALDKGASFVDPLVKLLEHLYTKKTFKTEDLENGCLLYGSLLEDIGIDLPKAPTQFGEVVARLILSCGLRFEAVEGILKAMEDTFFRKAIFTAVTKTLEADPAGQAILSSHAAVVDACNSLSI

SEQ ID NO: 135053 - protein, 217 aa, Triticum aestivum
  Clone ID: PAT_TA_29471.pep
MACINTLQSCSMFKGAKAEARRGKATGAGSFGCRASTFMDGSGLRLGLDENPDAIISGEWPENFSLLSYDDLRAYLQSQQQQQQQPPSHAADQRGPLLREAMSTPVLMVTAEQALVEVEGHFQLVSGLPVVDSARRCVGVVVKSDCARASHGPKTKIADVMTSPAITLSCDKTVTDAAALMLKKKIHRLPIVNQDNQVIGIVTRDDVLRALEAMLKF

SEQ ID NO: 135054 - protein, 295 aa, Triticum aestivum
  unsure (1)..(295): unsure at all Xaa locations
  Clone ID: PAT_TA_29472.pep
MGGLSMEHPWAFAFGLLGNVISFSSLLAPIPTFYRIFKSKSTEGFQSVPYVVALFSAMLWIFYXTGSRPVRGLLISINAXGCVIETVYIVMYLVYAPKXAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNVLGFTFGVIQMVLYVFYMNKTPVASEVKEGKEAWKAPAEDHVVVINVGKADKSSCAEVRPVTEMASAVDVPRRCAAEAASPGQQVMAVDFARSVEVV

SEQ ID NO: 135055 - protein, 295 aa, Triticum aestivum
  unsure (1)..(295): unsure at all Xaa locations
  Clone ID: PAT_TA_29473.pep
MAGLSMEHPWAFAFGLLGNIISFTSLLAPIPTFYRIFKSKSTEGFQSVPYVVALFSAMLWIFYALVKTGEGLLITINAAGCVIETIYIVMYLVYAPRKAKIFTAKIVLLLNIAGFGLIFLLTVFAFQGETRVISLGWICVGFSVCVFVAPLSIIGRVIKTKSVEYMPFSLSLTLTLSAIVWFLYGLLIKDKYVALPNXLGFTFGMIQMVLYMFYMNATPVVTSDVKEVKEAWKVPAEDQVVVINVGKADKSSCAEVRPVTEMASAVDVPRRCAAEAAAPRQQVMAVDFARSVEVV

SEQ ID NO: 135056 - protein, 290 aa, Triticum aestivum
  Clone ID: PAT_TA_29474.pep
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNVLGFTFGVIQMVLYVFYMNKTPVASEVKEGKEAWKVPAEDHVVVINVGKADKSSCAEVRPVTEMAGAVDVPRRCAAEAAAAPGMDFARSVDVV

SEQ ID NO: 135057 - protein, 281 aa, Triticum aestivum
  Clone ID: PAT_TA_29475.pep
MRTSSLHATPSVVELLPSLNFQFSNTVRRGCKVVFVASAAIVVGTQTHPNPSKEAVSGEEQLASMACINTLQSCSMFKGAKTEARRGRASGGSFGCRASTFMDGSGLRLGLDENPDAIISGEWPENFSLLSYDDLRAYLQSQQQQQQQPPSHAGDQQRGPLLREAMSTPVLMVTAEQALVEVEGHFQLVSGLPVVDSARRCIGVVVKSDRVRASHGSKTKIADVMTSPAITLSCDKTVTDAAALMLRKKIHRLPIVNQDNQVIGIVTRDDVLRALEAMLKF

SEQ ID NO: 135058 - protein, 211 aa, Triticum aestivum
  Clone ID: PAT_TA_29476.pep
MACINTLQSCSMFKGAKSKARRGRASGGTFECRASTFMDGSGLRLGLDENPDAIISGEWPENFSLLSYDDLRAYLQSQQQQQQRQPSHAGDQQRGPLLREAMSTPVLMVTAEQALVEVEGHFQLVSGLPVVDSARRCVGVVVKSDHPKTKIADVMTSPAITLSCDKTVTDAAALMLRKKIHRLPIVNQDNQVIGIVTRDDVLRALEAMLKF

SEQ ID NO: 135059 - protein, 218 aa, Triticum aestivum
  Clone ID: PAT_TA_29477.pep
MACINTLQSCSMFKGAKAEARRGRASGGGSFGCRASTFMDGSGLRLGLDENPDAIISGEWPENFSLLSYDDLRAYLQSQQQQQQQSPSHAADQQRGPLLREAMSTPVLMVTAEQALVEVESHFQLVSGLPVVDSARRCVGVIVKSDRVRASHGSKTLIADVMTSPAITLSCDKTVTDAAALMLKKKIHRLPIVNQDNQVIGIVTRDDVLRALEAMLKF

SEQ ID NO: 135060 - protein, 331 aa, Triticum aestivum
  unsure (1)..(331): unsure at all Xaa locations
  Clone ID: PAT_TA_29478.pep
ITVAVTGDIVALAGLKXTITGETLCDPDNLVVLERMEFPDPVIKVAIEPKTKADADKMANGLIKLAQEDPSFHFSRDEETNQTVIEGMGELHLDIIVDRLKREFKVEANVGAPQVNYRESISKIAEIQYVHKKQSGGSGQFADIIVRFEPMEAGSGYEFKSEIKGGAVPKEYVPGVMKGIEESLPNGVLAGYPVVDLRAVLVDGSYHDVDSSVLAFQIAARGAFREGLRKAGPRLLEPIMRVEVITPEEHLGDVIGDLNSRRGQVNSFGDKPGGLKVVDAFVPLAEMFQYVSTLRGMSKGRASYTMQLAKFDVVPQHIQNQLSAAKEEAAA

SEQ ID NO: 135061 - protein, 218 aa, Triticum aestivum
  Clone ID: PAT_TA_29479.pep
MACINTLQSCSMFKGAKAEARRGKATGAGSFGCRASTFMDGSGLRLGLDENPDAIISGEWPENFSLLSYDDLRAYLQSQQQQQQQPPSHAADQQRGPLLREAMSTPVLMVTAEQALVEVEGHFQLVSGLPVVDSARRCVGVVVKSDCARASHGPKTKIADVMTSPAITLSCDKTVTDAAALMLKKKIHRLPIVNQDNQVIGIVTRDDVLRALEAMLKF

SEQ ID NO: 135062 - protein, 127 aa, Triticum aestivum
  Clone ID: PAT_TA_29480.pep
MMARNHTFVDGRVLSLQDGVAIALRILNSGDSPVTIGSCIGVNEPTASLVTQSFVKAMFERAMPHLRWSYTSQKMEKMKRKFHKVHGMPNCCGVVHTTRITFGSQNREHVENEGILMQAVLDPDRGV

SEQ ID NO: 135063 - protein, 368 aa, Triticum aestivum
  unsure (1)..(368): unsure at all Xaa locations
  Clone ID: PAT_TA_29481.pep
FIASAHPDSRAGTRRDREPNPTANTSAMSSSNGNGGKKPAPSGGRGGIRTLADINRGPSGFPGAGGSGSDSDEPQEYYTGGEKSGMLVQDPTRRNNVDSIFEQARVMGAQQVPLPSFEGQSSSSTSFAGTGRLLSGDAQTAPAAPQPPQDVLHNIHFWNNGFTVDDGPLRAYEDPANADFIESIKKSQCPQELEPADRRTAVHVNVIKRHGDYEEPARPRSAFQGVGRTLGGSSARXESCTTPAPVTQEPRSAPRSIGIVXDDSQPFTSIQLRLXADGTRMVARFNLQXTTVGDIRSFIDASRPGAARPYQLQTGFPPKQLTDPTQTLDQAGLKNSVIMQKMSCSRPSCICRTKCLFRCIIKPVLLNG

SEQ ID NO: 135064 - protein, 116 aa, Triticum aestivum
  Clone ID: PAT_TA_29482.pep
YYQAPKKISWYLIAQSQTELDTIYTWSPHSIICFLCLPLNQVSMAAYCIVQACPKASFTTSGKQMAPEKSNQDHTTCPCTYSIACSELMASQLVMIAGPKLHCSLSFIPHLLYSSA

SEQ ID NO: 135065 - protein, 60 aa, Triticum aestivum
  Clone ID: PAT_TA_29483.pep
LMAQMFEKNEPQQSEEGLGLLVSRNLLRLMNGDVRHLREAGVSIFILTAELACAPTAMEH

SEQ ID NO: 135066 - protein, 407 aa, Triticum aestivum
  Clone ID: PAT_TA_29484.pep
ANFTAESFRCPQHGCMVCKQKMFFWRCGRCTVAAHTKCAPWPLIHLKDDQGSAICWRHPSNWLLQNENADLTNNIEEVFCRLPLPYVNEEFNIDSTIRNFTAIVCKPPSYTHIRRNVYLVKKKRADSSAETGCTNCKSDSVCKDDCECRGLSMSCSKSCHCSDLCSNKPFRKDKKIKIVKSEGCGWGAVALEPLEKGDFIIEYVGEVINDATCEQRLWDMKRRGDKNFYMCEISKDFTIDATFKGNTSRFLNHSCDPNCKLEKWQVEGETRVGVFASRFIEVGEPLTYDYRFVHFGEKVKCHCGAKSCQGYLGSQLKNPTQNALAAAALENNKLLVQQGGCSPSRVKTETRLLPWTNCIEVPFNLRSKTKIDRICWGHKRQRTSLLDPSSSSASVQPSDIEAGAFIL

SEQ ID NO: 135067 - protein, 153 aa, Triticum aestivum
  Clone ID: PAT_TA_29485.pep
FDRKGETSVGQKEWIKTAVFYLETGENPRVYSKFDPYFVRSLTRFSDAGLVPALSDAQERAITILEEICQKHALHMILDVGDIQFLSNNHIFHARTAYKDYAPPAPRRHLMRLWLSTPEGEGGWKLPFPDSNEKKRGGIQVNDTAPVAPYDAE

SEQ ID NO: 135068 - protein, 102 aa, Triticum aestivum
  Clone ID: PAT_TA_29486.pep
PRARSRAHELLSAQSSGGLGRGPPSGNQPRVDPTDAAPQLLPLLTRGSPPSLEGRRRGFIPSPKGSRQRRTPARRSISGWPRWTPPPVGRTRRRLHPQIQWP

SEQ ID NO: 135069 - protein, 102 aa, Triticum aestivum
  Clone ID: PAT_TA_29487.pep
VDKAFIAPRRQIYAGWDVLRSNALGASAAVNAIVLLHIFLKPKGVIYLYMVIPVPAALVGVAWIGLDLWRVNKGQGQTSGASHLGGTLVAALVWARIRKGWI

SEQ ID NO: 135070 - protein, 250 aa, Triticum aestivum
  Clone ID: PAT_TA_29488.pep
MMSESEEHGSLLEKIGDKIGDKIHEFKKDSSSSDSDDDKKKPHKSKKKHLFGRKHPLHNVLGGGKAADLVMWRDKQKSGSILGGVTVIWLLFEGIGYHLLTFLCHLLVIFLTVSFVWSNAASFINRSPPKFPEVILSETQCLIIAHVLRKEINEAFITLQSVASGKDLKTYLKSIGVLWFISIIGGCFSFLTLSYTIFLMAYTLPMLYEKYEDEVDVVGEKALIELKKQYAVFDEKVLSKIPLVADKKQH

SEQ ID NO: 135071 - protein, 373 aa, Triticum aestivum
  unsure (1)..(373): unsure at all Xaa locations
  Clone ID: PAT_TA_29489.pep
MAGGGWRAWAERHKPCVAMVLVQXSTSLVDMALKTAYGLGMRPIVFVAYRQGIAAAALLLASLAARGLTLRPXAVGPRAFALLFLASLASATGQYFYFMGLQLASPSMARATTNLAPGITFAIAAVIGLEKVDLRSSRSIAKIVGTVVCLAGAMLMAFFKGPKLLGALLLPATDDWVRGGIYLMGNAFCFSIWYILQVPVCKSYLDPLSLATWMCFLATLQCAVMAFFLEANYMEIWKLASIWELPCILYGGVFASGANFFMQSWCISVKGPLYSAIFTPLSAVITTILSTLVLHEELHIGSVLGAIVIILGLYVVLWGKADDASGEGLAIRSGDSESILEQDCMGVKVESGTNLSEPLLLSENADADASRCQ

SEQ ID NO: 135072 - protein, 208 aa, Triticum aestivum
  Clone ID: PAT_TA_29490.pep
MSEEDSTSRPAPKLNERILSSLSRRAVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 135073 - protein, 227 aa, Triticum aestivum
  unsure (1)..(227): unsure at all Xaa locations
  Clone ID: PAT_TA_29491.pep
MALAARLVSRSRQLYSVQAALGQWRSXQVRSFAKEAAPVSGDDLLXGIFFEVKKKFETALXFLKKEKITIDPDDPTAVANYAXNVMRTVKRKGRSSLRFSENLKYXIETFTKGIPDARTYVVXLQQLRKKSGLIDDMGXEDMIXEALEKVEKDIKKLLLRSDKKNMNLLLAEFDKINKKTWHLLWADLSKNEENVXTWNLTKAELTELKXEVVEAMEGQPKRKEGGV

SEQ ID NO: 135074 - protein, 113 aa, Triticum aestivum
  unsure (1)..(113): unsure at all Xaa locations
  Clone ID: PAT_TA_29492.pep
KEKKSKAGPRTRSRRRWRWPGGRPGRAASASAAGPGPGGRGASRPAAAAGTSRPPSPCRPPPPXSSSPGCAPPLPPPAAALPRPTNPPSPDLTWLLLLIFLAPPDDDDDDHRR

SEQ ID NO: 135075 - protein, 557 aa, Triticum aestivum
  unsure (1)..(557): unsure at all Xaa locations
  Clone ID: PAT_TA_29493.pep
GKIIWAKHNEIQTVNIKTVGANFEATDGERLPLAVKELGSCDLYPQNLKHNPNGRFVVVCGDGTMIIYRQLAWRNRQFGSAIEFACAKGGEAXVKPAVFPRVNKCNSNFIMALRNGLMLSXMSHLLLLGQIPQNEIQTLQWKASLMXVNIDVPVCSNLADLMVLYGTFSRQLVVLPERSVESLHDMGGACDTSVLLHEVNERVRTGIWVGDCFIYNNSSWRLNYCVGGEVTTMYHLDRPMYLMGYLANQSRVYLIDKEFNVIGYTLLLSLIEYKTLVMRGDLESANEILPSIPKTQYNSVAHFLESRGMLEEALEIATDADYKFDLAVQLGKLEVAKAIAVEAQSESKWKQLGELAMSTGKLEASEECLLQAKDLSGLLLLYSSLGDAEGXVEKLASLAKEXGKNNVAFLCLFMLGKLEDCIQLLVDSNRIPEAALMARSYLPSKVSEIVAIFFRGVNNCNPNFIMVLQIRLMLSNXMSHLLLLGQIPQNEIQTLQWKASLMGYLNHAEKSDTTLVEASCTAQVRAQVVPVEARDENGEPDEEVMETEENVDEVGQV

SEQ ID NO: 135076 - protein, 243 aa, Triticum aestivum
  Clone ID: PAT_TA_29494.pep
RPRGRTSRWPVAMECGQCSARLAVTRGASSVQCAHCRRATRVERHGAVVHGAVGFVRSVFTNIGRARPHPGYPPVHGNKRALLVGINYTGTAAELPGPINDVKCMSFLLTLKYGFPGDCILVLTDEERYPYRRPTRANILLAMRWLVHGCSSGDSLVFHFSGHGDQEKDKDGDEQDGQDESICPLDWQLNGAILDRQPGRPVLRPLRPPARPRPLAPPRRRGPPLRLPNLCQIKKNGKPLWID

SEQ ID NO: 135077 - protein, 180 aa, Triticum aestivum
  Clone ID: PAT_TA_29495.pep
MDAGSASSSLRIVVVPWLAFGHLLPYLELSERLAERGHRVSYVSTPRNLARLPPLRPATAPRVDLVALPLPRVDGLPGGAESTNDVPDQQRELHWKAFDGLAAHFAEFMAAACADEATRPHWVIADCFHHWVAASAVEHKSPSTEQSEARAETRPRYEQEDMAPMFDDQSASGMSLGQRW

SEQ ID NO: 135078 - protein, 219 aa, Triticum aestivum
  Clone ID: PAT_TA_29496.pep
EQVGASSAGPPPADRTPSRMPDIESWSFPCLPSCIQQGWRTAQPWRGASILAMALGLERGESAPSGSAPTTVGPGVALGLKTPPSTPGRAFDTGAREALGAAARPWTASPSGAVVPDSPPCWPSCGPVPEQSAVVSFFLSSVVHVHRPCATQEGRPQRPRRSTRWQRCAGRLCTAVGDAATRWNCYARRCAESSWPRPSWRARRGGHVRPPDEPSLLAA

SEQ ID NO: 135079 - protein, 151 aa, Triticum aestivum
  Clone ID: PAT_TA_29497.pep
LDYPGMEACYPRDLFPCLEPAVAHLQDSTTSLPWINRRLTSTIYTPHHSFPFHTSRPNPWGSPEDAGSADRHPQPTLSRVDAQGAMASKPEIPWTVVAEWKYARVRKQLANGSASDESDDLEKEHGLTGIKGSVSYRQPYVLYVDGGISSV

SEQ ID NO: 135080 - protein, 360 aa, Triticum aestivum
  Clone ID: PAT_TA_29498.pep
AVAVRLGLDGTGRVLVVCTSEGEVFVTAGSEHYVIEKLLYDFVPCDEMRDLLVPTSPAPNPPCALLFVQITRLRCGGLVLGQAMHHSIVDARGAAHFFETWASISRGGGAPTVPPCFDHTLLAARPPQSRAVLYDHPEYKPEPEPVDPVSASTYASAIVTMSKGQVGALKARCLGASTFRAVVALVWQCVCRARALPPSAGTRLYSMVDMRARLDPQLPAGYFGNAVIRTSVSATVEEVVSSPLVHAARLARAATSQGGDHARSLVDYLEGVDTMNLPRSGISRAHLRAISWMGMSLSDADFGWGAPAFMGPALMYYSGFVYVMNAPGKDGALALVLSLEPESMPAFRKVFADELARLEL

SEQ ID NO: 135081 - protein, 184 aa, Triticum aestivum
  Clone ID: PAT_TA_29499.pep
SPAKEPHIPPVAARSNGEVSQGLDAIEEHPQTIETVAERRPSLSTQISMNEAYNLAIGMSGFPSPTLTDVILGKGSSASVNGELRLLLSQLSASRGLEATWLDPGPSPRTYGRGDDLIVQNITRRISLERNVSGLESLDGSIISEMEGESTIDRLRRQIDLDRKSIHLLCRELEEERNAAAIAA

SEQ ID NO: 135082 - protein, 460 aa, Triticum aestivum
  Clone ID: PAT_TA_29500.pep
VISAKRIRNFGKRIGSEDWALGSRPRTRRRSPGEYDHVRELIKWGTDCLLLTFNSSASTINKLYSQVGTAKINGSTPDDHFCWNRPEDMAYPRPVQQASAAPDLGGEVAAALASASIVFRDNAAYSKKLVKGAATVYKFARANGKRTPYSRGNPAIEYFYNSTSYWDEFMWSASWMYYATGNNSYISFATDPRLPKNAKAFFNILDFSVFSWDNKLPGATLLLSRLRMFLNPGYPYEESLMGYHNVTSMNMCMYFPKFNAFNFTKGGLAQFNHGQGQALQYAVANSFLAALYADYMESVNVPGWYCGPNFMTVDDLRSFAKSQLNYILGDNPMKMSYVVGYGKKYPKRLHHRGASTPKNGIKYSCTGGNKWRDSKKADPHVLVGAMVGGPDKNDKFKDARISYAQNEPTLVGNAGLVAALVAITNSGRGTGVGAVDKNTMFSAVPPMFPAAPPPPATWKP

SEQ ID NO: 135083 - protein, 390 aa, Triticum aestivum
  unsure (1)..(390): unsure at all Xaa locations
  Clone ID: PAT_TA_29501.pep
RSAPGHSVFNDSLRRIFQSSDRHLRVSFNGIFEINCSKDVKIQGIIGPCTSLEKKGPLSSDTVVGQGNTSAWKMCGLDRKTSLCLVFDMAKKDAPDAIGQSQNNLFYFQFLTYYQHHDGQMRLRSTTISRRWVAGSGSVQELITGFDQEAAAAVMARLVSFKMEAEVDFDPXRWLDRALISLCSKFGDYQKEAPSSFSLSPRLSIFPQFIFNLRRSQFIQVFNNSPDETAYFRMMLNRENVANAVVMIQPSLISYSFQSGPEPVLLDVSAIAGDRILLLDSYFTVVIFHGITIAQWRKAGYQHQEGHEVFAQLLQAPQEEADSIIKERFPVPRLVVCDQYGSQARFLLAKLNPSVTYDSDTPPPPGGDMIFTDDASFQVFMEHLQRLAVQ

SEQ ID NO: 135084 - protein, 101 aa, Triticum aestivum
  Clone ID: PAT_TA_29502.pep
SSVDMQVVVEGLFHVHLQTAILVRTQAVAHVCRLRTVQAVDSSGAHSQAYVVDDGLLVCLVLYFSCYKRDLSRSQSFTYNMLRKTSIAEYIRQVMCFRLPA

SEQ ID NO: 135085 - protein, 76 aa, Triticum aestivum
  Clone ID: PAT_TA_29503.pep
HNKSPNDPFPAEWGVGSIFGAECEKRGMLIRVAGDNIMLSPPLIMTPDEVEEIVSKYGGALKATEERIEELKSAKK

SEQ ID NO: 135086 - protein, 101 aa, Triticum aestivum
  Clone ID: PAT_TA_29504.pep
TALFGKLSLQVRMCQIYLVCNQVVNHHCSVKECFALPFRASRTASVPVRYYHLIARNYSVHIRDQRRSRHYHRRCAASCLVFLRFELRHFHPRGPGNIRPV

SEQ ID NO: 135087 - protein, 131 aa, Triticum aestivum
  Clone ID: PAT_TA_29505.pep
MMIARGCLLRSKLAESLVKHVASGGSWHGLHSFSEASARGFSSEPSLQPDSTEEIGFKGHGMLAPFTAGWQSTDVHPLVIDRSEGAYVYDINGKKYIDALAGLWCTALGGSEPRLVKAATEQLNKLPFYHS

SEQ ID NO: 135088 - protein, 382 aa, Triticum aestivum
  unsure (1)..(382): unsure at all Xaa locations
  Clone ID: PAT_TA_29506.pep
MIARGLLRSNSSSQASKLVKYLTSAGSLQGHADSLSDASVRHFSSASSPQTNSTEENGFKGHGMLAPFTAGWQSNDVHPLVIERSEGSYVYDINGNKYLDSLAGLWCTALGGSEPRLVKAATDQLNKLPFYHSFWNRTTKPTLDLADDLLSMFTASKMGKAFFTNSGSEANDSHVKLVWYYNNALXRPNKKKVIARSKAYHGSTLISASLTGLATLHQDFDLPGTFVLHTDCPHYXWRYHLPGETEEECAXRLANNXENLILTEGPDTIAXAFIAEPEIGAXGGVTPXAPKTYSENIQEGGKKHDMLLIVDEDSTGLGRLVAMXGSDLYDINPDLDALAKALSSAYAPIGAVLVSREISDVIYSHSNKLGTFAHGFTYSGHP

SEQ ID NO: 135089 - protein, 483 aa, Triticum aestivum
  unsure (1)..(483): unsure at all Xaa locations
  Clone ID: PAT_TA_29507.pep
METPRGLLQSDASADQVASERSDSVQQHGVDKEHAMLAPFTAGWQTAISPTLIIERSEGCYIYDANGNKYLDALAGLLSTALGGSEPRLVKAATEQLNKLPFYHSFYNHTTRPSLDLANELISIFTARQMGKVFFTCSGSEANDSQVKLVWYYNNALGRPKKKKIIARSQSYHGTTYISASLTGLPALHQKFDLPAPFVLHTDCPHYWRFHLPGETEEEFATRLAKNLEDLILKEGPETIAAFIAEPVMGAGGVIPPPKTYFDKVQAVVKKYDILFIVDEVITAFGRLGTMFGSDMYNIKPDLVTLAKALSSAYVPIGAXLVSPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKATEERVAELKSKKN

SEQ ID NO: 135090 - protein, 185 aa, Triticum aestivum
  unsure (1)..(185): unsure at all Xaa locations
  Clone ID: PAT_TA_29508.pep
MPSKLVSVAEPLSPAYMPIANPLLGPEVADVAPSYGPKLGSLVHGFTSAGHPVACNVLGTFAKSFTDRNIPVSCNTIVRSIKNLSGNISFRPIIGEIRGVGLLLGTEFADNKSPYDLFPSEWGIGEIFGAECKKRGMVVKVLGNLIAMXPPLIMTLEEIDKLVSIYGEALKVTEERVAECKAKKE

SEQ ID NO: 135091 - protein, 216 aa, Triticum aestivum
  unsure (1)..(216): unsure at all Xaa locations
  Clone ID: PAT_TA_29509.pep
ACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTMQVFSDLNASKYQMAEYRISIYGRKQSEWDQLASWIVNNELYSENVVWLIQIPRLYNVYQQMGIVTSFQNLLDNIFLPLFEVTIDPASHPXQLHVFXLKQAVGLDLVDDESNPESN

SEQ ID NO: 135092 - protein, 249 aa, Triticum aestivum
  Clone ID: PAT_TA_29510.pep
MLRPSPYSSRRLLQSGDPSRIPGIPPADPPAGVSSDVVVILAALLCALICVVGLAAVARCARSRRNANAHANQSSPSGSPAHALAAFGGGGGGHNHGTTTTTTTGASGGSVTTTSKGLKKKALKALPKLAYADAVAAAAAARGAVAGGEEEEGQDGILAECAICLTEFGEREEVRVMPQCGHGFHVDCVDTWLRSNSSCPSCRRPIVLDDPAPPKRCRKCEETILEAVIASSSSSAGGSRGGGRGGFLP

SEQ ID NO: 135093 - protein, 201 aa, Triticum aestivum
  Clone ID: PAT_TA_29511.pep
WLTRLSLVLLCAGLPLLLFSRAEAGEVGVCYGRNGNNLMDPASVVQLLKKNGITSVRVYDTDQGVLDAMKNSGIKMVVAVPNEMLPSAAGDPDWAIQWANNNLLPYYPATDIRGVTVGNEVFKQASEHTSHLVPAMKNVQAALAGLGLADAVKVTTPIALDALKLSFPPSESSYLMVNIYPYYAYASSILAKKVLTQWVKI

SEQ ID NO: 135094 - protein, 119 aa, Triticum aestivum
  Clone ID: PAT_TA_29512.pep
TRLYLQVQRFRTNRFRLSEVKASAILASPPPPLDLKRSQTELALLLLTELNSGTTTASCPSPICWQDEINEAEIEPSSHLRRRSSIYRWIMDGALVDPFLQPATACPPQLVIHGCPAEI

SEQ ID NO: 135095 - protein, 178 aa, Triticum aestivum
  Clone ID: PAT_TA_29513.pep
SVGKQVPFNRDLRKKFTHCSSDMEPGQCIFPREVAKGIHTPMFILNPAYDVWQVEHVLSPEGSDPERLWQNCRLDITKCDSKQLETLQGFRKELLDAISEFKKKKDWGMFINACFIHCQSMNSLTWHSPSAPRINNKTIAESVGDWFFNRREVKEIDCEYPCNPTCHNAVLDQAYKEE

SEQ ID NO: 135096 - protein, 153 aa, Triticum aestivum
  Clone ID: PAT_TA_29514.pep
ELERRRSGRTKLSGEQIQSRRTREVAPDTKRDGRARAGAPYAVETESMPKSPAKAFSNSSTEQRKAAPAYSRVSVQQSSPNPVRIEPPTARDRWQEDEPEGSSSPENEGNRETSAETLKVSTPTAGPAHVHPKLPTDYDSFAAQFKSLRTNRR

SEQ ID NO: 135097 - protein, 160 aa, Triticum aestivum
  unsure (1)..(160): unsure at all Xaa locations
  Clone ID: PAT_TA_29515.pep
MVLPSTLMVSLSTIFTSALKVPSIEVVSNRDPLKLPWAELGIDIVIEGTGVFVDGPGAGKHLQAGAKKVIITAPAKGADIPTYVXVGVNEGDYGMRSPTSSSNASCTTNCLAXPFAKALDEDFGSLKGXMTTTTPYTGDKSCWTRPTRLLXQGRGAEILR

SEQ ID NO: 135098 - protein, 80 aa, Triticum aestivum
  Clone ID: PAT_TA_29516.pep
PEEKKAKAIPANELKGILDVCDEPLVSVDFRCSDVSSTIDASLSMVMGDDMVKVIAWYDNEWGYSQRVVDLADIVADQWK

SEQ ID NO: 135099 - protein, 133 aa, Triticum aestivum
  unsure (1)..(133): unsure at all Xaa locations
  Clone ID: PAT_TA_29517.pep
MASQLSAMTSVPQFHGLRSYSSPRSMATLPSLRRKRSQGIRCDYIGSSTNIIMVTPTTLXMLFAGRFGLAPSANRKATAGLKLEAREXRAANGANPAGFTFADTVACGSFGHILGVGIVLGLKNTGVLDQIIG

SEQ ID NO: 135100 - protein, 64 aa, Triticum aestivum
  Clone ID: PAT_TA_29518.pep
MYLQYYINEKGVKVYTTKKESPLGVPTQSAHPARFSPDDKYARQRYLLKKRFGLLPTQQPAQKY

SEQ ID NO: 135101 - protein, 92 aa, Triticum aestivum
  Clone ID: PAT_TA_29519.pep
ISTHLAITTYKALTQGRMIANIQLSAIIHLNRREFWRMIKRAAGVGAEDEPESLIHSTKSPEQEASFEFWTPQVKKIDLKTHHKPKKRTTTT

SEQ ID NO: 135102 - protein, 165 aa, Triticum aestivum
  unsure (1)..(165): unsure at all Xaa locations
  Clone ID: PAT_TA_29520.pep
GGADIVPTSTGAAKXVALVLPQLKGKLNGIALRVPTPNVSVVDLVINTVKTGITADDVNAAFRKAADGPLNGVLSVCDVPLVSVDFRCSDVSSTIDASLTMVMGDDMVKVVAWYDNEWGYSQRVVDLAHLVAAKWPGAAAAGSGDPLEDFCKDNPETDECKVYEA

SEQ ID NO: 135103 - protein, 125 aa, Triticum aestivum
  Clone ID: PAT_TA_29521.pep
MAPKADKKPAAENKVEKAAEKTPAGKKPKAEKRLPAGKTASKEAGGEGKTRGRKKGSKAMSIMNSFINDIFEKLAGESAKLARYNKKPTITSREIQTSVRLVLPGELAKHAVSEGTKAVTKFTSS

SEQ ID NO: 135104 - protein, 140 aa, Triticum aestivum
  Clone ID: PAT_TA_29522.pep
KAQIQSRRTREVAPDTKRDGRARVGAQYAVEAESTPKSPAKAFSNSSTEQRKVAPAYSRVSVQQSLPNPVRIEPPAARGRWQEDEPDGSSSPENEGNTETSAETLKVSTPTAGPAHVHPKLPTDYDSFAAHFKSLRTNRR

SEQ ID NO: 135105 - protein, 117 aa, Triticum aestivum
  Clone ID: PAT_TA_29523.pep
FFFFFFAEVTACIHNGHQKLEPATNPLHNLSRCSNAGAANKAISLSYNHVYMPLPKSFSYVPALLYTKEATSILVGSITLRITKSACLLRCQGAGKRESLKEYIFCQPQHRLSTSSK

SEQ ID NO: 135106 - protein, 129 aa, Triticum aestivum
  unsure (1)..(129): unsure at all Xaa locations
  Clone ID: PAT_TA_29524.pep
MASQLSAMTSVPQFHGLRSYSSPRSMATLPSLRKRSQGIRCDYIGSSTNIIMVTTTTLMLFAGRFGLAPSANRKATAGLKLEARESGLQTGDPAGFTLADTLACGSFGTXLGRRIVLGSKNTGVSTNYR

SEQ ID NO: 135107 - protein, 97 aa, Triticum aestivum
  Clone ID: PAT_TA_29525.pep
MLRGVENKHRSGDSQIGQPFKHPDIGISSKAMSIMNSFINDIFEKLAGESAKLARYNKKPTITSREIQTSVRLVLPGELAKHAVSEGTKAVTKFTSS

SEQ ID NO: 135108 - protein, 64 aa, Triticum aestivum
  Clone ID: PAT_TA_29526.pep
MYLQFYTNENGEKVYTTKKESPLGVPTQSAHPARFSPDDKYARQRYLLKKRFGLLPTQQPAQKY

SEQ ID NO: 135109 - protein, 301 aa, Triticum aestivum
  unsure (1)..(301): unsure at all Xaa locations
  Clone ID: PAT_TA_29527.pep
GLPVPHGGARRGRGKQKQPRNPEADPRAARYPHFLSRSSARRGDRWTXFESGDKGIAGPAPGPGAGDDGNSAPLPETVQIGNSPTYKLGRKLGKGGFGQVYVGRRVSSPSLGDRNPGANALEVALKFEHRTSKGCNYGAPSEWQVYNTLSGNHGVPRVHYKGKQGEFYIMVMDMLGPSLWDVWNNNSHSMSVEMVACIAIEAISILEKMHSKGYVHGDVKPENFLLGPCGTLEEKKLFLVDLGLATKWKGAGNGHIEYDQRPDVFRGTVRYASVHAHLGRTGSRRDDLESLXYTLIFLLPW

SEQ ID NO: 135110 - protein, 132 aa, Triticum aestivum
  Clone ID: PAT_TA_29528.pep
ERPPGQVVALVLPNLKGKLNGIALRVPTPNVSVVDLVVQVSKKTLAEEVNQAFRDAAANELKGILDVCDEPLVSVDFRCSDVSSTIDASLSMVMGDDMVKVIAWYLGRDHRAAARAGTRPLRCPDCPCSAFL

SEQ ID NO: 135111 - protein, 160 aa, Triticum aestivum
  unsure (1)..(160): unsure at all Xaa locations
  Clone ID: PAT_TA_29529.pep
QWERXYYITALAGANSGSSLVIMSRGTTYAQQSYKVSDAFPFKWINKKWKEGFYVTSMATAGSRWAVVMSRNAGFSDQVVELDFLYPSEGIHQRWDNGYRITATAATLDQAAFILSIPRRKPNDETQETLRTSAFPSQHVKEKWSKNLYLASICYGRAAS

SEQ ID NO: 135112 - protein, 154 aa, Triticum aestivum
  unsure (1)..(154): unsure at all Xaa locations
  Clone ID: PAT_TA_29530.pep
MAPKADKKPAAENKVEKAAEKTPAGKKPKAEKRLPAGKTASKEAGGEAKTRGRKKGSKAKKGVETYKIYIFKVLKQVHPDIGXISSKAMSIMNSFINDIFEKLAGESAKLARYNKKPTITSREIQTSVRLVLPGELAKHAVSEGTKAVTKFTSS

SEQ ID NO: 135113 - protein, 64 aa, Triticum aestivum; identical to SEQ ID NO: 135100
  Clone ID: PAT_TA_29531.pep

SEQ ID NO: 135114 - protein, 153 aa, Triticum aestivum
  Clone ID: PAT_TA_29532.pep
MAPKADKKPVAENKVEKAAEKTPAGKKPKAEKRLPAGKTASKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 135115 - protein, 355 aa, Triticum aestivum
  Clone ID: PAT_TA_29533.pep
STRPRLPWQGYQGDNKGFLVSKKKMATSPESLCGICPQSFRHFVEYVVNLKFDEEPNYAKCISLFDGIVGPHPDTRPINTDGAQKLIYQVGQKRGRLIAEEDDEQPKKKIRMGMPATQWISVYSARRPMKQRYHYNVADDRLVQHILKGNEDGLFISSVSSSANLWALIMDAGTGFTAQVYEISQHFLHKEWILEQWERNYYITALAGANSGSSLVIMSRGTTYAQQSYKVSDAFPFKWINKKWKEGFYVTSMATAGSRWAVVMSRNAGFSDQVVELDFLYPSEGIHQRWDNGYRITATAATLDQAAFILSIPRRKPNDETQETLRTSAFPSQHVKEKWSKNLYLASICYGRAAS

SEQ ID NO: 135116 - protein, 250 aa, Triticum aestivum
  Clone ID: PAT_TA_29534.pep
MAALRLASSITLCPAAAAASPSSAAAAPRAASFACAVARGLPSLRLAAPRRRRGDLGRPSAAGAEAAAENYATALTEVAYESDSLDATVADMEKLEKIFAEEAIAEFFDNPTVPREEKTALIDEIAKSSELQPHTVNFLNVVIDNTRAGLMPQIVREFETAYNALTGTEEAVVTSVVQLESQDLAQIATHVQNITGAANVRIKTRLDPELIAGFTVQYGRDSSNFIDMSVRKQIAEITSEFEMPSVNLEV

SEQ ID NO: 135117 - protein, 724 aa, Triticum aestivum
  unsure (1)..(724): unsure at all Xaa locations
  Clone ID: PAT_TA_29535.pep
GAYESTAYMNDTTPRKQQAGRLMKDGKSFNEQISGINDPRMISSNAREDEERAETXRVSSQNMSTPYSSQLHSYAPESRTDHDMPTEPHHAHSSEPPYFNDSSEPPYFDDSSEKESNIRRPEDHPFDLHEERLPDAGFDWHHTKDIGSRQASFDQESRNNHYSNFSASHGGSSMSWDNQNDKAGADSSAVLFDEYDYDVQEENLLDHFASKHTEELSTVQGHKGFSSADWSKQPRSESPVDRTTSTLFSRTETQPSYDLGANKEDIPLNDTRPPTFDSDGVSSDEETSTDMHILRTHSRGSDYSENKMFNKNSGKFVPAVIEDHESRPSKHYQNPPGSDVFRKEQNSDGSPRYDYSGARGNLGRVQSRDYDLSEEETEPHRLEGTSSGITGANENRPSPFRMQTSATSDDSDDGDLGLNYGRLTPGLRNKLRQRPQYKISGDNLLRKQSLEGASASIEESVHFKENDTSSEQTGDTPKGSRTTKNSFGANYHSEHLDGRHTVGKPVESRSSMTRNDFYSGDTGKLSERSGSPISSPAKTSVRENSIQESGVRRESRSRTARTFFDSDESEEELERRRSVQTKLSKEQIQSRRTREVAPDAKRDGRARAGAQYAVETESTPKSPAKAFSNSSTEQRKAAPAYSRVSVQQSSPNPARIEPPAARGRWQEDEPDGSSSPENEGNAETSAETLKVSTPTAGPAHVHPKLPTDYDSFAAHFKSLRTNRR

SEQ ID NO: 135118 - protein, 153 aa, Triticum aestivum
  Clone ID: PAT_TA_29536.pep
MAPKADKKPAAENKVEKAAEKTPAGKKPKAEKRLPAGKTASKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 135119 - protein, 593 aa, Triticum aestivum
  Clone ID: PAT_TA_29537.pep
TRQKIMCNVDEKDIAEHLRIRLKKEQEEKEHKKKEKAEAHLYTIIKVARDEDLKEQIGKNIYFDLVDHEKVRNFRIQKQLPFNSFKEEVAKEYGIPVQSQRFWLWAKRQNHTYRPNRPLAPHEEAQSVGQLREVSNKAHNAELKLFLEVELGLDLRPIRPPEKSKEDILLFFKLYNPEKEELRFVGRLFVKALGKPSDILTKLNEMAGFSPNEEIELYEEIKFEPNVMCEHIDKKLSFRSSQLEDGDIISFQKPSIPGGDTQVRYKDVPSFLEYVHNRQVVHFRCLEKPKEEEFCLELSKLHTYDDVVERVARQLGLNDPSKVRLTSHNCYSQQPKPQPIRYRGVEHLLDMLVHYNQTSDILYYEVLDIPLPELQCLKTLKVAFHHATKDEVVIHSIRLSKNSTISDVITDLKTKVELSNPDAELRLLEVFYHKIYKIFPPHEKIENINDQYWTLRAEEIPEEEKNLTAQDRLIHVYHFMKDPNQNQQIQNFGDPFLLVIREGETAAEVMDRVQKKLRVPNEEFAKWKVAFISMNRPEYLQDIDAVSARFQRRDVYGAWEQYLGLEHTDTTPKRSYTANQNRHTYEKPVKIYN

SEQ ID NO: 135120 - protein, 371 aa, Triticum aestivum
  unsure (1)..(371): unsure at all Xaa locations
  Clone ID: PAT_TA_29538.pep
KVEPGLSAYAGRPQEAAKSIVPLLEKAKSTVPRWLMKKTPVKLGATAGLRLIGDEKAEQILEAVRDAVHSKSKFQYNPSWINVLTGSQEGSYLWVALNYLLGNLGGDYSKTVGVIDLGGGSVQMAYAISADAAAAAPVVPQGDDPYVTKEYLKGRDYNVYVHSYLHYGAMASRVEIFKAKNGPVSYCMLRGYNGKYTYNGEQYDAVAPPQGAAYDKCREDVTKALKISAPCQAKNCTFNGAWNGGGGPGQADLYVTSSFYYMAADVGLIDSEATSGKTTPAAFRAAAEKICPMGFVEAKAAYPKVRSVDAPFICMDLIYQYSLXVDGFGLEPTKEITVAQKVKHGEYFIEAAWALGEAIEAVSPTKRLNDA

SEQ ID NO: 135121 - protein, 153 aa, Triticum aestivum; identical to SEQ ID NO: 135118
  Clone ID: PAT_TA_29539.pep

SEQ ID NO: 135122 - protein, 112 aa, Triticum aestivum
  unsure (1)..(112): unsure at all Xaa locations
  Clone ID: PAT_TA_29540.pep
VRHSTASPSSTNACIALPKNPVFNGLGCSHFVRRYXGDRFCFLFLXGYLRCFSSPGCLLPAHGFSRQFKRLTYLGISGSMLIFNSPKHFVACYALPRLWVPRYPPSCRIRHE

SEQ ID NO: 135123 - protein, 224 aa, Triticum aestivum
  Clone ID: PAT_TA_29541.pep
YHQICAGFAFVYFEDERDGDDAIRALDGYPFGPGRRRLSVEWSRGDRGTRRDDRDGYSKPPVNTKPTKTLFVINFDPINTRVSDLERHFGHFGRISNVRIRKNFAFVQFETQEEATKALDATHLTKLLDRVISVEYAFRDDSEPGDKYDRPSRGGGYGRPDDSSYRRSVSPMYRRSRPSPDYGRPASPQYGAYGRSRSPVRDRYRSRSPVQRSRSPAPNRRGYD

SEQ ID NO: 135124 - protein, 153 aa, Triticum aestivum; identical to SEQ ID NO: 135118
  Clone ID: PAT_TA_29542.pep

SEQ ID NO: 135125 - protein, 64 aa, Triticum aestivum; identical to SEQ ID NO: 135100
  Clone ID: PAT_TA_29543.pep

SEQ ID NO: 135126 - protein, 249 aa, Triticum aestivum
  Clone ID: PAT_TA_29544.pep
MAALRLASSITLCPAAAAASPSSAAAPRAASFACAVARGLPSLRLAAPRRRRGDIGRPSAAGAEAAAENYATALTEVAAESDSLDATVADMEKLEKIFAEEAIAEFFDNPTVPREEKTALIDEIAKSSELQPHTVNFLNVVIDNTRASLMPQIVREFETAYNALTGTEEAVVTSVVQLESQDLAQIATHVQNITGAANVRIKTRLDPELIAGFTVQYGRDSSNFIDMSVRKQIAEITSEFEMPSVNLEV

SEQ ID NO: 135127 - protein, 463 aa, Triticum aestivum
  Clone ID: PAT_TA_29545.pep
MAQAHHASSVLLLLLVAFSFAGSAFAADVAVLGRKAGIGAVAEEGPELKAAPGKYAVIFDAGSTGTRVHVFRFDKKMELIDIGDGDDIEVFAKVEPGLSAYAGRPQEAAKSIVPLLEKAKSTVPRWLMKKTPVKLGATAGLRLIGDEKAEQILEAVRDAVHSQSKFQYNPSWINVLKGSQEGSYLWVALNYLLGNLGGDYSKTVGVIDLGGGSVQMAYAISADAAAAAPGVPQGDDPYVTKEYLKGRDYNVYVHSYLHYGAMASRVEIFKAKNGPVSYCMLRGYNGKYTYNGEQYDAIAPPQGAAYDKCREDVTRALKISAPCQAKNCTFNGAWNGGSGPGQADLYVTSSFYYMASDVGLIDSEATSGKTTPAAFRAAAEKICPMGFVEAKAAYPKVRSADAPYICMDLIYQYSLLADGFGLEPTKEITVAQKVKHGEYFIEAAWALGEAIEAVSPTKRLNDA

SEQ ID NO: 135128 - protein, 293 aa, Triticum aestivum
  Clone ID: PAT_TA_29546.pep
MKATAGALLAVVAAVLLRGVAAAPRKPVDVPFDKNYVPTWAQDHIHYVNGGREVQLSLDKTTGTGFQTRGSYLFGHFSMHIKLVGGDSAGTVTAFYLSSQNSEHDEIDFEFLGNRTGQPYILQTNVFSGGKGDREQRIYLWFDPTKDYHSYSVLWNLYMIAFFVDDTPIRVFKNSKDLGVRYPFDQPMKLYSSLWNADDWATRGGREKTDWSKAPFVASYRGFHVDGCEASAEAKFCATQGARWWDQPEFQDLDAAQYRRLAWVRKEHTIYNYCTDHDRYAAMAPECKRDRDV

SEQ ID NO: 135129 - protein, 153 aa, Triticum aestivum; identical to SEQ ID NO: 109663
  Clone ID: PAT_TA_29547.pep

SEQ ID NO: 135130 - protein, 153 aa, Triticum aestivum; identical to SEQ ID NO: 109663
  Clone ID: PAT_TA_29548.pep

SEQ ID NO: 135131 - protein, 446 aa, Triticum aestivum
  unsure (1)..(446): unsure at all Xaa locations
  Clone ID: PAT_TA_29549.pep
MAAHAALAATRIPTSARLHSKAASRQRVDFADFSGLRPGSCSVSAAAREASFSDVLGAQLVARASGENTVRAPAEAKLKVAINGFGRIGRNFLRCWHGRENSPLEVIVINDSGGVRNASHLLKYDSMLGTFKADVKIVDNETISVDGKNIQVVSNRDPLKLPWAELGIDIVIEGTGVFVXDGPGAGKHLQAGAXKKVIITAPAKGADIPTYVVGVNEGDYDHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINTVKTGITADDVNAAFRKAADGPLKGILDVCDEPLVSVDFRCSDVSTSIDASLTMVMGDDMVKVVAWYDNEWGYSQRVVDLAHLVAAKWPGAGTGGSGDPLEDYCKTDPNAVECKVFDE

SEQ ID NO: 135132 - protein, 444 aa, Triticum aestivum
  Clone ID: PAT_TA_29550.pep
MAAHAALAATRIPTSARLHSKAASRQRVDFADFSGLRPGSCSVSAAAREASFSDVLGAQLVARASGENAVRAPAEAKLKVAINGFGRIGRNFLRCWHGRENSPLEVIVINDSGGVRNASHLLKYDSMLGTFKADVKIVDNETISVDGKNIQVVSNRDPLKLPWAELGIDIVIEGTGVFVDGPGAGKHLQAGAKKVIITAPAKGADIPTYVVGVNEGDYDHDVANIVSNASCTTNCLAPFAKILDEEFGIVKGTMTTTHSYTGDQRLLDASHRDLRRARAAALNIVPTSTGAAKAVSLVLPQLKGKLNGIALRVPTPNVSVVDLVINTVKTGITADDVNAAFRKAADGPLKGILDVCDEPLVSVDFRCSDVSTSIDASLTMVMGDDMVKVVAWYDNEWGYSQRVVDLAHLVAAKWPGAGTGGSGDPLEDYCKTDPNAVECKVFDE

SEQ ID NO: 135133 - protein, 446 aa, Triticum aestivum
  unsure (1)..(446): unsure at all Xaa locations
  Clone ID: PAT_TA_29551.pep
MAAHAALAATRIPTSARLHSKAASRQRVDFADFSGLRPGSCSVSAAAREASFSDVLGXQLVARASGENAVRAPAEAKLKVAINGFGRIGRNFLRCWHGRENSPLEVIVINDSGGVRNASHLLKYDSMLGTFKADVKIVDNETISVDGKNIQVVSNRDPLKLPWAELGIDIVIEGTGVFVDGPGAGKHLQAGAKKVIITAPXAKGADIPTYVVGVNEGDYGHEVANIISNASCTTNCLAPFAKVLDEEFGIVKGTMTTTHSYTGDQRLLDASHRDLRRARAAALNIVPTSTGAAKAVSLVLPQLKGKLNGIALRVPTXPNVSVVDLVINTVKTGITADDVNAAFRKAADGPLKGILDVCDEPLVSVDFRCSDVSTSIDASLTMVMGDDMVKVVAWYDNEWGYSQRVVDLAHLVAAKWPGAGTGGSGDPLEDYCKTDPNAVECKVFDE

SEQ ID NO: 135134 - protein, 462 aa, Triticum aestivum
  Clone ID: PAT_TA_29552.pep
MAHHASGALLLILLVAFSLAGSAFAADVAVLGRKAGISTITEEEPELKKAAGKYAVIFDAGSTGTRVHVFRFDKKMELIDIGDGDDIEVFAKVEPGLSAYAGRPQEAAKSIVPLLEKAKSTVPRSLMKKTPVKLGATAGLRLIGDEKAEQILEAVRDAVHSQSKFQYNPSWINVLKGSQEGSYLWVALNYLLGNLGGDYSKTVGVIDLGGGSVQMAYAISADAAATAPGVPQGDDPYVTKEYLKGRDYNVYVHSYLHYGAMASRVEIFKAKNGPVSYCMLRGYNGKYTYNGEQYDAIAPPQGATYDKCREDVTKALKINAPCQAKNCTFNGAWNGGGGPGQADLYVTSSFYYMAADVGLIDSEATSGKTTPAAFRAAAEKICPMGFMEAKATYPKVRSVDTPYICMDLVYQYSLLVDGFGLEPTKEITVAQKVKHGEYFIEAAWALGEAIEAVSPTKRLNDA

SEQ ID NO: 135135 - protein, 130 aa, Triticum aestivum
  Clone ID: PAT_TA_29553.pep
MASQLSAMTSVPQFHGLRSYSSPRSMATLPSLRKRSQGIRCDYIGSSTNIIMVTTTTLMLFAGRFGLAPSANRKATAGLKLEARESGLQTGDPAGFTLADTLACGSFGHILGVGIVLGLKNTGVLDQIIG

SEQ ID NO: 135136 - protein, 130 aa, Triticum aestivum
  Clone ID: PAT_TA_29554.pep
MASQLSAMTSVPQFHGLRSYSSPRSIATLPSLRKRSQGIRCDYIGSSTNIIMVTTTTLMLFAGRFGLAPSANRKATAGLKLEARESGLQTGDPAGFTLADTLACGSFGHILGVGIVLGLKNTGVLDQIIG

SEQ ID NO: 135137 - protein, 402 aa, Triticum aestivum
  unsure (1)..(402): unsure at all Xaa locations
  Clone ID: PAT_TA_29555.pep
MASPMLSTAMAPLQGGMLEFSGLRSSSSLPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTGVFVDRAGAGKHLXAGAKKVLITAXPGKGDIPTYVCGVNADLYTHADTIISNASXTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDAAANELKGILDVCDEPLVSVDFRCSDVSSTIDASLSMVMGDDMVKVIAWYDNEWGYSQRVVDLADIVANQWK

SEQ ID NO: 135138 - protein, 402 aa, Triticum aestivum
  unsure (1)..(402): unsure at all Xaa locations
  Clone ID: PAT_TA_29556.pep
MASPMLSTAMAPLQGGMLEFSGLRSSSSLPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTXGVFVDRAGAGKHLEAGAKKVLITAPGKGDIPTYVCGVNADLYTHADTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDAAANELKGILDVCDEPLVSVDFRCSDVSSTIDASLSMVMGDDMVKVIAWYDNEWGYSQRVVDLADIVANQWK

SEQ ID NO: 135139 - protein, 404 aa, Triticum aestivum
  unsure (1)..(404): unsure at all Xaa locations
  Clone ID: PAT_TA_29557.pep
MASPMLSTAMAPLQGGMLEFSGLRSSSSLPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTGVFVDRAGAGKHLEXPGAKKVLITXHPGKGDIPTYVCGVNADLYTHADTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDAAANELKGILDVCDEPLVSVDFRCSDVSSTIDASLSMVMGDDMVKVIAWYDNEWGYSXQRVVDLADIVADQWK

SEQ ID NO: 135140 - protein, 127 aa, Triticum aestivum
  Clone ID: PAT_TA_29558.pep
AQALPCTSSASWRAKRPSAPAALARYPLPGGSGSQQRESTPRNNGGGGEAGGYGGMYGGPGAGGGGGGGMFMMMGQPMYGSPPAAGYQHPQHHHQMMTGGQGGYGYGDAGAGGGSSSSSPFGKQDRA

SEQ ID NO: 135141 - protein, 135 aa, Triticum aestivum
  Clone ID: PAT_TA_29559.pep
SVAAPTTKMRSMDYAHQTDGHGSLDVQLSRCGVVRASAAHLRPDASKDEGDPRRLQPRQPDPLRPPCVDLTARPEGGELQWRAGASTVFFRQVRHQPEDIYAIKSTRCVGGWSCHLNATGDASSLSNSISAFSAR

SEQ ID NO: 135142 - protein, 136 aa, Triticum aestivum
  Clone ID: PAT_TA_29560.pep
TLTSAKLKCSMPANFAVASSNVIHNLTALFVRKSSNIVCLSSYTVSLIVILYADRNSTPLTARLGTASWGRASVHTSRTPMADSCTFLLIRSTYCSSGRRSSPRPIDDGQTNRRSLIVCTVWECEDVPALKCKRFG

SEQ ID NO: 135143 - protein, 198 aa, Triticum aestivum
  unsure (1)..(198): unsure at all Xaa locations
  Clone ID: PAT_TA_29561.pep
KVXLPLEQVHKLALGXELAGTRFLWALRKPSGAAVLDDGADMLPPGFQQRTRDQGLVTTGRVPQMSILAHAAVGGFLTHCGRNSLIEGLLFGHPLVMLPIFGDQGPNARQMEVKKVGLQVARDESDGSFDRHGVSSAVRAVMVDGEARRNFVAGAAKMQVVVANSERQERYIDEFVHHLRSHGAAIATDGKATTAATS

SEQ ID NO: 135144 - protein, 121 aa, Triticum aestivum
  Clone ID: PAT_TA_29562.pep
KTNIGSAALFEDERAYISKSLRKLEKKLHLYSNNNTSTDLSNSDAIEGTQESILLAKGEADLSTFQEEISSLNKRLKTLEGDRDFLEHSINSLKNGKEGAQFIREIACNLRELRAIAIESK

SEQ ID NO: 135145 - protein, 75 aa, Triticum aestivum
  Clone ID: PAT_TA_29563.pep
AHPNMQDLVEHYASKHPELKLTLKEVVGEGVRVQVNTNKLVELGFKFKYRAEAVLDGSVDCGKKLGVLSVADQGS

SEQ ID NO: 135146 - protein, 134 aa, Triticum aestivum
  Clone ID: PAT_TA_29564.pep
RTMSFKAVPSGRTRHRSAATVRSEDQSFPWSRMLGSENRDNAFKKGTTFAAAGPSEDRTGFHLGQHPPAPTATARPPRRPHGHGDWAAPRHGLRPRAPRCTTRAAAPASTTLTPPHPRPAATPAKEASRKVPHF

SEQ ID NO: 135147 - protein, 76 aa, Triticum aestivum
  Clone ID: PAT_TA_29565.pep
TDLSKDSYRIFYPPALVLTRRYYCHQKKTMSFPRSTNDKETQGSHKECTYREEQVIVINARCRTYVSNKSSDGLLQ

SEQ ID NO: 135148 - protein, 96 aa, Triticum aestivum
  Clone ID: PAT_TA_29566.pep
CGRQSGRQQSAMGTGNDPSFFLCCLLQAVWWRALVKIASHLTSPHLIYLAGCICSPIYSEIAGGGGFVRFEVGFVGVHSVPRCRYASCGAEKKENE

SEQ ID NO: 135149 - protein, 194 aa, Triticum aestivum
  Clone ID: PAT_TA_29567.pep
LAATFLLCHSISHGINLRKSPVLQYLYYLGQIGLAMSPLSNNSLFLDYHRNPFPMFFQRGLNQQLLVPRLPSGTLFLCFSHDGLNVSLSTDDPLQIHLTKEPLVEEYSIAASLWKLSSCDLCEIARNSVYQSGFSHALKAHWIGKNYYKRGPSGNDIHRTNVPTIRIEFRDLIWRDEMQLVYLNNVILPDEVDQ

SEQ ID NO: 135150 - protein, 344 aa, Triticum aestivum
  Clone ID: PAT_TA_29568.pep
APRVGGGACEGLLVSEGALPPLIRLAESGSSLVGREKAVLTLQRLSASPDVARAIAGHGGVRPLIEICQTGDSVSQSAAAGALKNLSAAPEARQALADEGIVRVMVSLLDYGTVLGSKEHAADCLQNLTTGGDSFRRAVAHDGGLRSLLLYLDAPSPQESAVRALGNMVDAISPDTIVSLGVLPRLAHALRVGSAGAQQAAAAAICRIAASGSKDMKRLVGEHGCIPLLVRMLEAKSGGAREVAAQAVASLAAGHPGNAREVRRDERSVPSLVQLLEPSPANTARKYAIACLATLSPAKRCKKLMVSHGAIGYLKKLSDMEVAGARDLLERLEERGKLRSIFGS

SEQ ID NO: 135151 - protein, 110 aa, Triticum aestivum
  Clone ID: PAT_TA_29569.pep
FSGAASIVSRQPAGTCDPKTGSWCVANPAVGDARLQAALDWACGHGADCSAIQPGARCFDPDTKVAHASYAFNDYYQRNGRSGSSCHFGGAGSVVHQAPKIGNCVLRSRA

SEQ ID NO: 135152 - protein, 81 aa, Triticum aestivum
  Clone ID: PAT_TA_29570.pep
KATLGNINSEIAATHAPASVVPTMKEVLTLTKYCGAEEGTPLYFTATDLVLQPNYRELFMLIETKKGRLDWLNRKHDQMNK

SEQ ID NO: 135153 - protein, 147 aa, Triticum aestivum
  Clone ID: PAT_TA_29571.pep
DKLRLHSFAIDAAKYWIGDAIRLHKVKSIDFTENTRWEAFYLDPEAISFSSKYLQTVKLTNVIIVTSVFDQLSRECESLENLQLADSTLCSPEISSSSLKTLEIINFLVLNHLLIRTGKLVSLCFKDTRCGCTPKYIVRTTSAVILM

SEQ ID NO: 135154 - protein, 177 aa, Triticum aestivum
  Clone ID: PAT_TA_29572.pep
MAAIMQSAVTSRVAAKASLRPASVKAPVVAAPALDARFKVWQPVNNKMYETFSYLPPLSNQEIAKQVDYVIRNGWTPCLEFADSSNSFVSNENAIRFGNVSAGYYDNRYWTMWKLPLFGCTDPSQVLKEVAACQVAFPNAYVRLVAFDNQKQVQCMGFLVQRPKNAVEYCPQEKRSV

SEQ ID NO: 135155 - protein, 206 aa, Triticum aestivum
  unsure (1)..(206): unsure at all Xaa locations
  Clone ID: PAT_TA_29573.pep
METHEPSGHRLGDWVDGEQQHVVSWSDIISGIGRSLFIKCLLRLSRSDYGSVACLNHDFNSLVRSGEIYRLRRNNGVAEYWLYFSCNPLQWDAYDPHRGRWIQVPKIPPDECFMCSDKESLAVGNELLVFGMAHIVVXRYXILTNSWTRGXPVNSPRXLFGIDKVSVXXAYXAGGILCGKNLSSRGDFNSGEHNNGNPLPLGNNKG

SEQ ID NO: 135156 - protein, 261 aa, Triticum aestivum
  Clone ID: PAT_TA_29574.pep
MAAPAGDSSGGDKYRSHLAGEGEKNTVWRHGAPPTYDAVNSLFEAGRTQEWAKGSLEETVQNAIKTWEMELSHKARIGDFKSVSPGRFTLSVNGGRALTGEETLAMGSYNALLASPILPGTGAYDAAAETFESSHDLFRSAFPRGFAWEVVKVYSGPPVIAFKFRHWGHMEGPYKGNAPTGDKVEFYGVAVLKVDEQLRAEDVEVFYDPGELLAGLVKGPKEEDEEAAALAGRLREAATVSASGADAQPQACPFLGSGKQG

SEQ ID NO: 135157 - protein, 514 aa, Triticum aestivum
  unsure (1)..(514): unsure at all Xaa locations
  Clone ID: PAT_TA_29575.pep
LSVCLAFFTDAYDLFCISLVTKLLGRIYYYREGADAPGSLPPNLAAAVNGVAFCGTLSGQLFFGWLGDRMGRKRVYGMTLMCMVLCSIASGLSFGSTPGSVMATLCFFRFWLGFGIGGDYPLSATIMSEYANKKTRGGFIAAVFAMQGFGILTGGSSRGPPPSAPPSPPAIHSSPSCPWTSPWLRLDVEEAAGASPLAICLSSCFAGTXHGRMKVPEPARNTALVATNAKHAAADRSKVLRLGIGADEADPTANDGRPGAADDRNSFGLFSGEFRRRNAADLVGTATCWFVLETAFYSQNLFQKDIFTAINWIPKAKPMSALEEVHRIARAQTLIALCGTVPGYWFTVALIDRIGRFWIQLGGFFFMAVFMLGLAFPYHHWTTPGNHIGFVVLYGLTFFFANFGPNSTTFIVPAEIFPARLRSTCHGISAAAGKLGAIVGSFGFLYLAQNQDPAKVDHGYKAGIGVRNSLFILAACNFLGMGFTFCAPESNGLSLEELSRENEEEAPDARTVPV

SEQ ID NO: 135158 - protein, 330 aa, Triticum aestivum
  Clone ID: PAT_TA_29576.pep
RPEFGIPIAPTNKSHQWASTKLIAATLLPAFLALHLHAPAAMATAAGSSNSNLFRDYIGALYNGVRFADVPVDPRARFDFILAFVIDYTTATEPPSPTNGRFNVFWQDTVLTPDAVAEVKRRNPKVRVAVSLGGATVNGRPVFFNVTSGVDSWVRNAVDSLTGIIRRYGLDGIDIDYEQFQVDPGTFAECAGRLVAALKSNGVISFASIAPYGNGDVQRYYRTLWAAHGAAIDYVNFQFYAYGASTTAAKYVSLFDEQIANYPGANILASFTTAATNTSVPVDTALSACRTLQGQGKLYGIFVWAADHSRNQGFKYETQSQALLTDATTY

SEQ ID NO: 135159 - protein, 56 aa, Triticum aestivum
  Clone ID: PAT_TA_29577.pep
GALGTLRYMLGQRPQKRSGSPRSFASNYNKRYKPDFQPMAQRIPSGRYSRNDSRVP

SEQ ID NO: 135160 - protein, 218 aa, Triticum aestivum
  Clone ID: PAT_TA_29578.pep
RTAPLGGGVALPVRRATADPGASEEVRMEVSSHNPDDAQIVVHTRGAWRIKGIMQVSRSIGDVYLKKPEYSLDPLFRQIGPVIALKRPALSAEPQIHVRKLKPNDQFIIFASDGLWEHLSDDAAVQIVFKNPRTGIANRLVRAALKEATKKREVSVHDLRTIERGVRRHFHDDISVVVVYLDRHRGRRQTRVVDSSSNCTSAPVDIYSSSSSAYRDSG

SEQ ID NO: 135161 - protein, 162 aa, Triticum aestivum
  Clone ID: PAT_TA_29579.pep
EQAAQGAGVTILCEMGLDPGIDHMLSMKMIDEAHALNGKIKAFTSFCGGLPSPAAANNPLAYKFSWSPAGAIRAGRNPAVYKFLGETINVDGSKLYESAKRLRLPELPAFALEHLPNRNSLMYGDLYGISKEASTVYRSTLRYERFNEIMAILAKIGFFGAG

SEQ ID NO: 135162 - protein, 542 aa, Triticum aestivum
  unsure (1)..(542): unsure at all Xaa locations
  Clone ID: PAT_TA_29580.pep
LPSFHFRLLTGSLDCHESVGADDTTTLDKIIDSLTSIANAHRGDPNAAEISLKIGRVSECGIDDSMDKVGPKVLILGAGRVCRPAAEFLTSYQNIDQVHVVVASLYQKDAEETVDGIKNATAAQLDVSDTESLSNLVSQVDVVVSLLPASFHAAIARVCIELKKHLVTASYVDDSMSKLEQAAQGAGVTILCEMGLDPGIDHMLSMKMIDEAHAPNGKIKAFTPFXMSFDLHPEQGPEERGDPASGTGELHPCAGDLGSVGHQADRESGDLRMSGWDENLSSIYAAATEAXVNQMMILAVVSKMSXTVCMYVTIYCTTYISTLSXFSEIMTILAKIGFFDAENHPLLQETNRPTYRNFLNELLNVNNVSTSNTKINGEETGGHDDELISRLMMLGHCKEKELAVKILKTIKFLGLHEETQIPKDCSSAFSVICQRMEQRMAYGHNEQDMVLLHHEVEVEYPDGRPTEKHQATLMEFGKTENGRSTTAMALTVGVPAAIGALLLLQNKVQRKGVIRPLQPEIYIPALEILEASGIKVIERVET

SEQ ID NO: 135163 - protein, 107 aa, Triticum aestivum
  Clone ID: PAT_TA_29581.pep
YIKTLIESQGGDFPVYPDTMKEQLKASRSKIMAALLVFAMVTQGLAIHVKEMVRNDFTDEAVISAKTTLGAGSSTAVDNHHAIPRGQYSSHGGEDGSGGSGGDTTKN

SEQ ID NO: 135164 - protein, 114 aa, Triticum aestivum
  unsure (1)..(114): unsure at all Xaa locations
  Clone ID: PAT_TA_29582.pep
AVXQKVDXSTTCXYCTSILKHYYGQLYXDLHRAKNVTFTIQAQARPKHPQACITIRKNLVDGKHSMHCISYSTWQENLTIKFTHPTEHSIEQHLEILQGPYRSTIISNESQNYN

SEQ ID NO: 135165 - protein, 158 aa, Triticum aestivum
  Clone ID: PAT_TA_29583.pep
LHPSMPPRPHAPVKVNVDAAFKPQLGSVDSTEMIGIMNMLYLAEKIGCNKVLVESDTRYCTGMQAIIVGLREGGVFSLPHGAVTASLPETAVSAPKSGAAAPTSTDPDGREIPRNSLNCLSQATPPRRTRHRRRRRLLRSTEARIFIRRAKSIVTHAS

SEQ ID NO: 135166 - protein, 152 aa, Triticum aestivum
  Clone ID: PAT_TA_29584.pep
VFPSAMKEVAPSSSTLHFPSDMNEDEPSSSTLLFPSAMNEVRPGVVLDLDDPPSRYNRLGKVTTVGVEQGIGCGGAEKEAGVDLGSHLRCRSGRSRASRAQGVLKRRRRSVLGARRHSRPCASRPVISVFCIRLLLAMISDPERRHRSFLRV

SEQ ID NO: 135167 - protein, 249 aa, Triticum aestivum
  Clone ID: PAT_TA_29585.pep
GDVAKRVIKKAVSTARAKSKSVRAKSKSPMKKLASPAKNLLGLASKAVETVKNAAPKLKSVTPKHAKSASPKKKAASASPKKTASPKKASPKRSSPSTKRGASASPKKASSPAKAVVEAAKKVASPAKKVAESPKKAVETVKKAASNLKSVTPKRAKSATPTKSSPKKKAASASPKKTASPKKASPKRATPSTKRGASASPKKASSPAGKIAHAVTKASSATKGAVFAVLDKTPLKRVADKAQSRTPQS

SEQ ID NO: 135168 - protein, 103 aa, Triticum aestivum; identical to SEQ ID NO: 107316
  Clone ID: PAT_TA_29586.pep

SEQ ID NO: 135169 - protein, 311 aa, Triticum aestivum
  unsure (1)..(311): unsure at all Xaa locations
  Clone ID: PAT_TA_29587.pep
MSTGGITLENLPKELPLDFLKEITNNFSNELLLGTGAFGSVYKGILGGGGVVAVKKLAENSPVPRDKIFANEVQNIMVLEHENIVKLLAYCREANNRLVQSNGRHIIAEITETLLCYEYLPKGSLEQKLFGESIDIDWDTRFKIIKGVCEGIHYLHALPSPVLHLGLKPQNILLDGNMTPKIADFGFSRIFGQEQTRMNTRSVVGSVGYMAPEYLYNGEISARSDIYSLGLIIXEISTKEKNSPSTDQKHARNYVDGVKQLWTPEKIMSEYPDIEDHCVDQVEACINIGLQCVXINQHKRPTIQKIRQHDQ

SEQ ID NO: 135170 - protein, 72 aa, Triticum aestivum
  Clone ID: PAT_TA_29588.pep
QPIRASALSSKVCPETIFRQNVGSPWESACHIPDVFPSHRCRADDDCGIESVTCKRRTCSMAGYCGLWLAVY

SEQ ID NO: 135171 - protein, 36 aa, Triticum aestivum
  Clone ID: PAT_TA_29589.pep
EEPRCSKYKGKQTTLSNGSLARHPITPPYRRSNSTS

SEQ ID NO: 135172 - protein, 105 aa, Triticum aestivum
  Clone ID: PAT_TA_29590.pep
TPLYSPMSYSDVGAALSWLHTPAPVCTVQRQRCGHYLDGFYTLEAAPLNGDLLPGELAMDDLDEAGTRASSPSWRGSGSSRRLLAAAQSIRCLPPVLQQLAGAAP

SEQ ID NO: 135173 - protein, 169 aa, Triticum aestivum
  Clone ID: PAT_TA_29591.pep
ATSSFCEMISSRDQNCQICRAIAGYVTLWAQHLLTLASPLSSPSPPVIHCHRRHSHQQGFPNSKRQGAQNVHCQPNHRYPSLRRVAFTSSLSVSGTYKFSEPKEQVNRCYSLFSHKSQAAQSHVDFQAESFLYAKGLPVDTVLNVMFLNGEFGACSTRHVSPPCDPDGT

SEQ ID NO: 135174 - protein, 106 aa, Triticum aestivum
  Clone ID: PAT_TA_29592.pep
ARWQGLQLQASALLCACSRRAPGLRASRPSIEAPPPVPQESSVQRVMTEEHGDMASSSALLQSKTAADALEELKKYKAIRESILDRAKALPRDDGKMGEKPADGDP

SEQ ID NO: 135175 - protein, 81 aa, Triticum aestivum
  Clone ID: PAT_TA_29593.pep
ERERERERERERERERERDGGQSPLIRMPNAEQVQPLVASHGSNRKEQLGMSTKATNKYYKNSSKDDLVLRATLDSITRMG

SEQ ID NO: 135176 - protein, 45 aa, Triticum aestivum
  Clone ID: PAT_TA_29594.pep
PNPILPWYPWYYRSPPSSSATRGSASAPVLCFVAAVTAAAALVGY

SEQ ID NO: 135177 - protein, 156 aa, Triticum aestivum
  unsure (1)..(156): unsure at all Xaa locations
  Clone ID: PAT_TA_29595.pep
CLAPEYYTXGIVDEKTDVFAFGVFLLELMAGXKPVDGTHRSLLGWARPLLSEGKTEALLDPRILAGGNGGYDAEQARRLAFVASLCVRASATWRPSMTEVLDLLEGAETTEERWAMPEPAAGDDEGEEMWGFDDLDDYEEESGTPSPLSTSSASSA

SEQ ID NO: 135178 - protein, 169 aa, Triticum aestivum
  unsure (1)..(169): unsure at all Xaa locations
  Clone ID: PAT_TA_29596.pep
CNMVXSIQFFPGTLVFKFQGSQLPRQGPDALTTTHSREARCCPKHAPRFRHRSTRPGPKPATSCNHNIRVQSSRENYIETNGPQRSKEQKNYSTASGISNTQDSLITSSTHPVGSSRSIKYLTSKRRHHRHRHQLIDRFLKLGFITSFQKTVTIYTTPLHTHPTHAGRP

SEQ ID NO: 135179 - protein, 129 aa, Triticum aestivum
  Clone ID: PAT_TA_29597.pep
VKSANILLDDQLNAKVGDFGASALKSMDESEFIMFVHGTLGYLEPESFISRHLTDKSDVYSFGVVLLELMTRKRAIYTDNFNEKESLSYSFPLMFQKRRHLVMLDTEITDDAVMVVLENMAELAVQSVF

SEQ ID NO: 135180 - protein, 43 aa, Triticum aestivum
  unsure (1)..(43): unsure at all Xaa locations
  Clone ID: PAT_TA_29598.pep
TRADQLLHIFIPLDPYVSSSAEHQRRDXVVVHEVLIKFRVLCS

SEQ ID NO: 135181 - protein, 321 aa, Triticum aestivum
  Clone ID: PAT_TA_29599.pep
GAEASTFGIRGVTEHATFLREVHDAQEIRRKLLLNLMLSDVPGISEGEKRRLLHCVVVGGGPTGVEFSGELSDFIIRDVKERYSHVKDYVHVTLIEANEILSSFDVRLRQYAINQLVKSGVRLVRGIVKDVQPDKLILDNGEEVPYGLLVWSTGVGASSFVKSLPFPKSHGGRIGVDEWLRVPSVPDVFAVGDCCGFLESTGKEVLPALAQVAERQGLYLARLLNRVMKAGGGHANSQVEVDLGPKFVYKHLGSMATVGRYKALVDLRQSKDSKGISIAGFASWFIWRSAYLTRVVSWRNRLYVAINWLTTMIFGRDISRI

SEQ ID NO: 135182 - protein, 149 aa, Triticum aestivum
  unsure (1)..(149): unsure at all Xaa locations
  Clone ID: PAT_TA_29600.pep
KLLGEGKSXITTRVMXTFGYVXAPEYVNTGLLNEKSXDVYSFGVLLLEAVTGRDPVNYSRPANKVHMVEWLKQMVGSRRAEEVVDSEMEAKPTKQALKRALLVALKCVDPVADRRPTMGQAVRMLEAEDGLSREERGKSRPAHVDGGDT

SEQ ID NO: 135183 - protein, 154 aa, Triticum aestivum
  unsure (1)..(154): unsure at all Xaa locations
  Clone ID: PAT_TA_29601.pep
SARGHLGLKPQNILLGDNMTPKIADFGFSRIFGQDQTRKNTRSVVGSVGYMAPEFLYNGEISARPDIYSLGLIIMERYTREMKSSSTDRKEACKYIDGFKESWTLERVKYXVSRPXLEKVSFNQMQACIKIARQWMEIDQKERPSIQEIISKFQ

SEQ ID NO: 135184 - protein, 313 aa, Triticum aestivum
  Clone ID: PAT_TA_29602.pep
MSLARLGQSLVRRLHRPLHLPPPLPPDHYATVSRSLALIHANTSVRGFASLAYNGGGVISGKFGGPSHVHTAQILELAVHLNHARPMSSGAGAAPKPPSLSEGVSFGGYKVALKADMPSPGFVFEPYRVPEPIPFWKRLFTPSGWSRTKEDAILQFMNAFTVSKLRKKIGYNKKQFQEQAFNIYKEVNKLIARGDIPSLQKALTDDMHSTVKNEIRKRQSKWKSVHWELVEPAVSIRTLKARMITLDKNDLNKAYVQLTLEFITKQKFEAYNSKREVVSGDKSKEVLVKDIWVFERSLFHPGAYWRVCARITL

SEQ ID NO: 135185 - protein, 60 aa, Triticum aestivum
  unsure (1)..(60): unsure at all Xaa locations
  Clone ID: PAT_TA_29603.pep
FNKILNHLFTLCQFLQELDILFQSSFIIGIIFGHILIYITNIFXNANIYALIPNAQNKYL

SEQ ID NO: 135186 - protein, 338 aa, Triticum aestivum
  unsure (1)..(338): unsure at all Xaa locations
  Clone ID: PAT_TA_29604.pep
TSSLSLSLCTALPISSLFPFLYFMIRDLGIAKRTEDIGFYAGFVGASFMFGRCLTSTAWGIAADRIGRKPVVVLCWVSVVVFNTLFGLSVNYWMAITTRFLLGALNGLLGPMKAYAIEVCRPEHEPLALSLVSTAWGIGLIIGPALGGYLALPAEKYPNIFSPDSLFGRFPYFLPCLCTSVFAAIVLISCIWMPETLHKHKVSDDGNQSVEALEAHLIDPKEEVGQSNSSNTKKSLFKNWPLMSSIIVYCVFSFHDMAYTEVFSLWAESDRKYGGLSLSSEDVGQTLAITGCXSFFVYQLFMYPTIINLLKPIPSAPEATVLCIPILFALVPWGPLPP

SEQ ID NO: 135187 - protein, 333 aa, Triticum aestivum
  unsure (1)..(333): unsure at all Xaa locations
  Clone ID: PAT_TA_29605.pep
HERAVQMASGVKTIPESVCSFEPSLWKDFFIHYKPEPLSRSEEWIKDRTHKLKGDIHMLFENHSNTIDRMNLVDVIQRLGIEHLFEEQIATALSDIHESEFNSSSLQEISLCFRLLREHGIWVSPDVFKKFRGEDGTFDDYVTSDPKGLFCLYNAAYVLIHGELELEEAISFARHHLELLAPSLTSPFAEQVKRALHVPLPRTYRRLEALRYMPEYEQEAGHNPIILELAKLEFNLLRAVHLKELKAISEWYNDLSGYVELTFARDRVVECYLWGYSLFYEEEYALARMIFAKLTFLHTLLDDTNDVGATLEEYRMLDTAIQXRWDKSAIYLV

SEQ ID NO: 135188 - protein, 86 aa, Triticum aestivum
  Clone ID: PAT_TA_29606.pep
MGCWWERLVLPVRRAWLGVASRFGVRQSGLWRLRQEVSTCEYEDVRVMWEMLSRTATAPPPPAARRHSRFRQPRPWADRLRLCRDI

SEQ ID NO: 135189 - protein, 475 aa, Triticum aestivum
  Clone ID: PAT_TA_29607.pep
LERSPASAAAPGTRAGVLAVVDSRTGKRYEVKVSEDGTVRATDFKKITAGKDDKGLKTYDPGYLNTAPVRSSICYIDGDEGILRYRGYPIEEVAESSSFVEVAYLLMYGNLPSQSQLAAWEFAISQHSAVPQGLLDIIQSMPHDAHPMGVLASAMSTLSVFHPDANPALRGQDLYKSKQVRDKQIVRVLGKAPAIAAAAYLRLAGRPAVLPSNNLSYSENFLYMLDSLGDKEYKPNPRLARVLDILFILHAEHEMNCSTAAVRHLASSGVDVFTALSGAVGALYGPLHGGANEAVLKMLNEIGAVENIPDFIEGVKNRKRKMSGFGHRVYKNYDPRAKVIRKLAEEVFSIVGRDPLIEVAVALEKAALSDDYFIKRKLYPNVDFYSGLIYRAMGFPTEFFPVLFAIPRMAGWLAHWKESLDDPDNKIMRPQQVYTGVWLRHYTPVRERVASNQGEELGQIAASNATRRRRAGSSL

SEQ ID NO: 135190 - protein, 237 aa, Triticum aestivum
  Clone ID: PAT_TA_29608.pep
AVQFVFNLDFFERNSSVHSHPPEVSPIYMRIDRIHGEEWSTPQSPKQRTYSGGSRGKRSRTHGREGKVNTDQEARLTRTQDQAVSRKQASKRRPPVDGPSLDVPAEAEPVGPRPRLPEPAVAPGRRRRRRRRGAAQHLPHHAHVLVLARAHLLPEPPQPGLAHTEAGGDAEPRPSHRQHEALPPAAHRRRRAVVRYSDMHRRRQKTRPSEAPLLVSPLRTAALLPGATIPRARTEGG

SEQ ID NO: 135191 - protein, 45 aa, Triticum aestivum
  Clone ID: PAT_TA_29609.pep
QQRTAEAERKQRSSNSGGRGRGGVMVLPKGRGSSGSGWTGAGFET

SEQ ID NO: 135192 - protein, 101 aa, Triticum aestivum
  unsure (1)..(101): unsure at all Xaa locations
  Clone ID: PAT_TA_29610.pep
MDPLLPFLLLLTLAAFSAASDEIDGCGGFVEASSGLAKSKRASESKFDYSDIKVELCTVDGLVKESTQCAPNGYYFIPVYDKXGSFIVRVKGPKGWSWKPV

SEQ ID NO: 135193 - protein, 133 aa, Triticum aestivum
  Clone ID: PAT_TA_29611.pep
GGEVGLRSHPLRRNGGEIDCAQGAAAYQRARSCSGGHGVLNAADKQVTDNNSTMEPVRVLITAQPEVELPAPAASSADAQICPAETGTAEMAQTSEHSIEQLDPKTPGWIQRVRVGAAAVGRAPCLDRVTALE

SEQ ID NO: 135194 - protein, 234 aa, Triticum aestivum
  Clone ID: PAT_TA_29612.pep
RKLDAAIQRWDESAISLVPGYLKKFYNKLLICFKEFDDELRLNGRYSIDHIKKEFQQQSSCYVQETEWLRSNHKPRFEDKLHLAAMSTGVTGLCVYTMVCMGDEMPKRALEWALGYPDVVMACAKIGRLMNDLAASSKPRDSRDVANCVECYMSEHKVTEDVAFAAIDSMIEDEWKITNQARFQHGRELLPAVQRVINFTLSLPVYYGDRKDAFTFSSHLDDIIKSLFVKPIPI

SEQ ID NO: 135195 - protein, 170 aa, Triticum aestivum
  Clone ID: PAT_TA_29613.pep
EMEAVMIIDILRRAKANVVVASLEGTLEIVASRNVTMVADVLLDDALKQQYDLILLPGGLGGAQAYAKSDKLIGLIKKQAEASKLYGAICASPAIALEPHGLLKGKKATSYPAMWSKLADQSECENRVVVDGNMITSQGPGTSMEFSLAIVEKLFGRERAFELAKSMVFV

SEQ ID NO: 135196 - protein, 406 aa, Triticum aestivum
  Clone ID: PAT_TA_29614.pep
HASADCANAVNCLLESAVHLNYIIELAANKRFTGCVRGLAAVVLGACVLNNASREKGRDAFAVADAISQKIGLTTYFLRFDELRKSFLHLPSGQQNHKQLSRSSANSMSDFQEIEEEETNKGDQHPVLSEIFDSQLVSLLSKLETDIRECIMDLFSRTKTATAVLPAELEQKNGEVDGEYIKRLKSFVERQCNEMQDLLGRNAILAEDLVRTGGGSTSDSSEKPSSGRERVQIEALRQELEGAARRIEVLKTEKAQIEAEASNQRNLAVKLESDLKSLADAYNSLEQSNYRLDAEVKTLRQGGSAPYPDVEAIKAQAKEEAEKESEVELNDLLVCLGQEQSKVEKLSARLAELGEDVDTLLQGIGDDAALPDDDDDDDDEDATMKSNVFLLHFHLWCNLASFIQSW

SEQ ID NO: 135197 - protein, 228 aa, Triticum aestivum
  Clone ID: PAT_TA_29615.pep
ALLPLSTALLGTQQVDAHIYLWEWNAHIVISDVDGTITKSDVLGQFMPMVGVDWSQNGVAHLFSAIKENGYHLLFLSARSISQAHLTRQFLFNLKQDGKALPDGPVVISPDGLFPSLYREVIRRAPHEFKISCLADIKALFPPDSHPFYAGFGNRDTDELSYLKVGIPMGKIFIINPKGEVAVNRRVNTKSYMSLHALVNRVFPPLSSPPEQEDYNTWNYWKMPVADI

SEQ ID NO: 135198 - protein, 165 aa, Triticum aestivum
  Clone ID: PAT_TA_29616.pep
TVKGVSFFGPNNEYVLSGSDCGHVFIWRKKEGELMRIMRGDKHIVNCIEPHPHFPFLATSGIDNTIKIWTPSSSKVMQLPQYANKVIASNARERQFYASRGEMTLSADVMMRILRLQSTQSELYANHEPSAADFATGGDETFFIGLGDGDGNQRSNSDPRECIVT

SEQ ID NO: 135199 - protein, 213 aa, Triticum aestivum
  unsure (1)..(213): unsure at all Xaa locations
  Clone ID: PAT_TA_29617.pep
FIPRMTXYQSIYHPMCLESHSXFGNICPLTSLSQYDERELRPGPLTPDPLTVIANINSPEAETHSEAPSRSHMPWSWGIIRSDALVCRRRHLPQVPSSDQIEAFYHCLATQLSTSPRHQTASSSCASPSPHIGRRISTAPRRRDTPPSMSRMKHRSAETGRASEDQSAAKQPKHHIHPKLTKNDTPKKVTTPGAPLSLNPAWIWAFARHTSWV

SEQ ID NO: 135200 - protein, 121 aa, Triticum aestivum
  Clone ID: PAT_TA_29618.pep
ICRSSCLWSVQGKRRSDALHNFFVSCHVGRSILLKQLSSRTTSNTSGTSSTGTKGRHGGPGQLQRGQTIPDTTDREEKIPNKLGNHRGHHEEKKIRQRSGDRATNPSSGSEKEARKRRQTD

SEQ ID NO: 135201 - protein, 266 aa, Triticum aestivum
  Clone ID: PAT_TA_29619.pep
MMYHAKKFSVPFAPQRAQNSEHVSNIGAFGGSNISNPANPVGSGKQRLRWTSDLHSRFVDAIAQLGGPDRATPKGVLTVMGVPGITIYHVKSHLQKYRLAKYIPESPAEGSKDEKKDSSDSFSNADSAPGSQINEALNMQMEVQKRLHEQLEVQKQLQLRIEAQGKYLQMIIEEQQKLGGSLEGSEERKLSHSPPTLDDYPDSIQPSPKKPRLDDLSTDAVRGVTQPGFESHLIGPWDQELCPKTNICDPAFQVDEFKANPGLSKS

SEQ ID NO: 135202 - protein, 210 aa, Triticum aestivum
  Clone ID: PAT_TA_29620.pep
MEPDPSKSPTGGSSSLIFLGTGCSGTLPDARCLLKPSTPPCAVCSMGISLPPEGNPNYRLNTSLLVDYCHDDGTHRYILIDIGKTFREQVLRWFVHHKVPYVDSIILTHEHADAVLGLDDVWVVQPRNDRNDVEQIPIFLTQFTMDSIARRFPYLVEQKPEDGDEDAQAAKIEWKIVQDDVEKPFVASALEFVPLPVMHGEGIFVRLLGR

SEQ ID NO: 135203 - protein, 391 aa, Triticum aestivum
  unsure (1)..(391): unsure at all Xaa locations
  Clone ID: PAT_TA_29621.pep
MAMIGEMDADSVVGYFRNKSILIAGSTGFLGKVLVEKILRVQPDVKKLFLLIRAPNVESAKLRLQTEVTAKEIFQLLKKKHGVGFKNFIEEKICPLAGDIMHEDFGLDSAQLRALCKDIDIIVNGAATTNFSERYDAAFDVNVLGAKNVCAFANKCTKLKMLLHVSTAYVAGEQEGLIPEKPFLMGETLRVGTHLDIESEINLIPQVRRELRANCSTEKAEKKTMKELGLKRARHFGWPNTYVFTKAMGEMIMGHLRGRFLVVIIRPSIITSTLKEPFPGWMEGIRTIDSVMIGYAKQILPFFIGDLDLIIDVIPGDIVVNAMMVAMAAQLKDQQPQIIYHVTSSLRNPAPSALVVESMHRYFFENPLCKGRNGEHVPMKKMXFFSTLAQL

SEQ ID NO: 135204 - protein, 344 aa, Triticum aestivum
  unsure (1)..(344): unsure at all Xaa locations
  Clone ID: PAT_TA_29622.pep
DNAAYQKAYLASLLAQQKLQYGMPYMGKSGGLSPTLYGSEQAYGMDMAYLSSPTSSHFIPSPQGHARQGDRLTTRIPSMARSTTGGAMGSWSSENGLVDNAYESTLLEEFKTNKTRSFELLDIVGHVVEFSSDQYGSRFIQQKLETASTEEKNMIFPEILPQARTLMTDVFGNYVIQKFFEYGTEPQQKQLANLLKGHVYTLSTQMYGCRVIQKALEVVGVEQQTQMALELDGNTIILKLVRDQNGNHVIQKCIECIPQERIQFIVSAFYGQVVELSTHPYGCRVIQXRVLEHCDDESTQNAMMEEIMQXVWVPLTQDQYGXLMLSKQCPCKQWGKPRKETHLL

SEQ ID NO: 135205 - protein, 70 aa, Triticum aestivum
  Clone ID: PAT_TA_29623.pep
MTSNQFDLLGDVDNDDPSQLLAAAAAKKAAEPKPAAPAPAAAKPGSKPPAKTTPPAEDARGSRGDGAGRG

SEQ ID NO: 135206 - protein, 188 aa, Triticum aestivum
  Clone ID: PAT_TA_29624.pep
IYLIEHDVIGGHVVPNRFATLSIQQLRAPRVPIRCVHMTHGYCCHARFFQQVDDLDPNVLHKHLHQILSLQKVHHLGSKLPYKHLNQILFLLKVHLLGSKSPYQNLSQNLFLQMVDDLDPSVPHKHLPQNLFLWKVHLLGSNSPYKDLPQNLLLLKGDPNVPRTHFHQSHLFEKMEVRPCRWTQQRLG

SEQ ID NO: 135207 - protein, 194 aa, Triticum aestivum
  Clone ID: PAT_TA_29625.pep
RRISEPALQIHLTADEAPVPLPPPAAPAAGVWGNLVSRCVYSVGFVRFLAGGVLEMEARPELVLQVALGIFGVGARCSFTAEHLLPRARGPWWPPCAFIPALELDAAAPDRDLEATGVQARQHFGRRSRMEALRSLRTDDLPSARGYLLIQGSCEDAAAARHRNVLFLVGSSALQGDLVVICIFVEVLSLKSLL

SEQ ID NO: 135208 - protein, 271 aa, Triticum aestivum
  Clone ID: PAT_TA_29626.pep
MAHAAAAAAVPLRRPLLLFLRPARLLSFVAPRSSSVRAYTRALRPLAPLPSDDEDPDDGDGAPSRNEKKREARRAVKWVMELAKFSPPQIKRIVRAASLEREVVDALMLVKKFGPDVREGRRRQYNYIGSLLRGAQPELMEDLIHSLKNGDESRIQALLSEVADKSMPIEDEEVGELPHEEEDEGNQEYMEIADRWFEGLVCQDIPVTNEVYAIHNVEFDRQELRKLVRIVQEVQKSTRDKDSGEGSDKKLSRAKKPLIMFLRSLAKKTLE

SEQ ID NO: 135209 - protein, 510 aa, Triticum aestivum
  Clone ID: PAT_TA_29627.pep
MFIESFKVESPNVKYTENEIHSVYDYETTEVVHENRNGTYQWVVKPKTVKYDFKTDTRVPKLGVMLVGWGGNNGSTLTAGVIANKEGISWATKDKVQQANYFGSLTQASSIRVGSYNGEEIYAPFKSLLPMVNPDDVVFGGWDISDMNLADAMARARVLDIDLQKQLRPYMEHMVPLPGIYDPDFIAANQGSRANSVIKGTKKEQVDQIIKDMREFKEKNKVDKLVVLWTANTERYSDVVVGLNDTMENLLASVEKNESEISPSTLYAIACVLEGIPFINGSPQNTFVPGLIELAISKNCLIGGDDFKSGQTKMKSVLVDFLVGAGIKPTSIVSYNHLGNNDGMNLSAPQTFRSKEISKSNVVDDMVASNGILFEPGEHPDHVVVIKYVPYVGDSKRAMDEYTSEIFMGGKNTIVMHNTCEDSLLAAPIILDLVLLAELSTRIQFKAEGEGKFHSFHPVATILSYLTKAPLVPAGTPVVNALSKQRAMLENILRACVGLAPENNMILEYK

SEQ ID NO: 135210 - protein, 69 aa, Triticum aestivum
  unsure (1)..(69): unsure at all Xaa locations
  Clone ID: PAT_TA_29628.pep
MGLYLWRVPVYICYDYSPXKKKKKKKKKKKKKKKKKKKKKKKKKKKKKKKKKKKKKKKKKKKKKKKKGG

SEQ ID NO: 135211 - protein, 165 aa, Triticum aestivum
  unsure (1)..(165): unsure at all Xaa locations
  Clone ID: PAT_TA_29629.pep
PRVRPRVRHYVHAALYESMRLFPPVQFDSKFAAGDDTLPDGTAVAKGTRVTYHAYAMGRMESVWGPDCSEFRPERWLRDGQFVPVSPYRXPVFQAGVRVCVGKDLALMEMKAAIVAVVRSFDIEAIGRSSRRPKFAPGLTATFAGGLPVRVRRRPRGVSGHSPPT

SEQ ID NO: 135212 - protein, 126 aa, Triticum aestivum
  Clone ID: PAT_TA_29630.pep
QQQDPRRKQQLHRTTTALRVSLSSASSRSRRPTPSTPSPSRWRPAPSPIQRPRHHLRPLPRSSAARALQPPPKAEERGSLPRALPVPSHEPADPPPTPPRFTTAVMPPPPLPRLDLAGAGAVASSL

SEQ ID NO: 135213 - protein, 210 aa, Triticum aestivum
  unsure (1)..(210): unsure at all Xaa locations
  Clone ID: PAT_TA_29631.pep
GSDGKAKEERASFPDECESVNTMVSFLWWIIGFYWVVTGGDMLEQGAPKLYWLTVVFLVFDVFFAVFCVVVACFIGVALCCCLPCVVAILYALVGQEGASDADIGVLPRYKYSDPSENGEKGTDEGVMIPILNNSGTSTSERILLREDAECCICLSXXEDGVELSALPCNHHASTTFSKAVKTENSPRTYTDVTSILKACMHEHPGASSK

SEQ ID NO: 135214 - protein, 150 aa, Triticum aestivum
  Clone ID: PAT_TA_29632.pep
ARGEFGPRIDFREYTFLENPSLPKQVKESFLEVRLCNEHSTRCSTANGTNKHRALLLPRNSTEQMLLDVFSSYKNIKIIHFSSMVDGFRGFADAAVETQFRNRVKRYTGIWCCVEFREIGHIYYDMYWDDKPGWKPHPPQNREEDHPPWA

SEQ ID NO: 135215 - protein, 214 aa, Triticum aestivum
  unsure (1)..(214): unsure at all Xaa locations
  Clone ID: PAT_TA_29633.pep
PHHGTMNISGNKKYSCEFTSDXRGRGRGNPRQVQGFVKDADGTKVASLMGKWDESMYCVVSDDASKLNSHTSHQSAGATLLWKKNEPPADPTRYNLSSFAITLNELTPGLKEKLPPTDSRLRPDQRHLENGEYEKANSEKLRLETRQRMARNMQESGWKPRWFQRDSEHGTYRYVGGYWEAREQTKWVGCSDIFGSFCDNPKPRVSTLYTSASV

SEQ ID NO: 135216 - protein, 195 aa, Triticum aestivum
  Clone ID: PAT_TA_29634.pep
RKTRGREMKSMATTIYVLALSLTTTTLLFTSSSACPRDPLMTIASACHQVSTGQPGLELCMITLHAAFENSEVTEYANIATGTSQYSCQETQRIGKNLLQNPSLPKELRAAYDHCIGKYDMVKNKIGAIDNAVRTCWFATFKQDCVEVAAAIDDCAHNLQPVGSSSPLYKMVLADRDLSTLICSLALHGVAKQWH

SEQ ID NO: 135217 - protein, 132 aa, Triticum aestivum
  Clone ID: PAT_TA_29635.pep
MISIGGSSSSSSSAAAGVRMGGAKRRGKPGGAAAPGAAGTPQTRWRSGTQERIYGRRLLDALRATRSGAASSAQPPQPRAVKAAADSALALTARGQSRWSRAILLAGAASCRRRVLVKAGGKIRRHRRPPAR

SEQ ID NO: 135218 - protein, 544 aa, Triticum aestivum
  Clone ID: PAT_TA_29636.pep
LPSYLRASISPHPEQSLDRFLPRRRVMTSSPSLISSSFSSSSRLLRSSSSSSSQCSTSGRRSMDEEAEAVVAPLPPMQKRVLSRSHGSRAAPGRQLPPKNVVRDAGPPSEMDLMKERFAKLLLGEDMSGTGKGVSSALALSNSITNLAASVFGEQRRLEPMSADRKARWKKEIGWLLSVTDHIVEFVPLQQVSEDGTSMEVMGTQLRRDILMNIPALRKLDAMLLGYLDNFKDEQEYWYVSKNANESEKGDAPRDGEKWWIPTVRVPPEGLSDQSRRWLQHQQDLVGQVLKAAMAINADVLAQMEIPEEYIEALPKNGRESLGDSIYRTITDDYFDPNGLLDSVDLSTGHKIVDLKDRIEASVVIWQRKLCNKLSWGPGVSLEKREQFEERAQTVLLILKHKFPGSAQSSLDISKIQYNKDVGFAILESYSRALESLAFAVLSRIEDVLYADTVARDPRRAKSRRRPSLEDDSTESLVVDATEATSAKSSDSFCWQELEDRSLDSGGGKLRKIPRIGRRKSMHVDKVEVNVCGVGAGSRSFSHR

SEQ ID NO: 135219 - protein, 245 aa, Triticum aestivum
  unsure (1)..(245): unsure at all Xaa locations
  Clone ID: PAT_TA_29637.pep
GRVGKELTVFYSFANAPNPSQPVATISTPRLVSLEWSDAYDPVSVQFGRMTRLQWLGTSFYVVYGPSGIEHNRDLMRLFRHFKVIHSLRLTLNYQRDLSNRQYLMEDMTMLPVISLLSISVIAHGHACGASLFHVLRMCTGVRRLILTLNPHTSLEVQTCPLGCICDQPLNWRSEELVLDCLEDVEIRGLRGTEWEVALVERLFGWSTALKTVXITFFRLMTESRAKELRQMLLRFSSPDTCMTF

SEQ ID NO: 135220 - protein, 132 aa, Triticum aestivum
  unsure (1)..(132): unsure at all Xaa locations
  Clone ID: PAT_TA_29638.pep
MGRLFLMHLEGNAYSCKFCRTHLGXLAADIISKNFHSKHGKAYLFNRVVNVTSGINEDRMMMTGLHTVSDIFCVGCGSIVGWKYEAAHEKSQRYKEGKFILERFKVSGPDGSHYWGVTHDAHHGGGSDTDDL

SEQ ID NO: 135221 - protein, 260 aa, Triticum aestivum
  Clone ID: PAT_TA_29639.pep
FIFFSVKDKVVLVTGGSRGIGEMIATGFVQGGAKVYISSRSSKACDEVAAKLNALGPGKCIALPADLQKLEDVKELVAEISKREDHLDVLVNNAGATWGAPLDEYPDAAFQKVMNLNVNRIFTLTQACLPLLRANATADSPSRVINIGSINGISPPALETYAYSSSKAALHQLTRHLAGQLGSEHILVNAVAPGSFPSKMMSATLKNFGDMIIAGVPVGRVGTPEDIAGTCIYLSSRAGQYTVGAIITVDGGALQKRAKL

SEQ ID NO: 135222 - protein, 337 aa, Triticum aestivum
  Clone ID: PAT_TA_29640.pep
AQHPSLPEWSSNRKHRSIYFADKSMGHILIAEPPSFLTVHDVIAIVVSHRLGAPVILPAPAVFACPDGSEKEVLQILHLGTDVGVSKREGRYDCSLGGELLSQDARQVQFLPLRPFYSGEIVAWKTGKEGEKLRYGRVPEDVRPSAGQALYRFPVETAPGETRMLLSSQVYSFKSVSTADLSSAPSQPDVGRVADVGQPGHSSVSSRTEGADNTAAGLEYGKVSSMELVQAVHDMLSAAGVRMDAEKETLLQTTLSLQDQLKESQVALLVEQEKAESAVKEADIAKAAWSCRVCLNNEVNMTIVPCGHVLCNRCSSSVSRCPFCRTQVSKMMKIFRP

SEQ ID NO: 135223 - protein, 113 aa, Triticum aestivum
  unsure (1)..(113): unsure at all Xaa locations
  Clone ID: PAT_TA_29641.pep
ESGFNYNXPHXAGATXXKAKLKXRRGRPVWRQSQKGRPVISALHGIASQQSEHAGSKEAGPKRPPIPIRQQTEEATGPGTPSRLCGSRAMACRWRSASCCLPSVAHCHHYSAT

SEQ ID NO: 135224 - protein, 153 aa, Triticum aestivum
  Clone ID: PAT_TA_29642.pep
MSATAIRSGELLAFPAALRRGPPVASASVVAFRLRAPVAGRVAVRVVAAAAEGAGAEAEAEGKPKPKKKRAASGIMKPKPISPELREFVGGAAELPRTEALKIIWAHIKGNNLQDPENKKIIVCDEKLKKIFGGRDRVGFLEISGLLNPHFQK

SEQ ID NO: 135225 - protein, 199 aa, Triticum aestivum
  Clone ID: PAT_TA_29643.pep
VQNTGQNTVTVDVKTTSDISIAHTLPPLSKGESKRVNISSSSPNGGEVTLNVGTGHCVLRIRQPVYDWQQQFQQLTSYATTVKPIYGAYFGVFTLVLVGAVFACCKFAGTKRDGGVPYQQLEMGSQAQAPDSSGANNTTSTGDGWEDGWDDDWDDEEAPAKPSERGPAGSISANGLSLRSPTNRSPTDSKDGWDVDWDD

SEQ ID NO: 135226 - protein, 173 aa, Triticum aestivum
  Clone ID: PAT_TA_29644.pep
ECRSAGCRTLAEAKIHIEQKRRKEYEANALKAKESGQLISNSKSGHKTNRPMKLETDGSLDLKKGSAILDAGGRDSPKTTGPTSAKQWDDWDIVGLPGAELLSSSEKLLCCQNRLLPSHYLRMQEVLMQEMFKGNVVKKEDAHVLFKVDPAKVDTVYDMVTKKLGNNEEAPMV

SEQ ID NO: 135227 - protein, 223 aa, Triticum aestivum
  Clone ID: PAT_TA_29645.pep
NGGVLVGLAACGVMMSIVSTASDLMQDFKTGYLTLASPKSMFISQVIGTAMGCVISPCVFWLFYKAFSDIGTSGTEYPAPYAIVYRNMAILGVDGFNTLPENCLTLCYIFFAAAIVINLIRDLTPHKFSRFIPLPMAMAIPFYIGSYFAIDMFLGSFILFVWEKMNKAKADAYGPAVASGLICGDGIWTLPQSILALAKVNPPICMKFLTRGDNVKVDKFLGG

SEQ ID NO: 135228 - protein, 102 aa, Triticum aestivum
  Clone ID: PAT_TA_29646.pep
MAAAAAPASSSSSPGWDFTCNFEVDYGSEEHASIVYKTLAVDKELQPDKVRREMTVSGGKLLVRFEAVEARFLRASFSAFVDLMVLITKLVEEYGVSKEEHS

SEQ ID NO: 135229 - protein, 182 aa, Triticum aestivum
  Clone ID: PAT_TA_29647.pep
MTNTIQKKFKVSSTQLLYQSCPYQALTLFIVGPFLDGFLTNKNVFAFAYTSHVVFFIVLSCLISVSVNFSTFLVIGKTSPVTYQVLGHLKTCLVLTFGYVLLHDPFSWRNILGILIAVVGMVLYSYFCSTETQPKNTDVSAQQSKEGDSAPLISDSLSKVENGGDDDEPLKVPMWSSKYSRA

SEQ ID NO: 135230 - protein, 194 aa, Triticum aestivum
  Clone ID: PAT_TA_29648.pep
LLAIITTCIAQIMTNTIQKKFKVSSTQLLYQSCPYQSLTLFLIGPFLDGFLTNQNVFAFNYTSNVVFFIVLSCLISVSVNFSTFLVIGKTSPVTYQVLGHLKTCLVLTFGYVLLHDPFSWRNILGILIAVVGMVLYSYFCSIETQPKNNDVSGQQSKEGDSAPLISDSLGKVENGGDDDEPLKVPMWSSKYPRA

SEQ ID NO: 135231 - protein, 412 aa, Triticum aestivum
  unsure (1)..(412): unsure at all Xaa locations
  Clone ID: PAT_TA_29649.pep
AQIRARGARCSRRRVRAVVIAKACSFLLVPLSGGWWQLSFASQGRSAGRWGRWVSLWLSRHACPISAARKLSLSVVSSVSIVICNKALMSALGFIFATTLTSWHLLVTFCSLHVALCMKLFEHKPFDARTVMGFGVLNGISIGLLNLSLGFNSVGFYQMTKLAIIPCTVILETLFFRKKFSRYIQLSLSVLLFGVGVATVTDLQLNAMGSVLSLLAIVTTCIAQIMTNTIQKKFKVSSTQLLYQSCPYQALTLFIVGXPFLDGVSXLNKNVFAFAYTPLVLFFIVLSCLTSPXLNFTCFLLIGXTSPVTFRFAGQPKXAWNLPWVHVSLLDPFRWRNLLGILIAVVGMGLYSYFCTREAPKPTEASPQVTQVKEGESDPLIADSLNAAENGAAATTDEPLKVPMWSSKYARA

SEQ ID NO: 135232 - protein, 275 aa, Triticum aestivum
  unsure (1)..(275): unsure at all Xaa locations
  Clone ID: PAT_TA_29650.pep
MAPATADAAGVGAGPAVGRVKTALGVAACERDAEKLELIEQLTKGFDDEQQRVLAAILARNNGAEYLRRHGMEGCTDRDAFKARVPVVTYEDLRPEIERIANGDRSNIISSHPISEFLTSSGTSAGERKLMPTIEDELDRRQMLYSLLMPVMNLFVPGLDKGKGLYFLFIKSEIKSPGGLGALPVLTVYYRYDKSKYRTYRPFDAYQVYTSPTPAILCTDSFQSMYSQMLCGLLVRTEVLRVGAVFASGLLRAIRFLQLHXXELARDIETGTLSA

SEQ ID NO: 135233 - protein, 386 aa, Triticum aestivum
  unsure (1)..(386): unsure at all Xaa locations
  Clone ID: PAT_TA_29651.pep
MCGEWRLNTHIEEPRFGSNPAVFTVLIHTELESSPEALPKSCKSVSFESSRGSLCAVKPGDTRIGPYVHVGFVKSDLSSDCTAGSTLVSQEYPPGITLVPIXSSTLRPFRTTNLVVIQATSGTCGSKRPDYFACGDVLLIDPGCCSQVHTELADLVNSLPKKLLVLVTHHHNDHVEGLSVVQRCNPDAVLLTHENTMKRIGKGNWSTGYTAVTGGESICIGDQELQVVFAPGHTDGHMGLLHVNTNALIVGDHCVGHGSAILDNRAGGNMKDYFQTTYKFLEMSPHVLIPMHGRINLWPKHMLCGYLKNRKAREASILQSIENGAQTLFDIVSKTYCDVDRKLWIPASFNVRLHVDHLNSQHKLPKDFSLEMFSGSCDEFMSSLQQ

SEQ ID NO: 135234 - protein, 47 aa, Triticum aestivum
  Clone ID: PAT_TA_29652.pep
LHPKALWEITMPIVQKAANYGGVMLWDRYYDVVNVQDHYSSYIKNWA

SEQ ID NO: 135235 - protein, 135 aa, Triticum aestivum
  Clone ID: PAT_TA_29653.pep
MASTACFVIVSKNDIPIYDAEVGSAPKKEDQAYQHQFILHAALDVVQDLAWATSAMFLKSVDRFNDLVVSVYVTAGHTRFMLLHDSRSEDGIKSFFQEVHELYIKIFLNPLYLPGSRITSSHFSTKVRSLARKYL

SEQ ID NO: 135236 - protein, 108 aa, Triticum aestivum
  Clone ID: PAT_TA_29654.pep
MHHPLHQQIFLELGTGKEIGIGSMRDGLYYLDSNIFPAVAATVSPSSLEEFLLQHRRLGHLSFAILGQIYPNLYCKISKEQLMCDACQYGKQVRSSYLSSDNRSDVPL

SEQ ID NO: 135237 - protein, 172 aa, Triticum aestivum
  Clone ID: PAT_TA_29655.pep
SISAALQVGPLLLAARLVVSSPVSEGCCRCGTRWRHARFRRRAESETVAARGGGLAGCLGARCSLVTHCLVVRAARFIRCLALGLCDCPGVMPELWREPPAGQRGEGASVPGPEPERDAMQCGDRLDFPLPLSLCVLGFCCWASTLIRYFAAAGRAGRGTHCCFVGLGGVLA

SEQ ID NO: 135238 - protein, 233 aa, Triticum aestivum
  Clone ID: PAT_TA_29656.pep
FTPIDVFAVQWIQAGVTHFGLTASYYGFVADVLQLSEKFRVQLGPFRYVVAGLLKFLSLPQYRFEVDYLPASPGRNSELRPLTKKCHEQLSDDGKVRRGTQINGRIEDNWVTRNGEFLGIFVCNHFCKPAQGLLSPVIAPKAQHDDGGLDLILVHGSGRLRLFCFFVAYQFCWHLLLPFVEYVKVKQVNVRPVGSTHSGCGVDGELLQAEGQPEWQCSLLPVQGRLLGRHPRT

SEQ ID NO: 135239 - protein, 258 aa, Triticum aestivum
  Clone ID: PAT_TA_29657.pep
MAKKAGADRTAAAMKAGSCSRKKARVEPEAKAASSSKITVTLDPKLLECSVCCSPLVAPLSQCANGHITCFECSSDLSYSCSLCSGPANTHCSALERILGGLAVPCSFQEHGCTEMIPFTEKLAHEESCLHAPCHCPIAGCCPYPGRSLCDHINAEHPTIQYTRLVSLGSKVVFLLVVDRSIPSGLTLSVIHLMSDPIEREGFKYKIQVHTQTGILSLSGETQSVGRLRGPYQAGASLFVSNTMWSPPDSPVYLELKC

SEQ ID NO: 135240 - protein, 137 aa, Triticum aestivum
  Clone ID: PAT_TA_29658.pep
HRTHRGWGLGQRRKWPAAGGPAWMGRRRRLEGGGSLLESSRTLSLLELTRMDGISLQSSYATNTFHWQRFQVLKSLLKTWIEPAYEARREEFLSILLCITMRARDSTETSDFIQVDKTSTCGEHARARFHRNFRLSS

SEQ ID NO: 135241 - protein, 303 aa, Triticum aestivum
  Clone ID: PAT_TA_29659.pep
VIDGSGSKWWANSCKIDRSKPCKGAPTAVTIDSCRGVRVRGLTVQNAQQMHLTVSRSRGVRLDGMAIQAPGDSPNTDGIHVAESTAVTITGARIGTGDDCVSISNASFAVKMKGIVCDPGHGISIGSLGRGGSYAAVEGVTLDDARISRAQNGVRIKTWQGGAGYVRNVRFSNVLVEAVDHPIIIDQFYCDARTACANQTSNVAVSNVSYRNISGTATRDEAIKFACSDAVPCSDIVLSNINLLGDDGAEVQAVCNCAMGLGYDPVRPAVDCLRNNACGGGGGGQKLGAEEPSTTDAPLHAEL

SEQ ID NO: 135242 - protein, 348 aa, Triticum aestivum
  unsure (1)..(348): unsure at all Xaa locations
  Clone ID: PAT_TA_29660.pep
MGDSGGSVVSVDVERISLGGKEHHIQTNHGSVSVAVYGDHDKPALVTCPDVALNYMSCFEGLLFCPEAASLLLHNFCIYHISPPGHELGAAPISPKTPVPSVDDLADQVADVLDFFGLGSVMCLGATAGAYILTLFAAKCRERVLGLVLVSPLCKAPTWTEWFYSKVESNLLYYYGMCGLVKESLLQRFFSXVRGCSESPESDIVQGCRSLLDQRQSMNVXWRFVEAMNGRYDLTEGLKQLQCRTLIFVGKNSQFHVEAVHMTAKLDRRYCALDEVQACGSLVTEEQPHAMLIPMEYFFMGYGLYKPSELDCSPRSPLSPFCISPELLSPESMGVKLKPIKTRARLQV

SEQ ID NO: 135243 - protein, 146 aa, Triticum aestivum
  unsure (1)..(146): unsure at all Xaa locations
  Clone ID: PAT_TA_29661.pep
MAAAKSNQLSTLVPNMFAAGLLDDQFRQLEMLQDEGNPDFVAKVVMLFCEEGERIIGELAKQLDQPCVDYGKVDTFVDQLWGSSLYVGAQRVKNTCIQFHECCQEKSKVGCLKTLDFLRNDFYDPCSMFXHRLQLQQHVLTCRPEQ

SEQ ID NO: 135244 - protein, 106 aa, Triticum aestivum
  unsure (1)..(106): unsure at all Xaa locations
  Clone ID: PAT_TA_29662.pep
RHRGRRHHADSTPNLGFRPKTATNPRREIWRCRHTLATPPRRRTTPMGTVIASTEHGQEFLLDRRTPSSLPLRIGATASKLATPPTQQHFAIIAEKSVSPSCRIXC

SEQ ID NO: 135245 - protein, 187 aa, Triticum aestivum
  unsure (1)..(187): unsure at all Xaa locations
  Clone ID: PAT_TA_29663.pep
PPPPPQPPPPAHSSRRKREQGARSNSSSDGIESASFFLARSSPRPPTWRTRRSGMAVDDECKLKFLELKAKRTHRFIIYKIDDKKKMVVVEEXFGEPALNYEDFAASLPTNECRYAIFDYDFVTEENCQKSKIFFVAWSPDTARVRSKMIYASSKERFKRELDGIQVELQATDPTEVGFDVIQGRAN

SEQ ID NO: 135246 - protein, 102 aa, Triticum aestivum
  Clone ID: PAT_TA_29664.pep
MARKAAAAMDGKSSELARAVAEAEAREERLRRELEAALARVAVAEEAEERLCVQLGELEAEAMTQAMEYQQHVRALSERLALMDGLLRSSGLHSGVVQSGLH

SEQ ID NO: 135247 - protein, 103 aa, Triticum aestivum
  Clone ID: PAT_TA_29665.pep
MARKAAAAAMDGKSSELARAVAEAEAREERLQRELEAALARVAVAEEAEERLCVQLGELEAEAMTQAMEYQQHVRALSERLALMDGLLRSSGLHGAVVQPGLH

SEQ ID NO: 135248 - protein, 158 aa, Triticum aestivum
  Clone ID: PAT_TA_29666.pep
AAPCAASLSPMLSSLIYLPGFSCSNGGQAPMESPELSSQPPFSFKFVGIRLDLDAGAPFPIFPPCLGRRPPRRCQYRSRDPAPPLLATSSPEMPPHPRLPTRAAAANTSLRPSPAVSFSFYRSLPNLCQNSHGDELQLKARERLVAFDAVPGEYLWGE

SEQ ID NO: 135249 - protein, 331 aa, Triticum aestivum
  Clone ID: PAT_TA_29667.pep
MGSYVQGEDEVPVYESGAHALQKLQEKWKSTAAPYPAMYSSFLGGIILDPAMMALPIDDHMVHRGHGVFDTAMLLDGHLYELDTHLDRFLRSAAQAKVGTPFPRDTLRSILVQMTAASGCRKGSIRYWLSSGPGDFLLSSSGCPGPAFYAVVIPSDYAQCRDGVRAVTTSVPMKPPLFATMKNVNYLPNVLSIMDAEERGAFASVWVDEQGYVAEGPMVNVAFVTQGGELVLPVFDKILSGCTAKRMLALAPKLVEAGLLKGVSTQHITADDAKRSVEMAFVGSGLPVLPIVEWDGQPIGDGKVGKLMLALSDLLWEDMKSGPDRVAVPYK

SEQ ID NO: 135250 - protein, 183 aa, Triticum aestivum
  Clone ID: PAT_TA_29668.pep
NPHFMPPRPQDNLSPPPHVHHVEKQPHYGISSYGRDANPTAAPTSGNQHLSHGSSQISQKMQVPLSYADAVIGSAGANISYIRKHSGATISIQEGVPGEMTVEIAGSASQVQTAQQLIKNFMAEASPQVPPPGPAPPSQPVDSGYNSYPPYGGPSYATPPGGAGPTPHNGGGYGAHYPPNYGY

SEQ ID NO: 135251 - protein, 256 aa, Triticum aestivum
  Clone ID: PAT_TA_29669.pep
MPVARGAKKPGPVDSDSDDDGLVSKKPTKSSTYSVPTGNKKQYKDGFKDSGGLENQSVEELENYAAYKAEETTDTLNGCLRIAENIKEDATNTMITLQKQGEQISRTHEKAVEIDQDLTKGEGLLNSLGGFFSKPWKPKKTKKIKGPVSRDDSFKKKTSRMEQRDKLGLSPRGKGNTREYGEATSAMDKVQLEKKKQDDALDDLSGVLGQLQGMAVDMGSELDRQNKALDDMHGDVEELNSRVKQANQRARKILAD

SEQ ID NO: 135252 - protein, 211 aa, Triticum aestivum
  Clone ID: PAT_TA_29670.pep
MELPLSAPRAHAAAAFPCSPTSIFRLHGAATPHSRARPLHARRNKNSRGDAAEPKVITIGRPGKKSKRRGDKKQDQQQLPADQEDEDDEEDDDEEEDERDVAIPEVVTNRMMRRVGASVGIPLALGLAFFPAFYYLKKVAKVDVPSFIPYGLSFVFFGAALAGVSYGIVSASWDPAREGSLLGWNEARRNWPVFWESFRGTPPPSPPRRGR

SEQ ID NO: 135253 - protein, 99 aa, Triticum aestivum
  Clone ID: PAT_TA_29671.pep
TIPGARQLVNHRHILVNGRIVNIPSFRCKPRDIITTKDNQRSKGLVQNYIASSDPGKLPKHLAIDTLEYKGLVNKILDRKWVGLKINELLVVEYYSRQT

SEQ ID NO: 135254 - protein, 493 aa, Triticum aestivum
  Clone ID: PAT_TA_29672.pep
RARLAVYKVAFEGPKKVQLASAALLAALDDAIHDGVDILSLSVQYNDNSFGSLHAVQKGITVVYGAGNSGPRPQVISNTAPTRPTVATSKIDRSFPTAITLGNNQTIVGQSLYYMIKNESKSGFQPLVQGGSCSIEALNGTEINGKIVLCIKETFGPTADILPDAITNVKSGGAFGLIFAIYTIDKLLSTEDCVGIACVIVDIDIGFQVATYIGSQGSPIAKIEPASTITGNRVPAPRVAFFSSRGPSAKYPTVLKPDIAAPGVNILAATGDGYVFDSGASMSTPHVAGVVALLKAVHPDWSHAALKSAIVTTASTKDEHGMPMLAEALPRKVADPFDYGGGNINPNAAADPGLVYDIDPRDYSKFFACTIQKYAICNISTSPAYHLNLPSIAIPELRGPIKVQRAVTNVGEVDAVYRADIQSPSGVRIKVDPPTLVFNATTKVHAFKVSMTPLWKVQGGYTFGSLTWRNERHSVRIPLAVRITIQDFYADVA

SEQ ID NO: 135255 - protein, 230 aa, Triticum aestivum
  unsure (1)..(230): unsure at all Xaa locations
  Clone ID: PAT_TA_29673.pep
MADADELSRGLASDAGTNNLFQVMRAVEDAEATIRHQLEENSRLKEELMRKTRELDAIRSEAINQTSTSSLLDQDRAVEPYRDSVGNQTVEDQRLLGTSSSPPGSQGTLPGHQNGPAEQTLHDAVMKQKYLDSDQPGRVSRKPSGEHIAAEAGVRSHFSTPSSRSLSPTRNRREGDYDSRLSLAGQGMEMSSNIIWKXDLLVKVKEHEEEIAHLRKTPADYSVKESQILN

SEQ ID NO: 135256 - protein, 202 aa, Triticum aestivum
  Clone ID: PAT_TA_29674.pep
KQSPGEKFDVYKLQLPVFNMSSLRVVNEDHRTYPSNADVDVNESIWQELEKELIPSSSVVRTNWLDTQPKSSPFKNNKACICVAGEAVKLNVELKNPLQISVNVSGISLICQLSTNLNSSETGALTTAAEEEIANTKPSISTFESDGNNFTVSKLDIVLGGGETKKIQLEVTPKVIGILKLVGIRWTLSDSVVGYQYFEVAT

SEQ ID NO: 135257 - protein, 256 aa, Triticum aestivum
  Clone ID: PAT_TA_29675.pep
RLSSAPSDSLAAIQHQAADNSHAGTTGRAPSLTTQAQRWPGRSLLARNSILAEPSQLRHQSGRWFAPPSPARVVATKLSHHTTPPQTPPRPLQLHAARCALSSATTTPSSQRNRQHHHRAWQPWRPGATTPAGSHDRVRAGQIQIQRRGSGRTRNQQPSLPQATPPYGAQTTPAATAPGRRRRESQHHATKRRWRQRHAPWPWGGESRGGEAPPPPALPGLCPGAALGGGEGDGRDEGRPAAAIEGSPRVDSPTLR

SEQ ID NO: 135258 - protein, 397 aa, Triticum aestivum
  unsure (1)..(397): unsure at all Xaa locations
  Clone ID: PAT_TA_29676.pep
MVLEGEKTAAAAVHGHRLSTVVPSSVTEVGGYELGDADLAFRLHYLRGVYYYAAGELMLPLXTKVLKGPHVPLASTPTYPVAGRVRRPADENEEASRRPSFKPNDCGLRIVDAQCERALDDWLRDDAVDRVRQSCYHHCFGPEXPNLPAAAMALGFSWAHLIGDVATATTCFNHWAKILGGKTPDAVTVNPRNEPQDRAPADAAVPRSVKSVGPIEDYWFVPAGVDMAGYSFHVTEPMLTRLQQQEPAAAGGAFELISALLWQTVAKIRAAKEVKTVTVVRNDMSARSGNSLANEQRVGYVEAGSPPAKTDVSELAALLAKNVVDETAAVVAFPGDVIIYGANLTFVDMEQVDLYGLEIKGQRPAHVEYGLDGVGEEGAVLVQPDADGRGRVVTAVL

SEQ ID NO: 135259 - protein, 189 aa, Triticum aestivum
  Clone ID: PAT_TA_29677.pep
LAAKTKSYFAKAVSMWDAEYFVKVDDDVHVNIATLGGILARHRSKPRAYIGCMKSGPVLAQEGVKYHEPEYWKFGEWGNKYFRHASGQLYAISKDLASYISINQHVLHKYANEDVSIGAWFIGVDAEHVDDRRLCCGTHPECERKAQAGNVCAASFDWSCSGICKSADRIKEVHRRCGESENAIWNATF

SEQ ID NO: 135260 - protein, 143 aa, Triticum aestivum
  Clone ID: PAT_TA_29678.pep
MGIRFVLLVNKQGQTRLAQYYEHLSLDERRALEGEIVRKCLARTDQQCSFVEHRNYKVVYRRYASLFFLVGVDNDENELAILEFIHLLVETMDRHFGNVCELDIMFHLEKVHFMLEEMVMNGCIVETSKQNILAPIQLMEKTS

SEQ ID NO: 135261 - protein, 120 aa, Triticum aestivum
  unsure (1)..(120): unsure at all Xaa locations
  Clone ID: PAT_TA_29679.pep
PASDERGALSSELARNXLARTDQQCSFVEHRNYKXLYRRYASLFFLVGVDNDENELAILEFIHLLVETMDRHFGNVCELDIMFHLEKVHFMLEEMVMNGCIVETSKQNILAPIQLMEKTS

SEQ ID NO: 135262 - protein, 92 aa, Triticum aestivum
  Clone ID: PAT_TA_29680.pep
STHASGKKYQRPANAQDAERCATSKRTRFCSICREPGHKNSTCPLRGDLRRKERKEAKCSNCGVGGHRRNTCNKPKVVVHVIEKIALETNLP

SEQ ID NO: 135263 - protein, 248 aa, Triticum aestivum
  Clone ID: PAT_TA_29681.pep
MARRCGCSVGATLLALSLAVLLAASAVPGAAGFHLGGDESGLVRGMLAAVRERAEAEDAARFAVAEHNRKQGSALEFTRVVNAKRQVVAGTLHDLMVEVVDSGKKSMYKAKVWVKPWQNFKAVVEFRHAGDFQYESSVASDVSTQPGSQPPHADAKLADQSKAREERRWPAAAAAPSAPRSSPSPSPSSSPPRPSPGPPGSTSAATRAASCGACSPPSASGPRPRTPRASPSPSTTGSRVLHWSLHGL

SEQ ID NO: 135264 - protein, 187 aa, Triticum aestivum
  unsure (1)..(187): unsure at all Xaa locations
  Clone ID: PAT_TA_29682.pep
MSVSSALSSFLYGCFNPAGGRNPHHRAGAXVAQQPPHERWHPVVRTRGRSSRPLSLPAQELAVPADGGAYAREVKHAVRKVREADSVEAARGGQRGGGGGDGEGHRELVRVRRAGEKAEFWPNPDQPLHFTTAKDYFHDQESFRPSYNYYRHGYNGDKHGHLPEPHRGSDPVSNMFNDDDVNACSIM

SEQ ID NO: 135265 - protein, 189 aa, Triticum aestivum
  Clone ID: PAT_TA_29683.pep
GTRLCRRVSKVLCKGVGPEGGGPPAGGGGEGGAGGGARGHACGRSPPRGARRGGGAHSDPGGMTMLLVDDHVRGLQVKKDGQWITVDPVPDAFIVNVGDQIQVLSNAAYKSVEHRVTVSAAEERLSLAFFYNPRSDVPVAPMAELVAPGRPVLYPEMTFDEYRAHIRQRGLSGKAQLQSLQNANSSVAS

SEQ ID NO: 135266 - protein, 197 aa, Triticum aestivum
  Clone ID: PAT_TA_29684.pep
MVKLAFGSLGDSFSATSVRSYVAEFIATLLFVFAGVGSAISYGQLTQGGALDPAGLVAIAIAHAFALFVGVAMAANISGGHLNPAVTFGFAVGGHITILTGLFYWVAQLLGSTVACFLLKFVTHGKAIPTHAVSAGMNEFQGVVMEILIPVILGEHDGIATHGDPILGVPMIILAAISNCVALYSDAMNIFPRKEVA

SEQ ID NO: 135267 - protein, 134 aa, Triticum aestivum
  Clone ID: PAT_TA_29685.pep
GCGIGCSGLCSLDQREHLLPPFGEPCWFNAPSCPGSEQAEILQRSGGGGERVGRGTIAPMAIGFIVGANILAAGPFSGGSMNPARSFGPAVAAGNFSGHWVYWVGPLIGGGLAGLVYGDVFIASYQPVGHQDYP

SEQ ID NO: 135268 - protein, 265 aa, Triticum aestivum
  unsure (1)..(265): unsure at all Xaa locations
  Clone ID: PAT_TA_29686.pep
MGVGNGSADVNQQTARNEIRDETAPLLPVKVEEEGFHEFNGASFSGAVFNLSTTIVGAGIMALPASIKMLGLIPGLLMIIFVALLTEASIDMLIRCSHQGKITSYGWLMGEAYGQWGRIALQASVVINNIGVMIVYMIIIGDVLSGTSSGGIHHRGILEGWFGAHLWEXRAIVLLVTTLFVFAPLVSFKRLDSLSYTSALSVALAVVFVVITAGIAIIKVINGTVAMPKLFPEIDDLSSVWKLFTAVPVLVTAYICHYNVHSIDN

SEQ ID NO: 135269 - protein, 220 aa, Triticum aestivum
  unsure (1)..(220): unsure at all Xaa locations
  Clone ID: PAT_TA_29687.pep
RVREAECPGTVSCADLLAIAARDAVVLVGGPYWDVPVGRLDSKEASLDLANKDIPTAEQGLVTLISKFWEKGLDATDMVALVGSHTIGFARCANFRDRIYGDFEMTSKYNPASATYLSKLKEICPLDGGDDNISAMDSHTSXTFDNAYFETLIKGEGLLXNSDQEMWSSIAGYSTADTVNKYWADPELFFKQFSDSMVKMGNITNPAGGEVRKTCRFVNT

SEQ ID NO: 135270 - protein, 539 aa, Triticum aestivum
  Clone ID: PAT_TA_29688.pep
MVGPGHRNSHGKRQSDYAENGGGKRRNPGDDTYAPGPDDTVYRYLCTSRKIGSIIGRGGEIAKQLRSDTQAKIRIGESVPNCDDRVITIFSSSRETNTIEDTEDKVCAAQDALFRVHEKLATDDGPVNEENEEGLGQLTVRLLVPSDQIGCIIGKGGHIIQGIRSDTGSQIRVLSNEHLPACATSGDELLLIIGDPMVVRKALLQVSSRLHGNPSRSQHLLASSLTQPFPAGSRLGSSSTAPVVGITPMVSPYGRYKGDMVGDWPSIYQQRREVSSAKEFSLRLLCAAANVGGVIGKRGGIIKQIRQESGAFIKVDSSSAEDDCIITVSAKEFFEDPVSPTIDATVRLQPRCSEKIDAESGEPSYTTRLLVSTSRIGCLIGKGGSIITEIRRTSRANIRIISKEDVPKVASDDEEMVQISGDLDVARHALVQITTRLKANFFEREGALSGFPPVIPYHPLPASVSDEPKYLSRDNKSAGHDYPYSSGYHASDDVLPVDRYANYGSSQVYGGGYGAYSGGSGSSGLSGSTYLSSGKRYGY

SEQ ID NO: 135271 - protein, 216 aa, Triticum aestivum
  Clone ID: PAT_TA_29689.pep
GGDGETSAARAARVLGFMDGLSSCCGEERVMVFTMSGGKEGVDPAVLRPGRLDVHIHFTMCDFDGFKALASNYLGLKDHKLYPQVEEGFHAGARLSPAELGEIMLANRGSPSRALRTVISALQHVVAPRTSSAARPPRLTSRTSGHLDESNPAAGESQSPGAGGGGGFGKDAPMREFKKLYGLIKIRSRKEGGVVPVDDTASANGRGNDASTEKDR

SEQ ID NO: 135272 - protein, 118 aa, Triticum aestivum
  Clone ID: PAT_TA_29690.pep
PSPPNCICSALQATIMSGRGKGGKGLGKGGAKRHRKVLRDNIQGITKPAIRRLARRGGVKRISGLIYEETRGVLKNDLENVIRDAVTYTEHARRKTVTAMDVVYALKRQGRTLYGFGG

SEQ ID NO: 135273 - protein, 77 aa, Triticum aestivum
  Clone ID: PAT_TA_29691.pep
PARKFTCRGLVRYFYCSWSFSSCFDLLVLNTCCVLVMLWLLNPKRERQNKLDDISKKHDMYASLRVGRGRSSSFSKV

SEQ ID NO: 135274 - protein, 125 aa, Triticum aestivum
  Clone ID: PAT_TA_29692.pep
CFTLKKPGILCQTARLTIPMAKRHVACLRCKGQEDLLPCIYSCHHYIILRSDELCLLRRAKLAIHTFGSPLVLIWMIRRCAHRIVEVALVAAYHRCSRSRRYSRTLDAVLRSQAEAASELTAGSS

SEQ ID NO: 135275 - protein, 143 aa, Triticum aestivum
  unsure (1)..(143): unsure at all Xaa locations
  Clone ID: PAT_TA_29693.pep
GRDKIPKKGVTTGYTCRAXAPERHKSIVRPDALNPXLINVVHHFHLKEGMKYANVGQGVMLINHYKYQVWEVFKEKFAGRVATYVADWQDEENVGSRDRAPGLGTKPVEPEDWPSRFCEVYDTGLKDFVHKEFTDPQTGSLPW

SEQ ID NO: 135276 - protein, 86 aa, Triticum aestivum
  Clone ID: PAT_TA_29694.pep
RPNSYFSLVQQFLGAVPRIDAMKRSACIEGARMALAHVKTYWAEMEATAIATQSSAVGRVSAEHYFKEVLEGARLIEARCSKNIMF

SEQ ID NO: 135277 - protein, 332 aa, Triticum aestivum
  Clone ID: PAT_TA_29695.pep
RHEATPRSDGGGGEPGAGGSAPVCNFVRKPPKNIRKRPAASVGSDDEEGSGGDDSGAIAAARSKKPPSTTSKLFFSSADNSHEPRRFQFESSRTIQSSTDNRATATLETETAYDRDARAIRERQLKQAEESLKKNPSASSSSGELYKGIHGYTDHKAGFRREHTVSGEKAGGAHGPLRASAHIRLSTRFDYQPDICKDYKETGYCGYGDSCKFMHDRGDYKSGWQLEREWDEAEKARKRRIAMRELDGSDAEAEEEDSDDEEALPFACFICREPFVDPVVTKCKHYFCEHCALKHHSKNKKCFVCNKPTLGIFNAAQEIRKKIAQDKKQQDL

SEQ ID NO: 135278 - protein, 68 aa, Triticum aestivum
  Clone ID: PAT_TA_29696.pep
LEPAEVLIEFLIDELCFSLPLLGHYLSCQLPPQLLGLSYVEWCLHGTCLWQVVFPYTKSGNWMAVNAF

SEQ ID NO: 135279 - protein, 141 aa, Triticum aestivum
  Clone ID: PAT_TA_29697.pep
GRLDRIPHLLPTLRLPDQLAAVLLHPHPGSRFGPSSTLVDPRLLPSRPLSGSANRPPRFFVLQDPVMEGSSAMSPLGEPSIPMIAACAPTLSGVRIAIELIKCPWRLSSLSQQEARLPGSTNTRQNDRYFRSCTSKMLVGR

SEQ ID NO: 135280 - protein, 200 aa, Triticum aestivum
  Clone ID: PAT_TA_29698.pep
SFAPSVISKISSIITDLIGLGAKTLLVPGNLPIGCLPVYLTMYQSDDTGDYESDTGCIRWMNEFSRYHNKLLVDELEKLRKLHRSVSIIYADYYGAAMEIFVSPSQFGIKNPLVACCGVEGPYGVSITTKCGHGEYKVCDNPQKYASWDGLHPTETSYKAIADGLLRGPYTQPPIATTKNSCSKLTELVSSVEYKVLYDL

SEQ ID NO: 135281 - protein, 99 aa, Triticum aestivum
  unsure (1)..(99): unsure at all Xaa locations
  Clone ID: PAT_TA_29699.pep
ILPVLLAREATTIDVSGXAFNSSILWXPERWGRPTSLPDTXQDSIKFVQEVVLKDRTKLKGIPSDCSQIMVWQYDVPSSPNTPKTKTKTATPKTHHRRR

SEQ ID NO: 135282 - protein, 301 aa, Triticum aestivum
  unsure (1)..(301): unsure at all Xaa locations
  Clone ID: PAT_TA_29700.pep
FTGFAPSSSSSWRPGGGGGTPPPILAAEQLAASRVAGNRDQHISLAPPSPEGAAAAGGGGAVVDLEDDEESGPRRMLIVVTTTRSGAGERRRRRPELLRLAHTLRLVRPPVVWVVVEPAADAPATAEVLRGTGVMYRHLAFRPEENFTTAAAEAHAQRNAALAHVEKHRLSGVVHFADAAGVYDTHFFEEIRQIEAFGTWPVATMSAGEKKVVVEGPLCSASKVVGWFSRNFNDGTTRSVTXTTEVDLNPVSGFAFTRCMFWDPEGGVRPASLPHTSQDSNKFLQEVVLEDGTSRKEIPST

SEQ ID NO: 135283 - protein, 166 aa, Triticum aestivum
  Clone ID: PAT_TA_29701.pep
MGAVSATADVVVALFSLIMAVAAPLFDSQVVLPRDLYPAPLVDIHRWFAVAFGHYLVAYPPPFFLGLVWLDLALLWPVCVANLYGILARRRWSATTSLMAGVYMLTYLSAILGDMLGSGKATLRLLQLYVPFIVVAVIAVLRGLCSWSAPLAAATSVASSAQKKKA

SEQ ID NO: 135284 - protein, 276 aa, Triticum aestivum
  Clone ID: PAT_TA_29702.pep
LPSPVDSPPHAASAAGVADGILGAARALAARPEAWIDFPMLAIDENATISDVERDHMEVIEKLVPDLASLRATLCPSYMDEDAFWKIYFKLLESSLSEHTSEEDTQNVQVSVHRVNEIESPPHVCEIESEKGTQEGYQSSGSHALTKTRSEQSMDQWVFAKSKSEQSMDQWSEIPSDVESFREGHKRYFSSEAEEMSDVDNSNVLVMDKYMDSLLPDRRSLPYASSSVRSDSVRRKPAASSPDYSRRPPQPTPPVSLSKKESWDLIQDSEFEILDS

SEQ ID NO: 135285 - protein, 96 aa, Triticum aestivum
  Clone ID: PAT_TA_29703.pep
ELDDYEMPDFLEDEAPDVYLKNKGLVTIYNKTAQIRRRLIKMLILRRQRSEEAIFLDDKLEMYLHEAKLIQKQIKAQRGRFFKLPKILEEDIILLN

SEQ ID NO: 135286 - protein, 144 aa, Triticum aestivum
  Clone ID: PAT_TA_29704.pep
VATSALGLLAAAMISRHQGVTTSPSRLLCLDLGPLLAVKVETRMQCKTHPKTFLAAARCPFCFHLLSFVDVVSSLPVRAQIWLWFVLRRDRKRLIPALRICPKTPSLEHLAHWHHAKVPMLRRKQWPYVELAHDHSEKSHGLHS

SEQ ID NO: 135287 - protein, 67 aa, Triticum aestivum
  Clone ID: PAT_TA_29705.pep
TTSSPFISCLDGLRRVYACRTFILHKSCMFSACPSRSGAKHLASEAAPRVDAELPAVGPVVARPGVH

SEQ ID NO: 135288 - protein, 230 aa, Triticum aestivum
  Clone ID: PAT_TA_29706.pep
MAKSPMAILALGLAAVVLSGAGLASGDPVESVVTDAFFDGIKSQAADGGCPGKSFYTRQFFLDGAQANPDFGKGGTSDDGKREIAAFFAHFTHETGYMCYIEEKDGASQNYCDTNYPLWPCTSGKAYYGRGPLQLTWNYNYGAAGQKLGFNGLDNPEKVAQDPALTFQAAFWFWMTNVHQVVPQGFGETSRKINSGECNGGNAPAMNARANYYVEYCKQFGVDPGNNLTC

SEQ ID NO: 135289 - protein, 275 aa, Triticum aestivum
  Clone ID: PAT_TA_29707.pep
MARSPMAMLPFLALGVAALVLSAAGMVAAQKCGCRANECCSQYGYCGTTDAYCGQGCQSGPCSGSGGGGGSGVSVESVVTEAFFNGIKSRAGNGCAGKSFYTRRSFLAGARANPNFGKGSTSDDGKREIAAFFAHVTHETGHMCYIEEIGGARQNYCDRKYTQWPCASGKGYYGRGPLQLTWNYNYGAAGKSVGFDGLKNPEKVAQDPEVAFKAALWFWMNNVKQVLPQGFGATTRKINSGECNGGNAPAMNARANYYVEYCKQFGVDPGNNLTC

SEQ ID NO: 135290 - protein, 274 aa, Triticum aestivum
  unsure (1)..(274): unsure at all Xaa locations
  Clone ID: PAT_TA_29708.pep
MAKSPMAILALGLAALVLSGAGLVAAQNCGCQPNECCSKYGYCGTDDSYCGQDCRSGPCTASGGGSGDPVESVVTDAFFDGIKSQAADXGCPGKSFYTRQFFLDGAQANPDFGKGSTSDDGKREIAAFFAHFTHETGHMCSIEENGGASKDYCDETNTQWPXCTPGKAYYGRGPLQLSWNYNYGAAGGEXPGFDGLNSPXTVAQDPALTFKAAFWFWMTNVHQAVPRGFGATTRAINGDVECDGKKXDLVSARAGYYTDYCQQFNVDPGNNLTC

SEQ ID NO: 135291 - protein, 159 aa, Triticum aestivum
  Clone ID: PAT_TA_29709.pep
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPNINPVLLPKKTAEKEGKAPKSPKKAAKSPKKAATPKKA

SEQ ID NO: 135292 - protein, 108 aa, Triticum aestivum
  Clone ID: PAT_TA_29710.pep
RHEGNAMQASQKRAEDRSAHAACAGRSGAPEDAVAGRGSAARTSPKPEPPPRAPPGSPWRARAVACRIGRPEMRRPCDALPARPPGSRPNTSFTMSYTHHRWLALGRS

SEQ ID NO: 135293 - protein, 207 aa, Triticum aestivum
  Clone ID: PAT_TA_29711.pep
SGLLPNPELQTSVLSICLTSITLLFTIPYGLGAAGSTRVANELGAGNPEGARSAVRVVMSVAVTEAVIVSGTLLLSRRLLGRAYSSEEEVASAVAAMVPLVCITVVTDGLQGVLSGVARGCGWQHVGAYVNLGSFYLLGIPMAMLLGFVLKMGEKGLWIGVVCGSISQTTLLSAITFFTDWQKMADKALERSLSEKATESESRSLLE

SEQ ID NO: 135294 - protein, 190 aa, Triticum aestivum
  unsure (1)..(190): unsure at all Xaa locations
  Clone ID: PAT_TA_29712.pep
ADSPAENSGASKKRRPSGNRAAVRKXREKKKAHTALLEEEVVQLKALNKQLLKKLQNHAALEAEAARLRCLLVDVRGRIDGEIGAFPYQXRPVKNVDLVSGVDQGGFLGSAQVMNSCDFRCNDQMYCNPGMQMRAMGDDGAMSGQVFGQGTGDIANIQCMGGAKSGFTMPPGCGGMGTMPSGCLPGSEKQ

SEQ ID NO: 135295 - protein, 107 aa, Triticum aestivum
  Clone ID: PAT_TA_29713.pep
RIPYYARIFVLDKIGSSAIDDMEVKRVYLKTEHGYTFNVKLYNGDTYTHFECKTWQALCKAYAFEPDMVITFDIRPEDDIEGNIDIWVDVQTPPVLPFGDFFSTMHA

SEQ ID NO: 135296 - protein, 118 aa, Triticum aestivum
  Clone ID: PAT_TA_29714.pep
RIPCHARVFVLDKIGFSRTMEEKKFYLKTEHGYIFNVKLYNSDDYTYFGCKTWRALCKTYAFEPDMVITFDIRLEDDIEGNTDIWLLAQPPPGMPLSYFGASKHVQVLDKQDRILSRG

SEQ ID NO: 135297 - protein, 255 aa, Triticum aestivum
  Clone ID: PAT_TA_29715.pep
GESNLHPTPDTAGGSTSLGFLPPQTPRGCRRHLSSMSQPLNSSRDASNPPATHRVLITNKHGEKLVGLLHPTGLNRIIVLCHGFTASKSSGVIVDLADAIIKQGISVFRFDFSGNGESEGVFQYGNYRKEAEDLHSVVSYLYQEKYDVAAVVGHSKGNVLYRVTKESLMERLNTDMRATSLSISKECSFFTVHGSADEIIPVEDAYEFAKHIPTHKLCVVEGADHCYTRHRKELSDAVVGFITSNKARDTTLEDQ

SEQ ID NO: 135298 - protein, 213 aa, Triticum aestivum
  Clone ID: PAT_TA_29716.pep
MKGLFLCALALAFAMVTTHAQLQYCEKRCGKQADGMECPNNLCCSKDGYCGLGVDYCSAAAGCQSGACYDNKICGAQAGGALCPNNHCCSSGGRCGYGSEYCSGSRGCQSGPCWADLKCGHLANGKQCPNNLCCSQYGYCGLGPEFCGASCQNGACSTDKPCGNKANGARCTNNYCCSQYGSCGLGKDYCGTGCQSGACYTPSFLANILKCVP

SEQ ID NO: 135299 - protein, 127 aa, Triticum aestivum
  unsure (1)..(127): unsure at all Xaa locations
  Clone ID: PAT_TA_29717.pep
PKKTGPKNPGKTTXPTNSLAALALMLTPETASKPFSTNFLSSTLASSPLNSSRYPSTTLKITAIPSSRSFHPNLANQNSAPPSNIKQNVSSNRPPILTFSAWLGLVGAPGSNSHFSITLPMYKLIIS

SEQ ID NO: 135300 - protein, 98 aa, Triticum aestivum
  Clone ID: PAT_TA_29718.pep
EKIIACTSVGEVVLFKSTIKKPIIGSPQEPMIIPLARSVLAVPLYSSLEIKVDLHIPSTEETVKYSVEWNPDNFDWEKPLLHFDCTNGQVDVKVTLSY

SEQ ID NO: 135301 - protein, 135 aa, Triticum aestivum
  Clone ID: PAT_TA_29719.pep
MAFRGYCHPHPSSSVATTGPRFGARSPAAALSFRTSAAHGCNQPSSHLSFAAPTSNKVFEDQVRGIVCYRDDKGELVCEGYDEGPRLGMRLPEKACFPWPVGVQVTDFIRLATLRVFEDGAEDGLLHKNDQKWQL

SEQ ID NO: 135302 - protein, 413 aa, Triticum aestivum
  Clone ID: PAT_TA_29720.pep
MPSPSQTAASENATTVPCGGGDQRRTEEEVSRLGACTGSTLIQANVPPLFCFSWFRFESKGLQGDPDRRTSTRDRRSSWGYVFILVNNCLQYSAYYGVSTNLVNFLKVQLHSGSKAAANSVTNWQGTASITPLAAGFLADSFLGRYWTITLFLFISVAGYGVVAASAVFYAGLYLVALGGALQPVLSSFGADQFDAESDEEERRRQSSFFNWFYLSIVVGSLVGGTVLVWVQSAHGWRLGYGIPALLSVLAVALFLAGTGAYRRHQPPGGSPLTRIAQVVVAAARKCDVEIPTDATLLHECDGDDGMSVIQGSRRLAHTDEFRFLDKAAVETAGDKARPASPWRLCTVTQVEELKCVLRLLPVWACGITFEGAWAPLRRCVWTGRRTTRTTRGPGGKSSHRKQRLSPAGGLGG

SEQ ID NO: 135303 - protein, 349 aa, Triticum aestivum
  Clone ID: PAT_TA_29721.pep
EALVIGLGCLLFSRKGLFTRSSPVYPMDEGYRLILLTTSFQRYSYAAIKKATGNFADEIGRGGSGVVYRGVLEDGRVVAVKALTTSVSRSHGEEEFQAELSVIGRIYHMNLVRIIGCCSQGKHRILVSEFIENGSLATMLFSDEDGDGDGGDDHDVLAWSQRFRIAVGVARGLAYLHSECLEWIIHCDMKPENILLDRDLEPKITDFGLAKLLDRRPEGSASRAGREANPSGRIRGTRGYMAPEWVSSLAISDKVDVYSFGVVLLELVKGVRVADGDQNTDVRAVAKAVGEKMHSGSVDDLVDGRLAGDFNRAQVKVVVGVALSCLEEERNRRPSMSAVVQALVSVEDA

SEQ ID NO: 135304 - protein, 347 aa, Triticum aestivum
  Clone ID: PAT_TA_29722.pep
AAVEGVGSEQVLADAAALLVNGSISTFPSLGNRQRLLYLRLPFARTARGPPRPRTVSRLRIPAEALPSDESLLASFRTSLHSFLLAHHRRRRGGTSNVASVMSELAGVLGRRFPTCAVVGNSGALLGSGRGPQIDAHELVIRLNNARVAGFVADVGAKTSLSFVNSNILHLCASRSAATAAGCGCHPYGPTVPMAMYICQPAHLLDALICNATATHASPFPLLVTDARLDALSARIAKYYSIRRFVSDTGAPASNWTRKHDERYFHYSSGMQAVVMALGVCEELSLFGFGKPAGAKHHYHTNQKKELDLHDYQAEYDFYGDLQARPEMVPFLDEAQGFTVPPVSLYW

SEQ ID NO: 135305 - protein, 247 aa, Triticum aestivum
  unsure (1)..(247): unsure at all Xaa locations
  Clone ID: PAT_TA_29723.pep
QHPKGGPFHLFLGLGGGKQIFVKTLXRGKTCPXKVKSCPTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 135306 - protein, 68 aa, Triticum aestivum
  Clone ID: PAT_TA_29724.pep
KHVFRVIFFFRKGYGLSLCIITMHTTSKFRVVSYRWRNGPYMWRTGFVGSHSMHDLSLILLNHVSMIS

SEQ ID NO: 135307 - protein, 209 aa, Triticum aestivum
  Clone ID: PAT_TA_29725.pep
MAANAGAGAGGSKIRNAKLVLLGDVGTGKSSLVLRFVKGQFVEFQESTIGAAFFSQTLAVSDETVKFEIWDTAGQERYHSLAPMYYRGAAAAIIVYDITNAASFTRAKKWVQELQAQGNPNTVMALAGNKADMLEARQVPVEEATTYAQENGLFFIETSAKTAINVNDVFYELAKRLLAGQQTQNPQAGMVLSQRPAERMVSSTSCCSS

SEQ ID NO: 135308 - protein, 306 aa, Triticum aestivum
  unsure (1)..(306): unsure at all Xaa locations
  Clone ID: PAT_TA_29726.pep
ATKQSIHRPRHATQQHHTTHPRRKSQTLSPLSIRPPALRLRTFSPDWTPCPPLQPARPGIPPAGEPSRDRSAPGRPRPQVAPARSEIGANNVARAGDGRIGNASLVVPGGVGPGTSSLDALVHXVRQFAQFPESTLGGAFFXGSNWGVNDQDGQVTKYGGRPPAKEEGHHSLVVPXSTAGAAALFYACEKNNSNTFKRKKKWVQELQAQGNPNTVMALAGNKADILAARQVPVEEATTYAQENGLFFIETSAKTAINVNAVFDDRGRRLLAGQQAQNEKAGMVLAQRLVVRMVSRLACWSRQDAWP

SEQ ID NO: 135309 - protein, 65 aa, Triticum aestivum
  Clone ID: PAT_TA_29727.pep
SALMYPPSKCSTSQEQLSYCKTTVSCFIFSDSPTNPLVGPPAQSKRKKNHFIISEQLQWEKDKQQ

SEQ ID NO: 135310 - protein, 86 aa, Triticum aestivum
  Clone ID: PAT_TA_29728.pep
RGSTRQPDSFEKIIYSFKRLAASTNSLDRKSLPVFPCVHPSIYNAAVAVPRLSFRWEEHLPIPRRAGGPPAPGFCSSDGSSSSCTP

SEQ ID NO: 135311 - protein, 227 aa, Triticum aestivum
  Clone ID: PAT_TA_29729.pep
AQIMTLFNKQGRTLDRRVFGGLELPPAALQTLGPASILLFVPIYDRLLVPALGRATGKPSGLTLLQRVGAGMAVSMGAVIAAALVEGRRLETAREHGLVDDAGATVPMSWAWLVPQYAMMGVADVLTVVGLQEFFYDQMPRELRSLGLALYFSVMGIGGFISSALISFIDRVTRSGGGDGWFADNLNRAHLDYFYWLLAGLSAAELVLFVWLASSYTYNNNHKRLQH

SEQ ID NO: 135312 - protein, 80 aa, Triticum aestivum
  Clone ID: PAT_TA_29730.pep
VFVNLQLCIAVPCHIFKLWAFSGIMFQIPLLFLTKYLQDKFKNTMVGNMIFWFFFSIVGQPMCVLLYYHDVMNRQAQTNG

SEQ ID NO: 135313 - protein, 92 aa, Triticum aestivum
  Clone ID: PAT_TA_29731.pep
AVTTQICDWYLFSYSRLLLSVSLHIHLYHLTDVHVRRSQIPLLFLTKYLQDKFKNTMVGNMIFWFFFSIVGQPMCVLLYYHDVMNRQAQTNG

SEQ ID NO: 135314 - protein, 158 aa, Triticum aestivum
  Clone ID: PAT_TA_29732.pep
TLRLSSIGDGLRSTSRTHPRHAPRCTRPSASLCRGRRSISSSSASCQALELARFFLLQLGRRLSQMHCSPSPRRTELRDSAGEGGGSWRPRIQNRSCLLNDRPSPPRGRGFWRNKTTLLRVNRTRFTWPRPIATVGFRSNGPQRFDWTRVETSDPRRT

SEQ ID NO: 135315 - protein, 329 aa, Triticum aestivum
  Clone ID: PAT_TA_29733.pep
RRYKQVPEWWFICILTVNIAVTVFACEYYIEQLQLPWWGVLLACAIAFFFTLPIGIITATTNQTPGLNIITEYIMGYLYPGRPVANMCFKVYGYISMSQALTFLQDFKLGHYMKIPPRTMFMAQVVGTLIAAFVYLGTAWWLMDSIPNICDTELLPAGSPWTCPGDHVFYDASVIWGLISPRRIFGDLGTYSAVNWFFLGGAIAPLLVWFAHKAFPGQNWILLINMPVLIGSTGQMPPATAVNYITWIFVGFLSGYVVYRYRRDWWERHNYLLSGALDAGLAFMAVLIYLCLGLENISLNWWGNDLDGCPLASCPTAKGIFVEGCPVYT

SEQ ID NO: 135316 - protein, 161 aa, Triticum aestivum
  Clone ID: PAT_TA_29734.pep
MASTKSWAHEIEASVAAPRLFRAGVMDWHTLAPKLAPQVVASAHPVEGEGGVGSVRQFNFTSAMPFSVVKERLDFLDADGCECRSTLLEGGHVGTVIETSTSCIKVEPAAGGGSVVKVESTYKLLPGVEEGEYEVAKAKESVTAIFKAAEAYLIANPDAYN

SEQ ID NO: 135317 - protein, 166 aa, Triticum aestivum
  Clone ID: PAT_TA_29735.pep
PRVRHYIKLTESEKNRKLNDLLDALDFNQVVIFVKSVSRAAELNKLLCECNFPSICIHSGMTQEERLTRYKNFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 135318 - protein, 515 aa, Triticum aestivum
  unsure (1)..(515): unsure at all Xaa locations
  Clone ID: PAT_TA_29736.pep
VVPNHSPAQEKSISTPPLSSPPRSRPQSSNALSLSPPTIPNPAQHALDPCACSRKALISLFAAASLLDIPRFFLYSLSEYPEPGWEKARDAEVYEEDLVDYDEEXVENAVDGAAANPSVDVGQEGLRRNPQLTGSGTSCSXRAAPVRSRTAGLEASFRSGNMNGIPQAILGMDVICQAKSGMGKTAVFVLSTLQQIDPVAGQVAALVLCHTRELAYQICNEFERFSKYLSETKVAVFYGGVHIKKHKDLLKNECPHIVVGTPGRILALARDKDLSLKNVRHFILDECDKMLDSLDMRRDVQEIFKMTPHDKQVMMFSATLSKEIRPVCKKFMQDPMEIYVDDEAKLTLHGLVQHYIKLSEAEKNRKLNDLLDALDFNQIVIFVKSVGRASELNRLLCECNFPAICIHSGMTQEERLTRYKNFKEGHKRILVATDLVGRGIDIERVNIVINYDMPDSADTYLHRVGRAGRFGTKGLAITFVASASDSDVLNQVQERFEVDIKELPEQIDTSTYMPS

SEQ ID NO: 135319 - protein, 154 aa, Triticum aestivum
  Clone ID: PAT_TA_29737.pep
FQETSTNALLCMQYQVLNLLTFDTKQAQIQCSICCPQVLTFDTKSKGMYGLQNTFCRSAHRITKRWGVAHLQLRCGEPKVGRSSGGGAPTADEPCGRGRVVVSSDELQWLYWSSGGGASAADGRVVGGGATDGRLGLVAAQGDSLHGQGLRARR

SEQ ID NO: 135320 - protein, 304 aa, Triticum aestivum
  unsure (1)..(304): unsure at all Xaa locations
  Clone ID: PAT_TA_29738.pep
MFRAVKHAVVWAKKSRAEPAALSAFASHFSAASTSQRLAGKVAVITGGASGLGKATAAEFVRNGAKVVLADVQEDLGHAVAAELGHDSACYTRCDVTDEAQVAAAVDLAVARHGRLDLMFNNAGISGALTPVPLGSLDLADFDRVMAVNARAVLAGVKHAARVMVPNRRGSIICTASTAXVLGGVALHPYSVSKAAVLGLVRAAAGEMARSGVRVNAVSPNYIPTPLVMRILEQWYPKASAEEHRRIVEGDINEMEGAVLEPDDIARAALYLASDEAKYVNGHNLVVDGGFTVGKAPNMPAPAL

SEQ ID NO: 135321 - protein, 338 aa, Triticum aestivum
  Clone ID: PAT_TA_29739.pep
KIRTDNPSGAGRNQGTPGLVSKEDGVRAPRTPGLGVAARVGSRGESRRAALASVAGYVSHRGYSTASSSQRLAGKVAVITGGASGIGKATAAEFVRNGADVVLADVQDDLGRALAADLGPDAACYTRCDVTDEAQVAAAVDLAVARHGKLDIMLNNAGIVGSLARPRLSDLDLADFDAVMAINARGVIAGVKHAARVMAPRRSGSIICMASVAGVLGSVTPHPYSVSKAAVVGIVRAVAGEMARSGVRVNAVSPNYIPTPLVMRILEEWYPKASAEEHRRIVEGDINEMEGAVLEPDDIARAALYLASDEAKYVNGHNLVVDGGFTVGKPPNMPAPAL

SEQ ID NO: 135322 - protein, 127 aa, Triticum aestivum
  unsure (1)..(127): unsure at all Xaa locations
  Clone ID: PAT_TA_29740.pep
YWDHVIGYWRAHLANXERVLFFRYEEMSRDPAAHVRRLXQFVGRPFSAEQEEDGAVDAVVKLCSFEHMTGLEVTKSGKTELVLGAVENSSFFRRGLVGDWENYLSPETARRIDAITEAKFRGFGLSV

SEQ ID NO: 135323 - protein, 340 aa, Triticum aestivum
  Clone ID: PAT_TA_29741.pep
MSSSSSTPAFPPQEGDAETNEELYGQFTELVSSWPCSRGLSSYQLYRHEKGWHSTLPPMVGAMVADARFAARPSDIVVATLPKSGTTWIKALLYSTVHRREHPPDASGHPFNTHGPHECINFLEYQLYTQNRVPDLDELPDPRLFATHVPFVSLPRSVVASACKIVYVCRDPKDTLISHWNFANKFRVRDGLEPLSVETAADYFCHGVSAFGPYWDHVLGYWRAHSANPELVLFFRYEEMNRDPAAHVRRLAEFVGCPFSVEEEEDGAVDAIVKLCSFEHMTGLEATKGGKTELTFGVVENSSFFRRGQVGDWENHLSPETARKIDAITEAKFRGSGLSV

SEQ ID NO: 135324 - protein, 447 aa, Triticum aestivum
  unsure (1)..(447): unsure at all Xaa locations
  Clone ID: PAT_TA_29742.pep
MAGGHVALFPLPFQGHLSPALQLADALHGRGLAITVLHTTFNALDPAAHPEFGFVAVADGGMPDAKDGIGKILAMNDAMEESGCVRDALAALEPRPSCLVIDTSLPAAQKAATELGMPTVVLHTGSAAAIRLFRSYAMLHDKGYLPAQEHELDKPVKELAPIRVSDLFDPSKYPNPEMANRLLDTATEVTDNSSGVVINTFEALETPELEAIRSELAASGVGVFAIGPLHKLSTIGGAGSSLLEADRSCIEWLDAQPXGSVLYVXFGXVAPVXRENFXXVAWGLANSGXPFLWVVRRGLVIGSGSGDTELPEGFERAAEGRGKVVRWAPQQEVLAHRAVGGFWTHSGWNSTLEGICEGVPMLCRPLFGDQLANGRYVEEVWRTGALLVGKLERGKVEVAIARFMDGEHGAAMRERAKELHIKAMEALSSAGSIQLAVDKLIDHILSL

SEQ ID NO: 135325 - protein, 139 aa, Triticum aestivum
  Clone ID: PAT_TA_29743.pep
MAMAASWWALLAAAAVVAAAAGCGEAAPTAAAEAAHDVLQTHGLPRGLLPAGIAAFSHDPATGRFEAVLESPCTSRTEVGLRYNVTVAGQITYGRIAELSGVDAQDLFLWFAVRSIRVDVPSSGVIYFDVGVAYKHFPL

SEQ ID NO: 135326 - protein, 422 aa, Triticum aestivum
  Clone ID: PAT_TA_29744.pep
EEETPAETKSTQKEETAVTKPDGADKTEEAKAKMTCDENAVDEGFPYARPSVCELTGDVRVSPKEKTMFFVNPSGAGPFDDNGEKKIRPYARKDTFLLPGVVEVTIKSVASPVSAPACTRRHDVPAVVFSTAGYTDNFFHDNTDVMIPLFLSTSHFAGEVQFLITNYKPWWVAKFAPLLKKLSNYEVINFDKEADVHCFPGGQLGLYRDRDLIIGPHPTRNPRNLTMVDYNRFLRRAFGLPRDAPAVLGDKTAVRPKMLMIERKGTRKLLNLRAVQALCEELGFEVTVAEAGADVRAFAATVNAADVLLAVHGAGLTNQIFLPTGAVLVQIVPWGKMDWMATNFYGQPARDMQLRYVEYYVSEEETTLKDKYSRDHYVFKNPMQIHAQGWPALAEIVMKQDVMVNVTRFKPFLLKALDQLQD

SEQ ID NO: 135327 - protein, 127 aa, Triticum aestivum
  Clone ID: PAT_TA_29745.pep
DHRASRQDERDRIEALKGGLVLNCRGVWRVQGSLAVTRGIGDAHLKPWVVAEPETRTVDVGADCELLILASDGLWDKVGSQEAVDAAAASSGDLPAACRRLVDMAVSRGSSDDISVLVVQLQRRPLR

SEQ ID NO: 135328 - protein, 264 aa, Triticum aestivum
  unsure (1)..(264): unsure at all Xaa locations
  Clone ID: PAT_TA_29746.pep
DAAGEQGDGFAAFCRRGKGRKRVEMEDRHVAAVALGGDRAQALFAVFDGHGGKSAAEFPADDMAGTVADELQRSARRRRAGRAAVEGAVQQAYLRTDEEFSSPSSKCREQAGGGTRRVNALLRXGWRQLLVAGGGDCRALLSRGGSAEAHNHDHRGTRKDERNRIEALKGGLVLNCRGVWRVQGSLAVTRGIGDXHLKPWVVAEPETRTSTWAPTASCYPRLRRLWDKWATKKRPSRRRSSNFPPLPRSCSRALQITLSQKSPK

SEQ ID NO: 135329 - protein, 254 aa, Triticum aestivum
  Clone ID: PAT_TA_29747.pep
GDRPRAWVDWLSWAEYCYNTSFHSAFRDTPFEVVYGRPPPPILPVDAASARTEAAGALLRNRDEMLVEVQQRLLQAQQLAKRYYDGHHREAKLAVGDWVWLRLLHRSTQSLEPSARKKLGPHYAGPFAILERIGKVAYRLQLPAGARIHDVFHVGLLKPFRGDPPAAPPALPPASDGRLLPAPEKALKAQLRRGAWYVLIRWAGLPEEDATWEQREEFHQHYPDFQLEDELFAQAGRDVMTGQVYGRRGPTGQA

SEQ ID NO: 135330 - protein, 235 aa, Triticum aestivum
  Clone ID: PAT_TA_29748.pep
FVGRESQQDLFNLLGATYAAVFFLGASNCITVQPVVAIERTVFYRERAAGMYSPLSYALAQTGVEIIYNILQGCLYTIIIYSMIGYEWKADKFFYFLFFIIASFNYFSLFGMMLVALTPSALLANIIISFVLPLWNLFAGFLIVRPAIPIWWRWYYWANPVSWTIYGVVASQFGENNNSLSIPGGSPIVVKKFLEDNLGINHDFLGYVVLAHFSYAIGFYFIFAYSIKVLNFQKR

SEQ ID NO: 135331 - protein, 334 aa, Triticum aestivum
  Clone ID: PAT_TA_29749.pep
MAKQGVASMLAVALVLVALAAFPAVHSIGVCNGVIGNNLPAPSDVVKLYQTKGIDAMRIYEPESNVLKALSGTGISLLMDVGNGALTSLANDPSAAPAWVKANVQPFPGVSFRYIAVGNEVMDSAGQKTILPAMKNVQAALAAAGLGGSIKVSTSVRFDVVTDTFPPSNGVFADTSFMGPILDFLASTGAPLLANVYPYFAYKGDQQNIKLDFATFVPGSTTVTDNGLTYTNLFDAMVDSIYAALEKAGKPGVKVVISESGWPSAGGFGATAQNARAYNQGLINHVGRGTPKQPSLLETYIFAMFNENQKDGEKREKNFGLFNPDNSPAYSITF

SEQ ID NO: 135332 - protein, 366 aa, Triticum aestivum
  unsure (1)..(366): unsure at all Xaa locations
  Clone ID: PAT_TA_29750.pep
YRTRPPQDTQKISEDEGGGRCRGWRGHWSLCSLPSCHLHAPHSIGLRGRAPGYRRPPPRDGRQPYRSNSTNAMRTDQGERSPLKALRRPGTSRPSVGGTALPTPRLRLPPLATASAKANGPAFPRRPVLSFPLXSPGQSTEPSDKDRPDRPPRTYKEPIAAAGVGGXVKVSTSVRXSAWLTDTFPPSDGVFMDPSLMGPIVEFLASTGAPLLAYFYPYSATSENQPTLRLTFSTSLPSSKTVHEKRIRYRNLLDSMVDSISASMQSWGKPGVKVVRSESGXPSDGGIGATAQNARAYSQGLMDHVGHGTPKRPGPLETYIFAMFNENLKEGEKSEKHFGLFNPDRSPAYSRYFLKRAKRVHILRYE

SEQ ID NO: 135333 - protein, 206 aa, Triticum aestivum
  Clone ID: PAT_TA_29751.pep
YGQGVDGDDPVVLDMTSMCKGMIYVNGEGMGRYWTSFITPGKVASQAVYHIPRTFLKSKNNLLVVFEEELGKPEGILIQTVRRDDICVFISEHNPAQIKPWDEHGGQIKLIAEDHNTRGFLNCPPKKTIQEVVFASFGNPVGSCGNFTVGTCHVPNAKDIVAKECLGKKGCVLPVLHTFYGADINCPTTTATLAVQVRCHKKGDPE

SEQ ID NO: 135334 - protein, 467 aa, Triticum aestivum
  unsure (1)..(467): unsure at all Xaa locations
  Clone ID: PAT_TA_29752.pep
PRVXXLXGKSEGTSKRRKTRKKDGRANSTEIGSASDKESSGTGGSNEMLYALPDGLDGCQIGKLRVHKKEIGKGSNGTVVFEGSYEGREVAVKRLLRSHTDIAPKEIENLIASDRDPNIVRLYGCDQDDNFVYISLERCCCSLADLIQQHTDPSFSDVEKIDVELWTQDGLPSPQLLKLMRDVVAGIVHLHSLGIIHRDLKPQNVLISKEGSLSAKLSDMGISKRLQEDMTSLSHHGTGYGSSGWQAPEQLCRASQTRAMDLFSLGCLIFYCITKGKHPFGEYYERDINIINGHFDLFVVDHIPEAVHLISLLLQPKPDERPTAVYAINHPLFWSPELRLLFLRDTSDRIEKTTETDLLNALESIGHQAFGGKWREKLDDGLVADVGRYRKYNFESTRDLLRLIRNKSGHYRELPADLKELLGSLPEGFDRYFSSRFPKLLIEVYKVMSVYCKDEEDFRKYFIGISV

SEQ ID NO: 135335 - protein, 248 aa, Triticum aestivum
  Clone ID: PAT_TA_29753.pep
MSFGVYVTGILFQTASFVSFMLISHGYCIMYERLSIRERRTTAGLGCLLYLSLIGYKAAVPYFTGFLLMNYFASFYIIFRRTSQCLLVLREQLNFVEEEDIHSLHGTLNTKYTMFKRFQGTMQVAAVAFIMVYMRADDTPDNYWFRVLVREWVQFCIFMYIGWNFRIPEASLHLPVMPLMKSNWEITMPPIYSVEMDAADFRGLVSDQWHVGVRTSHADACYSSQPLLVLVQNPSPKVSRAAVASGFS

SEQ ID NO: 135336 - protein, 141 aa, Triticum aestivum
  Clone ID: PAT_TA_29754.pep
MAPAGGRTTHLLLLALLLSFVLASSADGSYPEHPSPGAGGFFSGIPWFRGGQPSGARGAGGMGAGFGGGWGAGGVGPGGGFARRGVVQPSVVCSEQGPCYQQRLTCPSKCFSSYSYHGKNGGGGGGGGGCSFDCTSCEAHC

SEQ ID NO: 135337 - protein, 322 aa, Triticum aestivum
  Clone ID: PAT_TA_29755.pep
MAGHEEHNNSEANLVLATTNGKQEPSKRDTSGFLNPKSLEIYLLHLFHENILRKVREKYRNIVRYQSPAQSAESASEDCGLLSHFCMTVAHKTYSKKVQLELESVVSRVPYLQLRSLPTWHSRTSSWSLCLRVPQPILAADRPTKPSDNGEPKYKSSRTQFNTKIVLKDGQISLLGEGSPSIAGSLTRKPSDGYLIESWRSAQEDLPTMVLQQVASQIINWLHEVALGVGMSVTRHFLCLYFDLEHGDMLGLVAHVDPDDEYGCISWDQTVDQPAEAPGKAPAADDPWAEKRRFLGYLSLEVLYSTLLDLINLCGTGARPLR

SEQ ID NO: 135338 - protein, 221 aa, Triticum aestivum
  Clone ID: PAT_TA_29756.pep
MEPEPDRGVSLLSPAPSPSHQPSLRAAKSTAFKREERRKHKEQKRERKRQENLALALAQWEPLGAPPRPAATPTPGEPLDDKPWPCDPPSPADAAPSAAWGWGPPAEPSADRGWGLPAEPPAQPPVAARCPQADAVRACRALFEEHADNDDDGDEEGEEEEGDVARFFDELLEKDADLRGFYQVERETGWFLCLVCEGVGARAGKRFPGCAALVQHAGSVA

SEQ ID NO: 135339 - protein, 268 aa, Triticum aestivum
  unsure (1)..(268): unsure at all Xaa locations
  Clone ID: PAT_TA_29757.pep
MASPSPMLPSSPSAHRQPSSPHPGQLHLHPRLHSHNPSSRLALLRSLPLRLRLAIPRPRLPTLPLALPSSTGGNNNDDDNNGGGGGNDETGDGGGEWGVYRGRRCSCWRRREEDLXSLPAYLATAVEGCHITGDIVRRFAEMELSPLLRWLLGFRGSRERLLTDDLFIAKLAMEMGVSMIAKTAAEYEKRRENFVKEIDIVIADVGGVVMAIVADFMLVYLPPPTVSLQPPLARNAGLITSFFHNCPDNAFQIALAQGMDLSLKVRAL

SEQ ID NO: 135340 - protein, 196 aa, Triticum aestivum
  Clone ID: PAT_TA_29758.pep
IKSLNPLHKFAVFMFPFAQPAAEPPLFVVLVPGLRRLHLLAARVCAGRCRPSCVRAAHRQPPHDRSGRTAYGGNLDVALCSCCRASLELSHCLLALFGIVGVAQRTHADGVGRDGIIVLHGGLLVPCTALLSPPVADFRPQRGCRTLRGCRWPRTPRAPRGTSPCPTSADATPCPPPCTGPPPWPPSRRGTPCMIA

SEQ ID NO: 135341 - protein, 472 aa, Triticum aestivum
  Clone ID: PAT_TA_29759.pep
IVCLFHENKPKLIAVSNMVTFANPKAPVYPRLAQGKSWDEMTITWTSGYDIKEAVPFVEWGAKGGSQFLSPAGTLTFNRNSMCGAPARTVGWRHPGYIHTSFLKDLWPDSKYTYRLGHRLPNGTHIWSKLYNFKASPYPGQDSLQQIVIFGDMGKAEADGSNEFNDFQPGSLNTTNQIIKDLENVDMVLHIGDICYANGYLSQWDQFTSQIESIASTVPYMIGSGNHERDWPGTGSFYGNLDSGGECGVPAQTVFYTPAENRAKFWYATDYGMFRFCIANTEEDWRPGTEQYKFIEQCLSSVDRQKQPWLIFLAHRVLGYSSCTYYETEGTFEEPMGREALQELWQKYKVDLAFYGHVHNYERTCPVYQSQCVVDASDHYNGPFKATTHVVVGGTGASIADSAFTTSNIQWSHFRDFDFGFVKLTAFNHSSLLFEYKKSRDGNVYDHFTISRDYRDVLACSIDNCPRTTLAS

SEQ ID NO: 135342 - protein, 108 aa, Triticum aestivum
  Clone ID: PAT_TA_29760.pep
SLCWMHAQHLLRTPLHLLPASLDRHRIRLDSALIFPQSSSLAAPPMEIPLPKGSRCATDSAWGVADAPPPMGTRSAGSSAGFTNAIAPSFLSPSPPDHLAIAGAPGFF

SEQ ID NO: 135343 - protein, 91 aa, Triticum aestivum
  Clone ID: PAT_TA_29761.pep
MIILLFHSDGQCTEESASACGHQGVCCVRSNTSPSTRITLERFTRSFTVTKYGVNMCASYPCRRHDQELVPDTIKVAGSKCHGTCSSTCSR

SEQ ID NO: 135344 - protein, 272 aa, Triticum aestivum
  Clone ID: PAT_TA_29762.pep
SSASPTSFLPRSTALRPLLSLPFRPDLSRPRPLGPPARSLSKKAAMTAVAAKARVDGRGSAMEAREAQSGEIHVIVGPMFAGKTTALLRRVQAEAGTGRTVALIKSDKDNRYGLDSVVTHDGTKMACWALPELSTFQDKLGREAYDKVDVIGIDEAQFFDDLHDFCSKAADHDGKIIVVAGLDGDYKRNKFGSVLDIIPLANSVTKLTARCELCDRRASFTLRKTQETRTELIGGADVYMPVCRQHYLDGQIVIEATRIVMDIERSTEVARC

SEQ ID NO: 135345 - protein, 342 aa, Triticum aestivum
  unsure (1)..(342): unsure at all Xaa locations
  Clone ID: PAT_TA_29763.pep
MGSLPAAGERPHAVMMPYPAQGHVTPMLKLAKLLHTRGFHITFVNNEFNHLRLLGAQQSQAAVDRLCSLPGFRFATIADGLPPSDLEASRDTPALIYSTMTTCRPRFKELVVKLNEEAEASGGAVPPVTCVVADSITSFAISVARELGLRCAVLWTASACGFMGYYHYKDLLDRGLVPLKEEAQLSNGYLDTIIDWIPAMPKDLRLXRDLPSYLRTTDPDDIMFNFFIHEVPAMSQASAVVINTWDELDAPLLDAMSKLLPPIYTAGPLHLTARNNVPEESPVSRVGSHLWKEQDAPLRWLDGRPPRSVVHVNFGSTTVMSKEHMLEFAWGLANTGYAFLWN

SEQ ID NO: 135346 - protein, 195 aa, Triticum aestivum
  unsure (1)..(195): unsure at all Xaa locations
  Clone ID: PAT_TA_29764.pep
PPPWPSSPAQPPSAAPSPSSPPPGAGTIYPRPXRPPPIRIRFLPTQSSPPSASPPPPRSSSRLPHRPSRAHRPRLRPPRSPSRSHPRTPSRTTPTPSRSSSSRPPPSPVSAARRPRGPASLPPEAASNMPGSSRRSRSSWTARPTRRSPPSRSSRGRTPATTAPCSASTSCTLFWAGRRSRSRCSSAARRSPATN

SEQ ID NO: 135347 - protein, 265 aa, Triticum aestivum
  unsure (1)..(265): unsure at all Xaa locations
  Clone ID: PAT_TA_29765.pep
MSAPAAVRVIGAFDSPFSHRAEVALRLKGVPYELILEELHNKSELLLTSNPVHKKVPVLLHGDRAVCESLIIVEYVDETFDGPRLLPSDPYDRAMARFWARFIDDKVRTCPDXTSISSSDLVSAVLYLLVVMHGLILAEGEQCSKPFWLAMWTDGEAQKGFMKEIKENFALLVPQLEGKRCFGGDTIGLVDIAACGFAHWLTVCEEVSGVTLVTAKEFPRLCRWAKEYASDEKVRACLPDRAQMLAHFTANKEMFMAMAKSMLPK

SEQ ID NO: 135348 - protein, 119 aa, Triticum aestivum
  Clone ID: PAT_TA_29766.pep
TRHGYTRDRPPTTACARAIEKSMPPACAQKRSSWPVVTLLSTLLMTKAQSCGSFDGLLVYAGAATSPSMVAPKGNSWPVTLLSTRMAWSSGSSGSLSAVTRCSKRGLKVKEITVWMPSA

SEQ ID NO: 135349 - protein, 218 aa, Triticum aestivum
  Clone ID: PAT_TA_29767.pep
IPKIESAWLLGLVAARKLEFPGCKSTADGQATAPTMCDTVVITVAADNSLIGKSRADPWPGTRKVLQAATPPADGIGSVMFTYRFMEDQPTVFTDVQGSEAEPCAGGSACTSTNTVDSAVSAPCTDEGRTADDWVRTTDREVLLYDGDCRGRAADMCQEARLMAGTSVIYVNDEGPVERLLQWVAGICGGSGHACAEAQMMANNPYIYQNGLVHLLLR

SEQ ID NO: 135350 - protein, 317 aa, Triticum aestivum
  Clone ID: PAT_TA_29768.pep
SRLGKRTSCFSGGRSAGATMIPITISRVNQFDAARLDVEMSAMLKEQLVKVFSLMKPGLLFQYEPELDAFLEFLIWRFSIWVDKPTPGNALMNLRYRDERAAPIAGKEVRTGLEGPGLSVSQKILYCISTVGGQYLLSRLQSFSAFRRWGDSEQRPLARRAWGLVQHAEGLYRAVSFFNLLSFLYGGRYKTLVERILKARLVYGSPNMNRAVSFEYMNRQLVWNEFSEMLLLLLPLLNSSSVKKFLLPFSKDKSASSSGDEANCPICVSSPSIPFVALPCQHRYCYYCLRTRSAATSSYRCERCNEVVVAIQRHGSS

SEQ ID NO: 135351 - protein, 86 aa, Triticum aestivum
  unsure (1)..(86): unsure at all Xaa locations
  Clone ID: PAT_TA_29769.pep
SSHKILLKLELTNIKVNISWLPPRYGKSFTKVTRRKKIGATNQQKVTILKSGMWWVQCPHRISTYLQKHCPHLGVLLSQSNLLYRX

SEQ ID NO: 135352 - protein, 158 aa, Triticum aestivum
  Clone ID: PAT_TA_29770.pep
RKNHTKWLEETRWPDRLIQQTYNQAAATTRSKKRKRRYNPISTRNNTRELQEQNPPYLSERRRTRKPRSVNGGTPCEDDDDGLSSPSYGMRKKRKSSRCIAIVSPLRMMLLQRYLYPKHLHLHLHALSKYLLCFETTPHHLGLYLERRQGSSALNLDT

SEQ ID NO: 135353 - protein, 278 aa, Triticum aestivum
  Clone ID: PAT_TA_29771.pep
MIICMMIKHYRSTQLFPSSAVYIDLLNRERYRDPVLGRTKPEVTYQHKQRLEADEKRLRDLVDGLVESISSDSKNYRYVIMSIKENANMIMEEGFISSYARDEILEGLERIEKDIEVGKFHWRNNKDIRSNIVEALIDIVEGPAKRLDAVISRYAQILTVLQIWCHDSIDKFVAQIKELQVELVLLAIRNEGLVLPCTARSADCILLGDLVLSKVEQLENDVSQLVSCKNKIGSTLQTLPSGRTDDSMNSLSKGSLHHICNSILKFGNRSLVTSAHVQ

SEQ ID NO: 135354 - protein, 540 aa, Triticum aestivum
  unsure (1)..(540): unsure at all Xaa locations
  Clone ID: PAT_TA_29772.pep
MDPRCSQQWESSMEDVSTPLLPLHDDGRTDGRSCSALASLLANKYLAIAAGPLASALICAFVDFGHGRAAARNMLGVLAWVFIWWLTDAVPLGVASMAPLFLFPAFGISSSDAVAKAYMDDVISLVLGSFILALAIEHYNIHRRLALNITSLFCGDPVRPPLLLLGICGTTMFISMWIHNTPCTVMMMPVATGILQRFPRGRPASSSADAHEVRRFSRXVVLGVMYASTIGGMSTLTGTGANIILVGMWSTYFPEQRPITFSSWMSFGFPVALVLFAALWVTLCLMYCSSNTGRALSAYLDRTHLRRELSLLGPMAFAEKMVLAVFGGLIVLWMTRSLTNDIPGWGVLFHGKVGDGTVTIMMTTLLFIIPNGKGGGEKLMDWGKCRKLQWNIILLLGAGFAIAEGFKASGLTDILSEGLGFLRGAPPLVIAPVACVFSAVITEFTSDDAATTLVLPLLAELGNTIGVHPLLLMVPGTVGAQLSYLLPTASPPNVVGFGTGYITIKDMVLTGIPIKVVGVATLAVLLPTLGSVVFGMDQKL

SEQ ID NO: 135355 - protein, 135 aa, Triticum aestivum
  Clone ID: PAT_TA_29773.pep
ARRRGMAIRWSANPLYKLQKIKSLLMEEREKNSRKTEGLEDMGAVKPKDLLIAASPTSTRATSRWNCPSRILPSHHHFMCLSSGLAPHLEAQHAWVCAIILRLEIISQLRDPPSSRDNLASRRQSFFGIQLDCTI

SEQ ID NO: 135356 - protein, 131 aa, Triticum aestivum
  Clone ID: PAT_TA_29774.pep
MAGKASIALFLAVNLVVFSVASACGGNCPTPSTPTPSTPTPLLGSLGRCPRDALKVGACVNALNLVKVQVGRPTALPCCPLLDGLVDLEAALCLCTVINANVLNIVKLNLPINLSLILNHCGKKAPTGFMC

SEQ ID NO: 135357 - protein, 144 aa, Triticum aestivum
  Clone ID: PAT_TA_29775.pep
SFDLCLVITRQPMAGKDIHRAVSRREPGRVLRGQRVRGKAARPRPPPTPSTPPPTPASLRRCPRDARQGGRVFKRAEPGHGAGGSGRPRGRAAQLLGWAAVDLAPALCLCTDDQGPNVLNPTFPATTSPYSTSATRLQPTRSMR

SEQ ID NO: 135358 - protein, 138 aa, Triticum aestivum
  Clone ID: PAT_TA_29776.pep
PEVAPLLPRDPYARAQARFWADYIDNKIVDCQTRLLTMKGEAQEQAKKDMIGALKTLESELGDKDYFGDETFGFVDIAFMTLTPWFNTYEKYGDFSVEEHCPKIVAWAARCRGRDSVAKALTDPEKVYEIVQEEYGTN

SEQ ID NO: 135359 - protein, 78 aa, Triticum aestivum
  Clone ID: PAT_TA_29777.pep
WNVVTGQPWNRNENGVDSFRFSVEKMEMERNQRFILLDRAIEQNQHLNHVCRVRVSPSSTARPHTVARHATHRKPSLR

SEQ ID NO: 135360 - protein, 361 aa, Triticum aestivum
  Clone ID: PAT_TA_29778.pep
YSAKVSSSNVSAATSANPSEVSRIFTMGLPYTAHHAGQILFGPTDGYLYFMMGDGGNKGDPFNFSQNKKSLLGKIMRPDVDNVQSQKQIGNQTLWGNYSIPKDNPFAQDSDLQPEIWALGFRNPWRCSFDSERPSYFYCADVGQDAYEEVDLISKGGNYGWRAYEGPYVYHPEWTPGGNTSLSSINAIFPAMGYNHSTVNKNVGSASITGGYVYRGSTDPCLYGRYIYADLYASAMWTGLETPPSSGNYTSTLTPFSCSKNSPIPCESAGGAGAGAALPSLGYIFSFGEDNRKDVFVLASKGVYRVVRPSLCGYTCAAEKPATDNGTSPPPSGPPSSLASATRVGTPMAVALASVVYALYF

SEQ ID NO: 135361 - protein, 160 aa, Triticum aestivum
  unsure (1)..(160): unsure at all Xaa locations
  Clone ID: PAT_TA_29779.pep
VTXGFQAPPSPKRPPTRPFFPLPPLPFLPSGGPGGRQEDGVGGRALLVHIRSRFSSCLRLYASLWLHAGHRLYVGREMPGLGARIWYCFVSLLLVAALPWTEPEVMRRRAPETSNNKKVVVVELGFWVPLRDLVVAVAEDGEGWSNMSWRSPHDSHDLPP

SEQ ID NO: 135362 - protein, 206 aa, Triticum aestivum
  Clone ID: PAT_TA_29780.pep
LNVSTAGSMLYGAAWPLSGQTKITLTPAPGSPVGPVINAAELMMVVPLGGRTHPRDVIGMEGLARGFANPPSDWSGDPCLPVGNSWTGVSCSQGALARVTALNLTNFSVEGSISDRIANLTAISSVWLVGNNLTGQIPVMSSLHHLASLHLEDNQLAGPIPPSLGDLPRLQELFVQNNNLQGSIPIGLNRTSITFKYTPGNNLNQQ

SEQ ID NO: 135363 - protein, 534 aa, Triticum aestivum
  unsure (1)..(534): unsure at all Xaa locations
  Clone ID: PAT_TA_29781.pep
ETETVQGTDDTGPHHCVRGLSEDGXRRVDAVLLTDSNALLCGILTDKDITTRVIARELKLEDTPVSKVMTRNPLFVLGDTLAVEALQKMVQGKFRHLPVVDNGEVIALLDIAKCLYDAIARMERAAEKGRAIAAAVEGVEKHWGTSVAGPNTFVETLRERMFRPSLSTIISENSKVATVAPTDTVLTASKKMLELKVSSAVVAIENKPGGILTSRDILMRVIAQNLPPESTTVGKVMTQSPECATIDTPILEALHTMHDGKFLHLPVLDRDGSVVTVVDVLHITHAAIATVGNSGATGSEATSSMMQRFWDSAMSSGPLDDDDDSRSEGSTKVASEAADIGRSAFFPPSGLSNTFGFKIQDKQGRMHRFNCETSSLAELITSILQRLGDDIDKLNLPQILYEDDDHDKVILSSDTDLIAAVDHARQIGWKSLRLHLDYAGVGRRKRGAVSSDFEYAGRDAWASAYGTVAAGAALVARPRRDGLPEKSGLGATNTVVLVIHTGCYYIEMNRIGPRKRKFTRVGVRLILARKNGNL

SEQ ID NO: 135364 - protein, 357 aa, Triticum aestivum
  unsure (1)..(357): unsure at all Xaa locations
  Clone ID: PAT_TA_29782.pep
MAAESQTESGNCSAWAAKDPSGVLSPHSFNRRTVRHDDVSLRITHCGVCYADVIWTKNRHNDSVYPLVPGHEIAGVVTEVGSDVKGFKLGDHVAVGTYVNSCRDCDNCNSFLENHCSKFVFTFNGVDTDGTVTKGGYSSHIVVHERYCYKIPDGYPLEKAAPLVCAGITVYTPMMRHNMNQPGKSLGVIGLGGLGHMAVKFGKAFGLKVTVLSTSESKRDEAINLLGADNFVVSSDKSQMESLKNSLDFIVDTASGDHPFDPYXLALLKVRGTMALVGFPGEIRVHPATLNLGARTLSGSVTGGTKDTQEMINFCTANKIYPDIELIKIDYINEALERLVNRDVRYRFVIDIESSFK

SEQ ID NO: 135365 - protein, 220 aa, Triticum aestivum
  Clone ID: PAT_TA_29783.pep
MPPQPEPCSSSSSLGNDSDEGGAPTGKEDGEGEVQSAYSGAGLDGLAALEESLPIRRGISKFYNGKSRSFTFLKEAIGPSGSAKVIAKADNAYSRKRKNLLAYSIMYNQSQITVPETYENGITKRLAGLSRLRPSDGMSSNSSSSSSLSSDENEPPQQFIFVQSPDNTAQFASPAITTPRLGSCMSKILPVPMRSFSMVNLQRLHSRCSSVCLEKEPEVD

SEQ ID NO: 135366 - protein, 159 aa, Triticum aestivum
  unsure (1)..(159): unsure at all Xaa locations
  Clone ID: PAT_TA_29784.pep
AMFWGSYSSTCSQTFWKALAENKVKKFCXHLSLGRILTVDKLIQRGWQGSEICSMCSSREESVEHLLLNFYFARQFWRRIAAWSCFDLRHYDVKMASGRARFTLGGWSEPAKSLRPTSESLMGLLLTLFGRFEKIGMREFLTMLMLVSRTLSLEFRSPS

SEQ ID NO: 135367 - protein, 181 aa, Triticum aestivum
  unsure (1)..(181): unsure at all Xaa locations
  Clone ID: PAT_TA_29785.pep
MDLILPFKIGDFAEAKCFDEGFKGAWFRSKIKDMRVTESGHLEYYLEYIDYTEEANEWIGVFQKNPFNQACLEGKSNGSTEIMLRLSFPRWYRGQQAPKHFPKSEVIARVHDTWKVGDWVDWHNKDCYWTGQIIELTSKNVVEVKFLDHPMGEGQQCLAKKKDLXPALDWSIIKGWTVPLS

SEQ ID NO: 135368 - protein, 260 aa, Triticum aestivum
  Clone ID: PAT_TA_29786.pep
MNAIRSALARALSAPKPRPLLARHYASVGGTQPERVAAEMVRYALGGARHQSPSEDAMRILEQGASNLQGGGEGAAEAVSMLMLAMSTLLYRSGRREDAMEKLKATQQVAPSAAFRVAAWEALMGIRMEASQDVSSSMSPNDSVDLSIKEEEIKWSDQDHLKFRVDAIRGLAALLNGEIDSAQTLFGGPNSCYAAVGNNQTENAVFTYGEYLHCTGDFPLATQMYEKVLEAASREDIFGNLLAAGNMAPEEVSLGCTCSY

SEQ ID NO: 135369 - protein, 369 aa, Triticum aestivum
  Clone ID: PAT_TA_29787.pep
MAAWSRPSKVAADDSVEPAYRSDVRSPPGSWIDRKLLVDPKMLFVGSKIGEGAHGKVYKGKYGDQIVAIKVLNSGGTPEEKVTLEDRFIREVNMMCKVKHDNLVKFIGACKEPLMVIVSELLPGMSLKNYLNSIRPSQLDIHTALGYALNIARAMECLHANGIIHRDLKPDNLLLTANRKKLKLTDFGLAREETVTEMMTAETGTYRWMAPELYSTVTLQRGEKKHYTNKVDVYSFGIVLWELLTNKMPFEGMSNLQAAYAAAFKQVRPAFPEDTPQELASIVQSCWVEDPAVRPSFSQIIRMLDAFLLTIPPPPLSEADEDTAESEDTASSLSSKSSSVSSIVSRATSKLSVVRHLFASKKGGSNGKA

SEQ ID NO: 135370 - protein, 75 aa, Triticum aestivum
  unsure (1)..(75): unsure at all Xaa locations
  Clone ID: PAT_TA_29788.pep
GARCCLCXDPLSIQDMSFIVFYCCHAYHQSCLEGGLDSMKSNSNARDSDDGSEDDDGSPSGESRMRCVLCTTAAA

SEQ ID NO: 135371 - protein, 68 aa, Triticum aestivum
  Clone ID: PAT_TA_29789.pep
TDESALVSRFFHFLKILQLVSLISSILRFTLEMQHLVLRLMASPAAAAAAAEFTRETVRRSLIAISQC

SEQ ID NO: 135372 - protein, 162 aa, Triticum aestivum
  Clone ID: PAT_TA_29790.pep
RLVLLANLGAASVWPFPGLAPYFQPLGRRSLFASPSPPAPRSPPPLGSVPCRRRRSLFASPSSPGLLLCSSLHLVLRLMASPAAAAEFTRETVRRSLIAISQSLPETSLLNPKANPPSTTPGANTYRDDGAAKCRSKLISISYPSTPDALSTPCPQKNAATV

SEQ ID NO: 135373 - protein, 142 aa, Triticum aestivum
  unsure (1)..(142): unsure at all Xaa locations
  Clone ID: PAT_TA_29791.pep
PGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGGRFPKWXAILKIGANGPSQVSNRTKT

SEQ ID NO: 135374 - protein, 218 aa, Triticum aestivum
  Clone ID: PAT_TA_29792.pep
RSFPRSCRRRWGWLAADDRTTGDHGHSGNGGDEEGRPLAQTPVPDRWQRHIPPSRGAGPPVRATMPPAWRPGLGQPPRCRVRQVEDPTHRSASSSWIGGRVCPGAPSWGAGGVAVEGGDEAPRPGCRLLPRLLLRPIHSRPPCLQGLRVSRRRARQARRLVRGRGGRGGKRFVRLQQQGVRQDPRSNYLIPGRPLVTELAARFSGAKLSPQYLVSKIS

SEQ ID NO: 135375 - protein, 268 aa, Triticum aestivum
  unsure (1)..(268): unsure at all Xaa locations
  Clone ID: PAT_TA_29793.pep
MATNSRSNSRATFSSEIHDIGTVQNSTTPSMVYYTERSIADYFPPHLLKKVVSEVVSTFLLVFVTCGAAAISAHDVTRISQLGQSVAGGLIVVVMIYAVGHISGAHMNPAVTLAFAIFRHFPWIQVPFYWAAQFTGAICASFVLKAVLHPITVIGTTEPXGPHWXHALVIEVXVTFKHDVPSPSAVATGHQSGGLSLAGFXVRSXVCITPSSXKGVSSGXMNPGEGXWAPALGNNATRALVYSXGPXSGPQXGWTTLRRTAQGPTSPR

SEQ ID NO: 135376 - protein, 266 aa, Triticum aestivum
  unsure (1)..(266): unsure at all Xaa locations
  Clone ID: PAT_TA_29794.pep
LCFFPYKAESSIIDGCNDLLLNNASCPAAFHVVNPTGRRWAALPEPRRKTLLSVLSFDPCASPHYKVVCFTGWLPRGASVEVFDSETGAWGEHELDFGLDTXDAMSATMHCFAGAVHVLAYSGHVVRIDLATMACTVTALPAPVSYRARAGHCRGRLRYASSDGSRLTLWELVDAGKSEWVAKHELGVGDLVSGGSCHPATATFVFMAFHPEREVVYLWTPSKLIAFNMEQMRVEEECVFGSGKEDAQLIQIWLFPFSRHLASCLA

SEQ ID NO: 135377 - protein, 66 aa, Triticum aestivum
  Clone ID: PAT_TA_29795.pep
SPSTVAHFFSGSTPLAELLMDVAMMVMTNGRQRDETDWSEIFTKAGFNDYKLVKKLGARGVFEVYP

SEQ ID NO: 135378 - protein, 373 aa, Triticum aestivum
  unsure (1)..(373): unsure at all Xaa locations
  Clone ID: PAT_TA_29796.pep
MKVATMAAQAQQLTVPTEAELLQGQADLWRHSLYYMTSMAFQCAVKLGVPTTIHSLGGAASLPDLVTALSLPPAKLPYLRRIMRLLATSGVFAADNAADVVTYYRLTPLSWLLLDGVAVDGHPSQTSLVLAATSSNCLEAAMGLSDWFQKDVEASPFEDLHGVTLFDASMAEHDPTIDAVLKEGLASHDNSGFLTVLRECGAIFDGLESLTDCCGGDGTTARAIVETFPQMKCTXVLDLPRVIDNVPADGVVNYVAGDMFKSVPPAHAVLIKLVLHHXSDEDWMKILAQCKXAQPYRAEEGGKEIVIDIVVDSSSGXTHEAELLMDVAMMVMTXGRPSENETDWXEIVTKAGFSDYKLVKKLGARGVLKGLCR

SEQ ID NO: 135379 - protein, 102 aa, Triticum aestivum
  Clone ID: PAT_TA_29797.pep
MAERVTAMASQGIVVIFGASYCCMSHTMTGLFAQLGVSSTVHEVDKDPQRKDLERALAGMVGQSPAVPAVFIRGALVGGTRQVMELHLGGHLVPLLRQAGAL

SEQ ID NO: 135380 - protein, 80 aa, Triticum aestivum
  Clone ID: PAT_TA_29798.pep
MSRSGQPPDLKKYMDKKLQIKLNANRVVIGTLRGFDQFMNLVVDNTVEVNGDEKTDIGMVVLRGNSVVMIEALEPIARSQ

SEQ ID NO: 135381 - protein, 80 aa, Triticum aestivum; identical to SEQ ID NO: 135380
  Clone ID: PAT_TA_29799.pep

SEQ ID NO: 135382 - protein, 242 aa, Triticum aestivum
  Clone ID: PAT_TA_29800.pep
MAGNRACMFSVALALLGVLLASIPTTVQSIGVCYGVNGDGLPSASDVVQLYQSNGITGMRIYFPDANALQALSGSNIGLIVDVANEDLASLASDRSAATAWVQTNVQAYQGLNIKYIAAGNEVGDQGGDTGNILPAMQNLDAALSAAGLGGIKVSTSVSQGVTTGYPPSQGTFSAGYMGPIAQYLASTGAPLLANVYPYFSYVDNQAQIDINYALFTSPGTVVQDGANAYQNLFDALVDTFY

SEQ ID NO: 135383 - protein, 239 aa, Triticum aestivum
  unsure (1)..(239): unsure at all Xaa locations
  Clone ID: PAT_TA_29801.pep
MAGHRACMFSVALALLGVLLASIPAEVQSIGVCYGVNGDGLPSASEVVQLYQSNGITGMRIYFPDADALQALSGSNIGLIIDVANEDLASLASDRSAATAWVQTNVQAHQGLTIKYIAAGNEVGDQGGDTGNILPAMQNLDAALAAAGLGGIKVSTSVSQGVTTGFPPSQGTFSAGYMGPIVQYLATTGAPLLANVYPYFSYVDNQAQIDINYALFTSPGXTVVQDGGNAYQNLFDALV

SEQ ID NO: 135384 - protein, 107 aa, Triticum aestivum
  Clone ID: PAT_TA_29802.pep
TRWTSGGGTAATTETAQRWPSAGGKQVGQGTPKRPSAIEAYVFAMFNEDKKGPAEIEKHFGLFNPDKSPAYPISFKSGGAHLYSYIRSKTTNISCCSAKINYCGLCT

SEQ ID NO: 135385 - protein, 258 aa, Triticum aestivum
  Clone ID: PAT_TA_29803.pep
MRVKRRSRHRKVVKFYSTCFGFREPYKVLIDGTFVHHLLVHQLLPADDALRELLSASRAPPLLTSKCVVAELRRLGKSHSEAFDAAQLVATASCEHDKVVSAVDCILSLVGDKNPEHYFVATQDSDLRAKLREVPCVPVIYGLKNSLFIEQPSVQQRQFAQLDEEKRIHMEKSEFKKLLKASSEGKTSVCGNAPGVAEKSKFKRNRAKGPNPLSCKKKKPKPQPSAAQNQGPKTDGEAKRKRVRKRKRSAKGSSQAET

SEQ ID NO: 135386 - protein, 150 aa, Triticum aestivum
  Clone ID: PAT_TA_29804.pep
MKILFTLFLLALTVTSAYAQCKFIILVTTGDREDAGTDARVSLSVSTANGKKLVIESLKPWGQKGHNNFEKGHTDKFEGSGKCLPSKPCRMLLESNGKGNKPGWFVDKVAFTQIEQKNLSQKEKTFNVNRWLARDESPGTLFVVVDDCAK

SEQ ID NO: 135387 - protein, 354 aa, Triticum aestivum
  unsure (1)..(354): unsure at all Xaa locations
  Clone ID: PAT_TA_29805.pep
STPRPAHMFRKVISITKSHCKLGLTATLVREDERITDLNFLIGPKLYEANWLDLVKGGFIARAPRAEVWCPMTKEFFAEYLKKENSKKKQVLYVMNPNKFRACEFLIRIPAQQRGETRIVFADNLFALTAYAMKLRKPMIYGATSHAERTRILYQFKNSPEVNTVFLSKEGDNSIDIPEANVIIQISSHAGSRRQEAQRLGRILRAKGKHQDRMAGGKEEYNAFFYSLVSTDTQEMYYSTKRQQFLIDQGYSFKVITSLPPPEEGPNLSFHTLDEQLDLLGKVLSAGDDMIGVEHLEEDSDGKALLKARRSAGLMSAFSGAGGMVYMEYNTGKGKGAQXKDPAKRHTLFKKRYT

SEQ ID NO: 135388 - protein, 262 aa, Triticum aestivum
  unsure (1)..(262): unsure at all Xaa locations
  Clone ID: PAT_TA_29806.pep
DLAPVNSRIQEVRNMSYCQATTYKPLGGLTLDRPLGLGRTCKILPEHFVWQHFSRSCKLQEKVYPRLVVAACHKRLGPVYASSGKGNLDPFSMESLNKAMDGAKKQQSIQGFLMEQMAKITGQGSGGNGGNNNRYGGSGGGSDGPDDESFTDSLYEVVQVVLATVAFVLTYIHIIRGEELYRLARDYTXRYLVTGKRTSRLKRAMLNWRDFSDSITKNFSTQDDVCRNPVASEAMWWQHAQKLGHHREHHKECQQRRRGQES

SEQ ID NO: 135389 - protein, 420 aa, Triticum aestivum
  Clone ID: PAT_TA_29807.pep
VTDADNALRAGDPFPGTSANSTVTDTDRYAAAKELYLGDRCQVPDSPVPWQFWMVMLKNGNLDTTAAICPDNGRPARPFPQTSRFPCPGGTGCMNQPLVFHNRTALDDAGRWLRGGLFGTYELDATDLGRSDVSYYSVVWEKQIGPAGGAGWVFHHKLRTSAKYPWLMLYLRSDATRGFSGGYHYDTRGMTKIVPESPDFKVRLTLEVKQGGGPNSQFYLMDMGSCWKNDGAPCDGDTATDVTRYSEMIINPETPAWCQPGRRDQCPPWHTFRNGTRVHRDDTARFPYGAYHVYCSPGNARHAEQPTTYCDPYSNPQPQEILQIVPHPVWGEFGYPTAKGQGWIGDPRAWELDVGALSHALYFYQDPGTPPARRRWSSLDVGTEIYVSKKAEAEWTLSGFDILVPNKCVTSQGGTVSSCW

SEQ ID NO: 135390 - protein, 100 aa, Triticum aestivum
  Clone ID: PAT_TA_29808.pep
PFCPAIAVAMQPVTVYIDASGFEFQFYSGGIYRGPCSANVNHAITIVGYCEGPGQGNKYWIAKNSWSNDWGEQGYVYLAKDVPSSTGTCGLATSPFYPTA

SEQ ID NO: 135391 - protein, 363 aa, Triticum aestivum
  unsure (1)..(363): unsure at all Xaa locations
  Clone ID: PAT_TA_29809.pep
MASSTPYLVLLLCLTTFLQAWLAAAKXPPPPPPPFELPESEVRERFSKWVIKYSKHYSCHEEEEMRFQVFKNNTNAIGQFDQQNPGTVVGRGFRPTGFQVRGSGGVRMNRFGDLSPREVIQQFTGLNTTSFNATSPTYLPYHSFKPCCVDWRSSGAVTGVKNQGTCGSCWAFAAVAAIEGMNKIRTGELVSLSEQVLVDCDTRSGGCGGGHSDSAMALVAARGGITSEERYPYAGFQGKCDMDKLLFDHQASLKGFKAVPPNNEGQLAIAVAMQPVTVYIDASGFEFQFYSGGIYRGPCSANVNHAVTIVGYCEGPGEGNKYWIAKNSWSNDWGEQGYVYLAKDVPSSTGTCGLATSPFYPTA

SEQ ID NO: 135392 - protein, 197 aa, Triticum aestivum
  Clone ID: PAT_TA_29810.pep
GRAEPVRPAEPSCVSGGLPLLRRAQPRQDPSGPVPAAAGSASGDDRPQLLPHHPGPRQQQTITLSGLLNLIDGLWSTSGEERIIIFTTNYKDRLDPALLRPGRMDMHIYMGHCCWEAFKTLAVNYHLVDDHALFPEIQELLAAVEVKVTPAEVSEMLLRSEDADVALRVLTEFLQDKRSKARKEATEIKIGVAEKAM

SEQ ID NO: 135393 - protein, 345 aa, Triticum aestivum
  Clone ID: PAT_TA_29811.pep
MEDGASDFSDWEVLSASSGVGGDDAVLVSGEGGDVLHDHFALDSSSSTGFSGEGSWSEAASDDVEIESGLGSVDRFGSAMQEQTDLIGVVDSSAQLQLGWIDVTAQASPVFGASVACGGDAHEKQTAGLSCGELDWIPQAALQGLEGILDSDATAVAGVRLQIEISEKSSLQLEDGGADALSESSVLQAAATSDAMQTLQEEPEQGKDASAASGCAEPGGDDKDGSSPLVAAGAPGTGDGERQVVVWWRLPFRFIHYCAWKVSPVWPISIAAALLGIVVLGRRMYRMRRKTQGLPQIKIAFDDKRASQFADRAARLNEAFLIAKRVPALRTLSGAALPWSMMQER

SEQ ID NO: 135394 - protein, 111 aa, Triticum aestivum
  Clone ID: PAT_TA_29812.pep
MGMLFVEYLPGPKVFKCKFCRVDSASPDDIVSKEFRGRHGRAYLFDSVVNVSLGPNEDRHLLTGLHTVNDIYCSCCQRLLGWKYAKAYNEDQKYKEGKFILEKNMMLKEGR

SEQ ID NO: 135395 - protein, 86 aa, Triticum aestivum
  Clone ID: PAT_TA_29813.pep
ETYAQVEVGGQTLGKGVGITWEEAKLQAADEALGTLRSMLGQLAQKRSSSPRSLAPNYNKRFKPDFPRAVQRPPYGRYSRIEGHVP

SEQ ID NO: 135396 - protein, 170 aa, Triticum aestivum
  Clone ID: PAT_TA_29814.pep
MAWRRASMLAALVLVAAATCADAGDSYGASKFTVTGTVLCQDCTKNWNAYAYNAKPIAGSVVAVTCLDEHTGRTVIHRTDTTDEEGVFKVDVPYAHDGGSCRLDPAHCLVRIVRSGDKGCAVFTNFNNGRTGENLLRPSKVSSTEVGYSAGPYYATVPQCDVDGDDKSCS

SEQ ID NO: 135397 - protein, 595 aa, Triticum aestivum
  unsure (1)..(595): unsure at all Xaa locations
  Clone ID: PAT_TA_29815.pep
RAYQTWAEVLSGPPEHHLSSALDTHYEEKRKSHVEYSEDEKKAMXVSLKKKAMNASQKLRHSMKXGRRSSKVMSISIEDERDPEEVQAVDAFRQLLVLEELLPSQHDDYHMMLRFLKARKFDVEKAKQMWSDMLQWRKEFGTDTLLEGFEFEEADKVAECYPQGYHGVDKEGRPVYIERLGQIDVTKLMQVTTMERFVKNHVKEFEKNFADKFPACSVAAKRHIDQSTTILDVQGVGMKQFSKAARDLIGQLQKIDGDNYPETLCRMFIINAGQGFRLLWSTIKSFLDPKTTAKIHVLGNKYQSKLLEVIDASELPEFFGGTCQCQGGCMTADKGPWKNPEVMKMVHSGAGRCGKLNLESLDAGEKMICADNTVYTKKQDPLNGQDEWRNPARAQIEHPQLSPVHEELLPALFPNPGSPYSCDVPMVEKAIDAICKSHGLTDDNLALTKAVANASNASNPPMMGGIMALVMSIATMLRLSRNMPRKVIGAAIGAQSTPKTQAQQQSKMLAEAEYTVSAKRFADLEEKIIALLAKQAEMPADKEELLKAATSRVAALEEELARTNKALQETLERQQEIMEYIEKKKKKKAKRKFHW

SEQ ID NO: 135398 - protein, 401 aa, Triticum aestivum
  Clone ID: PAT_TA_29816.pep
MSRPAAAAAAALLVILAAAGGAAAKTTIEPCSSADSCAALLGYSLYADMKVSEVAALFGADPAALLAGNALDFASPGAANRILPAGLLLRVPTRCACADGVRKSVSVRYAARPADTLATVADVVFAGLASADQIRSANGLAEAARAAPRGAGPSPAARYPCVCLNSTDNNLPAVYLSYVVRVGDTVQSIAATHATTVTDLSNVNAMGSPVVAPGDILAVPLSACASTFPNFASDYGLLVANGTYALTAGNCVECSCGPGDLNLYCTPASLGTSCSSMQCSNSSLMLGNVTTQPTSGGCGVSSCNYAGFVNGSITTSLSSGLQPTCPGPHQVPPLMEPCTAAIHDSYLAPSPSPGPGEAGGAVPGSSDPVASSHSLAVSLSPSVHKLHQMILILSLVFYLHM

SEQ ID NO: 135399 - protein, 95 aa, Triticum aestivum
  Clone ID: PAT_TA_29817.pep
RKTAWHAPATRPRGVLTRQPTSSKSRQSCVHAYDVCVHLSHGGQGSSKEAIGREMHARGLVISTMDVPLDARASYFILVVLISMSIYHFHVMILL

SEQ ID NO: 135400 - protein, 119 aa, Triticum aestivum
  Clone ID: PAT_TA_29818.pep
GEYLRAVNLFPMLPGWRGNLLLNLLIGSCWLALSFSDKKNEKLTAKIWIVFAKGFLLETNIIALKISYTNPGLMAFQTAYVDEASATISCKRKIYQLCKGTPENISIKNTHLSMVPPSS

SEQ ID NO: 135401 - protein, 231 aa, Triticum aestivum
  Clone ID: PAT_TA_29819.pep
RIAWSYWFNKTLYYQVALLYMLARLITNVSQSLIAFYVTRDLKMNEYSKATIPAIIFCCSFLVSVVLQEMRWNSRRLKSLLTIGATLWVISGAAVFLLPSQMHNLMYPLAVVIGAANALVMVTTIGLESALVGEDLNGCAFVYGSLSFLDKMSCGLALFVLESYDVASSCGEERGLNTVSRYGTGLIPTCFAILAILVASTLRLQDDDVARADRRARASTAAGALEAPLLV

SEQ ID NO: 135402 - protein, 152 aa, Triticum aestivum
  Clone ID: PAT_TA_29820.pep
MTKRFAFEEKEMARMLLLVSREQAMPMPMPVAVPGDRAPERVFVCKTCDRVFPSFQALGGHRASHKKPRLDNGGDLKPKLHGCSVCGLEFAIGQALGGHMRRHRAMAAGGGRWRHGHDAADSSDQEARRQQRRRRCRHEAWAVARLEPSTLR

SEQ ID NO: 135403 - protein, 59 aa, Triticum aestivum
  Clone ID: PAT_TA_29821.pep
MARVMKLLGRTGSRGGVTQVRVEFLDEQNRSIIRNVKGPVREGDILVLLESEREARRLR

SEQ ID NO: 135404 - protein, 585 aa, Triticum aestivum
  unsure (1)..(585): unsure at all Xaa locations
  Clone ID: PAT_TA_29822.pep
RPCRCTAGCCGRCMLGMKYESQRGYIGLEYYGRTVTVKILPVGIHLTQLQAVLNLPETGLKVAELMKEFPDPHRIMMLGVDDMDIFKGISLKLLAFEELLTQHPEYRGKVVLVQIANPARGKGKDVKEVQDESYAMVKRINEAFGQPDYQPVILIDRPLHFYERMAYYVVAECCLVTAVRDGMNLIPYEYIIARQGNEKIDRILGLSPFTRKKSMLVVSEFIGCSPSLSGAIRVNPWNIESVAEAMDKALHTGEGEQALRHEKHHKFVSTHDVGYWANSFLQDLARXCQDHNKRRCWGIGFGLRFRVVALDTSFKKLAAEQLISAYRKASTRAILLDYDGTLMPESSFRKMPSSKTINMLNSLCRDEKNLVLIASTKTRATLSEWFSACEDLGLAAEHGYFIRLERDAEWETCGLATDFSWKQIAEPVMKTYTETTDGSIIEDKETAIVWCYKDADRDFGSCQAKELHDHLESVLSNEPVSVKADLNYVEVKPQGVSKGLVAKRMLSTMQELGLLXPDFILCVGDDRSDEDMFEVITTAVDGPYLSPCAXVFACTVGQKPSKAQVLPGTNPPTSSGTAPGRPQRL

SEQ ID NO: 135405 - protein, 116 aa, Triticum aestivum
  Clone ID: PAT_TA_29823.pep
ETSTTYFLQSGHASRSSSHNPWPLFALFQHTYYTQIHTLPCHCICTPKPETCWFLVCHVVMIVVVSELLCREKRKKGGAAGVCTEGRGRHIYGSTFMWFTVVAGWPLPAFNDMERA

SEQ ID NO: 135406 - protein, 191 aa, Triticum aestivum
  Clone ID: PAT_TA_29824.pep
SAQEIITKQNTQHSTGRSIYSLSRTGMQHPIHKCSGDARVEAQALHPQAPLPSWPVPAGGELRRSHLVQVLVDRPHHPGRGGGSGRGSRQAAAFRRLRAPPLLLPGHVAPRLLGRRLARRRRVLEPYVAAVLRLRGVALGRRLVVAVAVVPLPERRHLPPPRLIHLACAARGADRMRWRRREAKLGPEGVR

SEQ ID NO: 135407 - protein, 117 aa, Triticum aestivum
  Clone ID: PAT_TA_29825.pep
AGRGGSSDGRDMVAEEAVTAARPPSGGSYTPDLTALTTKIHEGAALYTTGGKIMTTMPTMLTGGVSMCQELTKMMAPPSAMWMQFAQPYIGTIQMASSAHPYPEFGVMLCRSLPYFL

SEQ ID NO: 135408 - protein, 169 aa, Triticum aestivum
  Clone ID: PAT_TA_29826.pep
HTKPTRTRKSHTANYHHRRNQKYSGSTPAPTTAMAAPTAACSWAPQDAAQRGQKVFMQVCAGCHVMLPYAGLRAAAQGEVGAQMDEIVVAEEAATAARSPSGGSYTPDLTQLTTKIHEGAALYTTGGKITTTMPLMLTGGVSTCAELMRRMVPPSAMWMHLAQPYIGTL

SEQ ID NO: 135409 - protein, 329 aa, Triticum aestivum
  Clone ID: PAT_TA_29827.pep
MAVRYLLLPLALLALAASSAAVAQLEIGFYSKTCPDAEKIVRGEMAKIIAAAPSLAGPLLRLHFHDCFVRGCDASVLLESTDGNVAEKDAKPNKSLRGFGSVERVKAKLEAACPGIVSCADVLTLMSRDAVVLAKGPFWPVALGRRDGRVSSATEASKELPPASGDVPLLAKIFASKGLDLKDLVVLSGAHTLGTAHCPSFADRLYNSTGENDAYGLVDPSLDSEYADKLRLKCKSVDDRTMLSEMDPGSFKTFDTSYYRHVAKRRGLFRSDAALLFDNTTREYVQRIATGKFDGEFFKDFSASMIKMGDVGVVTGAEGEIRKKGTAHN

SEQ ID NO: 135410 - protein, 100 aa, Triticum aestivum
  Clone ID: PAT_TA_29828.pep
RGLTRRPRARGPDVALHLPLLHDAAWMSSSSASCGSFTSPSTTAFDPHPCAPKAGPLEGVELAAGVEEGTSAGEGGGGGNPSWEIRQRNQPATHPACPLG

SEQ ID NO: 135411 - protein, 45 aa, Triticum aestivum
  Clone ID: PAT_TA_29829.pep
FLNTLANLMMNPADYFQHMAVCFVLHPGFKVTKRSHISTVLQWLI

SEQ ID NO: 135412 - protein, 397 aa, Triticum aestivum
  unsure (1)..(397): unsure at all Xaa locations
  Clone ID: PAT_TA_29830.pep
MASGGSGRTATAGAAALLSLVFLWLLQASAGAGAGADCHFPAVFNFGXDSNSDTGGLSAAFGAAPPPNGRTFFGMPAGRYCDGRLVIDFIAENLGIPYLSAYLNSVGSNFSQGANFATAGSTISRQNTSLFLSGFSPISLDVQSWEFEQFINRSQFVYNNKGGIYRELLPKAEYFSQALYTFDIGQNDITAGYFANMTTEQVVAFIPELMERLTSIIQNVHGFGGRNFWIHSTGPIGCLPYALIHRPDIAAVKDKVGCSVTYNKVAQLFNQRLKETVARLRKTYPDAAFTYVDVYAAKYKLISQASKLGFDDALLTCCGHDAGPYNFDPKVGCGGKVLVKGKWVVLGKSCDDPARRVSWDGVHFTEAANKFVFNQIVGGGLSDPPMPLRQACRSKGQ

SEQ ID NO: 135413 - protein, 243 aa, Triticum aestivum
  Clone ID: PAT_TA_29831.pep
MRSPSPARSPPFWDCLEEDLADDLADGLEWEEIADAADADAGDASVPGGGGGCGAGGGGGGGDADADVFGFLSEREILGVMEGIDSGEDESMFSDEPPFDFGDEGPELDDIFRSVGWEVLPVPLDEDEFEVLPGHMADVTVGGAPPAARAAVERLQVVAISGEEAAQGCAVCKDGIVQGELATWLPCAHFYHGACIGPWLAIRNSCPVCRYELPTDDPDYEQRRARRRSAGGSTAQLGTPMQM

SEQ ID NO: 135414 - protein, 237 aa, Triticum aestivum
  Clone ID: PAT_TA_29832.pep
MVAQAFTVDLDKPLVFQVGHLEEQYQDWVHQPIVSKEGPRFFANDVLEFLTRTKWWAVPLIWLPVVCWCLNTSIQMGHTVPEVALMVVAGIFIWTLVEYVLHRYLFHIDTKSYWTNTAHYLLHGCHHKHPMDGLRLVFPPTAAAILCYPFWNFVKLFTTTTTTPGVFGGGLLGYVIYDCTHYYLHHAQPSFDPAKYLKKYHLNHHFRIQNKGFGITSTLWDHVFGTLPSTKTADKSS

SEQ ID NO: 135415 - protein, 126 aa, Triticum aestivum
  Clone ID: PAT_TA_29833.pep
MAALRCYSSTAAIIVPRRKICARASMDGCSSSESRQQASSSVSFACKVNKVYEDKNMGILCYTDENGELVCEGLDEGPRLTRRDMEKLTKERESKNTAEDWRERALRIAGGIDWSGLQSAAATGKK

SEQ ID NO: 135416 - protein, 247 aa, Triticum aestivum
  unsure (1)..(247): unsure at all Xaa locations
  Clone ID: PAT_TA_29834.pep
LLSYGSLARARIARDAAALQPARPRRRLGGGRPGRPRPAGDAYKKQDVGDRRRQYDVLAVDYQAWALGHNFTLHXGDFLIFNTDKNHSVVQTRNETLYKSCDYDDSGLDDTVDWSAAAPEFSKDAVTAPVPLLKEGTTYFCTGTANGEQCAEXSSASAIAVAHGQRLPARPQADGRPTRPGPAAGPDSADRAPAFDFNHPKXTSPRRSETGASDDETSTSTSDSTLNLASLGAGLIMALSVLFAVQV

SEQ ID NO: 135417 - protein, 382 aa, Triticum aestivum
  Clone ID: PAT_TA_29835.pep
SRVRTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLLDSWGIDKFRAEVEKYYGKKFEDFHPLPEWQFNSYLGWQEQGDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 135418 - protein, 150 aa, Triticum aestivum
  unsure (1)..(150): unsure at all Xaa locations
  Clone ID: PAT_TA_29836.pep
SNPLRDPYANRGNSALRMRIGRGSGSKMLKNTHTLFAEGEDGWIAVHFFQLRQRRTESSPPTIHVSLAMSMDTWKKSGGYLITTRFSFSGSSSLALLLSPLASSSSPGSVTHTPCNRAYSESDCHTLTKGAPGANSPKRVYCRPKAXFXL

SEQ ID NO: 135419 - protein, 188 aa, Triticum aestivum
  Clone ID: PAT_TA_29837.pep
HASAHASAPAHYVSLQSIAVESTRVPGAGAAVVCTKVPFTLLRPDVYRPFVDAFARALKAQGAQGGPVARPVKPVPPFELCYDTQSLANTRIGYLVPGVTLTLGGGTNWTMNGLSSMVDLRPGTACLAFARMEGVKAGDRSAPAVLVGGFQMENTVLEFDVARKRLGFVRLPFFTQCGHFNFTKTPGY

SEQ ID NO: 135420 - protein, 204 aa, Triticum aestivum
  Clone ID: PAT_TA_29838.pep
MRSLGCTSLCFHLALLLLLAMVTADDPSLADGGRLIDPKPSPKPTPKPMPQPNPKMPHPNPNPNPKPMTRAKPEPNPIPDPDAKPQPKPMPQPDPKPTPEKPNPKPQPGSLPVYSLDDIGSDRTNPKPDPQPNPRTNPAKPDPEVKPQPQPKPQPNPKPTPAKPEPKPRPGPSKPQPNPNPQPGPSKPKPPVYARRAASGKPLN

SEQ ID NO: 135421 - protein, 315 aa, Triticum aestivum
  Clone ID: PAT_TA_29839.pep
MRSLGRTSLCFHLALLLLLAVVRADDPSLADGGRLIDPKPSPKPIPKLMPQPNPKMPHPNPNPNPNPKPTTPAMPEPNPIPDPDAKPQPKPMPQPDPKPTPEKPKAEPQPGSLPVYSLDDIGSDRTNPKPDPHPNPKANPRKPDPDAKPQPKPMPQPNPKPNPEKPKPKPQSGSLPVYSLDGVSDRTNPKPNPQPNPRTNPAKPDPEVKPQPQPKPQPNPKPTPAKPDPEIKPQPQPNAKPTPAKTEPEPRPGPSKSTPLDSLSVRFDKVNPKPDPHPTPKPTPKPQPNPNPHPGPSKPKPPVYARRVGSDKPLN

SEQ ID NO: 135422 - protein, 97 aa, Triticum aestivum
  Clone ID: PAT_TA_29840.pep
PASGHGSPVHRYGLYALQWIVEVNGQPTPDLESFIEVVKGLEDREFVRVKTVHLNGKPRVLTLKQDLHYWPTWELTFEPETDTWKRRTIKALQPTGA

SEQ ID NO: 135423 - protein, 333 aa, Triticum aestivum
  unsure (1)..(333): unsure at all Xaa locations
  Clone ID: PAT_TA_29841.pep
IVHKYGGXELDTDFGSSFSGILTDEQGRVQALWASFSTQLKYGCSSSEDHQFVRGIPIYAISQVLEKIISGTPGPFRLINGIRRPMPLVRLLEVELYPTLLSKARSYGLSDNWVQALAKKDPVRRQVLRVKGCLAGSKAEKLLEQGDMILAINKEPITCFLDIENACQKLDQSIDSDGVLNMTIFRQGKEIDLIVGTDVRDGNGSTRMVNWCGSIIQDPHSAVRALGFLPEEGHGVYVARWCHGSPVHRYGLYALQWIVEVNGQPTPDLESFIQVVKGLEDCELDSGRGRRPNPKPRVLILRVEGFEGPEFVRGKAAHFDGKPRRLIQELDPP

SEQ ID NO: 135424 - protein, 487 aa, Triticum aestivum
  Clone ID: PAT_TA_29842.pep
LGTAIPDTQIPSQEIATKMGFRQDPQFAPCTSMLPGTSTGLNVPQRPAKAPVLGLDAQGREIDEHGNVISMTKPSNLSTLKVNINKQKKDAFQIIKPDLESLAKATVHFDERMGINPTKLLRPKRPGFQFIEEGKLSRQAELQRIKNQFGEAQAKELKVKQAQLAKAKVEVDMNPNLIEIAPGGRPPKQKQKEEIPDIEPWDSKILLSPTYEDISLEKLNMDKITIYVEHPEPLEPPAEPAPPPPQPLKLTKKEQKKLRTQRRLAKEKDRQEMIRQGLLEPPKPKVKMSNLMKVLGAEATQDPTRMEMEIRTAAAEREQAHVDRNIARKLTPSERREKKERKLFDDPNTLGCIVCVYRIRDLSHPQTRFKVDVNAQENRLTGAAVITDGISVVVVEGGKKSIKRYNKLMLNRIDWAAAVGGEDDADEEPDKPVNSCVLVWQGSVVKPTFPRFGVHQCRSEAAAKKVFADAKVPHYWDLAVNFSEDSS

SEQ ID NO: 135425 - protein, 183 aa, Triticum aestivum
  unsure (1)..(183): unsure at all Xaa locations
  Clone ID: PAT_TA_29843.pep
KEEFGAEMDSTNSSSENAGNQHGQGXEAACSEDQDRDEFQSTSTHAGASQLLNAYKSEPVGSMDAGPLSSLGGGDMGTYAPAGLXLNHHGAGRRQASLQDAFAHHGDDARFVPYGGNMGDLSGSVSLTLGLQHCNNNNNAGHVPPEQQGLLYGNPGDFDFLNGADDRQRFASSSSQLLHDFVT

SEQ ID NO: 135426 - protein, 147 aa, Triticum aestivum
  Clone ID: PAT_TA_29844.pep
LASLRMNQSSSLLYTCTCVCIRARTTTGSGVDVAHLDGFAPRLGARRLQALDLAQLGAAPEEPPGDARKQRTWSGANRSWRSCGIRSTGFDLRPSHGRSYVACGRAQKEERKRKRGWRAAGARSSGGGASCPDVAAGPGGAHEGGAA

SEQ ID NO: 135427 - protein, 95 aa, Triticum aestivum
  Clone ID: PAT_TA_29845.pep
RLHNNRKRKQVLLRRYKEPTRSRTYIFYVYGYWSMYVCSITHSLNLYRSRTNLTKRMNEFHHWTGLDQKLWMESSMGSMQLEQAAQAVRRKRGVD

SEQ ID NO: 135428 - protein, 261 aa, Triticum aestivum
  unsure (1)..(261): unsure at all Xaa locations
  Clone ID: PAT_TA_29846.pep
MSSSAMEALHALIPEQHQLDVEAAAAVSSATSGEESGHVLQGWAKRKRSRRQRSEEENLALCLLMLSRGGKQRVQAPQPESFAAPVPAEFKCSVCGKSFSSYQALGGHKTSHRVKQPSPPSDAAAAPLVALPAVAAILPSAEPATSSTAASSDGATNRVHRCSICQKEFPTGQALGGHKRKHYDGGVGAAASSTELLAAAAAESEVGSTGNGSSAARAFDLNIPAVPEFVWRPCAKGKMXWEDEEEVQSPLAFKKPRLLTA

SEQ ID NO: 135429 - protein, 191 aa, Triticum aestivum
  Clone ID: PAT_TA_29847.pep
VAAGAGHHQECAPATGTPAKMRLLPPEHRLKMRLLPVEHQPGTQLLALEHHQSGTRLLALEHHQSGTWLPVLEHHQSGTRLPALEHHQSGTRLPALEHHQSGTRLPALEHHQSGTWLPALEHLQSGTRLLALEQQPGTRLLAPERHRPGTCSPAQEHHQLGMRLLSPEQHQPGTCLPAREHHQPFVNITQR

SEQ ID NO: 135430 - protein, 159 aa, Triticum aestivum
  Clone ID: PAT_TA_29848.pep
MRLHSQFPRQHLELKKTRTLDRGERSCLVQQTASRMEMAVGAASRVVVQLVRGVVVVLKDALQLQGARGLDLERPTSGDTPLHQVPELPLNICMVSEMFLQILATGLGALALVWATVVLLGGFSTYLHKADFWVITAIVFIQTARYLLSPRPLLMTVDD

SEQ ID NO: 135431 - protein, 324 aa, Triticum aestivum
  unsure (1)..(324): unsure at all Xaa locations
  Clone ID: PAT_TA_29849.pep
DLILFSNPLETLRNKRKGLMASASHGSAIEVLSRITMPTCDSIFGNPETRLLMHITGLLPWLGLQLTKDVSSLGSASPLQEQNQKAYYVASNISGWCRVKSLHVLAEVFRAYSYGEIISLEDLLARASPPICAERVPKHSSLAFGHLCRLLERGPLDYQRVVLLMXRRSRRRPPVDPSQIPHVYNVVSQLVESALCAEALNVLEALLRSCGGGGTAGSDDSLGLSGENGGGHGGMMTGEKGAGXMLLPQSSFKARSGPLQYAAGSGFGSMMAAQGVAAPVDTGLVTRDVALQNTRLLLGRVLDTCALGRKRDHKRLVPFVANIG

SEQ ID NO: 135432 - protein, 124 aa, Triticum aestivum
  Clone ID: PAT_TA_29850.pep
MMSDQRGEWEDYRTPHGLLMAVVMGAVVAGPLFVLDGGEAVREALSELLGPVGLPLLPLGLVLVIRVLSSGLRLVDVFGFALGESLDAAYRSGRGSPVGVVLALMFFLLAVYYRSWSPFGGDDE

SEQ ID NO: 135433 - protein, 196 aa, Triticum aestivum
  unsure (1)..(196): unsure at all Xaa locations
  Clone ID: PAT_TA_29851.pep
LHGPQVRLVEQAHRLFAETKEHLFESKSAEEHAKLLXHQLEVSTKQAIFVGSSVSDTIKTCIVMGNERAAVKVKSEFKVPDKRWYWLKSCALATVGNWDALETFSREKRPPGGYKPFVEACIDAGQKTEALKYIPKLTDPGERSEAYARLNMTEEAKKAASEANNGDELFGRLKSTLAQNTLIDTLRDRLSFQGTY

SEQ ID NO: 135434 - protein, 86 aa, Triticum aestivum
  Clone ID: PAT_TA_29852.pep
SIKLLAQRNTLLPKLLHTRQCVDDKCTTKGSSGHCSAVLEIRRLDLIVVHESSKLCRPHSIALLCYCRFFKELLGDTRAGMNGHFW

SEQ ID NO: 135435 - protein, 244 aa, Triticum aestivum
  Clone ID: PAT_TA_29853.pep
MAGRGAPTSPLPAPYLPHPRLLRLAADRRWVAAAPPLHADIDTHKTCGLGPAMPFAHRLLLSSSPSPSSLPAPSGVSDPAGEDSDPLVLGLVPCAVGGTRIWMWARGQPLYEAAVARARAAVAGRGGALGAVLWFQGESDTVEVDDARAYGGNMERLVADLREDLGSPNLLVIQVGLASGEGNYTDIVRDAQKSINLPNVILVDAMGLPLSDDQLHLSTEAQLRLGEMLAQAYLEFESSRDRKL

SEQ ID NO: 135436 - protein, 288 aa, Triticum aestivum
  Clone ID: PAT_TA_29854.pep
MAPPPTAAAAVRCHPHILRRGLLPASSPLLPFASRVASSTPLRAQPLRFSLSPVPKSISSSSTSHIPVRSLFTGIVEEVGRVRRIGPPPTPPGGGGDAAPGVDLEVETKNLLAGTQLGDSIAVDGTCLTVAAIDTAASTLTFGVAPETLRCTSLGERVAGDDVNLERALTPASRMGGHFVQGHVDGTGEIAAFRPEGDSIWVTVRAPPEILSLLVPKGFVAVDGTSLTVVNVNEEAGWFDFMLVRYTQGNVVLPKKKVGDKVNLEADILGKYVVKLLVGRLEATSKAN

SEQ ID NO: 135437 - protein, 50 aa, Triticum aestivum
  Clone ID: PAT_TA_29855.pep
PLTCNLNIHHTPKQMKKACDPEKKRKGVRTSTPLPTREKLSVELSNSFVS

SEQ ID NO: 135438 - protein, 115 aa, Triticum aestivum
  Clone ID: PAT_TA_29856.pep
PLTVNPPPIFPRQLHGPDFGHHHTIDNLISHLKIHAQLVLVLRICTLSSTICSSTRVATTLFPSMRARMSMVASPSRCCHALRLRNRLVWRPRLRVRRRDRPATPGLRRCCCALR

SEQ ID NO: 135439 - protein, 83 aa, Triticum aestivum
  unsure (1)..(83): unsure at all Xaa locations
  Clone ID: PAT_TA_29857.pep
TVISNWNGVVGFLADNQRTNITWDKGKALDFLNESLGYTQXSDDVPPVYIGDDRIDRILVAKCLKESSTSYSLPRPAELFHGL

SEQ ID NO: 135440 - protein, 276 aa, Triticum aestivum
  unsure (1)..(276): unsure at all Xaa locations
  Clone ID: PAT_TA_29858.pep
ERDAEAGDEKAAAEQGTAGLVAAPTVMPPTSVMTRLILIMVWRKLIRNPNTYSSLIGLIWSLVCFRWNFAMPAIVLGSIAILSDAGLGMAMFSLGLFMALQPRIIACGNKGATYAMAVRFLAGPXAVMAAASFAVGLRGTLLHVAIVQAAAGLGMVPFSLGGEMRVQPEIISGGGAVASAAAAARRVREQAVEVRHGRAVPDGPGRHGRALHRRRPPRHPPPHRHRAGSAAPGHCPLRLVIFGMRVALPITHVYYILHGPVSARHTRLLHPAGAVS

SEQ ID NO: 135441 - protein, 163 aa, Triticum aestivum
  Clone ID: PAT_TA_29859.pep
KQDKGDTEEAQSECNGDGAAPGQLSSPATVDPKWVKRILANRQSAQRSRVRKLQYISELERSVTSLQTEVSALSPRVAFLDHQRSLLTLGNSHLKQRIAALARDKIFKDAHQDALKKEIERLRQVYQQQSLRNAEPPAHDDGPLVRGDNSNGLIASEGTAAPS

SEQ ID NO: 135442 - protein, 288 aa, Triticum aestivum
  Clone ID: PAT_TA_29860.pep
MSTLAAARADNFYYPPEWSPKKGGLNKFHGQHALRERARKLDQGILIIRFEMPFNVWCGGCSSMIGKGVRFNAEKKQVGNYYSTKIWSFSMKSPCCQHEIVIHTDPKNTEYVIISGAQRKTEDFDVEDAETLLLPADEERDKLADPMYKLEHQGEDIRKKKEEEPVLVRLQRLSDSRHSDDYSLNRTPREVRQDLREEAAGEERREQGRRLLAGAMGHGSERQARPRAVRSESKCQSSGRVKSGPVKAAFVVPEQYGLGMCNNCDADLNKGKVKANPELSLITGRAIP

SEQ ID NO: 135443 - protein, 224 aa, Triticum aestivum
  Clone ID: PAT_TA_29861.pep
AAYEAHKHLRKLEWVHQVGTVELALDFDDGRHLSLAVEPLHAAVIAPFANSDDDDHAAGSGLALSRVAEQVGISESRTRKALAFWIKKGVLFESATDVYQVIEDEDEHRRRVAQRSSSSASSSAAASSSTASDESDKPSSSSSSSSSSSSAAAVSFTEDELLAQAFVQNMLRSNGALPLETIHSRLGMFLPDFEVTLVQLKQFLQRLILTDRIELSMDGLYTIK

SEQ ID NO: 135444 - protein, 322 aa, Triticum aestivum
  unsure (1)..(322): unsure at all Xaa locations
  Clone ID: PAT_TA_29862.pep
AWLLLSFKIKVRKNVVVPAYSKVSLLDKPSNEDSDEELEYADTNSGVTDSAPFSSTRSNADHPTILSEDDDLGGDSGRGSGVLXFIWASGDTGILEEWRQSIAPIPKEKLQELQHAVSVDGDVGSEEDLNNRPSEADRDNDSEIGVIEDDDYTKFEKEVEETFQRAVDGVHQDNLILEINALRLSYSLQHADCAGAVFYSIMRAALVAAQSTNDSLLKSTADALTKWKDLLRNYTKTVDEEMEILLKFEEMCQEMTKEFSPLFSKILPYLYDKEIVSEDAILRWAEEKENADEPDKVFVKQSDVFIQWLKEAEEEDEDAQEE

SEQ ID NO: 135445 - protein, 156 aa, Triticum aestivum
  Clone ID: PAT_TA_29863.pep
RTQGSHNVSAAPAACVHFIIVLHDVEDEEERGGCLASKPTTTPFIDPARPRPPPHPRRRHLPLTTGLITSGCDTASRLACPTSLPSYIFELGLQAVSLVGGQRFASRSHGERARQRPRKPYLWAGSNKVYPTISPATKMQRHEPENQFSLQDNTFL

SEQ ID NO: 135446 - protein, 189 aa, Triticum aestivum
  Clone ID: PAT_TA_29864.pep
ESRDALMRPAMAGNGLHWCQQRQLRASIDHCAQQADRRRRRGVAGGHVDLVRLDLVLPRLPRDESSRRRPPCHQRYGEEQGHALLRGRGPHRCIRRHGGCPSPGPRRPSDAFTRPCGGAGGRSEIETATAADFSSHPIRTAGGVLAAASPHPSLPPGLPVHWLPPPDCQELERPDQGKKRNERLRVMCM

SEQ ID NO: 135447 - protein, 208 aa, Triticum aestivum
  Clone ID: PAT_TA_29865.pep
QVQRCQEDMSILITTYEGTHNHPLPVGATAMASTATAGAGAATFMLLSSTTSDAAVSGGPPPASSSYLSPYLQLNSSSQYHSSASPLMSGNMGGGGAQHLSMFGHSSGLSAQPATHLKYPWPPNPSHGGAAGLGGGKRPFWGTGGVDDVRPTALPDNAGTMASDPNQFSAAIATAISNVIGKDGQATRSKEGESSNKWGVVESLPPHE

SEQ ID NO: 135448 - protein, 97 aa, Triticum aestivum
  Clone ID: PAT_TA_29866.pep
RKRLRCCSRATGTLVQILFFDTSQDFYPFHLSSLLHHLVRGTYKIRMCTSPSCPPAITAVDSSPDPFFLLHRRCHHRHTHHHPHHRYLPISLDPNED

SEQ ID NO: 135449 - protein, 421 aa, Triticum aestivum
  unsure (1)..(421): unsure at all Xaa locations
  Clone ID: PAT_TA_29867.pep
MDSASRVAPPPVSAGVRVRAPLVESVSCYCRLDTGLKTVVDARKFASGAKMCMQPDAKLTKRKSRGSRKERCRAQAPLLPGLPDDLAIACLIRVPRVEHPNLRTVCKRWNRLLSGNYYYSLRKKLSMAEEWVYVFKRDREGKISWHAFDPLNQLWKSLPPVPPEYSEAXGFGCAVLSGCYLYLFGGKDPLRGSMRRVVFYNARTNKWHRAPDMLRKRHFFGSCVINNCLYVAGGECEGIQRTLQSAEVYDPNRNRWVCIPEMNNGMVPFIGVVYDDKWFLKGLDSHRQVTCEVYLPSSNLWSTIDDEMVTGWRNPSISFNGRLYSSDCRDGCKQXHPGRARASEAAGLVSLNGKLCIIRNNMSITLVDILHPTMSIETDSACMWETVARKGQHKSFVANLWSTIAGRNLKSHIIHCQVLQI

SEQ ID NO: 135450 - protein, 90 aa, Triticum aestivum
  Clone ID: PAT_TA_29868.pep
SKTYTHRCMYISYAMFNPIWFSAHHIMPFRCTKSSRKLQYRGYIDLPDVGVVHPKPYPCPAMLVPTPPTRIEGIKPKSATRFPSSAEADD

SEQ ID NO: 135451 - protein, 207 aa, Triticum aestivum
  Clone ID: PAT_TA_29869.pep
RRSMAVSRSGAAGVAGGGDTTDDADRARLHQLGYKQELKRGLSLMSNFAFSFSIISVMAGVTTTYNGGLRYGGPASMTLGWLVVAFFNGCVALSMAEICSAYPTSGGLYYWSAKLAGEEWAPLASWVTGWFNIVGQWAATKSTDFSLAQLVQVIVLLGTGGANGNGYTHTVYVVPAIKLFFLVLPKSILKAAISGPVGGRGNHEFDY

SEQ ID NO: 135452 - protein, 177 aa, Triticum aestivum
  Clone ID: PAT_TA_29870.pep
MAEEAKQDVAPPAPEPTEDVADEKAAVPSPEESKALVVAENDAEKPAATGGSHERDALLTRVATEKRISLIKAWEENEKAKAENKAVKLLADITSWENSKAAELEAELKKMQEQLEKKKARCVEKLKNSAATVHKEAEEKRAAAEVRRGEEIVAAEEAAAKYRAKGEAPKKLLFGRG

SEQ ID NO: 135453 - protein, 142 aa, Triticum aestivum
  Clone ID: PAT_TA_29871.pep
PRVRSDFYFGDPYSPVNAPNTGFLYVRSSALMVGVFEAWRAARLSFPGKHEQQVFNEIKFELVDKRGLRVQFLDTVHNAGFCNNTRDFNTLYTMHANCCVGLAAKLHDLGNLMKEWRVYRGMDDAQRRRGPVRWKVPGICIH

SEQ ID NO: 135454 - protein, 303 aa, Triticum aestivum
  Clone ID: PAT_TA_29872.pep
HASAHASAPLEASHNTSQAAEDELERLLRTVADEHKTVIMTSVNEAWAAEGSLLDLFLESFRAGERIAHFVDHLLVVALDAGALERCRAVHPHCYLLPPVAGGNKNLSDEKVFMSKDYLDLVWSKVRLQQRILELGYNFLFTDVDIMWFRDPFERMSVAAHMVASSDFYFGDPYSPVNAPNTGFLYVRSSARMVGVFKAWRTARLSFPGKHEQQVFNEIKFELVDKRGLRVQFLDTVHNAGFCNNTRDFNTLYTMHANCCVGLAAKLHDLGNLMKEWRAYRGMDDAQRRRGPVRWKVPGICIH

SEQ ID NO: 135455 - protein, 366 aa, Triticum aestivum
  Clone ID: PAT_TA_29873.pep
AMDAPLPPPAYADGEQTDFVLIKKFGYLVDRQDATTATCVLQGPDIKGSIKVTFCAACPPRVSYFCVHATEYEHADFDLHPTILATEGPLVLLSVMLPSRSDIFHPEKEWDFVYQAATKDPEGKGKKVSHPSLKHLPNPGRHHEFEEASAALLRTCSKHRQAATNHDHLPHLPHGVTLRPRSSSRLTPRPHSSSGYILQHHGANKEEHNCEACQFVIAAKRSARVRRTQHELCLYHSEKEAWSIKTAIVLGNGPYNHHWTDKAITIGGDNGVVAWVNLARDILFCDVLAETPILCPIELPLLIPESEGVGTGDPRCSRDVAIVDGFIHYTQLQIRIGPGLVHRKMEPSHSMGWKLPNVAWQLTPVR

SEQ ID NO: 135456 - protein, 236 aa, Triticum aestivum
  unsure (1)..(236): unsure at all Xaa locations
  Clone ID: PAT_TA_29874.pep
MAYEIIDNIAAEGAPYYTPAQDPPAGTQTSGSTKVFTPITIRGVTFPNRLFLAPLCQYSAKDGYATDWHLTHLGGIIQRGPGLSMVEATAVQNHGRITPQDVGLWEDGQIEPLKRITTFAHSQSQKIGIQLSHAGRKASCVSPWLSINAVAAKEVGGWPDNIVAPSAIAQEAGVNPVPKAFTKEDIEELKNDFLAAAKRAIRAGFDVIEIHAAHGYLLHQFLSPVSNXRTDEYGGS

SEQ ID NO: 135457 - protein, 171 aa, Triticum aestivum
  Clone ID: PAT_TA_29875.pep
MAAMRTILLAVSAMAILSTASAAIYNVGEPGGAWDLSTNYGTWASSRNFHPSDQIIFKYSPQAHDVLEVSKADYDSCSTASPIATLNSGNDVVSLTATGTRYFLCGFPGHCAGGMKVKIDVVPSSSSSSPAPASGPSASNAPPPAPVSAATSIEATGFGLAVLLAVASLMA

SEQ ID NO: 135458 - protein, 253 aa, Triticum aestivum
  unsure (1)..(253): unsure at all Xaa locations
  Clone ID: PAT_TA_29876.pep
MSADTPPLPPPAPPLGALDPEPEPAQPLEPPEVMHKTRAVDFLGRRTPIVYQNDNGPCPLLAICNVLLLKNVISLNPDAGEVSQQKLLSLVADRLIDSNSSAQGRDEEYARNWEHNISDAIDLLPRLTTGIDVNVMFRKVDDFEFTPERAIFDLLDIPLYHGWIVDPQDTDTASAIGSKSYNALASGLAEFKSEKPAEDDKHXAEEETVDFAAATAAALGVPSPTVSLGISFDESTLSDSAELQMRRGDREED

SEQ ID NO: 135459 - protein, 177 aa, Triticum aestivum
  unsure (1)..(177): unsure at all Xaa locations
  Clone ID: PAT_TA_29877.pep
PRVRTAKVSLPEHRDYNMTTTIVQHEVEGLEVQLKDGSWFAVPPEPDTVVIVAGXLLNVKPDMHPSSPLPCMCAELLINVWLQVVTNGRVRACLHRVRTPSNRERFSALLGCMPTQGSTVRAMEQLVDEDHPLVYRPCDPYEYCAFKYSEEGRKSGDAHALMAFCGVAKDGPSCVMD

SEQ ID NO: 135460 - protein, 81 aa, Triticum aestivum
  unsure (1)..(81): unsure at all Xaa locations
  Clone ID: PAT_TA_29878.pep
SLAKAQKAAXLALQCLSVDSRNRPSMEQVVVALEQLHDAKEGGNSPRPQLQRKPSSNRSLTGSRPSSTKGNNNRPASSRPV

SEQ ID NO: 135461 - protein, 98 aa, Triticum aestivum
  Clone ID: PAT_TA_29879.pep
SKLFYHKCIFFAEVDLFASVPVQDKITLEYAARSGLIDSSKEQQNCWRRRWQMETEVSLVAEGRRHWTTSRSQPHSRRRRRWTGASGKGQRGQELRPV

SEQ ID NO: 135462 - protein, 159 aa, Triticum aestivum
  Clone ID: PAT_TA_29880.pep
ARSTRRFVHLWFAVVMKKLFNVPQDFLTKRDAWAGTFEGVVQTRTEPRTDCPEQLPTPTRIRQTEANEEAKLSSFQQEIVQLAAVLNGDHQLSSLQERIRERMNVREGTSYMRSAVRRFFEAGMSAKRMGLADDEQIVKMRPSLTTRMTSSPADQDDSP

SEQ ID NO: 135463 - protein, 181 aa, Triticum aestivum
  Clone ID: PAT_TA_29881.pep
ENLGSTRGLELDSSQISKSLPNLLVDEGTIAFERLHIGLPTLSLSPQEDDIVYFLAKIDYRDMERTAYVLAVDLRKKMIKSIAEFGAKNTIGLGQAYVASSLSKYLKIAPGTKQKKKRRGKTPLGSSSKKKHPGGVSTVTCLWLRSGLYGFRISWGIIKGSELACFILCFCQGFIYLRMNL

SEQ ID NO: 135464 - protein, 65 aa, Triticum aestivum
  Clone ID: PAT_TA_29882.pep
MEKGKAPAEAAESAAAYAARLAREWSTWAMKNTKVVAHYGFIPLVILVGMSSEPKPSLAQLLSPV

SEQ ID NO: 135465 - protein, 208 aa, Triticum aestivum
  Clone ID: PAT_TA_29883.pep
EQVIIHRDIKASNVLLDADMNGRLRPGAAVRPGADPQTTHVVGTMGYLAPELARTGKASPLTDVFAFGAFILEVACGRRPVEQAMNDSRLMLVDWVLEHWQKESLLEVVDARLDGNYDAGEVVLALKLGLMCSHPMPGARPSMRQVMQYLEGDMPIPELTPTQMSFSMLALMQSQGFDSFVLSATSDPSSATNTMMTMGTISGLSGGR

SEQ ID NO: 135466 - protein, 512 aa, Triticum aestivum
  unsure (1)..(512): unsure at all Xaa locations
  Clone ID: PAT_TA_29884.pep
GTRAHSAGYYDDETGAFNELLLISGKAMQVWVDYESDSTQISVFLAPLKNGAKPSTPLVSAKSNLSKVLVEPAYAGFSSSTGTVRSRHYLLGWSFAMDGPAPPIDIGSLPKLPFVGAKPRSKVPDIVLPIATAAFVLGVVAVVILLVRRRSRYAEVREEWEVEFGPHRFTYKDLFRATEGFKNKTLLGFGGFGRVYKGALPKSKLEVAVKKVSHESRQGIKEFVAEVVTIGRLRHRNLVQLLGYCRRKGELLLVYDYMSNGSLDKYLYSGSKEKPALDWAQRFRIIKGVASGLLYLHEDWDKIVIHRDIKASNVLLDADMNGRLGDFGLARLYDHGVDPQTTHVVGTMGYLAPELVRTGKATPVTDVFAFGVFVLEVTCGRRPPGRIAPDEQHVLLEWARAQERRRAGLDTVDPRLCGKYDADEAXLAIKLGLMCAHPLPDARPGMRQVTQYLDGEVALPEVVPTFLSYTTLALMQNDGFDSFAMSFPSTVTTDASPTSGDVSAVSGLSGGG

SEQ ID NO: 135467 - protein, 751 aa, Triticum aestivum
  unsure (1)..(751): unsure at all Xaa locations
  Clone ID: PAT_TA_29885.pep
MTVTPQITVSDGRPAVRGRTVLSGVPDGVTAAQASGAGLVDETSGGPAAGLGKRNGVFPXGTLRDCLLLCLLRSKPWTQXRRIAAPGSECRMATPPRLSGRPAAPGNDLVHIGPVGLVAPGAVRRAHRTAPQGXNDGGRRRRCIESGGTGAQTKXGHEKCXIQAGTRPLLTQAVKAVXEHMQTFHHREKKKVPSFVDWFGWCTWDAFYTDVTADGVKQGLRSLAEGGVPPRFLIIDDGWQQIGSENKEDPSVAVQEGAQFASRLTGIKENTKFQSKHDQDDTPGLKRLVEETKKEHGVKSVYVWHAMAGYWGGVKPSAAGMEHYESALAYPVQSPGVTGNQPDIVMDSLSVLGLGLVHPRKVYNFYDELHAYLAACGVDGVKVDVQNIVETLGAGHASVXAQHTRVPRALEASVARNFPDNGCISCMCHNTDMLYSAKQTAVVGASDDFYPRDPASHTVHISSVAYNTLFLGEFMQPDWDMFHSLHPAAEYHGAARAIGGCPIYVSDKPGNHNFDLLKKLVLPDGSVLRAQLPGRPTRDCLFSDPARDGASLLKIWNMNKCAGVVGVFNCQGAGWCRVVKKTRIHDEAPGTLTGSVRAEDVEGITQATGTDDCTGDAVVYTHRAGELVRLPRGATLPVTLKRLEYELFHVCPVRAVAPDISFAPIGLLHMFNAGGAVEECVVRTNEDDKAVVALRVRGCGRFGAYCSRRPAKCSLDSADVEFGYDADTGLVTVDVPVPEEEMYRWTLEIRV

SEQ ID NO: 135468 - protein, 187 aa, Triticum aestivum
  Clone ID: PAT_TA_29886.pep
GKTKTYFATAVSLWDADFYVKVDDDVHVNIATLGQILSKQAWKPRVYMGCMKSGPVLSEKGVRYYEPEHWEFGEPGNKYFRHATGQLYAISKDLATYISINKHVLHKYINEDVSLGSWFLGLDVEHIDDRRLCCGTPPDCEWKAQAGNTCAASFDWKCSGICNSEGRIWEVHNKCAEGDKALWNSTF

SEQ ID NO: 135469 - protein, 181 aa, Triticum aestivum
  Clone ID: PAT_TA_29887.pep
MAGRTFVDAAVRAMQEYVRVSDLALAAAVLFACNAATTRLKSRGRPMLWPVFGIIPTLFAHLDNIYDWGAAALARSGGTFPYRGMWGGGSSGVITSVPANVEHVLKTNFSNYPKGPYYRERFVELLGDGIFNADGEAWRAQRRAATAEMHSAQFHEFSARTVEQLVHGPADAAAAAAAEPG

SEQ ID NO: 135470 - protein, 283 aa, Triticum aestivum
  unsure (1)..(283): unsure at all Xaa locations
  Clone ID: PAT_TA_29888.pep
MSGQLKKTTRGEEAAQQRASSSEEQQQEKINEVRGLLDSLTEEMPSFLSDATIRRFLRARSWSTEQATKSLKETVKWRRQYRPDAISWDDIPETENEARRTHVADYLDKNGRSVLVANVPMKSKVSAKEQIKHLVYLLEYLATNSADEQDDFVVWLTDFRGWSISSTSLSIAREPMHIIQNYYPEADKPWRFLWKLSXIFESFWTXARNFVQYMLKSRRASRHSLTSLSWIRWADIFDLDTLESSFGGRSTGTAFHINKYAERMRRADKMRGASKDSNGHNHN

SEQ ID NO: 135471 - protein, 206 aa, Triticum aestivum
  unsure (1)..(206): unsure at all Xaa locations
  Clone ID: PAT_TA_29889.pep
XXXXXXXXXXXXXXXXXXXXXXXXXXXXXXXXXXXXXXXXXXXXXXXXXXXXXXXXXXXXXXXXXXXXXGSPSXXXPXXPPSRGLVGRGDMRVARPPPGAALGGRPAAWRGVQPPAPSWRRPPRPAAPAPCTADRSPWASAGSRRSQEACCSCCCIPGPGRCVKSDASSSWNWNSPDIGATLYCLAACGKXXDWCSSSXVXGAVTG

SEQ ID NO: 135472 - protein, 125 aa, Triticum aestivum
  unsure (1)..(125): unsure at all Xaa locations
  Clone ID: PAT_TA_29890.pep
MAALRRATRESAPRRRALCVPQLLAALRRVLLSARHSAAARADATAALANLSLAAVNQSKLARAPGAAKNLLSISSDSNEPLPIRRLALMVICNVGDCTEGRTALMDAGADSTXGGVLGGDAYRG

SEQ ID NO: 135473 - protein, 177 aa, Triticum aestivum
  Clone ID: PAT_TA_29891.pep
AAIEEQQQISSKSKDMGLDYNAFIEMDTLHSCIKEALRKHPPTPMLVRRAHKQFMVKTKEGKEYDIPQDHIVATPTIVTNNISYIYKDPQVYDPCRFGPERREDKVGGKFSYTSFSGGRHICTGEAYAYMQLKVIWSHLLRNFELELISPFPKTDWGKFLPEPQGKLLVKYKRNGIL

SEQ ID NO: 135474 - protein, 154 aa, Triticum aestivum
  Clone ID: PAT_TA_29892.pep
RAPVAPSSIPIWIEGTRSSCLPETPTAGLLLAPPLRPAPPRPLEPGKPWPELGLEVPAAVSCSFCPAASPPELAVAPPPALVASTSAPGNPRSPARWSTTADDGCLVVCDGCSSHAQTRVGAASSSSCPPAASLPVPYCRLPVITGSPGPLLLT

SEQ ID NO: 135475 - protein, 123 aa, Triticum aestivum
  Clone ID: PAT_TA_29893.pep
AGRPGPAGTSLTITFQPQLPTRYQSINMKASFVVSLLLSLGVSATPAVDTTTIEDGGFTYTGIDKPLLALRGLEARCDCFPCYSPHADCSPGKCQCAGDYGCWSCGGGRMQCQPGPGSGQCWT

SEQ ID NO: 135476 - protein, 207 aa, Triticum aestivum
  Clone ID: PAT_TA_29894.pep
ERRQDSSIGFGAPIRTNMRSSGVTSPTITSSLLESVESGDLCKFGLIPEFIGRLPILVSLAALDEDQLVQVLTEPKNSLSRQYRKMFSLNNVKLHFTDGALRIVAKKAIVKNTGARGLRALLETILLEAMYEIPDEKAGNERVDAVVVDEEAIGSVDRPGCGAKILRGDGALAQYIIRNNIPNSPETNEALAGELEDAYMLSRIVSL

SEQ ID NO: 135477 - protein, 115 aa, Triticum aestivum
  Clone ID: PAT_TA_29895.pep
LHNACMPTNWWQKWSFLLRKGRKGFTNKTRPSIQKIYKVLALNFRIPRSDVSALFQLSNMQSLWYAALSPPPATLSRPTASLETGAYPYPDSISASPSSLVYSHILLWILGWMLT

SEQ ID NO: 135478 - protein, 309 aa, Triticum aestivum
  unsure (1)..(309): unsure at all Xaa locations
  Clone ID: PAT_TA_29896.pep
MDAAARKRSRPESANGGAAGGKRSRESESQQTGLSSKSKPCTKFFSTVGCPFGEGCHFAHFVPGGYQAVSKSHSLGHAAVSAPSRAPADHAASGVKTRMCTKYNTAEGCKFGDKCHFAHGERELGRAPSSYMSQESSYAPPMGGRYGGRHEPPPPASTSSMGPPAGNFGASSTCKVSVDAALAGGIIGKGGVNTKQICRITGRKLSIRDHEXNPDLKNIELEGSFDQIKQANDMARDLIASISASTPSKNRCSGAAPLLRGVVGGGVGPGGRIDYRAKTCENFLKGTCTFGERCHFAHGETEQRKGAAV

SEQ ID NO: 135479 - protein, 362 aa, Triticum aestivum
  unsure (1)..(362): unsure at all Xaa locations
  Clone ID: PAT_TA_29897.pep
MVAIENQSQAQRPAEPARIPKEARRLLHDLAAAWPNVADCRALEVVPLKGAMTNEVYQVRWLTAPAGGEAGAXAGALKEREVRKGLVRIYGDGVDLFFDRDDELRTAGCMSRHGQGPRLLGRFPNGRVEEFIHARTLSAPDMRDPEISALVATKLREFHNLDMPGPKHVLLWDRLKNWLKTANNLCPTDQANELRLDCLEDEIASLEKEFSGDYHHWIGFCHNDLQYGNIMMDEETNMLTIIDYEYASFNPVAYDIANHFCEMAADYHSEKPHILDYSKYPDIDEQRRFVKTYLSTSREEPETEELENLLQSVEKYTLASHLVWGLWGIISDRVSDIDFDYQEYARQRFKQYWQRKPAVLTS

SEQ ID NO: 135480 - protein, 115 aa, Triticum aestivum
  unsure (1)..(115): unsure at all Xaa locations
  Clone ID: PAT_TA_29898.pep
MPCCHWVLSVAESSSNNKTPSWLHRLHTKGGLSFPSHLQIDDLLYGRIQPPPPSPPPPVPPPPPPSDRDAAATNPQDPPPNPKSXPQSTPQPRPPKPXRLPNXNHSPPXXSPAAV

SEQ ID NO: 135481 - protein, 54 aa, Triticum aestivum
  Clone ID: PAT_TA_29899.pep
VNLQQSANSMYKNNKVIFGQIDADERQTVQTNKIHHPNNNNDDNQRPHSSHTRR

SEQ ID NO: 135482 - protein, 187 aa, Triticum aestivum
  Clone ID: PAT_TA_29900.pep
ATGPHIASRMLYTAENSFDDIAGKVVADFGCGCGTLAVASALLDAEHVTGIDIDLQSLELAQENATDLELDIDLIQCDIKNLNLKGLLVDTVVMNPPFGTKRKGADMEFLSMGLKVASQAVYSLHKTSTREYIKKAALRNCNAVSAEVLCELRYDLPRTYRFHKQKELDIAVDLWRFVPQARDERAS

SEQ ID NO: 135483 - protein, 169 aa, Triticum aestivum
  Clone ID: PAT_TA_29901.pep
MRRSDWEDRCRRHPEHRLSKGVCPSCLRDRLAHLSANSSATTTLTRASNSASTSPYSSTDSPPLHRAALSADATSVHVVGSGAGSSFVNVSAFSQPLMPTASKKPAEAKGKEGEAKKKKKSSSKKKIGRFLSRLVGTEKRRKTGEAGDGGELFHSSTMKEKSSTKWVFF

SEQ ID NO: 135484 - protein, 226 aa, Triticum aestivum
  Clone ID: PAT_TA_29902.pep
MAVSSYFLVFALLALASWQAIASDPSPLQDFCVADNSSHVLVNGFVCKDPKDVKAEDFFLAAKLDMPRDTKTNKVGSNVTLINVMRIPGLNTLGISLARIDYAPLGENPPHTHPRATEILTVLEGTLYVGFVTSNPDNKFLSKVLNKGDVFVFPEGLIHFQFNPNPYKLAVAIAALSSQNPGAITIANAVFGSKPAISDDVLAKAFQVEKNTVDWLQAQFWADNHN

SEQ ID NO: 135485 - protein, 100 aa, Triticum aestivum
  Clone ID: PAT_TA_29903.pep
LAAKKREIPVRGYVSCVVGCPVEGSVPPSNVAYVAKELYDMGCYEVSLGDTIGVGTPGTVVPMLEAVMSVVPVEKLAVHFHDTYGQSLSNILVSLKHWYN

SEQ ID NO: 135486 - protein, 134 aa, Triticum aestivum
  unsure (1)..(134): unsure at all Xaa locations
  Clone ID: PAT_TA_29904.pep
HVASLIYSGTVVPMLEAVMSVVPVEKLAVHFHDTYGQSLSNILVSLQMGISVVDSSVAGLGGCPYAQGASRNVATEXDVVYMLNGLGIKTSVHLSKVIXAGEFICKHLGRQSGSXXTTAXNKGYRERLKAMRLP

SEQ ID NO: 135487 - protein, 215 aa, Triticum aestivum
  Clone ID: PAT_TA_29905.pep
MDTSHSCDVEISNRNVGTGEAEHVDVDSPLSNGTCRRIKVKKVGTRIDPSDTSLVVKDGYQWRKYGQKVTRDNPSPRAYFRCAFAPSCRVKKKVQRSAEDSSVVEATYEGEHNHPHPTRAGELPSCATQGGGSVPCSISINSSGPTITLDLTKNGGGVQVVDAGEAQPDMKKVCREVASPEFQRALVEQMARELTGDQKFTDALAAAILRKLPDY

SEQ ID NO: 135488 - protein, 286 aa, Triticum aestivum
  Clone ID: PAT_TA_29906.pep
PTRPPTRPDKTLAPRLAELRDLGLSPSQIARLVLVDPARFRRPTIISKLQYYVPLFGSFENLLQALKYNSYLLSSDLENVVKPNVALLRECGLGDCDIAKLCIPVPRLLTSKPERIQAMVARAEDVGVPRGSAMFRHALLAVAFLSEEKIAAKVEFLKKTFRWSEAEVAIAVAKLPVVLRNSQERLLRMSEFLMSEVGLEPEYIAHRPAMLACSLEARLKPRYYVVKLLKEHGLLKPNRSFYTAAQVSEKVFVEKFIRPHKEAAPRLAEDYAATLKGEVPTRFRLQ

SEQ ID NO: 135489 - protein, 293 aa, Triticum aestivum
  Clone ID: PAT_TA_29907.pep
MEVSADAAAAAAARTLRWAGRAGHLRGVPRAAVIGAVGTIAKAYVSLLNTTTVHNADALHRLVSSRPPGTPLLTVSNHMSTIDDPFMWGFKGFPITDSKLARWVLTAEDICFRNVFMSYMFRLGKCVPITRGAGIYQDHMNEALEVLSTGGWLHSFPEGKVAQDHQPIRRLKWGTASLIVRAPVTPIVLPIVHTGFEKVMPEKSFFGRRPPLPLCGKEIQIIVGEPVDFDLPGLKQVAAMIPQDTSFGRKGWPTITPEGLDEAAQRWLYQKMSDKIQSAMESLRKTLLNLKQH

SEQ ID NO: 135490 - protein, 78 aa, Triticum aestivum
  Clone ID: PAT_TA_29908.pep
KQHTPYNPVLNLTQRQYSIVTRAKASSWSTHTHTHTHTDTRAMRCRSDALLVVEELGEAGGEGFHDVRRQHHADRTRG

SEQ ID NO: 135491 - protein, 198 aa, Triticum aestivum
  unsure (1)..(198): unsure at all Xaa locations
  Clone ID: PAT_TA_29909.pep
ESSDTVESGRVSKAARGAWGRAVRLEETDKFYQVVKKLFLSGIAPRVGGGVAITAVHKVAQGPRCRAFQQQGQLLAAARGADGGNAKFAWYGAPSADVAAAVEHGFGRTNSRVLGHRAHGDGVHLSPPQSPYASAMLANADENGEAHIVLCRVLMGRPEAIPAGSSQLHPSSDDYDSAVDXMQNPQWYVVXWSKDMNT

SEQ ID NO: 135492 - protein, 432 aa, Triticum aestivum
  unsure (1)..(432): unsure at all Xaa locations
  Clone ID: PAT_TA_29910.pep
MDFSGDVKQAIPRPAVAFGGVGSAGPSPLLRGWREFRRSGAPVRFLCFEGGAWADVVGEAAVPLRRAFLDGRVVAEAAYGGREFLFDFLRMVRIDAGTAQEVAMGWIDDRGACFFPVPDSGRKRKRGEPELEDGALSGVEEGSDESSDTVESGRVSKAARGAWGRAVRLEETDKFYQVVKKLXAAGGVAITAVHKVAXGPRCRAFQQQGQLLAAARGADGGNAKFAWYGAPSADVAAAVEHGFGRTNSRVLGHRAHGDGVHLSPPQSPYASAMLANADENGEAHIVLCRVLMGRPEAIPAGSSQLHPSSDDYDSAVDNMQNPQWYVVWSKDMNTRILPEYVVSFKCPSLHQMQGSSGATSALKKPSPVARDMFPTLLAEIQRFVPSSKLETLQGTYNRFKKGQMKKDQFIRFLRAFIGDRVLTAVAKKLRGY

SEQ ID NO: 135493 - protein, 201 aa, Triticum aestivum
  Clone ID: PAT_TA_29911.pep
MSWWRSKPHFSADSQDSSSNDAYRGGKDRSPSRREKSDDDEEEYRPYAGYGANTNRGGANEGGGGGGGHNGGYGGGGGGYNNGYGGGGSYSNGNGGITPYNGGGGGYNSNSSYGNGGGGYNNSSYGNGNGGDGYNNAPSWASQDTGGRTPMVHKHQGGPRLWGAAERRRLQRRPEAAWWRRRRGQRVLRSGLPCRRPFRRS

SEQ ID NO: 135494 - protein, 211 aa, Triticum aestivum
  Clone ID: PAT_TA_29912.pep
MATGSMETALMSDPTAKLPDDLLVEIISRVPFKSTRCCKCVSTRWRDLIAHPDHREKLPRSTLAGFFYKTYDIASRPYDSHGYLSVSGNWCPIDASLSFLPKWEKIDLLDCCNGLLLCRCSKPYPEEPDYLVCNPATEKWVTFPANEWSSESYARLGFDPAVSSHFYVFELVPAVGAVVGLEVCMAHRRSGDLLVQSWEAGTHQIEWGRSN

SEQ ID NO: 135495 - protein, 516 aa, Triticum aestivum
  unsure (1)..(516): unsure at all Xaa locations
  Clone ID: PAT_TA_29913.pep
MASYDKAMESYKKAVTTAASLAASAMLVRGVVNELVPYEVRDLLFSGMGYLRSHMSSQHTIIIEETEGWANNQLYDAARAYLATRINTDMQRLRVSRVDETKSMMFSMEEGEEMADVHEGTEFKWRLVCRDNSSASSSNANGRGGSGNFKLEVRSFEMSFHRKHKDKALTSYLPHILAVAKKIKEQNRTLKIYMNEGESWFAIDLHHPSTFSTLAMDHKLKQSVMDDLERFVKRKEYYKKIGKAWKRGYLLYGPPGTGKSSMIAAMANYLKFDVYDLELTEVNWNSTLRRLLIGMTNRSILVIEDIDCTVELQQREEGQEGTKSNPSEDKVTLSGLLNFVDGLWSTSGEERIIIFTTNYKERLDPALLRPGRMDMHIHMGYCCPKSFRILASNYHSIDHHATYPXEIEKLIKEVMVTPPKVAKVLMRNEKTDVALKGFIQFLKKKKNGAGKQENVAQVAKEEDQKKKMMPKSFVPANQDQQNGSKKLCVSSANIVQLVPGTSGTNVSFCYNKRSIL

SEQ ID NO: 135496 - protein, 216 aa, Triticum aestivum
  unsure (1)..(216): unsure at all Xaa locations
  Clone ID: PAT_TA_29914.pep
PQGRAGGVQFELNGRCIYLVGMXMGSGKSTVGKILAEVLGYSYFDSDSLVEQAVGMPSVAQIFKVHSEAFFRDSESSVLRDLSSMHRLVVATGGGAVIRPVNWRYMKKGLSIMLDVPLDALAKRIAQVGTASRPLLDQPSADPYTAAFTKLSLLAEQRGDAYANADVRVSLEELAAKKGHDDVSQLTPTDIAVEALQKIKNFVTEHSMASGPFDDL

SEQ ID NO: 135497 - protein, 375 aa, Triticum aestivum
  Clone ID: PAT_TA_29915.pep
MDDLLGLGFPGPGGYDGEDEEAMRSLYAGAPAEEEEEVDEGYAVAAMKAGDERGIGKEGLRKRLLIEGEGSQLPGAGDEVEVHYTGTLADGTKFDSSRDRDAPFQFTLGRGQVIKGWDLGIKTMKRGENAIFTIPPELAYGEDGSPPVIPPNATLQFDVELLSWASVKDICKDGSIFKKILAEGEKWENPKDRDEVFVKYEARLEDGTLVTKSDGVEFTVKEGHFCPAIAKAVKTMKKNEKALLTVKPQYGFGEQGRPASRDEAAVPPNAMLHIDLQLVSWKTVTEIGNDKTILKKILQEGEGYDRPKDCSTVKVKLIGKLDDGTMFVKKGHDGEEPFEFKTDEDQVIEGLDKAVLSMKKGEVAFVTIPPEHAFG

SEQ ID NO: 135498 - protein, 369 aa, Triticum aestivum
  Clone ID: PAT_TA_29916.pep
MAAAVTVDEVMKMQRAQGPATVLAIGTATPHNCVYQADYADYYFRITNSEHLTDLKDKFQRMCDRSMIRKRYMHVTEEILKENPNVCAYMAPSLDARQDMVLGEVPKLGKEAAHKAIKEWGQPLSKITHLVFCTTSGVDMPGADYQLTKMLGLHPSVRRVMLYQQGCFAGGTVLRVAKDLAENNRGARVLVVCSEITAVTFRGPCDTQLDSMVGQALFGDGAAAVVVGADPDVLVERPLFQLVSASQTILPDTDGFIKGHLREGGLTFHLHKDVPVAISKNIQQALEDAFAPLGIDDWNSIFWVAHPGGPAILDMVEAEAKLDKRRMRATRHILSEYGNMSSACVLFILDEMRKRSAEDGHATTGEGLD

SEQ ID NO: 135499 - protein, 263 aa, Triticum aestivum
  Clone ID: PAT_TA_29917.pep
DGILVNTFESLDAGVVAALGDPRCLPGRIMPPVYCVGPFVGGVGNEAKDRHECLTWLDGQPDSSVVFLCFGSAGNHSAEQIKEIAVGLENSGHRFLWVVGNPFSDDQDFDALLPNGFLDRTRGCGLVVKQWVPQADVLHHRATGAFVTHCGWNSVLEGVTAGVPMLCWPLYAEQKMNTLRMVGEMGVAAEMVGWERGLVEAAEVEGKVRLVMDSEDGMELRARAAAHKEGAATAWSDGGSSRAAIARFLADVDSRQPQTRGDR

SEQ ID NO: 135500 - protein, 256 aa, Triticum aestivum
  unsure (1)..(256): unsure at all Xaa locations
  Clone ID: PAT_TA_29918.pep
SFGFXCXDELVSPNGHIRQSVFLIASNAAAILPAFWALRQKAFAEWILYTSSGISSALYHSWDVGTWCILSFRVLQFLDFWLSFMAVVGTFIYMATIKEASKRAMHTAVFILTAILAATGATRSANIGIVVAIGSFGLLIGWILEFSTARRFVCCSWRINLNVPHRWPNLAALFXNTLEMLNKRFPFGCIYFXFITLPFAALSWXXESXXSYWVWXSMWHITIYTSHPLLSQCVQHYEHGDNYFEQILPTNHRDGE

SEQ ID NO: 135501 - protein, 135 aa, Triticum aestivum
  Clone ID: PAT_TA_29919.pep
PWWRQNAAESSSFTKPFIQGFVSAVCQPSSSSMLVWGCEPQQGIDTSRMPNTMARTPPCHLQQLQSRCCHVVLHPLFLPICPQTPNHLSSLPMVLHSVAQLPDLHACGHVALASPIRMTSMALKYSVVCLRCVPM

SEQ ID NO: 135502 - protein, 217 aa, Triticum aestivum
  Clone ID: PAT_TA_29920.pep
MSKITVANVRTQVGELLEYSNETKKRNFLETVELQIGLKNYDPQRDKRFSGSIRLPSIPRPNMSICILGDQHDIDRAKHGGVDAMSADDLKKLNKNKKLIKKLARKYDAFVASEALIKQIPRLLGPGLSKAGKFPTPVSHADDLTGRINEVKSTIKFQLKKVLCMGVAVGNVEMSQEQLVGNIMLAINYLVSLLKKGWQNVGSLTIKASMSPPKRLY

SEQ ID NO: 135503 - protein, 201 aa, Triticum aestivum
  Clone ID: PAT_TA_29921.pep
DPASGYFDTQLNPNGSQGDAMVSPSTSPMSSPHRFQKPQAGFLPSSPYPLPSCSLSSVACSHPRRGSENEGRFPSSPNDMCHGADLRRTALLRSVQMRVHGPHAYDPSFGSRQEQEHVHEHDDEHGHEHLEDLGGPERPSCRKSIDNEASGYQGAENSYGRQEHDIDYIHGCTADDVLSGPKFKQEDDNQGNSDASMDKTR

SEQ ID NO: 135504 - protein, 93 aa, Triticum aestivum
  Clone ID: PAT_TA_29922.pep
NRPGPLEWNHFITLHLVRQSKTPQDHPCTLYTPSINTIKHEVEFYIHRECMNLGNLPYLFSTYIIRLAVTPNRVICLVPNQCFPCTMLSTIIM

SEQ ID NO: 135505 - protein, 249 aa, Triticum aestivum
  unsure (1)..(249): unsure at all Xaa locations
  Clone ID: PAT_TA_29923.pep
CRFGTRHPYRRRRLNPRRPRSLPTRNARWRRGRSRPGRRQRGPRACGPCPPATRPGTGASRPPPRAPPTGSAPTAPPSREPNPGPSAAAASLRSRFPAPRRPRPRQAHGLDPGGPVKVLNAPWPDGRGGHLRGPARRRPPRXHDANHNLSFYVPPQLPVVPVMGDEWVLHIDGDYQYALVGQPPRKXLRVIRGPPKDDGLWCMEPLEGAKEEGHDVSKLRMRADPEPAPESKDTPMDGGVWWIKSLFGK

SEQ ID NO: 135506 - protein, 171 aa, Triticum aestivum
  unsure (1)..(171): unsure at all Xaa locations
  Clone ID: PAT_TA_29924.pep
IVADAHAPRLEVVKFGFLARLRVMEWSHGAASNXREVAIGACHALTHMTWVQHLPCLESLNLSGCNGMTRLVGGAAEGGSEAEEVVTFPRLRLLALLGLPRLEDIRGGGGECAFPELRRLQTRGCSRLRRIPMRPVAGGQGRVRVEGDKHWWNGLQWASDDVKACFVPVLL

SEQ ID NO: 135507 - protein, 73 aa, Triticum aestivum
  Clone ID: PAT_TA_29925.pep
QSQRSAVGQTELARARSIQKSMQGMATVLLVGPLVRQRRRRRRWHMGTRHHRRRRYGGGRHGRRRRGPRPDAW

SEQ ID NO: 135508 - protein, 231 aa, Triticum aestivum
  Clone ID: PAT_TA_29926.pep
PRVRPSSPATHPATPVSVSLPTHPTSTRTDRDTDMTTQLQQTPMAARRFLQAAAEGVSTPGARTIADDRDIVIILASLLCALITVLGIGLVARWCACGGAEARVRAAANRGVKKSVLRAIPTVAYVSADAGKGKGKGKEEEDAAAPECAICLAEFEDGEAMRVLPQCGHAFHAACVDKWLGGHSACPSCRRILGVHLPAGHRSQRGVPRPDHADQAGKAEGQFREMASFVP

SEQ ID NO: 135509 - protein, 228 aa, Triticum aestivum
  unsure (1)..(228): unsure at all Xaa locations
  Clone ID: PAT_TA_29927.pep
LSXIRLFLEKIRPIDKKMEYQIQKLTNAADGAAAQDKVPDAEVNVKGRQQGEDDLLGYRPNPDMMDPKIVSEGQGKDGIYVPPRIGPAAMDDSHSKDAVRKEKRLLRMATENPYFKEMIDDAADRPEEWKETAGDESKEFMAYMRQREKQEKAEEELFTRAPVTKREKYMEKQMKKQLHGLQGLTDGFDLGMNTLLDGEKEDDGGSSEPRRQSAGRRKHQKGGKRKRH

SEQ ID NO: 135510 - protein, 246 aa, Triticum aestivum
  Clone ID: PAT_TA_29928.pep
PTRPVLCLVYKVVDYAVEAEWKPCYCSAAAREDGGGGGVATGAKGALSFVAPRAAAGTAGPKVVRLSSSSANKMQLEDVSDTLYVRASLLSDATRKPGPIAPALTVSPAIAELIRGKIDRAPRPPRQAPCWSDCDCKMCHSWSTGSRASHLYVHVQAPPPPGAGAGEQEAVIFIHGFISSSVFWTETVFPAFSPAARGRYRMFAVDLLGFGRSPKPADSLYTLREHLEMIERSVLQRYRLNFFHVV

SEQ ID NO: 135511 - protein, 230 aa, Triticum aestivum
  Clone ID: PAT_TA_29929.pep
KKRKKRKATGHTRHGLAQRDDDGNDGGVGTHYHGVRKRPWGRYAAEIRDPAKKSRVWLGTYDTAEEAARAYDAAAREYRGNKAKTNFPFAPASAPPAAAAALTVDGSRSSNSSTVESFGGDVQAPMQAMPLPPSLDLDLFHRAATSTAGAGMRFPFSGYPVSHPYYFFGQAAAAAAAGCHMYSQAPKVTVASVSPSDSDSSSVVDLAPSPPARKPVPFDLDLNCPPPAEL

SEQ ID NO: 135512 - protein, 451 aa, Triticum aestivum
  unsure (1)..(451): unsure at all Xaa locations
  Clone ID: PAT_TA_29930.pep
MSVSCGLECVLCVGCVRWAWKRLTYIGAYDSETWPPASPDDFEPVPRICQIIMAISDDLDNPKLMPATRGYTQIDGAGVHKRTTYDEVGTACHNYIVYVARPLDVVDVADLSQEETHEGACPASSSDTHSETTSSEPKSAGRTSWDELVVLERETETLRELLRQQGPDCKLIFAGHSLGSGIAALMXVLVVNNRKAFGNIPRSHIRCYALAPARCMSLKLAVMYADVIYSIVLQDDFLPRTPSPLQVLFGSIFCLPCLLFLFCLRDTFKQDKKKFKDPRRLYAPGRMYHIVERKFCSCARYPPEVRTAIPVEGRFEHIVLSCSTTADHGIIWIERESALALELMKENEKATTPPAEQKMERLQSFKEEHKNALHRAKTLDVPHAIDISEEETHEGACPAPSSDTHSETTSSEPKSAGRTSWDELVDKLFTRDEDGKLIVNRDMVARDVVIE

SEQ ID NO: 135513 - protein, 244 aa, Triticum aestivum
  Clone ID: PAT_TA_29931.pep
MQEAGMSALWNTVHGWFTPWVLFLVLHLIVATIFVTSRATSSAGSGEGAPAGAVGERRSLSLVDSMAIDRPHFTAPAPEAPVTGLLDLGQPDEQPPPLQMEPEDQGEHDAFTKEGELDEHTHMERSMSEAAVEAELPRLPTRLRKSASDKPAFAHFVAESDTKEVEGRRRATRRDAERRRPLVAEPEEPASEVEIEEAGGEVDARADEFINRFHHQLKMQHMDSFMRSQKRLHRRRATVVPEAR

SEQ ID NO: 135514 - protein, 94 aa, Triticum aestivum
  Clone ID: PAT_TA_29932.pep
YECRLSPLSSLSNIEDSQICVYILAISMNIHAHSAPSISQLFCFQIAAFVIKTLLLTPHGLLRGQGMYSFTLKNSDVISANHVGCIPIDPFMSQ

SEQ ID NO: 135515 - protein, 76 aa, Triticum aestivum
  Clone ID: PAT_TA_29933.pep
FARKYDYFNLTSQKNLQDNLKTNWAAMFFFSVKVLFGSQIIHWKELVPAGIGKIPVFLAGPKYERKTIYCISDVYP

SEQ ID NO: 135516 - protein, 165 aa, Triticum aestivum
  Clone ID: PAT_TA_29934.pep
MAFGSTARNQANTSRFKFSSKAQSQLQQASQLPTLPLQILSHQTSHPSIMDASDEMKYKQTQEHFGVERKPTMGHVDKSRLRAQPSSGVRLESARPKTQDGLESNVRLEAAKRRLQERYQEAENAKKQRTIQVMELGDIPKPKSNTRQPMVKSRNNIRSRVLGRR

SEQ ID NO: 135517 - protein, 385 aa, Triticum aestivum
  unsure (1)..(385): unsure at all Xaa locations
  Clone ID: PAT_TA_29935.pep
MGLDYYKILGVDKAASDDDLKKAYRKLAMKWHPDKNPTSKKEAESKFKQISEAYEVLSDSQKRAVXDQYGEEGLKGPGAAAGGRRRRGRAGGRHLAPHGRRRGPRRCGDAEGTAGGRLGGGPGAPADAGRAQPGGAGHRGDPPGXERRCCAAAASRSPRVRPRPVFGGSGAAAGPPPAPPPAGGPAAGRACPGMFGSGGGGGAPLRAAPIERKLPCSLEELYKGTXRKMWIPRGVPDVRGKTIPVEEILTIDVKPGWKKGTKITFPEKGNEQPHTIAADLVFIIDEKPHAVYTRDGNDLVATQKIPLAEALTGYTVHLTTLDGRSLTVPISSVIHPGYEEVVRGEGMPIPKDPSRKGNLRVKFDIKFPARLTADQKSGVKRLLGQ

SEQ ID NO: 135518 - protein, 237 aa, Triticum aestivum
  Clone ID: PAT_TA_29936.pep
MDKLPKRPANYVPLSPVGFLPRASAVYGDRTSVVYGRLKFTWSQTHERCRRLAAALVSLGVRKNDVVSVLAPNVPAMYEMHFAVPMAAAVLNTINTRLDAKAVAVILRHAQAKVLFVDYEYVRLAHDALQIVADAGAPVPLVAVIDDIDRPTGVRLGLFKLEYEALLSKGDPAAELPSLADEWDAVVLNYTSGTTSAPKGVVSSHRGAYLNTMGQLLSWGVGNEPVYLWTLPMFHCN

SEQ ID NO: 135519 - protein, 358 aa, Triticum aestivum
  Clone ID: PAT_TA_29937.pep
MSDQPATVAAPAARSDLASAVESAPAPQPELVPAADPQDGDESEADSAVGDDAASSTASITSSILEYRTIQGRTFHSDRHPTEYFTPNDEQQSASIDINHQALTLLLGGKLFLAPVKPNVQRVLDVGTGTGIWAIDFADEYPEAEVIGSDLSPIQPTWVPPNVKFEIDDASLRWTWDNNTFDFIHIRYLFGAIKDWTSLFQEAYRCCAADGWIQSGEADVHIRSDDGTTDDIDCLKLWAKLFTEGGKLLGNSFFVQDGDLQEKGIHEAGFPDIKSIEYKFPIGGWPKDPELREVGNFVRATLENDLEGYTLLLWKTIFQWPDDEYQVFFMEMRKFLRNRKVHPYMTVRYVYGRKAGES

SEQ ID NO: 135520 - protein, 148 aa, Triticum aestivum
  Clone ID: PAT_TA_29938.pep
MSAASRGVRALAMLGRCVRAPFRALVRARDLYVSRMAACAAGRGPVGIAAVSRSRSHGFHFHHSAGGDGAEADVRELIRAASHAGPPSPAGVGPRSQSVAIGRIDEDRPCEFGLDDGAAAHALGPRSRSCAVGSTAKMPRRLGAVATA

SEQ ID NO: 135521 - protein, 225 aa, Triticum aestivum
  unsure (1)..(225): unsure at all Xaa locations
  Clone ID: PAT_TA_29939.pep
VPPPFAAAAIMEALEAELDLVVCITEGIPQHDMVKVKAALNRQSKTXLIGPNCPGIIKPGECKIGIMPGYIHKPGRIGIVSRSGTLTYEAVFQTTAVGLGQSTCVGMGGDPFNGTNFVDCLEKFVDDPQTEGIVLIGEIGGTAEEDAAAFIRESKTEKPVVAFIAGLTAPPGRRMGHAGAIVSGGKGTAQDKIKALRDAGVTVVESPAKIGSTMFELFKQRGMVE

SEQ ID NO: 135522 - protein, 120 aa, Triticum aestivum
  unsure (1)..(120): unsure at all Xaa locations
  Clone ID: PAT_TA_29940.pep
CALXAXWVGLLYTRPDDESLQSIIDMTSDWTKEEREMLRRKVPVTGLKTPFRDGYVRDLAEDVLQLAKNGLERRGYKEVGFLREVDEVVRTGVTPAEKLLNLYETKWQRSVDPVFEELLY

SEQ ID NO: 135523 - protein, 317 aa, Triticum aestivum
  unsure (1)..(317): unsure at all Xaa locations
  Clone ID: PAT_TA_29941.pep
MAASCRRASQMLGPAACRLLYSRGYAGAAAAPSPAVFVDVSARVICQGITGENATFHTDQAIEXYGTEIVXELFPGKAGNEDRNCPVLNSSIKLXQRTKGNGSVVYVPPPFTAAAXMDGLEAALDLVVCITEGMPQDDLDKVKAVLNKQTVKVMVVLNRQSKTRXLIELKCPGIIKTSECKIGIMPGFIHRPRRIGRVFRSGTLTYEAVFQSTAVGLGHLNCVGLGGDPFKVSXNFVDCLEKFVDDPRTEGTDIVGEIGGTAEEDAEAFIQLSKGVNPAVALIMGLVSRPGRRMGHAGAILLGGERGPARRQFQGDW

SEQ ID NO: 135524 - protein, 176 aa, Triticum aestivum
  unsure (1)..(176): unsure at all Xaa locations
  Clone ID: PAT_TA_29942.pep
AGDAGRAGGVLVVVGRIGGGGGGGXGALPRFAEAPEYRNGEGCPAAVAGAGVCDPGLVHIAMTLDAHYLRGSMAAIYSLLKHASCPESLFFHFLAADGAAPGVAELRSALAASFPSLRFEIYPFRADAVTGLISASVRAALEAPLNYARNYLGDLLPKCVPXAIYLDSVLLSVDYV

SEQ ID NO: 135525 - protein, 393 aa, Triticum aestivum
  Clone ID: PAT_TA_29943.pep
MAFGLPPAAAAVVTLVLGLAAASAVADDVEMVFLKSAVAKGAVCLDGSAPVYHFSPGSGTGANNWIVHMEGGGWCKTPEECVIRKGNFRGSSKFMKPLSFSGILGGNQQFNPDFYNWNRVKVRYCDGSSFTGDVEEVDSKTNLHFRGARVWDAIIEDLLNKGMSKAKSAILSGCSAGGLSAVLHCDKFKDLLPPSAFVKCVSDAGYFIDGTDITGNKFVRTTFKSVVTLHGSVKNLPSSCTSRVSPELCFFPQHVLPTMKTPLFILNAAYDSWQIRNILVPSAADKKKEWAKCKADIKGCSSSQLVTLQHFRDEFLSALPKPEQSPKIGMFIDSCFAHCQSGAQDSWNADGSPSIQKMRIGKAVGDWYFDRAVSQRVDCPYPCNQSCIDNEDD

SEQ ID NO: 135526 - protein, 200 aa, Triticum aestivum
  Clone ID: PAT_TA_29944.pep
LHRLPSNSAADASLHNGRCSARSTPHRFERGGWEPAANGAFPAPLALPDLPPHRLEQRGWQNEAHQVPSRWSIPSKKQQELPDVSHAPEKTKLPLLLSTRAWHLISTLETDESVQPDETNVHAVSMSCVNLWMPPPSPRRLDTDLLAAADFVDAACRRSPRRLFHCICDCICGRQTHTLLSLQFLFSIFTYKSKYTVTPG

SEQ ID NO: 135527 - protein, 119 aa, Triticum aestivum
  unsure (1)..(119): unsure at all Xaa locations
  Clone ID: PAT_TA_29945.pep
PHYQPRATETALVLAXGRVYAGFGXIDTGPPLFAKVLVEGEVMVFPRGMVHFQLNVGDQPATVYGTFNSENPGIVRVPATVFGSGIRDAVLXEGFGLTVEELRRIEKRFGVPKKAELED

SEQ ID NO: 135528 - protein, 329 aa, Triticum aestivum
  unsure (1)..(329): unsure at all Xaa locations
  Clone ID: PAT_TA_29946.pep
SGYGGDWAVRLDAKNEGSSLSEAQESTTHLFFYIADEAGKLITMGSHEPPSRGPVLLASGSHEEIGDWELYLRSEDNLEIHRAGFQTSSMHNLSDLVQHALVTNARQSGNLNLPDMAEDSSNAIIYQVSIKLPAKIDIVFLSGAGSKNPMTAERVNRLTGPMLSTRLKSKQKHFEERXDQIFNVNNKIVSKELSVGRAALSSLLGGIGYFYGQSKIALPKGFSQKNGDKYIPYWPAALYTAVPSRSFFPRGFLWDEGFHQLVIWRWDAHISMDIIGHWLDLINADGWIPREQILGAEALSKVPEKFVLQYPSNGNPPTLFLALRDLASG

SEQ ID NO: 135529 - protein, 336 aa, Triticum aestivum
  unsure (1)..(336): unsure at all Xaa locations
  Clone ID: PAT_TA_29947.pep
LGQLLSWGVGNEPVYLWTLPMFHCNGWTLTWGMAARGAVNVCIRQNRAADVYRAISDYGVTHMCCAPVVFNILLEGEARRLTAPVHVLTGGAPPTAALLDRVERIGFKVTHSYGLTEATGPAMACEWRHQWDLLPLPERSRLKARQGVSVLSLADAXVVDDNTMSXVPRDGKSLGEIVLRGSSVMKGYLNNPEANGXAFKGGWFMTGDVGVVHPDGYIEIKDRSKDVIISGGENICSKELEEVLLQHPAVANVAVVAMPHPHWGETPCAFLVAKNKAVEVCKDKVIAFCRERMSRFMVPRKVVVIDALPRNALGKVEKVKLRDAARNLVPSAVSRL

SEQ ID NO: 135530 - protein, 366 aa, Triticum aestivum
  unsure (1)..(366): unsure at all Xaa locations
  Clone ID: PAT_TA_29948.pep
VGQNSANLIEYFEEIEGISKIKDGYNPATWMLEVSSSAQEEMLGIDFAEVYRQSELYQRNKELIKELSMPPPGSRDLNFPTQYSRSFVTQCLACLWKQKLSYWRNPSYTAVRLLFTIVIALMFGTMFWDLGSKTRRSQDLFNAMGSMYAAVLYIGVQNSGSVQPVVVVERTVFYRERAAGMYSAFPYAFGQVAIEFPYVLVQALIYGGLVYSMIGFEWTVAGGLGHXSYQANTLLGKTRWGTLGDGMTPKESNAAPTRTAPPNAWDLFSGYLIPRPKPRVRPGRYSWICPVAWTLYGLVASQFGDIQQPLDQGIPGPQITVAQFVTDYFGFHHDFLWVVAAVHVAFTVLFAFLFSFAIMRFNFQKR

SEQ ID NO: 135531 - protein, 422 aa, Triticum aestivum
  unsure (1)..(422): unsure at all Xaa locations
  Clone ID: PAT_TA_29949.pep
MAMEGPSVEVPPYFLCPISLEIMRDPVTLATGITYDRCSIERWLSDGHATCPITQQKLAEADREATPNHTLRRLTQAWCALHAVERFPTPRPPLDACRVAEIVEEGRGAGRQKELAALREIKDIVAESDRNRRCVEATPGAVEFLVSVVRNHATASKSAEDLLELSLDSPTSTSSPEEDALSVICSLKPSKKSLVRILEENGDFLDTLVYMLRRPSYRSRCYGILLLKAMVSVMEPARLMAVRTEVVQELVRVVSDRVSAKAVKAALNVLCRLCPWGRNRVKAVEAGAMTVLVELLLDEGGRHPTELAVVAIDHLCXLCGGAVGLGGAPGRAGRRVQEGYASVPXTTESAVRALHAVARHSPTPAVLQEMLAVGVVAKLLLVLQVDAGERARAKAKELLKMHARVWKDSPCLQAHLKAHYPC

SEQ ID NO: 135532 - protein, 278 aa, Triticum aestivum
  Clone ID: PAT_TA_29950.pep
MSDSSSTASSSPSPSSTSPRLTTGDVNFLARRAVTTQQNHHQAAAEAFPLHSPGSSTGSADSAPWHHRAPATPPPVLPFDTSDADEMLLLDMVSQHHEVQHAAASPTTAPAVKQEADEEDKVVLGVARAFRGVRKRPWGKFAAEIRDSTRNGVRVWLGTFDSPEAAALAYDQAALAIRGGAAVLNFPADQVRRSLEGAADDLCGCTNGVSPVLALKQRHCIRSRKATTMSRKAKAARGQPEGMVMELEDLGAEYLEQLLGTSQEMASMDSWCWSHHSI

SEQ ID NO: 135533 - protein, 54 aa, Triticum aestivum
  Clone ID: PAT_TA_29951.pep
RGLFFFFFSFFETFFTYTMHTNESNHTSARRKNVYNASKEVGKEEEEKDLLEKK

SEQ ID NO: 135534 - protein, 156 aa, Triticum aestivum
  Clone ID: PAT_TA_29952.pep
GPLEAGPAWFYLHIACQISGYALGVAGWGLGLKLGSESKGLTYTTHRSIGIAIFCLATLQVFALFLRPDKKNKYRVYWNAYHHSVGYSVIVLAAVNIFKGLNILKPATGWKTSYVVILATLAGVVLLLEAITWAVVLRRRKRNRAHAGANGTGVQL

SEQ ID NO: 135535 - protein, 385 aa, Triticum aestivum
  unsure (1)..(385): unsure at all Xaa locations
  Clone ID: PAT_TA_29953.pep
MARPGHSTAWLPLLVLLFAAGAAVSATFTGGRTFLKCNHASRALPVLGASLHWTYHAGNGTADIAFRXAPSGADGWVGWGXSTPGGSGMAGSNVFVASQSGGAVSVLTTILRNTAPTLDNTALSFDVPVPASAEYAGGAYTIYATVALPGNTTSQNTVWQAGPISGGRISPHSISGPNVQSLQRLDFLSGTSTGASNSRLHRRNLHGVLNGVGWGVLIPLGAMIARYLRVFEAADPAWFYLHIACQISGYALGVAGWGLGLKLGSESKGLTYTTHRSIGIAIFCLATLQVFALFLRPDKKNKYRVYWNAYHHSVGYSVIVLAAVNIFKGLNILKPVTGWKTSYIVILATLAGVALVLEAITWAIVLRRRKRNQAHGGANGTGVQL

SEQ ID NO: 135536 - protein, 267 aa, Triticum aestivum
  Clone ID: PAT_TA_29954.pep
AASLFTPLEQRRKGKKSRARLRISAAGAAGWGRDGEGARSSTISSRSSLVVSLVEFGEMPEFGFMPMEAVSLARPSRVRWLLELTLMVVVSWLLLLLAGVNPASPVISSRCPCLWKRLLFLFLEPDATMEVEKELRRGSQMVLAGIRAHQQQLQSSGATTPVSAGELLLLQAERWPSLFLLALMPYRRQLLCSFGGHGDLRRLWRFRRPKWHVPGDGVAQSMGTQRRTRLLFHLLVWGPLRKRQGLVCNIMFLWCLDVNCSVIRACV

SEQ ID NO: 135537 - protein, 186 aa, Triticum aestivum
  Clone ID: PAT_TA_29955.pep
HLAKIITAGYFATEDFTVDEGPDWEKEQRMYTTSSIAPVFIVHQLVHKGLLRKGSKVVLVSSESGSIALRHPKEGGGNYAHHASKAALNMVGKLLSLDLRDQGIIVSIVHPGFMRTEMTKGVGFDKFWDEGGAVTPDEAAKSLVEWTDKLDTSKTGQYWAPRGPGDIGTAEVVLGKNLATPLQLPW

SEQ ID NO: 135538 - protein, 476 aa, Triticum aestivum
  Clone ID: PAT_TA_29956.pep
MCKKQAKAVPRHTSASVRSGDTVEDLLSCLKMPYMTFYNSLNTNSGTAPTFGTLADYNPVYISLFRDLSQQGGARLFLPTGANDVVIPVFDDEPTSIISYALVSPVYHFQMSVESNQNKDSADSTLSLPVYDSGNFNLFHLFEDFGSSDDFASSISSSRGSFAPDLLHSRVSFQDGGPLGKVKCTVTCYYAKSFEELRKSCCPSELDYLRSISRCKKWGAQGGKSNVFFAKSLDDRFIIKQVTKTELESFLQFGPDYFKYLSESISTGSPTCLAKILGIYQVTIKHLKGGKESKMDLLVMENLLFGRNITRLYDLKGSSRSRYNADSSSNKVLLDQNLIEAMPTSPIFVGNKAKRLLERAVWNDTSFLAGIDVMDYSLLVGVDEEKHELVLGIIDFMRQYTWDKHLETWVKSSGILGGPKNAAPTVVSPMQYKKRFRKAMSAYFIVIPEQWMPAIINPDQSSSNICEDDSQNASPE

SEQ ID NO: 135539 - protein, 250 aa, Triticum aestivum
  unsure (1)..(250): unsure at all Xaa locations
  Clone ID: PAT_TA_29957.pep
PSREPATARQSRLAFSLGLSAPGARNRSTPPLLFFVARILPSLPPPNPPPPKCCPFSAPPSPGAGAAPSPPPPRALPGRXCTGSPRGPAPREACRSRSPRRRPSPPSPCPDTPPTSTPFRPNPSASACLRASSTPPAATASSSWTPAEPASRLMTSSSSTRGSRASSATRSPASCSASRTSTAPRRPLPTAWGSSPRLTAPAGRPRGMPLLSSPRSTAGGASCCAGSPRSRGTGRSWSFLPRCRLTGECT

SEQ ID NO: 135540 - protein, 85 aa, Triticum aestivum
  Clone ID: PAT_TA_29958.pep
AVLGTCARRLPAGRRPPAVTLPFSGGAALKLSAQNLLVDVDSSTTCLAFAPARSAAIIGNTQQQTFSVVYDVKSNRIGFAAGGCR

SEQ ID NO: 135541 - protein, 89 aa, Triticum aestivum
  Clone ID: PAT_TA_29959.pep
MRPQALLLALAVVAVLTALPLTHGQGASPWPCCDKCGVCTKSIPPQCRCQDVSPTGCNSACKSCVRSTAGFQCVDSITNFCERRCTPAA

SEQ ID NO: 135542 - protein, 89 aa, Triticum aestivum
  Clone ID: PAT_TA_29960.pep
MRPQVLLLALAVVAVLAALPLAHGQGASPWPCCDKCGVCTKSIPPQCRCQDVSPTGCNSACKSCVRSTAGFQCVDSITNFCERRCTPAA

SEQ ID NO: 135543 - protein, 265 aa, Triticum aestivum
  Clone ID: PAT_TA_29961.pep
LKSSRDKGGGARDRASCSWNVLVVQAWRLSRGLRAAAGLWLSSMTVSKAPTSAFTLFTCRSSSSLIRASSTASLLRADSRRRGVSASNDRFPVDVLTRQPWNLHTTSALMSSSRCCFLAAAILSTSATVSSGAGGASFSGLSFSFSISAAASSFSLSFSAGDVLLVLLSGSGVLLLLLSDGVIFLLRRGYCAPRRVPPRRPPADGSRSTKRFASRSKISGTIPTCGCPIRPRATASPIWSCAEKTLLAAPGTPAVSASSGVPLTD

SEQ ID NO: 135544 - protein, 148 aa, Triticum aestivum
  unsure (1)..(148): unsure at all Xaa locations
  Clone ID: PAT_TA_29962.pep
NILLLLPWLHLRIQFQDPCFRLRSIWGQGTPGLPFSSPDFWSGCYSSPELRPPPSASPEQEWRPPPPQCTIPCSSSSLQFWWWPPSPSRQSPAPSLGHRRVHRSNFPGAPGPSTRADAPKEDVLFMPQEAGAAPNAVXKQVAAGVGIE

SEQ ID NO: 135545 - protein, 277 aa, Triticum aestivum
  Clone ID: PAT_TA_29963.pep
NVFVHRAGRTARYDQEGDAIVFLLPTEDAYVEFLKLRGVPLMERECSPDIVDIVPQIRTAALEDRNIMEKGLRAFVSFVRSYKEHHCSFIFRWKGLEVGKLAMEYGLLQIPSMPEVKHNNLSLKGFFPLGNIDFSQIKFKDKTREKQRQKALKRKAEELANEPPVPEKRIPRERPDKPKRKQTGKQRQTIQSKEDMDELTNEYRLLKKLKRGVIDEDEYEKLTGFGGSDGEGSDGDAAGKGKGKERRSKEQKKLKQRGGKTGGRRFEVKSKLKSKRR

SEQ ID NO: 135546 - protein, 157 aa, Triticum aestivum
  Clone ID: PAT_TA_29964.pep
TASPPPAPILTPLAPQNHAVNEANVAKESLEIARVENSQLQEDMSEKENTLKSIVQEYESLKVSEAAAQSSIKELKDMIDAMFSSESAKTSAEASPIDAKGGDGKGRYVAADNMYSDVESSPRSKDIRSPARQQKRTILRKFGDIMKKRNPQTQSVI

SEQ ID NO: 135547 - protein, 131 aa, Triticum aestivum
  Clone ID: PAT_TA_29965.pep
MANDERGAGEERGAAEDSIVWREEAGKFETPDGEAFLQYRLVVQPRASSVRGGASPAAMDMVHTYVPGSKRGQGLAARLCDAAFAHAQRHGMRVIPACSYISDTYLPRNPAWNELVYKADEPKHSSTSSSM

SEQ ID NO: 135548 - protein, 81 aa, Triticum aestivum
  Clone ID: PAT_TA_29966.pep
TKQKQQTASVTAYVVRISHYLTKNRRTKRLISHHILFGHIFSDLASVLSMAGRCSRSQGSSCKQRRCRGCSGRCGGRPRVR

SEQ ID NO: 135549 - protein, 96 aa, Triticum aestivum
  unsure (1)..(96): unsure at all Xaa locations
  Clone ID: PAT_TA_29967.pep
SVVRGQRSVELLISRHCAIQLQVGEKCVNSTDSSPCVMRGPSYCKQNKTLAALHAHDLAFKTLLEGLSALCCADCVIVFLHNFYFCFKYKVYKFFX

SEQ ID NO: 135550 - protein, 161 aa, Triticum aestivum
  Clone ID: PAT_TA_29968.pep
IQGQPGGGQRGALGALNPTDQVLLARHLLVASLMGYIFFLALVIDRLHSYIREMRALKQNLEAVSKQNKTLEEAKSGRSDESKPHHNDIASLNEEIKKLKRQLKEKAEEAKDAEAKALAAQTQSEGLARKYDRLLEDNKHLHEQLQSGDIPLSRSDGKKNA

SEQ ID NO: 135551 - protein, 125 aa, Triticum aestivum
  Clone ID: PAT_TA_29969.pep
MEVTQPLWWERALVLATQGVFFNAYFVGYLISPKFAHRFVGYLEEEAVHSYTEYLKDLEAGLIENTPAPAIAIDYWRLPADARLKDVVIAVRADEAHHRDANHYASDIHYQGMTLNQTPAPLGYH

SEQ ID NO: 135552 - protein, 191 aa, Triticum aestivum
  Clone ID: PAT_TA_29970.pep
RAGSDLFFQRRHASHALLLETVAAVPPMVGGVLLHLRSLRRFEHSGGWIRALMEEAENERMHLMTFTEVRQPLWWERALVLGTQGVFFDAYFVGCPSPPKFAHRFVGYLEEEAVHSYTEYLKDLEAGLIENTPAPAIAIDYWRLPADARLKDVVIAVRADEAHHRDANHYASDIHYQGMTLNQTPAPLGYH

SEQ ID NO: 135553 - protein, 194 aa, Triticum aestivum
  Clone ID: PAT_TA_29971.pep
QHHPKHQPYTSAMYFSAILLTLAATASAVDVRAYSNSGCNGGWVGCAGINPGVCCVFSNSASSGRLSVSVNAIPSSWRIRGEANTGGGCTYLANQQDSNGNTDICMTYSSRGDRTGGSYSFVGRKRAADNSCPAEQPDGGKCEAGVKPDLLGLSDGTVYNIADLSDEKVEELEKIANTGAGADAVPAEFEPLRR

SEQ ID NO: 135554 - protein, 448 aa, Triticum aestivum
  unsure (1)..(448): unsure at all Xaa locations
  Clone ID: PAT_TA_29972.pep
MASGCCVLVDSGAYIDDTNDSTNDSTAREYTNTGSQIMVSLWPAHPPIPSRLSVHCKWMRPGHVFFHEPKILCAADCFFVLRIAIGRSPPPINITQKVSDYFIYQSASSTGPSLKLLPHPHPHLFSDNEVGVLPRGNEFTIAVLSQTSYYNFVLYLFKSEDWYWTSKKVLVDSPRLPFPMPLPPDDVLGHFQHHGNSVITIGSRGLVGWVDLWHGILLYDVLRDDNDKVRLVPLPVRLGSHGGYALICCPKPYRSVAVLGXASSLSSWKSPAIVFLVKTLKPGAPISELMTGHSPHXTNCNITGDPDDWIIDFTVNASAIRIDTAMRSGLLHCGMLRKTEAAERNLQNLWTCQPVLSLNDQGTVVYLITRVKFWHPKAWLLAVDVANKQVRAMAKIEAERSTALSLNYFPCRISSPATCLNGTTMPVTRGTLMLGEQTAEQTAGDGGK

SEQ ID NO: 135555 - protein, 133 aa, Triticum aestivum
  Clone ID: PAT_TA_29973.pep
MSVEFDGFPGGGEGFELVARFCYGDGRLPPLCPAEVPLMHCAAAFLEMTEEVRAGNLLAQAEAFVDDGLCYWTWADVLAAVKSCESFAAHASGAGLQEKLLSALFSRIDAGAETPKSNCSTSSTCSSSSQDTV

SEQ ID NO: 135556 - protein, 64 aa, Triticum aestivum
  Clone ID: PAT_TA_29974.pep
VTSHEGIGLFDIHRRNPSTIYKNLSKSLKSSTSSFSPTILLYCKVIQPTKDIYATRRHARRTRG

SEQ ID NO: 135557 - protein, 121 aa, Triticum aestivum
  Clone ID: PAT_TA_29975.pep
LTTAYIALGLALSVVAYDYQEIGTLVILFCIFHASVGFVLPLLARFRTMYLPNELRGGMMSFSLALGNAPMFIFLIQGAYHGNIANSTILGLAACGLLSAGGCIHMLRRWRKHTRQNVRSL

SEQ ID NO: 135558 - protein, 236 aa, Triticum aestivum
  Clone ID: PAT_TA_29976.pep
HRQIPRMRGRTPLLVDSKVPFLFYVRTCRLAALSTSPATEPTLALDTPPPRGEPSRKSTAATRFPLILVDDDEDASPPSELSVLLGVEKNLPDNVLVYLRNDGHLPALCARRCELCSPAAATISLRTCSGSHSVNRSRSRSSRTTAREWPAEYDRTSFAAFVPAGRDPDRIARRWVPIRCSSIASFMRCSASSSVTTSMTMAAGRAPLSAWWWRTTVISLELLLASGTGGLLASSS

SEQ ID NO: 135559 - protein, 430 aa, Triticum aestivum
  Clone ID: PAT_TA_29977.pep
QLVQKSDSDTKHLSVTNVRTLKMNDDVLAVSIGPTGKHIAVALLDCTVKVFFLDTLKFCLSLYGHKLPVLCMDISSDGALIVTGSADKNLKIWGMDFGDCHKSIFAHTDSVMDVKFVPKTHYMFSVGKDRTVKYWDADKFELLLTLEGHHAEVWCLAISSRGDFIVTGSHDRSIRRWDRTEEQLFIEEEREKRLEETFEADLDNAVEDRYGQKDDAPDEGSVGVPGKKTKETVTATDAIIDALDTAEEEEKRLNEQKKLQNNGEGTKSKPNVIMQGHSPSEYVLNAVSSVRPNDLEQALLSLPFSDALKLMAYLKEWSLIPLKVELVCRVCLVLLQTHHNQLTTTPAARSILTELKYILYGRVKDCKDTIGFNLAAMDHIKELLTMRSDAPFRDAKAKLMEIRQEQSKRSDRSDGGEKRKKKKPKPSVHS

SEQ ID NO: 135560 - protein, 62 aa, Triticum aestivum
  Clone ID: PAT_TA_29978.pep
QPGMHHDSLSHKEKTEIQFSSSDAKFLQLAAQDSTKFLQANDMSCTCQRGTLQITKKRHNTS

SEQ ID NO: 135561 - protein, 232 aa, Triticum aestivum
  Clone ID: PAT_TA_29979.pep
MDETPAEARLSGIRQAVLLLERSHPSAPLPTLAGSESKESCRSGVDEQKEVNKIVDRQIRVFFNVPGSSVAEIDTPDSFYKLSGEEVRNEAKMRRERLEQSRLLIPKSYKEKQALAARQKYKQAVIRVQFPDGVILQGVFLPAEATGSLYEFVADALKQPGLEFDLICPAVPRSRVLPHSPNTGERARTLQDEGLVPSALLKFKPNETDSVVFTGLLDKLLEASEPFTAASS

SEQ ID NO: 135562 - protein, 203 aa, Triticum aestivum
  Clone ID: PAT_TA_29980.pep
FFNGDALCMDWLEKQSNSSVVLVSYGTVSNYDATQLEELGNGLCNSGKPFLWVVRSNEEHKLSKELKEKCEKIGLIVSWCPQLEVLAHRAIACFVTHCGWNSTLEALVNGVPLVGIPHWADQPTIAKYMESAWSMGVRVPKDNNGYLKMEELERCIREVMDVERKDEYKRNVVKWMQKAKEAMREGGSSDKNIIEFATKYSSI

SEQ ID NO: 135563 - protein, 244 aa, Triticum aestivum
  Clone ID: PAT_TA_29981.pep
MEERRSDSRRQEPMVARADGPPIPADESDDEFEFSFGSREPATGGATADELFADGRIRPFYPVFGRVFDDAHVPSAPGRRPLGRLFLEEARNSSVGSTSSSSSSAATDAGDLDGASPDTYCVWTPGASAASSPARSPRKSGSTGSLSRWRRVSELVVGRSRSDGRDKFRFLSAPPSPAREQPKGKPRGRDSKATTELDTVAAGHRQFYGAKASPGAARRTFLPYRQDLVGLFSTPKGLSRSQYF

SEQ ID NO: 135564 - protein, 212 aa, Triticum aestivum
  Clone ID: PAT_TA_29982.pep
MNPFAKKPTPREAIRNSKRELTNATRGIERDIGTLQQEEKRLVAEIKRTAKTGNEAATKILARQLIRLRQKISTLQGSRAQIRGIATHTQAMQANTSVSAGMQSASKAMGAMNKQMDPAKQMKVMQEFQKQSAQMDMTNEMMSDSIDNVLDDDQAEDETEELANQVLDEIGVDVASQLSSAPKGRIAGKKVQADESSELEELEQRLAALKNP

SEQ ID NO: 135565 - protein, 418 aa, Triticum aestivum
  Clone ID: PAT_TA_29983.pep
PAPVHFKPQCLRFPGGTFVEGILLRNAFRWRETIGPWEERPGHYGDVWNYWTDDGLGYYELLQLAEDLGAEPIWVFNAGISRNDQVDTTAIAPFVKDVLDSLEFARGSAKSTWGSVRAAMGHPERFPLKYVAVGNEDCDNTKPFYQGHYLKFYNAIRGAYPDIQIISNCDGSSEPLDHPADLYDFHIYNSANDLFLKKDTFSRTSRTGPKVFVSEYAVHVDGDTSKGSLQASLAEAAFLIGLEVNSDIVHMASYAPLFVNDNDRKWTPDAIVFNSWQQYGTPSYWMQTFFGESSGAVIHPVRLNSSYSGSLAASAITWRDNEDIFLRIKIVNFGPNTVNLTLSATGLEAGVDTSRSAVTVLTSNYSLDENSFDDPLKVKPVKSGLASAAEEMQAMLVPYSFTSYDLALDEYGELVADM

SEQ ID NO: 135566 - protein, 170 aa, Triticum aestivum
  Clone ID: PAT_TA_29984.pep
ESNRTRNEAACHTSNGRGRGRGRGRGRRAGRGAEREIEHHELGCAQFSKPGHLKVEIGDVVLDTSETKEHTPLSNARASLRNIDLNLDLADYEEDTPQVQPSAPSAPVVTVAPQVQTSGPSVSQLKEEVETKDFLGWQMPEMNKMAMDPVQFALSSNHRLEEDEDYDNEE

SEQ ID NO: 135567 - protein, 227 aa, Triticum aestivum
  unsure (1)..(227): unsure at all Xaa locations
  Clone ID: PAT_TA_29985.pep
MAATRACLVALAVALSFLFLEGPAAVLAAPAKTAESLEQRRREAQSLLRRLNKPPVASFQSPDGDVIDCVHISKQPAFDHPLLKNHTIQMRPSYNPGGMYHDPTIAPHPITQTWHQNGKCPENTIPIQRTKEQDVLRASSIKRYGKKRPRSIPNLSSINDPDTTNITRGHQHAIASTSVDKCHGTKATFNLWQPMIARANDFSLAQFWISXGSYQGNDLNTIEVGWQ

SEQ ID NO: 135568 - protein, 479 aa, Triticum aestivum
  unsure (1)..(479): unsure at all Xaa locations
  Clone ID: PAT_TA_29986.pep
PANFGESTTWGDDDPSVFVVTIVYWVPSIFDGIPDKDLLDGTQLQFKSVTQNAFVAAEXGGGAALVANRPSASGWESFKLWRIDQNTFNFKVSNNQFVTVSSVNVVATASAPGQTETFQLVRSYADKNRMRIRAPNGSFLQANKDGSVTANFGESTTWGDNDPSVFAVNIVNGPHGEYQICNGYGKDMATQVMNNHWSTYIVEADFAFMAANGLNAVRIPVGWWIASDPNPPAPFVGGSLQALDSAFTWAERHNIHVIIDLHAAPGSQNPNEHSGGRDGSQTWGDSQIAQTVQVIDFLAARYAKRSSLLAVELMNEPVAPGVSLDSLKTYYQQGYNAVRRHSLTAYVIMSNRLSGSSLELIDFASQFNRVVLDMHYYALFDSKFDSFTVQDNIDYVNNFIASEINAINRPDGPLTFVGEWVAEWQVKDATKEDFQRFANAQMAVYRKATFGWAYWTYKNVNNHWSMQWMMDPYISLGNA

SEQ ID NO: 135569 - protein, 168 aa, Triticum aestivum
  Clone ID: PAT_TA_29987.pep
DGLIHKEEFRLALFRTSKGANLFADRVFDLFDLKRNGVIEFGEFVRSLSIFHPKAPESEKTAFAFKLYDLRGTGYIEKEELREMVVALLDESDLCISDSAVEEIVDNTFSQADSNGDDRIDPKEWEEFVKKNPASLRNMSLPYLQDITTAFPSFVMHSEADDYSGISK

SEQ ID NO: 135570 - protein, 28 aa, Triticum aestivum
  Clone ID: PAT_TA_29988.pep
GRVGNPGTTSMAASPREFCVRCHMCLIN

SEQ ID NO: 135571 - protein, 311 aa, Triticum aestivum
  unsure (1)..(311): unsure at all Xaa locations
  Clone ID: PAT_TA_29989.pep
GDRVDLRILLTIGMVGTGLFTAAFGAGYWLNIHSFYYFLGVQMIAGLFQSSGWPSVVAVVGNWFGKSKRGLIMGIWNAHTSVGNISGSLIAAAMLKFGWSWSFAVPGAMIALVGLAVFLFLPVDPEVIGVEEDRHVKDYEKNGTDVPLLEGHSSGRDEAVGFIQAWRIPGVAPFALCLFFCKLVAYTFLYWLPFYLSHTEIGGEYLSDSAAGILSTLFDVGGVVGGILAGHISDRLDARALTAATFTFSAIPALFFYRIYGSISLTWNVALMFVTGVLVNGPYALITTAVCGDLXTHRWVDGDSQALGPGA

SEQ ID NO: 135572 - protein, 342 aa, Triticum aestivum
  unsure (1)..(342): unsure at all Xaa locations
  Clone ID: PAT_TA_29990.pep
DTGCDRAIAPVCAAAARRRPAGGAAAAGGFAASRLVLLLLEGGSALRAARRPPDVAARAHLRAAVGAAARLPPLRLVLLLEESLIAAFRGCEGVFHTACPVTDDPEKMIEPAVNGTRNVINAAAEVGGIRRVVMTSSTGAAVFVPPRRTDGGAAEACWWDRPRXCTHTTGSACYAKTVAEQAAWELAKERKLDLVVINPSLVLGPLLQTAVNAXSTWHIAKYLDGSVQTYANAAQAYVHVRDVADAHARAYETPDAHGRYLCAGRTLHRAEVCRILAKFFPEYPVPTRCKEGAREMKKGCRFSSRRIMELGVGITPASQCLYDTVTSLQDKGILPRRHADMS

SEQ ID NO: 135573 - protein, 111 aa, Triticum aestivum
  Clone ID: PAT_TA_29991.pep
QDKGSLFTLGWIHTHPTQSCFLSSIDLHNHYSYQVMLPEAIAIVMAPTDTRKKHGIFHLTDPGGIGVIHDCPERGFHPHKAPLDGSPIYEHCSHVYMNADTKFDMIDLREQ

SEQ ID NO: 135574 - protein, 513 aa, Triticum aestivum
  unsure (1)..(513): unsure at all Xaa locations
  Clone ID: PAT_TA_29992.pep
MGPPQPAKGIISIEACARPIAVDHRISLPYYFRIAGTLLRQAKIYRDEKNILDLYVILLRYTSLLCETIPKHRDYPVFKLREAEFVRNANSSTLIDVVNELESLKPVVKRQLVEHNRRGSPEANGLNGTPAASLRTEKHPRTTYSTQPFVGSLQKFYPDGRHHVASWTSIQIDRQIRKQFVNLPFPKEETLARHSILGPNGLHGQWNGPVAAVKVQYPCNLEFTQSDMTSLVPAMLNQDGLHGPSTTHPDSTTKDNDDMQSVLSLDDGRWSAPAEECTSTPSASLEGELSQLNIRQPXPPAVLAEVHPDRAPPISPSRVADPTQGLAISETGRYHNLHVPVKLMECFLRVAEANTKRSLETCGVLAGTLKKRTFHITTLIIPKQKSTSDSCEATNEEELFEVQDKGSLFTLGWIHTHPTQSCFLSSIDLHNHYSYQVMLPEAIAIVMAPTDTRKKHGIFHLTDPGGIGVIHDCPERGFHPHKATLDGSPIYEHCSHVYMNADTKFDMIDLREQ

SEQ ID NO: 135575 - protein, 184 aa, Triticum aestivum
  unsure (1)..(184): unsure at all Xaa locations
  Clone ID: PAT_TA_29993.pep
PAGSDLLAAVHRIGYTAAVPEVPGWLSAEAKDFLDGCFRRQPSDRSTGAQLLDHXFVASAAAAGDYKAAPAKQQYTSPKSTLQDALWDSDTDDEDADETPAERIGALACGNSALPDWDSEDGWIDVCHQVHRGADSPPADVGYDLVWPEESDAEREPSAVAADDSNGIPRNAVVTDSSIWQYSL

SEQ ID NO: 135576 - protein, 81 aa, Triticum aestivum
  Clone ID: PAT_TA_29994.pep
NRRPFFFFFFFFIFFLFFFYFFFFFFFFFFFFFFFFFFFFFFFFFFFFTQSKHRPQNSESSCSNTGHTETLHFSCFEFLGL

SEQ ID NO: 135577 - protein, 200 aa, Triticum aestivum
  Clone ID: PAT_TA_29995.pep
RNSARGKEANAGGSSLAVTLVVVVVAASSMPVVKGDDKSACVGEYSKLCGKKDPACTAMVETTCHDDADSVKAIKGMFDELAKVGGDDYGLASTARPWGHVALGDAVDEHGACPGNKTVSEFAGEHCIPDIDAACKDPSCSDGAYIECGSAASRFCYIKATPANKKAIQQNLDCFKSCCAQKKSEDCRNECILNKSSPAA

SEQ ID NO: 135578 - protein, 314 aa, Triticum aestivum
  Clone ID: PAT_TA_29996.pep
LRDDDRRGGASTSVLPQPAVAATQPWVLDSGASFHVTSDHSQLVSCQPVRDGASVQTADGTPCSVTHQGSLCTSKFSVPAISFALELSMNLMSIGQLADMNYFVGFDDSFCYVQDRQSKRVIGTGHRRRGSTSLYILDTLHLPSASTTSAFQMVASTSRSTSSFSFAQWHHRLGHLCGSRLSTLVRQGVLGHVSIDAGFHCKGCKLGKQIQLPYSSSTTHSSHPFDLVHSDVWGPSPFVSKGGHKHYVIFVDDHSRHTWVYFMKHRSELFSIYKAFVHMVHTQFSSAVRVFRSDSGGEYLSTAFREFLSSEPTL

SEQ ID NO: 135579 - protein, 131 aa, Triticum aestivum
  unsure (1)..(131): unsure at all Xaa locations
  Clone ID: PAT_TA_29997.pep
CAFLYDIFWVFVSKXLFHESVMIGGAGGGNPDGDGVPMLLKIPRMFDPWGGYSIIGFGDILLPGLVVAFAIRYDWAAQKKSLRSGYFLWSASAYGTGLLITYVALNVRDGHGQPALRYLVPCTLGTLMALG

SEQ ID NO: 135580 - protein, 109 aa, Triticum aestivum
  Clone ID: PAT_TA_29998.pep
IKIKPLFVTLDPQRDSPAQLKAYLSEFDPRITGLTGSVDAIRQMAQEYRIFFKKVGEVGQDYIVESSHNMYLLDPCLETVRCFGAEYKASDLAEAITTEIQKASNSAAK

SEQ ID NO: 135581 - protein, 91 aa, Triticum aestivum
  Clone ID: PAT_TA_29999.pep
MERVASRCVSLLAQRRGYSAAVTMVKGAGRSAAATEEKTAVAAKSAMAAKKDVGTGAEKAAWVPDPVTGYYRPSGGGKEVAAADLRAKLCC

SEQ ID NO: 135582 - protein, 307 aa, Triticum aestivum
  unsure (1)..(307): unsure at all Xaa locations
  Clone ID: PAT_TA_30000.pep
MVDVHRFHLMVQLPPHLTRPTRPSRRPAPSPPRPPRAEHHHPKEQSSRRPPPCWTSHCHAVPKTAACRRPPKLGAAGAPPRQSTAGPTGPPADHSKLQPPPAAPPTHARCRSDRGEIGRGTAAERTLRRPPAARQERRAPPSPGAAAPASSRRRDGRTTPQXSAPPPTPPDAKSKPPAAFGSRARRHRGNGRRQRRRWIPLRGSLAAEECRPRCRLGCDTGGCFFSPCDMLRLLFTVWPTMEWLWTYGAQGGGAFRGRLIDVVHDLQLPAAWATKSWIGRVDVNSWRNTCKLHLVWELEHTAACMHT

SEQ ID NO: 135583 - protein, 127 aa, Triticum aestivum
  Clone ID: PAT_TA_30001.pep
IDRNLKKKKNHMTHSDETRAARTIPKNPFRLPRFEQAASMRPRGTDTFPRDHSTRRLSGARSDVSCNLSSKLGAEFFPYLFLSELSSLSCRPWHGRDVASRSANNSPARSLPIPSPCDSRFSRVILI

SEQ ID NO: 135584 - protein, 88 aa, Triticum aestivum
  Clone ID: PAT_TA_30002.pep
GFRMPRVGDPSASSILRITYELGYLASIIAGCWVDGNLFIHGVRYMSTFTDLSGKVLAIGRPLMIANSVMLLLDGINSPYARTLSLTR

SEQ ID NO: 135585 - protein, 139 aa, Triticum aestivum
  Clone ID: PAT_TA_30003.pep
MRPLVSLQMAMAGLQGLVVGNRNPTVRVYVSRHWHHRGTTDNGPIKHTDMVLLDTRGNHIYAEIGSIGSPRPVLIPTQRLSFHSAPTHSLNCHACLPLSMHLNSSQMYLELSLVCLMLFSIIARTGASLPQSILSTSRT

SEQ ID NO: 135586 - protein, 88 aa, Triticum aestivum
  unsure (1)..(88): unsure at all Xaa locations
  Clone ID: PAT_TA_30004.pep
KTEAWMLDLACSFHATPNREWFSSYKSGEFGLAXMGDDTGYRVAGVGDIKIRMFDGVERMLRGVXRVPWLRRNLISLGVLYDGARRPG

SEQ ID NO: 135587 - protein, 105 aa, Triticum aestivum
  Clone ID: PAT_TA_30005.pep
MGRPSSTAKLVCVALAALAVLSPLYMDRDLEAEEEEEEEGWGLLLPSALWLPALLVVLILAINVACFVDRRVVRFDPYWIHRVGGSSCGLMATLLLLGFVLKCKG

SEQ ID NO: 135588 - protein, 57 aa, Triticum aestivum
  Clone ID: PAT_TA_30006.pep
KSHASTTNLSEVGTSEDIESPKKNTRTHGTFSLQQTTCFWGIWAQGTREEILFSFVL

SEQ ID NO: 135589 - protein, 404 aa, Triticum aestivum
  unsure (1)..(404): unsure at all Xaa locations
  Clone ID: PAT_TA_30007.pep
GYVALAASYLPFPCHCHSWSRSGCAGGVPVGRPAGLLQPFVLDLPGKYPLGLVAKGPRCRVHFFPADIRAPRCFLPWAGRTVFPGEADWFYAPVYTTCDLTRAGLPLPFKSPRMMRSAIQFISKRWPFWXNRTDGGDHFFVAPHDFAACFHYQEENAIARGILPLLRRATLVQTFGQKNHVCLKEGSITIPPFAPPQKMQAHLIPPDTPRSIFVYFRGLFYDNGNDPEGGYYARGARASLWENFKNNPLFDISTEHPATYYEDMQRSVFCLCPLGWAPWSPRLVEAVVFGCIPVIIADDIVLPFADAIPWDEIGVFVDEEDVPKLDSILTSIPIDDILRKQRLLANPSMKKAMLFPQPAQPRDAFHQILNGLARKLPHPETIYLQPGEKHLNWTAGPVGDLKPW

SEQ ID NO: 135590 - protein, 376 aa, Triticum aestivum
  Clone ID: PAT_TA_30008.pep
SRNPPPVCVPMATFSNEELLQAHTELWDLTFGYLKSMALECAIKLGLPNAIHRCGGAATLPDLLDAISVPERKKAHLPRLMRFLAAFGIFTVNAPAAEECADGEKASAVYGLTPVSRLLVDDAGANGSCGSLSPFVLSQTTRYHVKAAMHLPEWFMSDDGAAAVAMPFRMAHGTDLWGVMGRDPKMNQVFNAGMGSDTQLAMDFVIGNYGDVFEGVTSLVDVGGGTGSAARAIARAFPHVKCSVLDLPNVVNSIPPDGVVEYISGDMMSSIPNTDAVFLKYIMHDWNDEDCVKILTQCKKAIPESGGKVIIIDIVVGSPLKAMLEAQVSFDLLMMVITAGKERDEHEWRKIFMDAGFSHYKTRPILGFMAITELYA

SEQ ID NO: 135591 - protein, 107 aa, Triticum aestivum
  Clone ID: PAT_TA_30009.pep
SKAGSVASWAFGEVRYSNNFRGPRASWPTKWWKSGCEHEVREKCCKQLSQIAPQCRCDSIRRVIQGRLGGFLGIWRGEVFKQLQRAQSLPSKCNMGADCKFPSGYYW

SEQ ID NO: 135592 - protein, 148 aa, Triticum aestivum
  Clone ID: PAT_TA_30010.pep
MKTLFLLALLALVASTTFAQYSEVGGWYNEVGGGGGSQQCPQERPKLSSCKDYVMERCFTMKDFPVTWPTKWWKSGCEHEVREKCCKQLSQIAPQCRCDSIRRVIQGRLGGFLGIWRGEVFKQLQRAQSLPSKCNMGADCKFPSGYYW

SEQ ID NO: 135593 - protein, 233 aa, Triticum aestivum
  Clone ID: PAT_TA_30011.pep
MTEPVKLIGAFGSPFVHRAEVALRLKGVAYELITEDLSNKSELLLRHNPVQHRVPVLLHGDKAICESLVILEYIDEAFDGPPLLPTDPSERAKARFWAKFFADKCLMSVWLALWTEGETQKVLMEDAKEHLTIVEMQLKGKRFFGGAAIGLADIAGASVLSHWAGVLQEVAGVTVMRDDEYPAIRQWMEDYNANEVVTKCLPDRDQLVTHFTAIRGKCVAAAKSMLPNYLASK

SEQ ID NO: 135594 - protein, 229 aa, Triticum aestivum
  Clone ID: PAT_TA_30012.pep
AEPVKLIGAFGSPFVHRAEVALRLKGVPFELILEDLNNKSELLLKHNPIHKTVPVLLHGDRPAVLESLLIVEYVDEAFDGPPLLPVDPYGRAMARFWAQFIEQKCSRPFWMAVWLDDGEAREGFVRDTKENLALLDARLQGKRFFAGDAVGYLDLAACGLAHLLGVIEEVAGASIVGAGEFPALRRWAEDYTSDATVAACLPRREQLAAHFAGKKDRIKLAVSAMVGRA

SEQ ID NO: 135595 - protein, 233 aa, Triticum aestivum
  Clone ID: PAT_TA_30013.pep
MTEPVKLIGAFGSPFVHRAEVALRLKGVAYELITEDLFNKSELLLRHNPVHHRVPVLLHGDKAICESLVILEYIDEAFDGQPLLPTDPGERAEARFWAKFFAEKCLMSVWLALWTEGETQKVLMKDAKEHLAIVETQLKEKRFFGGVAIGLADIAGASVLSHWAGVLQEVAGITIMSDDEYPAIRRWMEDYNADEVVTECLPDREQLVSHFTSIRGKCVAAGKSMLPNYLATK

SEQ ID NO: 135596 - protein, 599 aa, Triticum aestivum
  Clone ID: PAT_TA_30014.pep
MLPFCSSAAPTPCSPLCPVTAGARALRRVEAGALRPFAADPLVAQAVPDRPLFSDSAILSPYATAPDDIVRGFASAAELPDPLWRAGVDPPLMPVDLAADAVVGAVTDDAAQQALMDAEMPTTFPADATGVEESVARFIDKLSKQIFQAEDALTEGYDKLRLSAYDALGAYRKAIRGVAGGITSSVAATKKQAAGGVPDVPGAFQDKVAGAGAVAADVLRKAIVVAEDSLGSATTSLVYYYGSAKSSLPPNVKDLLNSSEEKASIVLRPIGSALQQVYIIIEGIGKNVGLNPSDPIVQLAVLLGGSTTIGISYWLFAYGGYSGDLSPESTLELLKSDGKAVLVDVRPEDLRVKDGIPDLRRAARSKYASVASPEIKGPTKKLLKGGSEVDDALVAVVIRNLKLVKGDSKVIIMDANGTRSKSIARLLKKLGVQQPYLVKGGFQSWAKNLRVKELKPETALTVINEDAEEILEGIKPTPTLVLGSLLGFSAVTYALLEWETTLQYIGVLSIGLTIYLRFSTYEGSEDFLQDLKLLLSPVRVGAEAFSWAAKKLEPNKIGLATSPSTTAVQDRVLKAAAMHESKPSDAEESTKTDSFASEA

SEQ ID NO: 135597 - protein, 294 aa, Triticum aestivum
  unsure (1)..(294): unsure at all Xaa locations
  Clone ID: PAT_TA_30015.pep
MGIPFQLQSQQGIQQAKALLAENKIMIKKETSPSEPFGGQPAKNASTPKPNMATAAKVNAMVGNKTWFGGLFTGSGKKRQVHAEKNFEMTPLQEQRMQKLKDRLNIPFDETRPDHLTSLKALWKTSFPDTELTSLVSEQWKDMGWQGPNPATDFXRGCGFVSLENLLFFARRYPASFQKLLLKTQGMRATWEYPFATAGVNVSHMLIQLLELNSARPKTLPGINFVRMLSEHEDVFDILYCIAFEMMDAQWLAMRASYMQFNDVLEATKSQLERELSLEDLLRIQDLPAYNLLL

SEQ ID NO: 135598 - protein, 452 aa, Triticum aestivum
  unsure (1)..(452): unsure at all Xaa locations
  Clone ID: PAT_TA_30016.pep
MVGKDLVLQRNAPVDIREIAAKATLREVRQNGHTYVELRRVGKRVIFFCTICLTECFSDNVLFDHLKGNLHSRRYAEAKVTLFGPMPWPFNDGVLFFNNSRENDPLLLDSSSHNTSELALVPHPDFAGNGXEVTSRLRDGSSSHNGAKGSFIGANGRLNGGCRAQTEDSALSNRSETDGPLVIPGVLIKDVVLNLPVHLLGYGNIAYXRLLKLGEGRKKISKIWCAWVGEEASLGSEASNIYEQSGFAIVNFSYAYELGRKWPSEDQDLPISAGSFFVIDEAGHRGKRRKKSFSDQEASSEESNGQTHDSRSQAIVTGSPTGSSCNLQLSPLSSKSMRRELRKQKRLAAEKVCDICGRSMLPGKDVATLLNCSTGNLACSSRNSRAINAFLEKMFRYKLKSIEAHKAWMKTPEVLQNCSTGLHFPAEHLENAEEQVMPLKSLPFFAADGYMA

SEQ ID NO: 135599 - protein, 261 aa, Triticum aestivum
  unsure (1)..(261): unsure at all Xaa locations
  Clone ID: PAT_TA_30017.pep
XXFKXXXIXXXXNIQKESPLXHLVFRFRGGMQIFVKTLTGKAHSVXEVKSWDTIDNVKAKIQDKEGXSPRDQQRFIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 135600 - protein, 308 aa, Triticum aestivum
  Clone ID: PAT_TA_30018.pep
LFKAERKAGEKERRRADIERRRREWEESLAAAPSQEAREAMLAARRETRLERVGKRVEERGARAERLRRAAEGGQKVVLDLEFADLMRPNEIHSLTQQIMYCYAVNGRSATPAHLWLTGCSGEMGTQVQRIPGFDKWIIEKEAKSYLEAFADCKENLVYLTADAETVLDELDMSKIYIIGGLVDRNRWKGITQKKAVDQGIQSAKLPIGNYLKMSSSQVLTVNQVFEIMQKFVETKDWKTAFFHVIPPRKRGEAGAANDDDSPEGAANGDLDKCLEEEVDDDDDDGDGDEEADVANKRHCVRSENGKS

SEQ ID NO: 135601 - protein, 79 aa, Triticum aestivum
  Clone ID: PAT_TA_30019.pep
YHLSALIKRHTPNSDRSFFFFVIFTVLHTCTSFVLLFWERCEVNRFCRINFAAFPLNLYKFCRFPCNLSAMRSLEWCHP

SEQ ID NO: 135602 - protein, 159 aa, Triticum aestivum
  unsure (1)..(159): unsure at all Xaa locations
  Clone ID: PAT_TA_30020.pep
XGVSSSASYDIAXEGRMAVIRTTDDAGTPLGMRDLGGLAESISTTRSSKSESLRSLQSSYEQESPSAGRRRRVRFELPNEDAMDQQVKDELLALVEAKHAGAAYIMGHSYIKARRSSNFVKKFAIDVAYSFLRKNCRGPSVSLHIPHISLIEVGMIYYV

SEQ ID NO: 135603 - protein, 253 aa, Triticum aestivum
  Clone ID: PAT_TA_30021.pep
SNKKKMCHWIKVRGKVCRFIKLLLNSRAGFLESPTNLAARCVRLPREVRSATNGPRGGFAHHREHGVRRERGQACVGRRRGAPVKAMPRCFDGEAPAEAVRRQKEGGDRRRRRRAARRQEEGLLRQVRSKQKDEAAAAGGGGLHPFQSDPSRSRPSILSGFWTHPDRATSMRLQRNSPSSRPGYGASTPSMAMWRSTTTTWLTGNRSELAATQHGRLRSKPWTFLMETKISKCFLGTGGPEPIHITSPVVLYL

SEQ ID NO: 135604 - protein, 121 aa, Triticum aestivum
  Clone ID: PAT_TA_30022.pep
LLLESSSTTATSSPKGQIHLSRMTLLDVAAYQQKIKLSHRLEDWGYIDCFLKPMQITLLKKKERKLEISFQFYRCKINSFHCNTGHPDVQDVGSIRVAFMNLTYTCKRYSPSYSFPNIGNH

SEQ ID NO: 135605 - protein, 275 aa, Triticum aestivum
  Clone ID: PAT_TA_30023.pep
MPIASKLLYFQRRPSPAPPDPGPPEPPDPRRRPCRGASASGPRRQRSSAVSHHHHHHHKPGQELVPANQRDGGKLVGCAGNKIEHIGFTCSSSRLSRSVSDHGRLPDAVQQARERLLQRLNSVDLSGRRENTSCSETIWAGVVTHPADIGVSNLADSELGSLTSYFQSSVSITTYSEVQETFLEPFSTVDNCMPVTPCTEPVPVLQETACQDAEDGENTAPSPECSICLERCGEADGLMQLRCKHVFHSACLERWLRSHGDCPYCRGSVLLTSDE

SEQ ID NO: 135606 - protein, 107 aa, Triticum aestivum
  Clone ID: PAT_TA_30024.pep
LPGSPGRATLSASALCTPVLTRADAHHLALAPRELGLQDGYRPPRHRDSWRWAIPVQVPPAAAVGVQWVRTRGRTRGLTRAASVVLQRQPSFAELPNRPENIRTSKH

SEQ ID NO: 135607 - protein, 63 aa, Triticum aestivum
  Clone ID: PAT_TA_30025.pep
LGCHKMVQDTTSCAINAMQITSLEIYITFSFRLLITSCTSKWGLQTKTQFGAQTHAPGQKKSK

SEQ ID NO: 135608 - protein, 304 aa, Triticum aestivum
  unsure (1)..(304): unsure at all Xaa locations
  Clone ID: PAT_TA_30026.pep
VTAACLEAISGLASLVLLNLNRCGICDEGCEKLEGLVKLKVLNLGFNHITDACLVHLRELINLECLNLDSCKIGDEGLLHLKGLLQLRSLELSDTAVGSNGLRHLSXGLRNLHSMNLSFTXVITDIGXLKKMAGMNSLRSLNPDNRQITDNGLAALTTLTGLTHLDLFGXLRITDAGTNCLRCFKGLRSLEFCGGLITDAGVKNIKDLKDLTLLNLSQNGNLTDKTLEIISGLTALVSLNXSSSRVSNAGLHHLXPLQNLRSLSLDSCKETGSXLKKLQLAALPHLVNLRPESSGNRKLRPICR

SEQ ID NO: 135609 - protein, 200 aa, Triticum aestivum
  unsure (1)..(200): unsure at all Xaa locations
  Clone ID: PAT_TA_30027.pep
YSSAYQDTLAPSTXRQFFRDCTITGTIDFIFGNSQVVIQNCLILPRKPMDNQLNIITAQGRREKRSVGGTVMHNNTIEPHPDFKDSTGKIKTYLARPWKEYSRTIYIQNEIGAFIDPKGWLEWNGDFALETLFYAEVENTGPGADMSQRAKWGGIKTVTYADAQKEYTVEAFIQGEQFIPKYGVPFIPGLLPQSEAGRDH

SEQ ID NO: 135610 - protein, 171 aa, Triticum aestivum
  unsure (1)..(171): unsure at all Xaa locations
  Clone ID: PAT_TA_30028.pep
PRPSAADDGLTKFKLYWHDVLAGTSPTAIRIAQAASSNSSSTFFGAVVAIDDPPTTGPAVTGSAKSKDEXGRAQGTYTFADQATLXDLLMNMNFVFTAGDYKGSGLTIYGRNEVLSAVREMSIIGGTGKFRMARGYVEARTMDSGAKSGETVVEYTVYVKAAAAAALAAAA

SEQ ID NO: 135611 - protein, 459 aa, Triticum aestivum
  Clone ID: PAT_TA_30029.pep
MASTEEQVFLESRNLSYDGAHHPDACTDWDYPEDPGDRRNGVEVAELHDQPARMSTSDSDPCEVARRALDLMFPREEDSDDGWSTWSAREEGSDDDDEQGGEEGDGSTQESSDYEDDGRNCQVILAETNCPGKLYPESQAEAIELRWADWFFQRIVEHSKLCKEIMALGDDDETPFPPSPMKVFPEATALCILGAKSCHHRVYRTHDTSTTPSTLGYREPSHMLQFFSMRLSSFEASYSISVYGIFAIRDYLDRRRNYVFNRPRDDAVTIEKQDSFVVPLCSPCRGMYVSDKALVEVDLWVKKEGDESDDKQLLSAYAEIDVHAEANVMFYSRISGDNCNLDLKYIVLSESVEAVIQVYAKVDHPHHVRFTAFSTGYDDYPHRGVVLFDDKLFGHEKLFQHIVAVKANEELHVFLEVNGSVFQWTFQDEHVGAVISPDDSVFEYGQFFVRVIFAPKDCQ

SEQ ID NO: 135612 - protein, 254 aa, Triticum aestivum
  Clone ID: PAT_TA_30030.pep
ATICSRSDHRAASMSLPPSFIHDEYMSSCLVASCVLLLLLTPKDVDLRSSAPCTPQSSFPSGDPESAGMGYGGGELGLRGGPSGGRWEGERGREERLRWQKAAARGLRPATQSGRLWAARRAGVVLWLARMRVPPGGGRVQLCGSEVLLLFVLRRTRLVDISKTGAIMLFVGFYWRPNREWRVTNKATLCARCGRRAASAAGAGAAMQEEEGSSWRRRRGRRVRRGGVARPRPLGRPGHMLPSVRFLWFGWWGR

SEQ ID NO: 135613 - protein, 320 aa, Triticum aestivum
  Clone ID: PAT_TA_30031.pep
SPSSAFSSSKDLTKGTMAAKPTSCFTFLKEALILPTLNPKLFTPLLLLFAAAAFLDHIVGFVFVQPLADVVASHVSEVNNTDFSSAEYAEVMEMGRPLLQDGMKLILIAVSKVMVALAVGFAKKILFLFAASTTYSGDRYSLAELLRELVKGRISLKGPFITIAVVGALDFAWAVLAALPPALMRGPSGVLSVQGLVSLIALLASLYVTVVALVGVAASVVDRRCRGVGALRQAWRLVTLVRRKEGLLLVLVAHFVPPVVAPLYRVAFVYAKTSMALCLCSLAVHAFLSCALQLFFLTAAPVYYYQAMQSKEVIDALRLC

SEQ ID NO: 135614 - protein, 258 aa, Triticum aestivum
  Clone ID: PAT_TA_30032.pep
MAPPLLLLVVFLLPALAAGHQHPSSYGSSALSEWRNAKSSYFAADPGDAIGGACGFGDLGKHGYGMATVGLSTALFERGAACGGCYEVKCVEDLKYCLPGTSIVVTATNFCPPNYGFPADAGGVCNPPNHHFLLPIQAFEKIALWKAGVMPIQYRRVKCLREGGVRFSVSGKSFFFTVLISNVGGAGDVRSVKIKGTESGWLDMGRNWGQIWHINLDLTGQPVSFELTSSDGTTMTNFNVVPKDWEFGKTYTGKQFLL

SEQ ID NO: 135615 - protein, 319 aa, Triticum aestivum
  Clone ID: PAT_TA_30033.pep
MEEWSLCLCFTAASTLLALLFVWLSGGKEKPAVKRQLPPGPWTLPVIGSLHHVVSILPHRRMMDMSRRHGPLMHLTLGEVPTVIVSSAEAAALVMKTNGLTFAGRPRSTTLDIFGCGGKGIIFAPYSDHCRQMRKLCNLELLSTKQVKQTEGIRAEEVGNLLRSITASNGAIVNVSKMVATLSNNVVTRAVFGGRFTKQDEYLRELDEALVLVGGFCLVDLFPSSLLVRWLSNGERRMRRCQGRIQRFISSIIDERKAARTAGDGACITHDENLLDVLLRLQQDNTLEYPLTTESIGAVLFVSFSSFSHMNFLIKGTFY

SEQ ID NO: 135616 - protein, 153 aa, Triticum aestivum
  Clone ID: PAT_TA_30034.pep
SCNGLVLSATDMTCSDDEVIAEGWHGGYDGSVATSSAARGRVLPPLARAHARGGQGQRCSRGTGRRGFLFALTNAREGGASATGYKSPDRREKNELGLSARSDGPDSLHPAADVRPAQQLGRRAGADNRPFPFVFIPQRSLFVSSLPHALFSS

SEQ ID NO: 135617 - protein, 131 aa, Triticum aestivum
  Clone ID: PAT_TA_30035.pep
AYIVVALAYIPVVRFTYMYIKLIKHGFIVRQGMHAQYEAALGHTNKLQAHALIEITYNHEFLCSNMHIMLRGTKYIPLPFIVHTTGLLSIAPVICRKSSWNNPSPPTLALPAMVPSAALLMRHVPRLNPTV

SEQ ID NO: 135618 - protein, 255 aa, Triticum aestivum
  Clone ID: PAT_TA_30036.pep
MRKKLGTRFPAARIKKIMQADEDVGKIALAVPVLVSRALELFLQDLIDHSYKITLQSGAKTLNSFHLKQCVKRYSSFDFLTEIVNKVPDLGGGESCGDERGLPRRRKFSNGSDPENEEPRSSKMPIRSLNTSPRGRGRGRGRGRGRPPTKRKEIGYVQFEDESSMFAEQSEPLPGDEIVPETNRGNESIPQSSHPLVEAPSAMTPAVISKVEEASTNHQPDWPMPDAIGGIGVGPSSFGHLTVQVDEVEDYDNED

SEQ ID NO: 135619 - protein, 91 aa, Triticum aestivum
  Clone ID: PAT_TA_30037.pep
NKSWVTGLDSFSSFQVESTIMEKLLNKNNREQIVLHKLQLHMPIYLLQVEAPLSNIITTFTIQLAYTPTEGSKQNEGTQQAQFKIRSAPGT

SEQ ID NO: 135620 - protein, 250 aa, Triticum aestivum
  Clone ID: PAT_TA_30038.pep
RRLEMEPVAWNETVSSAVSRDPAVLEFRKIVCEGDFGTEKSVFVGPRSRSISGVTENGYYVITPLIPRSTEPGSLQSPILVNRGWIPRAWRDKNMQDHQDLGETLDVNEADKKTDERGTWWKFWSKKPESSPEIEKPVKPPVRVIGVIRGSEKPSIFVPPNEPSNGQWFYVDVPMIARACGLPENTVYIEDMNEDISASNPYPLPKDANALIHHSVMPDDHLKYTFTWYTLSAAVTYMAAKRIKAKKMRL

SEQ ID NO: 135621 - protein, 201 aa, Triticum aestivum
  Clone ID: PAT_TA_30039.pep
MPCLAHEHHPRPPAANHCKSLSCLIRETYAHCHVPCIGTPGAGWSSDDDSDDDDDMLDTKQVILNEMRSRQLRKESRCGAGSPTLSSAFVWSFTPLDPRSVLEKVSSPEKFVVVEGGQKGEAEAGSDDGDAESEAFFSVKSFFTRSTSRAATVASLTDMGPPATWEGFRDCEGWPFGLCRRPAVPPLPSTPADSWQWRKQS

SEQ ID NO: 135622 - protein, 125 aa, Triticum aestivum
  Clone ID: PAT_TA_30040.pep
SKVRGPFSESSLVKVKGCVLPLCWKGKNPFSSVNDVKNQFKALSLKITHARGPSYLDIPPQNSLFLEEDGKTCLAIPNALWDLFFKELNFFFFGVVSMQVFFFFFPPETNQLGWVFAQCAKAQEL

SEQ ID NO: 135623 - protein, 122 aa, Triticum aestivum
  Clone ID: PAT_TA_30041.pep
VVAVKKLVVGPWAGSAGPPHGEHRPTRPFGRHRAPSLNWPGRVSGIVTLKKLECLTFDQLALRAPTGENTILLRGPKNAREAVRHFGKAPGVPHSHTKPYVRSKGRKFEKARGRRNSRGFKV

SEQ ID NO: 135624 - protein, 77 aa, Triticum aestivum
  Clone ID: PAT_TA_30042.pep
MITRRIARPSCRRRIIQISALSTFDGRIGAYHGGGEAVRHFGKAPGVPHSHTKPYVRSKGRKFEKARGRRNSRGFKV

SEQ ID NO: 135625 - protein, 277 aa, Triticum aestivum
  unsure (1)..(277): unsure at all Xaa locations
  Clone ID: PAT_TA_30043.pep
FFFFFFFFLFFFFFFFFFFFFFFFFFFFFFFFFFFFFFFLGEYTILFSLCATHKLRGRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPQIPQQSRYEAIRAIIYSIILQEQQQVQGSIQSQQQQPQQLGQCVSQPXQQSQQQLG

SEQ ID NO: 135626 - protein, 152 aa, Triticum aestivum
  unsure (1)..(152): unsure at all Xaa locations
  Clone ID: PAT_TA_30044.pep
MKALFLIGLLALVASTAFAQYSEVVGSYDVAGGGGAQQCPVETKLNSCRNYLLDXRCSTMKDFPVTWRWWKWWKGGCQELLGECCSRLGQMPPQCRCNIIQGSIQGDLGGIFGFQRDRXAKLIQEAKNLXPPKCKQGPPLQTSPGTNWAITG

SEQ ID NO: 135627 - protein, 188 aa, Triticum aestivum
  Clone ID: PAT_TA_30045.pep
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIQEVPAMKVTALRFTETARARIVNAGGECLTFDQLALRAPTGENTILLRGPKNAREAVRHFGKAPGVPHSHTKPYVRSKGRKFEKARGRRNSRGFKV

SEQ ID NO: 135628 - protein, 240 aa, Triticum aestivum
  Clone ID: PAT_TA_30046.pep
MNRLGGSGIGGTDVPPLQHQRREDVMGLGDPMLVTLRNNYRQRIMEHARWEVTARLYEGKRVPADWQRGLPELARRVEKVLFEKHPNKWEYYNMTNGPVEPHFEFAVTSLAQIQRQRASSTAYAHGGMIPAPGVTQGDTSNELVNTLLSLGINSSDDLSKVSNSNLAIRAPVKKEVSEEPKFSCPFCFDELVDASSTICGHIFCHKCIKFSVQAQNRCPACWRGLTMNSFHRVYLPATMD

SEQ ID NO: 135629 - protein, 67 aa, Triticum aestivum
  Clone ID: PAT_TA_30047.pep
TFDQLALRAPLGENTVLLRGPKNAREAVRHFGKAPGVPHSHTKPYVRSKGRKFEKARGRRNSRGFKV

SEQ ID NO: 135630 - protein, 236 aa, Triticum aestivum
  Clone ID: PAT_TA_30048.pep
MNRLGGSGTGGADVPPLQHQQLEEVMGHGDPMLVAMRNNYRQRILEHAERVVTARLHNGLRVPDDWQRGLPELARRVEKVLFEKHPNKREYYNMTNEPIQPHFEFAVTTSLAQTERQRASSTAYARVTQGDTPNELVNTVLSLAINSSDDHSKASNSNLAIHAPVKEEVSEEPKFSCPFCFEELVDATMRHPTICGHIFCDKCIEFSIQAQSRCPSCWRGLTMNSFHRVYLPATMD

SEQ ID NO: 135631 - protein, 154 aa, Triticum aestivum
  Clone ID: PAT_TA_30049.pep
MSMKTMFSVLLLCMLVATPIAAEYDAWSGNSGPWMCYPGQAFQVPALPACRPLLRLQCNGSQVPEAVLRDCCQQLAHISEWCRCGALYSMLDSMYKEHGAQEGQAGTGAFPRCRREVVKLTAASITAVCRLPIVVDASGDGAYVCKDVAAYPDA

SEQ ID NO: 135632 - protein, 154 aa, Triticum aestivum
  Clone ID: PAT_TA_30050.pep
MSMKTVFSVLLLCMLVATPIAAEYDAWSVNSGPWMCYPGYAFKVPALPGCRPVLKLQCNGSQVPEAVLRECCQQLADISEWCRCGALYSMLDSMYKEHGVQEGQAGTGAFPSCRREVVKLTAASITAVCKLPIVIDASGDGAYVCKGVAAYPDA

SEQ ID NO: 135633 - protein, 152 aa, Triticum aestivum
  Clone ID: PAT_TA_30051.pep
MKIVFSVLLLCMLVATPIASEYGPWSYNSGPWMCYPGQAFQVPALPGCRPLLKLQCNGSQVPEAVLRDCCQQLADISEWCRCGALYSMLDSMYKEHGVSEGQAGTGAFPSCRREVVKLTAASITAVCRLPIVVDASGDGAYVCKDVAAYPDA

SEQ ID NO: 135634 - protein, 188 aa, Triticum aestivum
  Clone ID: PAT_TA_30052.pep
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIQEVPAMKVTALRFTETARARIINAGGECLTFDQLALRAPTGENTILLRGPKNAREAVRHFGKAPGVPHSHTKPYVRSKGRKFEKARGRRNSRGFKV

SEQ ID NO: 135635 - protein, 148 aa, Triticum aestivum
  Clone ID: PAT_TA_30053.pep
MKALFLIGLLALVASTAFAQYSEVVGSYDVAGGGGAQQCPVETKLNSCRNYLLDRCSTMKDFPVTWRWWKWWKGGCQELLGECCSRLGQMPPQCRCNIIQGSIQGDLGGIFGFQRDRASKVIQEAKNLPPRCNQGPPCNIPGTIGYYW

SEQ ID NO: 135636 - protein, 154 aa, Triticum aestivum
  Clone ID: PAT_TA_30054.pep
MSMKTVFSVLLLCMLVATPIAAEYDAWSVNSGPWMCYPGQAFQVPALPACRPLLRLQCNGSQVPEAVLRDCCQQLAHISEWCRCGALYSMLDSMYKEHGAQEGQAGTGAFPRCRREVVKLTAASITAVCRLPIVVDASGDGAYVCKDVAAYPDA

SEQ ID NO: 135637 - protein, 188 aa, Triticum aestivum; identical to SEQ ID NO: 135627
  Clone ID: PAT_TA_30055.pep

SEQ ID NO: 135638 - protein, 188 aa, Triticum aestivum; identical to SEQ ID NO: 135627
  Clone ID: PAT_TA_30056.pep

SEQ ID NO: 135639 - protein, 401 aa, Triticum aestivum
  unsure (1)..(401): unsure at all Xaa locations
  Clone ID: PAT_TA_30057.pep
MEARRRTLLVALAVLALAAAAEGYNITKILAAYPEYSQFNKLLTQTRLAQDINKRRTITVLVVANGDMGSLAGGGRTLQTIRHMLQIHVLVDYYGGKKLHQLAHGVTACSTMFQESGAAPGMSGYVNITQHRGGKVTFTAEDAEDSAPSSAFVKSVKEIPYDLAVLQISKVLASPEAEAPVAAPAPVNITELLSKKYCKSFAGLLAADADAYSTINATKDNGLTLFCPVDSAVASFMPKYKNLTAKGRTAILLYHAVPDYYSLQLLTSNSGKVSTLATSNVAKKDYSFDVEKDGETAELDTKVNSASVTYTIKDDDPLAVYAISKFLQPKELYKIAKDIAPAPAPEAPKKKKTTKKKPSAGASPSDDDDADDSAADSPDDPSSDDXALDKDGAAPSAVAGG

SEQ ID NO: 135640 - protein, 196 aa, Triticum aestivum
  Clone ID: PAT_TA_30058.pep
MGSGLSHNHRSSVAPQQQPSSARVIAADGSLTEFATSSPVSVSDVLGAGNAGGSFFLCSSDALYFDEDVPALGGGELLRPGQIYFVLPVAMLGRPLSSADMAAMAVRASEALATRARPRGRGAGIRKVRVTPVHAEGGRGDVDAQVNAKLNERTLGEYSVKASGSPAKIGKKAAVAAFPPAKKALKPLSTIEEDAE

SEQ ID NO: 135641 - protein, 160 aa, Triticum aestivum
  Clone ID: PAT_TA_30059.pep
AVGQCVLAVAEAAYGGHSSTVWSVSFNQKGDRMVTCSDDCTLKIWDTSADLSQPTTGEVHESWRHLSTLSGHHGRTIFSAHWSSEDVIASGAGDDAICLYAEEKSTMVEGPLYRLILKKEKAHDMDVNCVRWCPQDPRVLASASDDGTVKLWELRGNVLE

SEQ ID NO: 135642 - protein, 413 aa, Triticum aestivum
  Clone ID: PAT_TA_30060.pep
MAKHSATLCGLLVVVLCLASSLAQAQILFQGFNWESWKTQGGWYKFMQGKVEDIASTGATHVWLPPPSQSVSPEGYLPGQLYNLNSKYGSGADLKSLIQAFRSKNISCVADIVINHRCADKKDGRGVYCIFEGGTSDNRLDWGPDEICSDDTKYSNGRGHRDTGGGFDAAPDIDHLNPRVQRELSAWLNWLKTDLGFVGWRLDFAKGYSAAMAKIYVDNSKPSFVVGELYDRDRQLLANWVQGVGGPATAFDFPTKGVLQEAVQGDLGRMRGNGGKAPGLIGWMPEKTVTFIDNHDTGSTQRLWPFPSDKVMQGYAYILTHPGIPCLFYDHVFDWKLKQEITALARVRSRNGIHPGSTLDILKAEGDLYVAKIGGKVITKIGSRYNIGNNVIPSGFKIAAKGNNYCVWEKSGL

SEQ ID NO: 135643 - protein, 173 aa, Triticum aestivum
  Clone ID: PAT_TA_30061.pep
MSDNISSRSALQLRILILQLTLQLTLMEYFFDKMKLILQLALYLQPTAAAEAISSRGARGQRQSAVEGRSNQQRQSAEAISRSNRLWHQQVCVVLSPPGKIRLALPAEFFKRGAATGVGSGGWGCREGEEPASRARDASRATRRRRPSRWSRSSLSWAAGQLASVRMAHVRSG

SEQ ID NO: 135644 - protein, 75 aa, Triticum aestivum
  Clone ID: PAT_TA_30062.pep
LTMRLVLLVDAKISSKMYILMVRPRRAMQSNSIPQQTNQSNRRIERKDPATNRSNREKESDQIPQWWRTESAHAS

SEQ ID NO: 135645 - protein, 210 aa, Triticum aestivum
  unsure (1)..(210): unsure at all Xaa locations
  Clone ID: PAT_TA_30063.pep
MGSGSRAASCLCCPFKCLACGLFSCLCSILVSLLVTAGVLALILYFVFRPQMIAATVDSASLAQFALGTPASPALLQYNLTLAMTVRNPNKRVGLYYDGXEALALFDGQRFGFAPLDPFFQGHQASTEVKPAFGGQQVLEGDVTQANLRSQLAGGAVEVEVKLNAKLRVKVWAFKVPGPRARISCPLSLPAPGAAAGAPAFKRTECKVWF

SEQ ID NO: 135646 - protein, 310 aa, Triticum aestivum
  unsure (1)..(310): unsure at all Xaa locations
  Clone ID: PAT_TA_30064.pep
MGSGSRAASCLCCPFKCLACGLFSCLCSILVSXLLVTAGVLALILYFIFRPQMIAATVDSASLAQFALGTPASPALLQYNLTLAMTVRNPNKRVGLYYDNVEALALYDGQRFGFAPLDPFFQGHQASTEVKPAFGGQQVLEGDVTQSNLRTQLSGGAVDVEVKLNAKLRVKVWAFKVPGPRARISCPLSLPAPAAAGAPAFKPTECRGLVLSPGSIRVDSCARALRAASSPGPGPALDAMGCIARCWSPPPPPRSLPWPVRSRSYSDSQRGIAVVALDVLIPSRFLFIWLIGCVWVAASLRDSYGLSSSR

SEQ ID NO: 135647 - protein, 73 aa, Triticum aestivum
  Clone ID: PAT_TA_30065.pep
TVSHVRYYLRYKFSGNHGTMSHSSFLCVQNIIVLLGNIFIILVNCLCIVADGHIYNKGAYMFSWFNINIVCNT

SEQ ID NO: 135648 - protein, 163 aa, Triticum aestivum
  Clone ID: PAT_TA_30066.pep
HAGKLQNEDGSWFGSWGICFTYGTWFAIEGLSAVGQCYNNSTYIRKGCQFLLSKQLRNGGWGESHLSSTTKAYTNLDGEKSHVVNTAWAMLALMKAGQAERDPSPLHEAARLIMSMQLGNGDFPQEEMIGSFLKNGPLCYMAYRNIFPIWALGEYHRLVLCSG

SEQ ID NO: 135649 - protein, 174 aa, Triticum aestivum
  unsure (1)..(174): unsure at all Xaa locations
  Clone ID: PAT_TA_30067.pep
HSPGGKGPAPRGMPQIEVXNGIVKVSAKDKSTGKEQDITIKSSGGLSDSDIEKMVKEAELNSQRDQERKSLIDLRNSADTTIYSIEKSVSEYKDKVPAEVVTEIQSAVSDLRAAMAGDDLDAIKQKLEAANKAVSKIGQHMQGGGGAAGGDSGSSGGGDQTPEAEYQDPKEAKM

SEQ ID NO: 135650 - protein, 141 aa, Triticum aestivum
  unsure (1)..(141): unsure at all Xaa locations
  Clone ID: PAT_TA_30068.pep
MNFVAGSHNQTEPRVGFGGGCRRARHRSPHATTARRRRGCRRSRRARSRWCKHPRGRLHRRGPVAHGDRRRAWPGGRRFGSREWRVRRHRRRKAGHIGGGSRARXPRARRRHTRRRAWRRRRSRRTRRAPCRVTGVAKRGT

SEQ ID NO: 135651 - protein, 196 aa, Triticum aestivum
  unsure (1)..(196): unsure at all Xaa locations
  Clone ID: PAT_TA_30069.pep
MASYHRVHPVIVDGAPPPVPEQNKDKLPPPPSGAYGDRLPITAPAPGAAAPLRAPRRKRHSRCCRCVCCTLLVLILLVVALGATAGILYAVFRPKIPTFRVERLTATRFDVNTTSMTVSDAFEVQVITDNPNRRIGVYYDGGWVAASFNGTELCRGAFTALYQGHRSTVRXLITLQGETRLDSAVAAQLPQQRQGR

SEQ ID NO: 135652 - protein, 253 aa, Triticum aestivum
  Clone ID: PAT_TA_30070.pep
MASYHRVHPVIVDGAPPPVPEQNKDKLPRPPSADYGDRLPITAPAPGAAAPLRAPRRKRHNRCCRCVCCTLLVLIVLIVALGATAGILYAVFRPKIPTFRVERLTATRFDVNTTSMTVSDAFEVQVVAENPNRRIGVYYDGGWVAASFNGTELCRGAFPALYQGHRSTVRPLITLQGETRLDSAVAAQLAQQRQAGFVPLTVTARVPIRIKFGALKLWTMTGKARCSLVVDSLEAGTRLRIRSNSCTFKLKPN

SEQ ID NO: 135653 - protein, 138 aa, Triticum aestivum
  Clone ID: PAT_TA_30071.pep
GADRGGLLAAPPTKTITGNSSLTCAAVGSIPEAQLNYPAILVPLSEKPFKAKRTVTNVGPAMSTYTAHLDVPGWLKVKVEPEALEFTSAMEKKTFTVTVSSRGGDADAGQLAEGSLRWVSEDHVVRSPIIADARVVPT

SEQ ID NO: 135654 - protein, 384 aa, Triticum aestivum
  Clone ID: PAT_TA_30072.pep
PGLCLNDDLQRVLAKHDAIAAGIEVPVEKQRSLHSTPAKPDTTKEAVQRSSATTTSASKQSPFEQLALPAPRSSSSAKAIVAAPAPSFDLLSGDDYIKPEPENSLALVPVSEYSASDQNVLALADMFQQNSVAANNRNHNQLTNSFVSPASRANPAPVHPTLPQQPTTYSNGDIVPYGQQSQPNVTRSWNGQPAYGVDSQRQALNYGVEDQNRGLPPPPWEIQHLTGNQPQQAQSGQGFMSTQQMPGGMRLPPVLGAQQAPQFVPNMQYGGMYPNSMQINQGMGMNSQPIVGGQFYGMNYQQSYAVQMAGYGYVHQSGGYYIPNAAYAYTSANELSQRMNGATSSFSLKQQNKASRPEDSLFGDLLSIAKMKQSKPAAGKVGGL

SEQ ID NO: 135655 - protein, 310 aa, Triticum aestivum
  unsure (1)..(310): unsure at all Xaa locations
  Clone ID: PAT_TA_30073.pep
MAACVDKWNPAYSCHRISRSIYRFMPDCTVTAPAGAPVNGNGGDEVWEELYGEAQADAQDEPLLGMFYSELVLSHPSLEAALAAHLSAKLCIPGALPQDALRDILAGALAAHPEASQHTRADLLAARDRDPACAKMVHCFLYYKGFLALQAHRAAHALXGSEGRRPPALLLQSAASEVFGVDIHPGARIGGGILLDHATGVVIGETAVIGDDVSILHGVTLGGTGKACGDRHPKVGDGVLIGAGASVLGNVRIGDGAKVGAGAVVLRDVACGATAVGNPAKPIGKKAAPSLRPEEQPGVTMEQRWSDYVI

SEQ ID NO: 135656 - protein, 425 aa, Triticum aestivum
  unsure (1)..(425): unsure at all Xaa locations
  Clone ID: PAT_TA_30074.pep
MGQKDSKPSYNSADYGNSSNGYNSRYANTPSSYSPRYASSAGNNVQQPEAQARLQRKYSRIGDDYRSVSQVTEALAQAGLESSNLIVGIDFTKSNEWTGKISYNRRCLHDIGNTPNPYEQAISIIGRTLSAFDEDNLIPCFGFGDASTHDQEVFSFYPENQPCNGFEEALERYREIVPTLRLAGPTSFAPIIETAIGIADSTGGQYHVLLIIADGQVTRSVDTQSGQLSPQERDTIDAIVKASHFPLSIVLVGVGDGPWDMMHKFDDNIPARSFXDNFQFVNFTEIMSKSIAADRKEAEFALSALMEIPTQYKATLDLQLLGRRQGIPPRVPLPPPTKDSLFTRQHGATRRPDSYSSESSQPAASRIPDTYASESSESTLSCAICMDKSKDLAFGCGHQTCYDCGKNLVRCPMCQQHITTRIRLY

SEQ ID NO: 135657 - protein, 122 aa, Triticum aestivum
  Clone ID: PAT_TA_30075.pep
RSRPGSHSAAFFTLPEASRPARASRSRTPRPPGRGPSRPRPRTRCRRSGTRSPWRQCRRPQPPGTPARRRSFLPSSRGAPAFSRRPRPGPARPRRARRRTPAPCPARRRTARRGPSPARRPG

SEQ ID NO: 135658 - protein, 484 aa, Triticum aestivum
  Clone ID: PAT_TA_30076.pep
MEDTFITVCLAVALVSLLIMIAGRRRWGARGDGLRMAPGPWQLPVIGSLHHLVLAGQLPHRAMRDLSRRYGPAVLLQLGQVKTLVVSSREGAREVMKNHDTMFATRPLSTTMRVLSYGGQDIVFAPYGEYWRQLRKIAVSELFTARRVLSFRAIREEEVATAVRAVDEAAAAARPVEMRAVLSTLVTDSTARAVIGDRCKERDAFLRELDRIVQLASGFNLADMWPSSRLAAWLSGAEECRHTLYTMLDGIVEEHLQRMDGGGDHAEDLLDVLLKIQKEGGLKFPIHMDAVKAIILDVFSAGSETTTTTIEWAISELMNNPMAMQKATTEVRQAFQASGTVAEHALSELTYLRFVIRETLRLHRNRVLARPRVPPIVPSARPRDAARYTRPCRLLFRECQEPCQVQGYDVQRGTQVLVNAWALGRDERYWPDAPEEFRPERFEEEAAKADFGGGDFAFLPFGAGPRMCPGTTRGSPRRELDFDR

SEQ ID NO: 135659 - protein, 413 aa, Triticum aestivum
  Clone ID: PAT_TA_30077.pep
MVNFKNLAAAATSLLGLANAAPTAKVNSDEVIPGKYIVTLKSDIAASKIESHLNWVGDVHKRGLNERAEKGVERTYNGKYGFHGYAGSFDKDTIKEIKENPDVALVEEDRVWTINWVDEPEKESLSKRAETTQSSATWGLGTVSHRSKGSTSYIYDTNAGSGTYAYIVDTGIITSHNEFEGRAQAVYTAFSGQNADTNGHGTHVAGTIAGKTYGVAKKATIQAVKVFQGSSSSTSIILAGFNWAANDIISKGRTKTSVVNMSLGGGYSASFNNAVESASSSGIISAIAAGNDGANAANTSPASAPSAITVGAIDSNWAIASYSNYGTVLDIFAPGTSVLSAWYTSNSATNTISGTSMATPHIAGLVLYGISVKGVSGVSGVTNWLTSTATSGKITGNLRSSPNLIGNNGNSLQ

SEQ ID NO: 135660 - protein, 254 aa, Triticum aestivum
  unsure (1)..(254): unsure at all Xaa locations
  Clone ID: PAT_TA_30078.pep
MESTRAATASSGVGHGGSDEGAAVLLLPFPXAQGHTNPMLELGRRXGAHGLRPTFVSTRHVLSSTPPPGAPFRVAAISDGFDAGGFASCPDPAEYFSRLEAVGPETLRELLLSEEATSVRILMYDSHLPWAGRVARPAGVPAAAFFSQSCAVNDVYGEVWAGRXALPVTDGRELLVRGALGVELGPEDVPPFASAPESLPVFLKTSIEQFDGLEDADDVLVNSFSDIEPTERNIKRSPIDLKLYDDDFWTKRSP

SEQ ID NO: 135661 - protein, 125 aa, Triticum aestivum
  Clone ID: PAT_TA_30079.pep
APERVTMYDVLAVGNAAGPEEIKAAYRRAARRWHPDACPGGADRFMRAREAYEVLSDPERRRGYDIQLRCGAGAGAAGSRSSPAPRAGFADWEAQLAGLQWRMADTRGETWGSRMRRGAAQPTSF

SEQ ID NO: 135662 - protein, 234 aa, Triticum aestivum
  Clone ID: PAT_TA_30080.pep
ARGSSPIQRKPPTLTPTRGDPHLRSDPMLPMVDDPSAAGAAASSSFPDADAYGNGDSEDIDFPVDPIPNPPFSSAPVAAPASATATVGERRPLFQRLWTEEDEIVILRAFAEFTAQRGTAFASHQYDTEPFYEEMRRRLQLDFSKSQLAEKLRRLKRKYRNCVERLRCSGNTFSFRSPHEQAVFEIARNIWRPSSDKHGRDPNAADSEDDATITATNAAANGDAKSPSSSKAHR

SEQ ID NO: 135663 - protein, 77 aa, Triticum aestivum
  Clone ID: PAT_TA_30081.pep
LIIQLDNEGIQTFFESFFRLPKWMSRGFLGSTLSSADLMLFALYMFAIAPNTLRMNLVRHLLSDPTGSAMIRTYLTL

SEQ ID NO: 135664 - protein, 116 aa, Triticum aestivum
  Clone ID: PAT_TA_30082.pep
MALIRAAVAPLRAARCLRQPLSSRGFSVSARRQGGGGSHQFDPPTGWLWGVKPGEKAEPEGWEWPTYILLGSLAATAVALAFKPDTTVSTWALEEARRRLEEEGVLPDPSKQGKKN

SEQ ID NO: 135665 - protein, 397 aa, Triticum aestivum
  Clone ID: PAT_TA_30083.pep
MHSVKVLSAIAALGISAVSAATCTSDIKVTEPTPSIDCTVVKGDIVIDKKVAGAVVINGPEKIEGNFVAKNGGDIVSIASTSIESIDGNFQLENLEALSNLEFSSLKSLSGLSFIKLPRLGELNFGTEGVTKIKSIRITDTFISDLSGLSVATVESFQIDNNRKMNAFRSDLVNITSELKIFDNGNDAMEIIMDKLELAAEIQISSAKNFSVPLLKEVTKSLKLNANPSLEFFSAPNLTIIEETLSLIDMKKLTNVSFPLLEEIGGGFTIQNNTKLEAIDDFPKLEKVTGGMALRGSFEKVKLPKLDQVSGSVVVSSTTDIEEFCKYFDDLKKDKKIDGEEKCTFNNKNANKGEDGGEESDGSGSSQSNEDDSAAGSVSINMAVLALAGVAALAQIF

SEQ ID NO: 135666 - protein, 231 aa, Triticum aestivum
  Clone ID: PAT_TA_30084.pep
MAKNSRSMKYSSGELRSTRYLRPFSHCSFKRVATQEPTLAATEKCAWKDAICPVCIECPHDAVLLLCSSHDKGCRPYVCGTSFLHSNCLDQLIESRRSPGSGDDPGSIVLTCPLCRGEVKGYTLVEPAREQLNRNRRSCMQDGCSYSGTYRELCRHARKKHPSAKPRAADPLQTYRWRRLMFRTTLQDMICATSSSMLQGLLSAMLQWEELLSSGWRGGDDHLGAANDTAV

SEQ ID NO: 135667 - protein, 270 aa, Triticum aestivum
  Clone ID: PAT_TA_30085.pep
MASSSSSVLLVAAVLAAVVCGAHGIPKVPPGPNITASPASYGNKWLDAKTTWYGKPTGAGPKDNGGACGYKEVDKAPFHGMTSCGNIPIFKDGRGCGSCFELKCTKPEACSGEPTMVTITDKNEEPIAPYHFDLSGHAFGSMAKKGEEQKLRDAGEVEIKFRRVKCKYPPGTKVNFHVEKSSNENYLALVIKFLQGDGDVVGVDIKQKGEDKWTELNESWGAVWRIDTPHKLIGPFSVRYTTEGGTKTVVDDVIPKGWKPDTSYEAKGGY

SEQ ID NO: 135668 - protein, 160 aa, Triticum aestivum
  Clone ID: PAT_TA_30086.pep
AQVLQDGRRARERRCRKAVVVVGELGVRPLQGRRRPPPPPARPAGPPEPPALGPPRPSSPRSWTSSSSTAAPASSPHAPGAPTGSWRGGHLRPSAPAPERPSRPATAPAPAAGARTAAAAAGRGSTGPPDAAAAAPLVGAAALGGRRHGRPGVGAGGSGR

SEQ ID NO: 135669 - protein, 135 aa, Triticum aestivum
  unsure (1)..(135): unsure at all Xaa locations
  Clone ID: PAT_TA_30087.pep
RRPWSSPAASSSPGSPSSPPXALPRPPPXAPSPAPPTPPATPTRTPPPPRRTSRPPPLPPPPPSPPLSPPPSPRRRTPLSPSPRPSRPRPRSLPRLWRARTRERTRRSNWERSGRRPWPPRPSEDDGARLAWLHF

SEQ ID NO: 135670 - protein, 69 aa, Triticum aestivum
  Clone ID: PAT_TA_30088.pep
RGRRPRRAVAGGRRQPGRNGVAAHASVMAYQHHHRTHSSTIELCVPSQISTRSVNMFQARLFFSFLLPF

SEQ ID NO: 135671 - protein, 321 aa, Triticum aestivum
  unsure (1)..(321): unsure at all Xaa locations
  Clone ID: PAT_TA_30089.pep
MGAVKNLVKLLILVEVAVALAGPGVAALSMNYYGMNCPFAEYIVRSVVSDAVXAPTLAAGLLRLHFHDCFVQGCDASVLLDAAPGSKAEKDALANKSLRGFEVIDKIKDTLEAQCPGVVTCADILALAARDAVLMVGGPYYDVPQGRRDGRRSVDTDTLTALPSPFLNASALITLFGTHGFNVQDMVALSGGHTLGVAHCPSFTPRLKFEASTLDAGFASSLAATCSKGGDSASATFDRTSTAFDGVYFKELQQRRGLLSSDQTLYESPETQRRVNMFAMNQGYFFYAFTQGMGKMGQIDLKEGDRGEVRKSCRVVNKPSW

SEQ ID NO: 135672 - protein, 189 aa, Triticum aestivum
  Clone ID: PAT_TA_30090.pep
MTASTRRHYIDDPYTGTRFWQNRCVLDGPPPVLAKPVDSSPTAPSDIRKVHCPRLQLRHSAFFAPPALCGFIIHDDHTIDHDYIDHGYITMIGYLDIDINGLVYSNTSATTSVNSVRVVTSVHATPHVTAGGNRGEGEKAPEGDVVTALGADPSETQLMMAEKRRRRKHKSSNSVAVARFTPATTEGEY

SEQ ID NO: 135673 - protein, 94 aa, Triticum aestivum
  Clone ID: PAT_TA_30091.pep
PVSTPPSTAAALEDGELTCGDHRGVAALVRLRSVGGVLQAVARSCPRRGRLVHGELAGVCRREGGAKQARRGSLVAGSLCKVVKCIISPVSLFQ

SEQ ID NO: 135674 - protein, 158 aa, Triticum aestivum
  Clone ID: PAT_TA_30092.pep
FECWHLSIFSFAKCAAQAIRHQGGGRKEAEERQQEEERRIDGGRGRMHEEVVAQIEKEKVSALVEAQQRAEREKKEREELEKELEEERKKAEEAQMKVAMEQQQKELERYQELERLQKEREEAMKQKQMEEQQQKQNQIKLLGKNKSRPKLSFSFGMK

SEQ ID NO: 135675 - protein, 261 aa, Triticum aestivum
  Clone ID: PAT_TA_30093.pep
MARGIKKHQKRLSAPSHWLLDKLSGTYAPKPSAGPHKLRDCMPLIVFIRNRLKYALNYREVKAILMQRLVKVDGKVRTDSTFPSGFMDVITIEKTGENFRLVYDTKGRFTVHRIQNEEAEYKLGKVKRVQLGRGGIPFLVTHDARTIRYPDPLIKVNDTVKIDLATGKITDFIKFDTGAVVMVTGGRNMGRVGVITHRERHDGGFNIVHVKDAIDNSFATRESNVFIIGQDKPWISLPKGKGVKLTIAEERDRRRAYAISH

SEQ ID NO: 135676 - protein, 240 aa, Triticum aestivum
  unsure (1)..(240): unsure at all Xaa locations
  Clone ID: PAT_TA_30094.pep
MDQPASDAGACLEVRLFYVRLSPRSSGAAAPPRLSLAIHHAGTEASPSSLPLRLDRCDPVSGEATYVSTAAARLPPPDASFEVADHRDAALLRGTLRRCPDAKADSPAWAIDCVPADAAAASASAFEVYVAGYCAGEPAVLTRALRLATPEEAAGGLVRRRSAPLAAMCDEDESDMNMGTRAYPEXWYSDDDDGQLTWFNAGVRVGVGIGLGVCVGVGIGVGLLMSSYQATARNLKRRFF

SEQ ID NO: 135677 - protein, 321 aa, Triticum aestivum
  Clone ID: PAT_TA_30095.pep
ARNTLFPECRTEGNGKHDFVVFTSAHGHYSVEKSAMICGMGSNSVWPVPVNEVGCMKPDALRELVLKAKSEGKTPLYVNSTAGTTVMGSYEPFEEISKICKEFGLWMHIDASWGGPAIFSSKHKHKLNGAHLADSLTVNPHKMMNVPVTCSFLLGPDMGIFNKANSTAAGYLFHTNDGGDFWDLADLTLQCGRRGDSLKLALAWIYYGAAGFEKQIDHAFEQAAYLANLIKQSDNFVLVSQDPPPCLQICFYNAPGGTLSEDKEENTLRTKTMVEKIILRGYMVDYAPGPKGSFFRVVVNCQTLKGTVEGLVKGLEEVGRE

SEQ ID NO: 135678 - protein, 64 aa, Triticum aestivum
  Clone ID: PAT_TA_30096.pep
ERKQAYIAELESLVTQLEEENAHLSKEQEEANQRRLKELKEKLTPVIIAKTPSQDLRRTNSMEW

SEQ ID NO: 135679 - protein, 49 aa, Triticum aestivum
  Clone ID: PAT_TA_30097.pep
HPKKTSSFSNNGLVPCSTNLKAACPCLLAKIMSFPEKDRLAPTRPPTRP

SEQ ID NO: 135680 - protein, 262 aa, Triticum aestivum
  unsure (1)..(262): unsure at all Xaa locations
  Clone ID: PAT_TA_30098.pep
PAPARGASTGSAAAAPPTPPGRPGPTRWELGSDTVKEFQFGCTRVEEGFGDKTDGLMGLRRDAQSLISHTAATYGRAFSYCLPPSPGPKGFXTLPPKSATTGFATTGMLRSEQAPTFYGVLLQGIKVGGDQISVAPSVFSAGSVMDSGTIITRLPPTAYTALKTAFKDGMKQYPTAPSRSILDTCFDFSGQDNVTIPTVALMFDGGAVVDLDANGIIFGSCLAFTGTDDDESTGIIGNVQQRTLEVLYDAGQSVFGFKSNAC

SEQ ID NO: 135681 - protein, 59 aa, Triticum aestivum
  Clone ID: PAT_TA_30099.pep
WVEGDNGGVSRDSRAYGPVPLGLVQGRVTHVVWPPSKMGRVDKRVPSEGRGRVMPQRNL

SEQ ID NO: 135682 - protein, 246 aa, Triticum aestivum
  Clone ID: PAT_TA_30100.pep
CYDQVVHDVDLQKLPVRFAMDRAGLVGAHGPTHGGAFDVAFMACLPNMVVMAPSDEAELLNMVATAAAIDDRPSCFRYPRGNGIGVPLPENYKGTAIEVGKGRIMIEGERVALLGYGSAVQYCMAASSIVAHHGLRVTVADARFCKPLDHALIRSLAKSHEVIITVEEGSIGGFGSHVAQFMALDGLLDGKLKWRPVVLPDKYIDHGSPADQLVEAGLTPSHIAATVFNILGQAREALAIMTVQNA

SEQ ID NO: 135683 - protein, 78 aa, Triticum aestivum
  unsure (1)..(78): unsure at all Xaa locations
  Clone ID: PAT_TA_30101.pep
MDPYKHRPTSGANSGYWTTNSGAPVWNNNNALTVGXKRGPILLEDXHLIEKLAQFDREAYPLNVLFNARGXQLQKGFF

SEQ ID NO: 135684 - protein, 73 aa, Triticum aestivum
  unsure (1)..(73): unsure at all Xaa locations
  Clone ID: PAT_TA_30102.pep
LIHTKCNLPWMQSGKTFDSNILNNHRCPRLISSSTTLLWPSRRYSLGTYXPYPLHGSFAILSSQQFTYLALFY

SEQ ID NO: 135685 - protein, 191 aa, Triticum aestivum
  unsure (1)..(191): unsure at all Xaa locations
  Clone ID: PAT_TA_30103.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHALVLQQQQQLVQGISTQPQQQQQQGQQQQGQGSSQPQQQTQLDXGWNAVIXDMVIQTIPAMWHVHVPPYCYTTISPSN

SEQ ID NO: 135686 - protein, 212 aa, Triticum aestivum
  unsure (1)..(212): unsure at all Xaa locations
  Clone ID: PAT_TA_30104.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHAIVLQQQQQLVQGISTQPQQQQQQGQQQQGQGSSQPQQQTQLDQGWIAVIGTWVIQXISXMCDVHVPPYCYTTYHHSLDVLPAWAATERSKNPKTDHIC

SEQ ID NO: 135687 - protein, 204 aa, Triticum aestivum
  unsure (1)..(204): unsure at all Xaa locations
  Clone ID: PAT_TA_30105.pep
MKKFLVLALIVIAATTTAAEPFTAFRIASEPQHPSSPEQQPTLQPQEHPVPHQKLNPCRDALLHQCSPVADMSFLRSQVVQHSSCLVMWEQCCQQLKAIPKQSRCEAIHNVVHAIILQQAKTIGYKVLQXQPQQQQQQGQQEHGQGSSQPQHQQQQQQLDQGWIVAIGTWXIQTVPAMCDVHVPPYCYTTISSSSDVTTGMGGY

SEQ ID NO: 135688 - protein, 201 aa, Triticum aestivum
  Clone ID: PAT_TA_30106.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIQTIPAMCDVHVPPYCYTTISPSNDVTTDIGGS

SEQ ID NO: 135689 - protein, 230 aa, Triticum aestivum
  Clone ID: PAT_TA_30107.pep
MTTAARPTWAPAKGGNEQGGTRIFGPSQKYSSRDLAAHTSLKPRKDGQQTQEELQKRNLREELEERERKHYSSKDKSYSEERDRRKSSSQLLLEGSKREAEDKIVPREIDADDSDVEPKSDDESDEDDDDDDTEALMAELERIKKERAEEKLRKERQQAEEEAKMKEAELMRGNPLININNAGSFSVKRRWDDDVVFKNQARGETKTPKRFINDTIRSDFHRKFLQRYMK

SEQ ID NO: 135690 - protein, 153 aa, Triticum aestivum
  Clone ID: PAT_TA_30108.pep
LLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDASLGQKLASRLKIKPSM

SEQ ID NO: 135691 - protein, 222 aa, Triticum aestivum
  Clone ID: PAT_TA_30109.pep
FTQQQQPSFSQQPPISQQQQQQQQQQQPFTQQQQPPFSQQPPISQQQQPPFSQQQQPPFSQQQQIPVIHPSVLQLLNPCKVFLQQQCIPVAMQRCLARSQMLQQSICHVMQQQCCQQLRQIPEQSRHESIRAIIYSIILQQQQQQQQQQQQGQSIIQYQQQQQQGQGSSQPQQQTQLDQGWIAVIGTWVIQTIPAMCDVHVPPYCYTTISPSIDVTTGMGGY

SEQ ID NO: 135692 - protein, 287 aa, Triticum aestivum
  unsure (1)..(287): unsure at all Xaa locations
  Clone ID: PAT_TA_30110.pep
RVNTYTLISRGXKAHLVKFHWKPTCGVKCLLDDEAVTVGGTCHSHATKDLYDSIAAGNYPEWKLYIQTIDLDHEDKFDFDPLDVTKTWPEDIIPLQPVGRMVLNKNIDNFFAENEQIAFCPAIIVPGIHYSDDKLLQTRIFSYADTQRHRLGPNYLMLPVNAPKCAHHNNHHEGFMNFMHRDEEVNYFPSRFDPTRHAEKVPIPPRVLTGCREKCIIEKENNFKQAGERFRSFDPARQDRFIQRWVDALSDPRVTHEHHTIWINYWSQCDASLGQKLASRLNLKPNM

SEQ ID NO: 135693 - protein, 87 aa, Triticum aestivum
  Clone ID: PAT_TA_30111.pep
MAKLAMPLAATFLTLGLAVLLLSAAGPAVAQNCNCPAGMCCSQWGYCGTGPDYCGAGCQSGPCTVVSSGAAAAETSGGKPVGSERTR

SEQ ID NO: 135694 - protein, 87 aa, Triticum aestivum
  Clone ID: PAT_TA_30112.pep
MAKLAMPLAATFLALGLAVLLLSAAGPAVAQNCNCPAGMCCSQWGYCGTGPDYCGAGCQSGPCTVASSGAAAAEASVGKPVGSNRTP

SEQ ID NO: 135695 - protein, 138 aa, Triticum aestivum
  Clone ID: PAT_TA_30113.pep
SIFLLRCSCRSGQGMAVRACTCFFRLCVAPGGQEHDPPDGVLGGGQAPAVGAVGRLRHRLGGHSRGGRRRPRGAVAAGARGARGGCPPELVTKGLLDLVSPGGAGGGLPGEVRGLHGRKMRTGGGRLAACACAGREDI

SEQ ID NO: 135696 - protein, 160 aa, Triticum aestivum
  unsure (1)..(160): unsure at all Xaa locations
  Clone ID: PAT_TA_30114.pep
EIFALRDTXQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 135697 - protein, 87 aa, Triticum aestivum
  Clone ID: PAT_TA_30115.pep
MAKLAMPLTATFLAFGLAVLLLSAAGPAVAQNCNCPAGMCCSQWGYCGTGPDYCGAGCQSGPCTVASSGAAAAEASGGKPVGSGRTP

SEQ ID NO: 135698 - protein, 87 aa, Triticum aestivum
  Clone ID: PAT_TA_30116.pep
MAKLAMPLTATFLAFGLAVLLLSAAGPAVAQNCNCPAGMCCSQWGYCGTGPDYCGAGCQSGPCTVASSGAAAAEASGGKPVGSNRTP

SEQ ID NO: 135699 - protein, 228 aa, Triticum aestivum
  Clone ID: PAT_TA_30117.pep
MTTAARPTWAPAKGGNEQGGTRIFGPSGKYSSRDLAAHTSLKPRKEGQQTQEEVQKRNLRDELEERERKHFSSKDKSYVDERDRRKSSSLLLEGSKRDEDKIVPREIDADDSDVELKSDDESDDDDDDDDTEALMAELERIKKERAEDRFRKERQQAEEEAKMKEAELMRGNPLINMNNSGSFNVKRRWDDDVVFKNQARGETKTPKRFINDTIRSDFHRKFLHRYMK

SEQ ID NO: 135700 - protein, 130 aa, Triticum aestivum
  Clone ID: PAT_TA_30118.pep
MVDGVPLNGRLLLMGWIRLLPPPSGCDDDDDDTEALMAELERIKKERADDRLRKERQQAEEEAKMKEAELMRGNPLINMNNSGSFNVKRRWDDDVVFKNQARGETKTPKRFINDTIRSDFHRKFLHRYMK

SEQ ID NO: 135701 - protein, 88 aa, Triticum aestivum
  unsure (1)..(88): unsure at all Xaa locations
  Clone ID: PAT_TA_30119.pep
MKKFLVLALIVVAATTTAAEPFTAFRTAWEPHHPSSPEQQPTPQPQEQPVPHQKLNPCRDALLQQCSPXVADMSFLRSQVVQHSKLLG

SEQ ID NO: 135702 - protein, 159 aa, Triticum aestivum
  Clone ID: PAT_TA_30120.pep
PPSRRCSRPTAPTAGAWPPPRTPSGGSCSWPPGATHKREKQVHARPCLVLAGSAIAPQQKYGLVRIYMWPYGPSTDEHELIKDQLKTGTRSGEEDVVLEVFVHVSLGEMHACMGRSRLTGLVHIYGLWVLLPGRLKLQLCCSHEPVFFVSLQKICTKSL

SEQ ID NO: 135703 - protein, 228 aa, Triticum aestivum
  Clone ID: PAT_TA_30121.pep
MTTAARPTWAPAKGGNEQGGTRIFGPSGKYSSRDLAAHTSLKPRKEGQQTQEEVQKRNLRDELEERERKHFSSKDKSYVDERDRRKSSSLLLEGSKRDEDKIVPREIDADDSDVELKSDDESDDDDDDDDTEALMAELERIKKERAEDRLRKERQQAEEEAKMKEAELMRGNPLINMNNSGSFNVKRRWDDDVVFKNQARGETKTPKRFINDTIRSDFHRKFLHRYMK

SEQ ID NO: 135704 - protein, 204 aa, Triticum aestivum
  unsure (1)..(204): unsure at all Xaa locations
  Clone ID: PAT_TA_30122.pep
MKKFLVLALIVVAATTTAAEPFTAFRSAWEPQHPSSPEHQPTPQPQEHPVPHQKLNPCRDALLQQCSPVADMSFLRSQVVQXASCLVMXSKCCQATKSDPQSKSKMARAIHNVVHAIILQQQQQLVQATSTQPQASKQQQGQQQQQGLGSSQPQQQTQLDQGWIAVIGTWVIQTIPAMCDVHVPPYCYTTISPSSDVTTDMGGY

SEQ ID NO: 135705 - protein, 151 aa, Triticum aestivum
  Clone ID: PAT_TA_30123.pep
NSARGERERERERERERERERERERERERERARAALPPGLHTHKQRRSLLSCLLPPPSLSAMKPPHFTGEAAAGASWAHEVKQALRDKLRWAPAAGTTGTGGHGAARPPTASLAVTAEPAAQPAHGADCRGLAAAEDPIRRVMFLAPWGHT

SEQ ID NO: 135706 - protein, 200 aa, Triticum aestivum
  Clone ID: PAT_TA_30124.pep
MKKFLVLALIVVAATSTAAEPFTAFRAAWEPHHPSSPEQQPTPQPQEQPVPHQKLNPCRDALLQQCSPVADMSFLRSQAVQPRSCLVMWEQCCQQLKAIPKQSRCEAIHNVVHAIVLQQQQQLVQGISTQPQQQQQQGQQQQGQGSSQPQQQTQLDQGWIAVIGTWVIQTIPAMCDVHVPPYCYTTISPSIDVTTGMGGY

SEQ ID NO: 135707 - protein, 492 aa, Triticum aestivum
  Clone ID: PAT_TA_30125.pep
MDPYKHRPTSGANSGYWTTNSGAPVWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDAIAAGNYPEWKLFIQTIDADHEDKFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHEIQGIWVSYWSQCDASLGQKLALRLKIKPSM

SEQ ID NO: 135708 - protein, 524 aa, Triticum aestivum
  unsure (1)..(524): unsure at all Xaa locations
  Clone ID: PAT_TA_30126.pep
MDPYKVCTPPILPQPTRSRQLAGPDRRFGCPCRPAIRSSDALGFPGFLCCSQHRPTSGANSGYWTTNSGAPVXWNNNNALTVGQRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDKFDFDPLDVTKTWPEDIIPLQPVGRMVLNKNIDNFFAENEQLAFCPAITVPGIHYSDDKLLQTRIFSYADTQRHRLGPNYLMLPVNAPKCAHHNNHHDGLMNFMHRDEEVNYFPSRFDPTRHAEQYPIPPRVLSGCREKCIIEKENNFKQAGERYRSFDPARQDRFLQRWVDALTDARVTHELNLFCGGVAMNKKV

SEQ ID NO: 135709 - protein, 495 aa, Triticum aestivum
  unsure (1)..(495): unsure at all Xaa locations
  Clone ID: PAT_TA_30127.pep
MDPYKHRPTSGANAGYWTTNSGAPVWNNNNALTVGQRGPILLEDYHLIEKLAQFDRERIPERVVHARGASAKGFFXEVTHDVSQLTCADFLRAPGVQTPVIVRFSTVVHERGSPETLRDPRGFAVKFYTXREGNFDLVXGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDAIAAGNYPEWKLFIQTIDADHEDKFDFDPLDVTKTWPEDIIPLQPVGRMVLNKNIDNFFAENEQLAFCPAVTVPGIHYSDDKLLQTRIFSYADTQRHRLGPNYLMLPVNSPKCAHHNNHHDGLMNFMHRDEEVNYFPSRFDPTRHAEQYPIPPRVLSGCREKCIIKKENNFKQAGERYRSFDPARQDRFLQRWVDALTDARVTHEIQGIWVSYWSQCDASLGQKLASRLKMKPNM

SEQ ID NO: 135710 - protein, 203 aa, Triticum aestivum
  Clone ID: PAT_TA_30128.pep
MKKFLVLALIVIAATTTAAEPFTAFRIASEPQHPSSPEQQPTLQPQEHPVPHQKLNPCRDALLHQCSPVADMSFLRSQVVQHSSCLVMWEQCCQQLKAIPKQSRCEAIHNVVHAIILQQQKQLVQGTSTQPQQQQQQGQQEHGQGSSQPQHQQQQQQLDQGWIVAIGTWVIQTVPAMCDVHVPPYCYTTISSSSDVTTGMGGY

SEQ ID NO: 135711 - protein, 200 aa, Triticum aestivum
  Clone ID: PAT_TA_30129.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHAIVLQQQQQLVQGISTQPQQQQQQGQQQQGQGSSQPQQQTQLDQGWIAVIGTWVIQTIPAMCDVHVPPYCYTTISPSIDVTTGMGGY

SEQ ID NO: 135712 - protein, 306 aa, Triticum aestivum
  Clone ID: PAT_TA_30130.pep
MWIPRAAGIRHQQQSKLEASHHEGLHPGSPCPRSNHRHCPVGKPHVARALDNPNNNNNLGQRQLLKQMKPCVAFLQQKCSPLRMPFLQTQVEQLSSCQIVQYQCCQQLAQIPERTRCHAIHIVVEAIIQQQSQQQWQEPQQQAQHKSMRMLLENLSLMCNIYVPVQCQQQQQLGQQQQQQLQEQLTPCTTFLQQQCSPVTVPFPQIPVDQPTSCQNVQHQCCRQLSQIPEQFRCQAIHNVAEAIRQQQPQQQWQGMYQPQQPAQLESIRMSLQALRSMCSIYIPVQCPAPTTYNIPLVATYTGGAC

SEQ ID NO: 135713 - protein, 422 aa, Triticum aestivum
  Clone ID: PAT_TA_30131.pep
MVRGSLGRLASRTLSVAGKWQHQQLRRLNIHEYQGAELMGKFGINVPKGAVVGSVQEVKEVLKNVFPSEKEIVVKSQILAGGRGLGTFKSGLKGGVHIVKAEEAESLAAKMLNQVLVTKQTGPQGKVVGKVYLCEKMSLVNEMYFAITLDRKTAGPLIIACAEGGTSIEDLAEKFPDKIVKVPVDVFKGITDEDAAKVVDGLAPKTADRQSSIEQIKKLYELFCKTDCTMLEINPLAETADKKLVAADAKLNFDDNAAFRQKEIFALRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 135714 - protein, 228 aa, Triticum aestivum; identical to SEQ ID NO: 135703
  Clone ID: PAT_TA_30132.pep

SEQ ID NO: 135715 - protein, 201 aa, Triticum aestivum
  Clone ID: PAT_TA_30133.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIQTIPAMCDVHVPPYCYTTISPSSDVTTDMGGY

SEQ ID NO: 135716 - protein, 131 aa, Triticum aestivum
  Clone ID: PAT_TA_30134.pep
HHWEGICAGVPMITWPHFGEQFLNEELLVDVLKIGMEVGVKGVTQWGSENQEVMVTRDEVQKAVNTLMDEGVAAEEMRVRAKDCAIKARRAFDEGGSSYDNIRLLIQEMEIKTNACRSVVDTDGNKLSFLV

SEQ ID NO: 135717 - protein, 213 aa, Triticum aestivum
  Clone ID: PAT_TA_30135.pep
RWGGALRGCLDSFGRPKRLFVLINPYGGERRASKIYEAEIKPLLQAAGVEVTRQETRYRGHAREVASSLDLARDDGIVCVSGDGVLVELVNGILQRSDWEEAIKMPIGVVPAGTGNGMAKSLLHAASETCSVSDAVFAIIRGHKQLLDVCTIAQGEKIVFSVLSTTWGLVADVDIESEKYRWMGSARFDFYALVRIMNLRRYRGSVHFVPAPG

SEQ ID NO: 135718 - protein, 49 aa, Triticum aestivum
  Clone ID: PAT_TA_30136.pep
MLHSHRFAIVRSFFPSTYVAFGFADAWADAWADAWADAWPDAWADAWPK

SEQ ID NO: 135719 - protein, 145 aa, Triticum aestivum
  Clone ID: PAT_TA_30137.pep
KFCVSVHFRWVDEKSWGALAETVKGVMREYPKLRMSQGRMVFEVRPTIKWDKGKALEFLLESLGFADCPNVLPVYIGDDRTDEDAFKVLRRRGQGVGILVSKHPKDTSASFSLQEPAEVMEFLLRLVEWKQLSKARLRLRRQADA

SEQ ID NO: 135720 - protein, 369 aa, Triticum aestivum
  unsure (1)..(369): unsure at all Xaa locations
  Clone ID: PAT_TA_30138.pep
KLLYEALLKVKEELMLMGFISLLLTVFQGPVGKVCVRQSAMHIMLPCKPPPHPPSKTEHLRYAMFTSVMGRGRRLLAGGGTSEDYCLKKGKVSILSAEAIHQLHIFIFVLAVTHFLFSAITVLLGIAQTRNWRHWETKIQINDDSAPQMIKHVQEFKFIEDHFKXSFFKQLYGSVTEEDYTTMRLGFIMKHCSGNPKFNFYSYMIRALEVDFKKVLGISWYLWIMLMTFLLLNVQGWYVYFWISPVPFIMLLLVGCKMEHIITDLAYEVAQKHTAIQGVVSQFLCGYSTLPLYAIVSHMGNSFKKSIFDKNVAEGLVNWAENARRRKRMPNRTTIDASSSPVDEAAGGAFQMTNIPSESSVEQGTARLI

SEQ ID NO: 135721 - protein, 313 aa, Triticum aestivum
  unsure (1)..(313): unsure at all Xaa locations
  Clone ID: PAT_TA_30139.pep
MASAAMVASSRALFRPHRLLLLPDPRRRRHLSASAVASANAAARTVRRGVVDVLRERGLVEATTSEALGSSSAVSGEQQQLKVYCGFDPTAESLHLGNLLGLVALSWFRRCGHTAVALVGGATGRVGDPSGKSAERPELDLAAVVANSDAIKSLIAQILSRAPEPSHHGQSGKSAILDKHEDALANSDQDLSEKSGNAGESMGSFVILDNYDWWKDITLLDFLKEVGQFAXVGTMIAKESVKKRLNSEDGMSYTEFTYQLLQGYDFLYMFRNMGVNVQIGGXSDQWGNITAGTDLIRKILQVEGAHGLTFPLL

SEQ ID NO: 135722 - protein, 196 aa, Triticum aestivum
  Clone ID: PAT_TA_30140.pep
MSTPAGDGEDPGAGTPEAAAPFSADWKERILVPVVAAGVVGAGFGLVSRHRARLGPIRAAATYAANLSIVAGCYGGARELARDARATTPDDLMNSVVGGLASGAVLGRIQGGHFGAVKYAVTLAVAGTALDYAAMKLSPQWRDWKEHLSVDTKDWFTVPEWSPIQVLDEEALAKKREREELLFAQRALGKVSKEEP

SEQ ID NO: 135723 - protein, 183 aa, Triticum aestivum
  Clone ID: PAT_TA_30141.pep
AKKMNYMGAHPGVKCTALPCKYERPKKTLKYTVNSSAMALPEYYSELQCQGEVSIMLRLRDCTVASLYCKKNEVTPMNNEPHGTRHLVAVHHGCQRRACCIQRAQVPAPATTLEDTKGVRHGQRCGRQDGRNWRTEVVLMEDPAIGRKGVSPLLQGNSPGKEGGGARKSQRRSNLGMGIRPNP

SEQ ID NO: 135724 - protein, 108 aa, Triticum aestivum
  Clone ID: PAT_TA_30142.pep
MSHAELASSYAALILADDGIEITADKLQTLIKAANVEEVEPIWTSIFAKALEGKDVKDLLVNVGSGGGAAPAAGGAAAAGGAEEAAPEEAKEEEKEESDEDMGFGLFD

SEQ ID NO: 135725 - protein, 138 aa, Triticum aestivum
  Clone ID: PAT_TA_30143.pep
FMNTVLTMSGIDDEEPHQVHQFMNRAVAMSAMDVKEPPSVVSIDPSRSVNIVDEDDDWVIVKKQRITILIPPLSPAAASPQAGTPKLSSRQVSLPRMSRRNCNAATKKHPKHFSTKKSLGGLGVVAPFLKARTCPSGG

SEQ ID NO: 135726 - protein, 37 aa, Triticum aestivum
  Clone ID: PAT_TA_30144.pep
LSGYQQLFVVHGWAGCYFIRVCDETLQHLRLLVFYMG

SEQ ID NO: 135727 - protein, 322 aa, Triticum aestivum
  Clone ID: PAT_TA_30145.pep
HASGKINKCVTFPDMLDMVPFVTGAGDHPPLYFLYAVVVHVDTENASFSGHYISYVKDMQGTWLRIDDSEVKAVSLNQVMSEGAYMLFYLRSFPRPPRIYIEKGLLPDPSSSYRHSSKSSKGSSKQEQKQTESLFTSDDQIRGIYDFRPEEEGYRQDQHAKLRSQNLYHTDDAFADSVSTDFSDATSSEWSLFTSSDESSFTTESTRDSFSVADYGDNAGLDPITSIFGPYYAPDHPLGNFVSCTRPSPSNPQTRYFPESMGFVSDSSLPTQPYGNVHRGRYPDRACASSAEPLASANQRSLYGRYNHSRDGIVQTSGFCHM

SEQ ID NO: 135728 - protein, 214 aa, Triticum aestivum
  Clone ID: PAT_TA_30146.pep
HASADAWALAKGQRVNAVFPLAQLGPALLLLLQASALAFRNEADGDIRYAVLEASTVSGVLHASLYLDAVVLPYYTGLEALRWSRFSGECASCLCRMEPLVVGGTAMRYRGLSKTALAIIFALCSRMVCRIYGEERLSAWTRSALEGVGWVFVAADAVYLVGWVAAEGGAVGVAAYSLVAGLVFLCVFGKVYRFLAWVESRQSQWKSSLCHAVV

SEQ ID NO: 135729 - protein, 103 aa, Triticum aestivum
  Clone ID: PAT_TA_30147.pep
DAGSCRDQGLRRARQCHRPSLRLRGRGRGRGHRRVQLLRRGGRVRRQAQKETQGPTRRYCLRWWRLLRKRVVHTSPPGVGANALQSILTTTFFNITAMYCSLL

SEQ ID NO: 135730 - protein, 542 aa, Triticum aestivum
  unsure (1)..(542): unsure at all Xaa locations
  Clone ID: PAT_TA_30148.pep
MSAPPSLKSPATAAFLASPRLAVAPRAAVLGATAQPPRRLSCSAAVGAEARDLEMSAPLDWAARSVGELEQATDLDTFCMMALSPLDGRYFRFIKDLMPFFSEFGLIRYRVLVEVRWLLKLSQIPEVKEVPPFSEEAQLFLDAIIQDFSINDAKEVKQIEKITNHDVKAVEYYLKQKCSSNPEVAKVLEFFHFGCTSEDINNLSHALALKEGVNTIMFPVMIDVCSAICSLATENAHVPLLSKTHGQPASPTTLGKEMANFAARLSDIGKSFSEVKILGKFAGAVGNYNADVVAYPEIDWPKMTEEFVRSLGLEFNPYVTQIEPHDYISKLFNLFVQFNIVLTDFDRDMWSYISAGYFKQIPKAGEVGSSTMPHKINPINFENSEGNLSVSNGLLCTLSMKLPISRLQRDLTDSTVLRNLGVGLGHSLLAYKXTMQGIKKLEVNKVRLDEDLEQTWEVLAEPIQTVMRRYGIPEPFEKLKEMTRGQAVTKDSIRKFIEGLDLPEDAQSSLLKLTPHSYTGEAENLAANIWNVVDLKSGFKIK

SEQ ID NO: 135731 - protein, 115 aa, Triticum aestivum
  Clone ID: PAT_TA_30149.pep
STSYYAHCVACHPLKNLHPVTRAFRYPCPSGVLDRNTFNSALLKPLLDRMGFGQFIRVVAIRDASGSCMDGGVTSASFLRFQVEPGHQALPTLDKLQVLSSQFLDFRLVFVARWR

SEQ ID NO: 135732 - protein, 330 aa, Triticum aestivum
  Clone ID: PAT_TA_30150.pep
MSSTVDLSAFPTAAPAAPSAEIRYADVAVTATAKEFKGVYRDDKQCHEPDFINTLDRAKDAGVSKVMLTGMSLSDASHNDSITKQRPAQAYYTIGVHPYHAAELEQGGKAYLAELEQKVKNALAQDSPHIAAFGELGLDYDKEEHASKDVQKKAFVAQLDLFVKNQWDLPLFLHCRNAFDDFVEIMTPYMEKLPRGGLVHSFVGSASQMEKLVSMGFGVSVNGFSFQTTESLEMVSKVPLDALQLETDAPWGELKSTSEVVKQYCANARPLPASKKRDKWDAKCMVKERNESCTMERVALVVAGLKGVAVDEVAEAAWRNSVRMFGLGRR

SEQ ID NO: 135733 - protein, 287 aa, Triticum aestivum
  unsure (1)..(287): unsure at all Xaa locations
  Clone ID: PAT_TA_30151.pep
FHRAPLDPLAHPISLEPPPPPSSLFPRAARSXPRPARAPAGPPPTSSSRARPPGRHFVGPXAPPLQEPAGAPPPRQEIAASSEYAERHHPVRLPHRRPPPRPCRRLPSSTSSQAPPWSPPSCCFTSPGPVPPRPHRSSVRGRRRPPCPVATLHQRRDFLLCSRVPASPLRLPWPRCSVLPQVTPSWFLFAVDRQVPPPRVFAFASFWTEDRDETAKMHPGVADPPRPTTMPERALFSRMAPSSTTVDLEDLGFTSSHDDKCDPSDAPSSSTQKRLMSARPASRTPND

SEQ ID NO: 135734 - protein, 1002 aa, Triticum aestivum
  unsure (1)..(1002): unsure at all Xaa locations
  Clone ID: PAT_TA_30152.pep
HASGGPQLWRLILLLKAQCILYKRYGHVLEPFKYAGYPMLLNAVTVDKDDSNFLSSDRAPLLIAASELIWLTCASSSLNGEELIRDSGIPLLATLLSRCMCIVQPTTPAHEPAAKIVTNIMHTFSALSLFESGRVEILTFAGLVEDIVHCTELEFVPSAVDAALQTAANVSVSSELQNALLAAGFLWFVLPLLLQYDSTAEENETNESHGVGARVQIAKNLHAVHAAQALSKLCGLGGDGISSPSNFPAFNTLRALLTPKLADMLRNRPPKDLLSNLNSNLESPEIIWNSSTRGELLRSGVPRRPTRPPDGSYDLTESESFNYEALSKELNVGDVYLRVYNNQPDYEISDQEGFCIALLKFIAGLVQKWNSINSEENMTHEHDSVIDTSTENGGASDSTNEGKEDNSFEKGGKYETGGDCEVITNLRSGLTSLQNLLTSNPGLAAVFASKERLTPLFECLALPVPPESNIPQICLSVLSLLTKHAPCLEAMVAERTSLILLFQILHCNPSCRDGALAVLYSLASTPELAWAAAKHGGVMYILELMLPLQEEIPMQQRAAAASLLGKLAGQPMHGPRVAITLARFLPDGLVSAIRDGPGEAVVSSLEQTTETPELVWXTPAMAASLSAQLSTMAADLYQEQMKGRLVDWDVPEQPSGQHVMKDEPQVGGIYVRLFLKDPKFPLRNPKRFLEGLLDQYVSSVAATHYEANAVDPELPLLLSAALVSLLRVHPALADHVGYLGYVPKLVAAMAYEGRRETMASGQDTSRVQAEPIEHDNSDGVPETTVQTPQERVRLSCLRVLHQLASSTTCAEAMAATSAGTPQVVALLMKAIGWQGGSILALETLKRVVGAGNRARDALVAQGLKVGLVDVLLGILDWRAGGRQGLCNQMKWNESEASIGRVLAVEVLHAFATEGAHCAKVREILNSSDVWSAYKDQKHDLFLPSNAQTSAAGVAGLIESSSSRLTYALTAAPSPQPALVRLPSSSPPPPTGPVNPASGRRHS

SEQ ID NO: 135735 - protein, 308 aa, Triticum aestivum
  unsure (1)..(308): unsure at all Xaa locations
  Clone ID: PAT_TA_30153.pep
QVSPQCGGLWLFFSSPRPSPPCHVRPSPPLVFTGLPAVCRPGALLFITVLVTKISRARVTTVDLHRTTGQLPPLVNGVALLKLLPTLFNKGLPAMVNDLYVKYGSVFMVSSFGVKVTLLIGPEVTAHFFQGLESEISHGNLFEFTVPMFGEAVGYGRDTATRTEQMRFHIEALRPSRLRSHVYPMLQEVEGYFAKWGEEGIVDLKLEFEKLLMLISSRCLLGKEVRENMFDEVYTLFHQIEDNGVTLISFLFPYLPTPANRKRDKARIRLTQILSDVVDSRKNSAQELWMIHCRNWSTPKYKDGXPHN

SEQ ID NO: 135736 - protein, 245 aa, Triticum aestivum
  Clone ID: PAT_TA_30154.pep
MASDTVFVLPGDSIDPSLIPSHPKKPLRLGPGLRHVPPNDIIPTLAGQLVTDRQKNAIRVENARGRYTPRVGELVIGTIQRSAADFFFVTLSDYTAPAQLPQLSFEGATKKTRPQLAAGALVYARVALANRHMDPEIECVSASTGKSEGLGPLAGGMLYNVSLGMARRLMMPKSVQEGRVVVLEELGNAGLQFETATGRNGKFWVDSENVKTVIAVGRAVQETDEKNLDVEDQKKLVRKIIKELS

SEQ ID NO: 135737 - protein, 251 aa, Triticum aestivum
  Clone ID: PAT_TA_30155.pep
MEGAEAPLPVPTEKLSMDPNRDGGNRGGVVLVATGSFNPPTYMHLRMFELAKDELQQRGYCVLGGYMSPVNDAYKKKDLLPAAHRVRLCELACRSSSFVMVDPWEAMQKGYQRTLTVLSRVKNSLCKDGLADQGGVRVMLLCGSDLLESFSTPGVWIPDQVRAICKDFGVVCIRREGKDVQKLISSSETLQECRDNIISVDEIVPNQISSSRVRECIRKHLSIKYLTCDEVIEYIREHKLYMETEEGDTKS

SEQ ID NO: 135738 - protein, 75 aa, Triticum aestivum
  Clone ID: PAT_TA_30156.pep
EKWSDDEAFFAWKDDPDKYGKYLEELKAERASTLLSNLAETSDAKALPNGLSLLLSKMDPAKREQVMDGLRQLLG

SEQ ID NO: 135739 - protein, 2362 aa, Triticum aestivum
  unsure (1)..(2362): unsure at all Xaa locations
  Clone ID: PAT_TA_30157.pep
PGPRSPALPPLPQRPRPPENDDLQAVPALSEWPGHVPPYVGAALPAAQPLDPHERPVAYAAANSAAAPLLTIDPPDTDGGKWVVGELLGGSLPGPLAWWALKVSKSGAPLGGNPVISIAVEIATALQAIPPDPSQLDSPERVVPQAGQVWIRVSAAKTAEALLEFNREELPLFILANRRGVSGGQRDLFEGILQAGSRNVENLRPYKQPVFVYIPDSGDLRGGARVVADSKFPAAHIEKGAVWPGRGKVLEAPVVDKINFYPNEQEERVLRLEPGLLRVKVQHQKENCTTHRPCEKAAASTTIETSVASQMMQHPPINTAVAGGGGKGIRKVDRMDAISVLIKEVEWEVSGAVIYIIQVASLAQHLDVKLVXDDDGKVEAPNRRDSCVQSRQWYLAAQGGNGVKRGEDKAFFTWKDDPDEYGKYLEELKAERASTLLSHLAETSDAKALPNGLSLLLSKMDPAKREPASQVVVGMGIPLYNIPEIRRFYGIEHGGGYHAWKEISAVATKFDLDKAQSVKPKGHCVAVRVTSEDPDDGFKPTSGRVEELNFKSKPNVWAYFSVKSGGAIHEFSDSQFGHVFAFGESRSLAIANMVLGLKEIQIRGEIRTNVDYTVDLLNAAEYRENKIHTGWLDSRIAMRVRAERPPWYLSVVGGALYEASSRSSSVVTDYVGYLSKGQIPPKHISLVNLTVTLNIDGGKYTIETVRGGPRSYKLRINESEVEAEIHSLRDGGLLMQLDGNSHVIYAETEAAGTRLLINGRTCLLQKEHDPSRLLADTPCKLLRFLVADGSHVVADTPYAEVEVMKMCMPLLLPASGVIHFVMPEGQAMQASDLIARLDLDDPSSVRRAEPFHGTFPKLGPPTAISGKVHQKFAASVNSAHMILAGYEHNINHVVQDLLNCLDSPELPFLQWQELMSVLATRLPKDLRNELDAKYKEYELNADFRKSKDFPAKLLRGVIEANLAYCSEKDRVTSERLVEPLMSLVKSYEGGRESHARAVVKSLFEEYLSVEELFSDDIQSDVIERLRLQHAKDLEKVVYIVFSHQGVKSKNKLILRLMEALVYPNPSAYRDQLIRFSALNHTAYSGLALKASQLLEHTKLSELRTSIARSLSELEMFTEEGERISTPRRKMAINERMEDLVCAPVAVEDALVALFDHSDPTLQRRVVETYIRRLYQHYLVRGSVRMQWHRSGLIALWEFSEEHIEQRNGQSASLLKPQVEDPIGRRWGVMVVIKSLQLLSTAIEAALKETSHYGAGVGGVSNGNPINSNSSNMLHIALVGINNQMSTLQDSGDEDQAQERINKLSKILKDNTITSHLNGAGVRVVSCIIQRDEGRSPMRHSFKWSSDKLYYEEDPMLRHVEPPLSTFLELDKVNLEGYNDAKYTPSRDRQWHMYTLVKNKKDPRSNDQRMFLRTIVRQPSVTNGFLFGSIDNEVQASSSFTSNSILRSLMAALEEIELRAHSETGMSGHSHMYLCIMREQRLFDLIPSSRMTNEVGQDEKTACTLLKHMGMIYMSMWCQDASLSVCQWEVKLWLDCDGQANGAWRVVVTSVTGHTCTVDIYREVEDPNTHQLFYRSATPTAGPLHGIALHEPYKPLDAIDLKRAAARKNETTYCYDFPLAFETALKKSWESGISHVAESNEHNQRYAEVTELIFADSTGSWGTPLVPVERPPGSNNFGVVAWNMKLSTPEFPGGREIIVVANDVTFKAGSFGPREDAFFDAVTNLACERKIPLIYLSATAGARLGVAEEIKACFHVGWSDDQSPERGFHYIYLTEQDYSRLSSSVIAHELKVPESGETRWVVDTIVGKEDGLGCENLHGSGAIASAYSKAYRETFTLTFVTGRAIGIGAYLARLGMRCIQRLDQPIILTGYSALNKLLGREVYSSQMQLGGPKIMATNGVVHLTVSDDLEGVSAILKWLSYVPPYVGGPLPIVKSLDPPERAVTYFPENSCDARAAICGIQDTQGGKWLDGMFDRESFVETLEGWAKTVITGRAKLGGIPVGIIAVETETVMQVIPADPGQLDSAERVVPQAGQVWFPDSAAKTGQALLDFNREELPLFILANWRGFSGGQRDLFEGILQAGSMIVENLRTYKQPAFVYIPKAGELRGGAWVVVDSKINPEHIEMYAERTARGNVLEAPGLIEIKFKPNELEESMLRLDPELISLNAKLLKETSASPSPWETAAAAETIRRSMAARRKQLMPIYTQVATRFAELHDTSARMAAKGVISKVVDWEESRAFFYRRLRRRLAEDSLAKQVREAAGEQQMPTHRSALECIKKWYLASQGGDGEKWGDDEAFFAWKDDPDKYGKYLEELKAERASTLLSHLAETSDAKALPNGLSLLLSKMDPAKREQVMDGLRQLLG

SEQ ID NO: 135740 - protein, 152 aa, Triticum aestivum
  Clone ID: PAT_TA_30158.pep
DTRSRGDLTDDERKALRGSKFAPLPAPPPSSRPNPRMAHPGGPLTTNKAAALAKFLERKLQQPDGLDSLNPDLVNLAVKNAKETIKASKGEASTSGRVVRHVPSFEDSSEVSNQDDGEQRQEKKKKKKKKRKTKAAKDKLHNTSKKKKKLSL

SEQ ID NO: 135741 - protein, 190 aa, Triticum aestivum
  unsure (1)..(190): unsure at all Xaa locations
  Clone ID: PAT_TA_30159.pep
RKDATLPEVNLADGVLRRPTFGLPPENRTTLAFFAGGMHGEIRRSLLQHWXAEDPDMHVHEYLHAGQDYHALMARARFCLCPSGFEVASPRVVESVFAGCVPVIISEGYPLPFSDVPDWSKMSVTVPAARIPELKVILRGVSERRYRVLHARVLQAQRHFVLHRPARRFDMIHMVLHSIWLRRLNVRLPY

SEQ ID NO: 135742 - protein, 270 aa, Triticum aestivum
  Clone ID: PAT_TA_30160.pep
FDVSYNNLTGDIPTGGQFLTFAVEGFLGNPALCLLRNASCSEKARVVEAAHRKKSKASLAAVGVGTAVGVIFVLWITYVILARVVRSRMHECNPKAVANAEDSSSGSANSSLVLLFQNNKDLSIEDILKSTNHFDQAYIVGCGGFGLVYKSTLPDGRRVAIKRLSGDYSQIEREFQAEVETLSRAQHENLVLLQGYCKIGNDRLLIYSYMENGSLDYWLHERTDSGALLDWQKRLRIAQGSARGLAYLHMSCEPHILHRDIKSSNILLDE

SEQ ID NO: 135743 - protein, 329 aa, Triticum aestivum
  Clone ID: PAT_TA_30161.pep
MPPRPPLPLSVAVAVLSVLLLTAEAVPFVVLHGIGDQCANRGVAEFTRLLADWSAADGHCLEIGSGTWDSWLMPLHQQADAICNKVKEMKELSGGYNIVGLSQGNLIGRAVLQYCDDGPPVKNFISLAGPHAGTASVPLCGSGIFCVIADALIKLEIYSDYVQAHLAPSGYIKIPTDMDDYLKGCRFLPKLNNEIPGERNATYKERFSSLENLVLIMFENDVVVIPRETSWFGYYPDGAFEPVLPPQQTKLYQEDWIGLKALDKAGRVKFVSVPGGHLGISNSDMRKHIVPYLKDKPSVSASLAATWHAVGEALGLMGDDVGVLLQSST

SEQ ID NO: 135744 - protein, 449 aa, Triticum aestivum
  unsure (1)..(449): unsure at all Xaa locations
  Clone ID: PAT_TA_30162.pep
MDVAVERPPPVKEENKPETMEIASALPMVLESFPSTQRNSITTSKDDKLEATKAEMGEVREENERLKTLLSHIVRDYQSLQTHFQDAVKVKHQAPAADKLPAAPAPAPTATTDDLVSLCLGSGGYARPKGAHQRSLSSSSSGTETDPDDQLSLGLSSRRSTDGDDRQAARPSATPLMNLSSDSSADDDAAPGSGLPAAACPPATKARKSPGAGVDGADDEVLQQQAKKARVSVRVKCDTPTMNDGCQWRKYGQKISKGNPCPRAYYRCTVAPSCPVRKQVQRCADDMSILITTYEGTHSHPLPPAAAAMASTTSAAASMLLAGSSSSSSHGHHLPFPSAGLLGPTTISTIASCPTVTLDLTAPHXSCSSSTSLPTRQGTSPRRCRRRGAAATWRRTPGGCRTTARAPCRRWGSISAWAWRRRGRSSCTAPPIRPRTCRERPAAASSMAR

SEQ ID NO: 135745 - protein, 222 aa, Triticum aestivum
  Clone ID: PAT_TA_30163.pep
VELASSPRGGGSDGPTRPGLRIRRQLIHRKIRSPLPPSHYLLQPRRQEPDRDSGTMTTSSSSSQPDEVLPLIPCPTGGDKVVTFISQGGPRFYKCVREDAGLCQFLRSTDTYLPELTRHDLSQPYVLHQPLAVHPSASLHKRYRREHNLADGGSQAEIQPAHGRPRPQLEQSRPPCAAPHCCSMDSQSTALLMASTNLLLFLSLCSRAVTSVYKSPVMGRVV

SEQ ID NO: 135746 - protein, 93 aa, Triticum aestivum
  Clone ID: PAT_TA_30164.pep
APPGSGPCSAPRPRQPRRRWRCCSHASTPSFPCSRSRSRSLPPATGWPAAPSSSSASPSHAQDAASTAHSSSWPSACWSWATSSAPWLSSWER

SEQ ID NO: 135747 - protein, 194 aa, Triticum aestivum
  Clone ID: PAT_TA_30165.pep
MTGGKIQKKRHGGGGGGGGARLQGGIPFEKSKGQHILRNPALVDSIIAKAGLKPTDTVLEIGPGTGNLTKRLLDAGVKVVVAVELDPRMVLELSRRFQGHPLSSRLKVIQGDVLKCDLPYFDICVANIPYQISSPLTFKLLSHRPIFRCAVIMFQRESPLVTVTTSSVTSKTQSSPSSLTSSITLFIALATHLT

SEQ ID NO: 135748 - protein, 274 aa, Triticum aestivum
  unsure (1)..(274): unsure at all Xaa locations
  Clone ID: PAT_TA_30166.pep
YLHGRRQDPEEAPRTAVAAAAARGCRVGSRSRTSKGQHILRNPALVDSIIAKAGLKPTDTVLEIGPGTGNLTKRLLEPGVKAVVAVELDPRMVLELSRRFQGHPLSSRLKVIXEDVLECDLPYFDICVANIPYQISSPLTFKLLSHRPIFRCAVIMFQREFAMXLLANPGYTLDCRLSVNVQLIARVSHLRKVGLTTPTPSPMVDTTVVRIEPRKPLPPVTCQECACLVTTSINRKNKTLGSLFKQKRVLELLEKNYKTMQSLRRAPGPGMRAD

SEQ ID NO: 135749 - protein, 302 aa, Triticum aestivum
  Clone ID: PAT_TA_30167.pep
MSRGAAASGSLRTALSYCVQQVRSYDYHNYLCLLHLPPAMRKAAFTFRAFNVETAKAIDVVSDPRKGLMRLLWWKDVVDKVCAGKKVEHPVALALSSVLSEHKVSKHWLKRSLEARINDGNRDEDAIPENVPELERYAEDTQSTILYMTLQAGGIQSTVADHAASHIGKASGLLLLLKALPHHVSKQGKIPYIPASVAEECGLLAREGGRTEVRMGDALPDAVFKVASVAEAHLQKARELATSVPAEAVPVLLPAVPAQVLLDSLRRREFNVFDSRLSSGVHGISPLWYQLKLNWHAWRNKY

SEQ ID NO: 135750 - protein, 293 aa, Triticum aestivum
  unsure (1)..(293): unsure at all Xaa locations
  Clone ID: PAT_TA_30168.pep
AVAAVAGSSGPAALPLGGRVAIVTGASRGIGRAIAAHLSSLGASVVLGYAASAAEADALAAELPRAVAVRADVSEEAGARSLFDAAESAFGCAAPHILVANAGVLDDXYPSLADTATADFDRVLAVNARGAFLCLREAANRLPRGGGGRIVAVTSSVVGSNPTGYSAYTASKAAVEAMVRTMAKELKGTRVTANCVAPGATANGHVLRRGKSNETVRRAAGEDPDGAXSGEAGDIAPVVRLSLHSTPPEWVNGQAGRATGGTAGTSAGRPAVGWASPAGGQYGGREMQRPGEA

SEQ ID NO: 135751 - protein, 346 aa, Triticum aestivum
  Clone ID: PAT_TA_30169.pep
MVCGGAMSRWLVLLVGLLTISLVPSCAAAEVKISPTEWSLRLPLPDGVTGAESLAFDALGQGPYTGVSDGRVLKWDGSAVGWTTFAHHANYRKLPMCTVAMAPSEETEGLCGRLLGLAFHLESGDLYMADAYNGLMRVGPDGGEAEVLATAADGVQFNFVNGLDIDQVTGDVYFTDSSVTYPRRFNTEIMMNADATGRLLKYDARTKQVTVLKYSLPYPNGVAVSHDRMHIVVAHTLPCQAYRYYFQGPKAGHYELLADLPGYPDNVRRDENGGYWVALNQERGRPGGTTRPVRHLVGVRLNGNGVEVKKLTPAKGVTLSEVTERKGKLWLGSIELDYIGLLVPLY

SEQ ID NO: 135752 - protein, 238 aa, Triticum aestivum
  Clone ID: PAT_TA_30170.pep
PRVRNELVRYIKESTKIPVLGHADGLCHIYLTASADKEKAITAIVDSKTSYPAACNAVETLLVQESALNSVFPGVASALAAKGVSLRVDEASKAAITSLSLEGVQDATTQDYDTEHLSLTIGVKTVSSIDEAITHINTHGSHHTDAIMTSDSAEAERFMNEVDSAGVYWNAATRLADGMRYGFGTEVGISTNKIHSRGPVGLDGLTIYKYKIRGDYQATADYGDGEGKKPWKHEKLSL

SEQ ID NO: 135753 - protein, 178 aa, Triticum aestivum
  Clone ID: PAT_TA_30171.pep
APTRPPTRPAPSSSIPTTPPSSSFLARAHPHNPSLLLAPRRGLRPRSLARASYSLSTIVGAHRRRICAGEEQLWWGAAATEMKEVRRPSLPPQRVLVAEPSSAAVGDKGKEQADPTASLCTRTGGASREGSRHGQRRRCTGTPASGFLSCLPIPPHSSSLRGIGQWHGGGTGRGRGRP

SEQ ID NO: 135754 - protein, 91 aa, Triticum aestivum
  unsure (1)..(91): unsure at all Xaa locations
  Clone ID: PAT_TA_30172.pep
ALLRGVLSIDQTKPSLSTDDGHVLSFFKYSSSSVFSSAGVFRPSQEFVERGLXPNGEFYIWQWRVGVPHDAGMYLWMDGWMYQGEWWHGPG

SEQ ID NO: 135755 - protein, 134 aa, Triticum aestivum
  Clone ID: PAT_TA_30173.pep
VQTCAWAKVLQALSVQGAPGSTGSSTPADLNSSGVSRAVIKERFKAFNTQFEELHAKQSLWIVPDQELRESLRLAIAEVLLPAYRSFIKRFGNVVGSGKNPLKYIRYSPELVDKLLNEFFEGQQYGEPKHQHRL

SEQ ID NO: 135756 - protein, 124 aa, Triticum aestivum
  Clone ID: PAT_TA_30174.pep
PRVRPRVRAKRQVDVEYILSVAAFMAQRGRPHFAVARAYLVSDVTNVGIRDLDFGWGKPVYAGPANGGVVALPGIGSFFIAARNATGEEGITVPVCMPGPTMDKFVNEMGKLMRPALADTFSKM

SEQ ID NO: 135757 - protein, 167 aa, Triticum aestivum
  Clone ID: PAT_TA_30175.pep
MEAASGDPDDPLIAVRPQRVGGWWARNQDFIRRRAETLRRPAARAETEFEAEAECRREPPASKNSMAGLLVPAAAEVRDLECAVCLEDLVAGGRKLRKMDCSHCFHQRCIFRWLHVSRLCPMCRFAMPSRSDDERVGDEVERELAAEEEDDADEEKSAATEERSSSE

SEQ ID NO: 135758 - protein, 95 aa, Triticum aestivum
  Clone ID: PAT_TA_30176.pep
FVSRKDGLEVWSRLEEQRDDTCNFPEQPGAKETLDRKGINENSFRSSYVDTEEDSKRGMIEMMEGGGDRLFVTREDMPVVEVWESSHLAGAISLA

SEQ ID NO: 135759 - protein, 363 aa, Triticum aestivum
  unsure (1)..(363): unsure at all Xaa locations
  Clone ID: PAT_TA_30177.pep
TALAAHHDGSLCLAHGAGQLTYYSPALDRLTTFRTHHHRATSXRLLPSSLAVVGSSSLXPGLHVYDLLEGWHVASVEWSDPTDLRVLKAKVIAIAARPPADATDTNSPILATFECPHRENCILAIDPVTLKPIQEIGRQSGSAAKSSSPDRLVHLQELGLVFASSVSSGAFGYSGYMRLWDIRSGNVVWETSEPGGSGRSSRFGXDPFSDADVDVKQLMLYKVCSKSGDIGAADLRRLDNDPWVYMSSGPKGSGGGHGSVLHCYKSQVFVSRKDGLEVWSRLEEQRDDTCNLPEQRGAKETLDRKGINENSFRSSYVDTEEDSKRGMIEMMEGGGDRLFVTREDMPVVEVWESSRLAGAISLA

SEQ ID NO: 135760 - protein, 235 aa, Triticum aestivum
  unsure (1)..(235): unsure at all Xaa locations
  Clone ID: PAT_TA_30178.pep
MDGGGEEGKQQPQLVLAHKLFLLSQPDVDDLAKVGLRDDVLAAVKSDDMAALYESLAADGMLEMDAALLAEMRGRIEEETKKFDEKIADAEENLGESEVREAHLAKSLYFIRVGEKEKALEQLKVTEGKTVAVGQKMDLVFYTLQIGLFHMDFDLISKSVDKAKILFEEGGDWERKNRLKVYEGLYCMATRNFKKATSLFLDSVSTFTTYXVFPYDTFIFYTVLXQCITLDRVSL

SEQ ID NO: 135761 - protein, 395 aa, Triticum aestivum
  Clone ID: PAT_TA_30179.pep
MDGGGGGGSTSGDDGKQEKHLVLAHKLFLLSHPDVDDLSKVDLRSDVLSAVKSDDMAPLFESLAAAGVLEPDAVLLSEMRARIDEEIRKLDEKIADAEENLGESEVREAHLAKSLYFVKVGEKEKALEQLKVTEGKTVAIGQKMDLVFYTLQIGLFYMDFDLISKSIDKAKKLFEEGGDWERKNRLKVYEGLYCMATRNFKKATSLFLDSISTFTTYELFPYDTFIFYTVLTSIISLDRVSLKQKVVDAPEILAVISKVPHLSEFLNSLYNCQYKSFFVAFSGLTEQIKLDRYLQPHFRYFMREVRTVVYSQFLESYKSVTMEAMAASFGVTVDFIDQELSRFIAAGKLHCKIDKVAGVLETNRPDARNAFYQSTIKQGDFLLNRIQKLSRVIDL

SEQ ID NO: 135762 - protein, 185 aa, Triticum aestivum
  unsure (1)..(185): unsure at all Xaa locations
  Clone ID: PAT_TA_30180.pep
ILAVISKTTHISEFLLSLCNCQSKSFFVAFTALTXQIKLDRYLQPHFQLLHGGEMRTVVYSQFLESYNXVTMEAMASAFXVTVDFIRREELSRFIAAGKLHCKIDKVARVFWRQTGLDERNAFYQSAIKQGDFLLNRIPEAIPKSLLCKSCCSCWIALAAQQRLCPVVGPISASLLEYMTSAWLC

SEQ ID NO: 135763 - protein, 171 aa, Triticum aestivum
  Clone ID: PAT_TA_30181.pep
MAALPVMKLGTLLLRTLSKPIANRLKSQAAVHPKFRDFIISIAQTNHRITTRIQRRIYGHATNVAIRPLDEEKAVQAATDLIGEGFIFSVAVAALIFEVQRSARSEARKEEARKQELEELRQKEEILAKDLEDLKLKLAELERLAKGRGLSGILNFKGVNAADSSKEATPA

SEQ ID NO: 135764 - protein, 92 aa, Triticum aestivum
  Clone ID: PAT_TA_30182.pep
IIFFFRNSTKGYSHSDPPIQLLQPFPSTSYHFPRHMIVLSSVDDFFLVQRPFSMVSKREISHFYLWSHNRGRGKSMNLIRFVFLILFVFLIL

SEQ ID NO: 135765 - protein, 75 aa, Triticum aestivum
  Clone ID: PAT_TA_30183.pep
MESSHKLFPAVAILLLLVVATEVVPAQARECETESERFNGLCFVSANCAGVCNAEGFTGGKCSGLKRSCMCTKEC

SEQ ID NO: 135766 - protein, 304 aa, Triticum aestivum
  Clone ID: PAT_TA_30184.pep
MEGGSSCRRVALVTGANRGIGLEVCRQLASGSATVVLTARDEKRGAAAVDALRELGLSDVVFCQLDVGEPSSAARLADFLRDRFGRLDILVNNAGVSGVRMDVGDPAALHQVRTSMSAAERLEWFNQRTAEPFEEAEECLRTNYHGTKNVTEALLPLLLSSSDARVVNVSSSYGLLRYFSGEELKHELDDIDNLSAERLDELSGLFLKDFKNGRLDHRGWPVGGFSAYKVSKALINAYTRILAKKHTSMRLNCLDPGYVKTDINFHTGVLTVEEGARGPVMLALMPKEGPTGSYFNGTEQAAFM

SEQ ID NO: 135767 - protein, 110 aa, Triticum aestivum
  Clone ID: PAT_TA_30185.pep
HITCMGGNHMGSALNHTIQTVVNIGDHDCVVTVYTDYEPGKETNGSSKFFQKNIKVQSGSYISTITPICDFLQEMRTKMILQPHVPSLFGCYIRHVPSHQMSISIFPLCK

SEQ ID NO: 135768 - protein, 207 aa, Triticum aestivum
  unsure (1)..(207): unsure at all Xaa locations
  Clone ID: PAT_TA_30186.pep
MGKHQMPAYYDKNAFDDDEEFDSNSSAREERESQERLEHAREMRLREEQRRVEKERVLEQQREKQAVERATKEARERAAAEAHAKAERDARQRSQRAAVQRAHQEARERAAAEAKDRVARAAAEERERAAAEERERAAAEARDRERPAARGRAAAERAAAERVQQEARKRAERAXAVERAAAEARQRQAAAAAAAAKEKQSTPNDVE

SEQ ID NO: 135769 - protein, 323 aa, Triticum aestivum
  Clone ID: PAT_TA_30187.pep
RGPCTPGLQSHNPSSNANASSGTTNNNAPASSSSLPDNMQRKIFVGNVHADVDVNRLYEYFSQFGEIEEGPLGFDKSTGKPKGFALFVYKSVDSARRALEEPMRNFDGKMLNVQKATAGRTKGSSGSNSSANNANATAASTQMTMPSIAAINPYDPSAYGAAAVHDMGFAQQAALLGMGAQQQAFAQPNTAMLAMMAAAMQNPAMLASLNPAFAAAALGAGGQSGIPGFGAQGFGTQGFGAAGVNFPNAAGLQGAAAYQGGPPGFQGTPGFPTSAGFQVGQAASQTGTTAAATGAAGGYQAGAAGQGQVSNTQIGGTGFQGGY

SEQ ID NO: 135770 - protein, 182 aa, Triticum aestivum
  unsure (1)..(182): unsure at all Xaa locations
  Clone ID: PAT_TA_30188.pep
FVRKMTSXQRSESANHMLKGYMPPGCPMHLFLKQRPQLQFNRESEQSFQEKRTLLSGVSLRNNLPLERHASKVYTRAMFEKFGEELYKCGAHVLDEIVPRKVYRSTHVDAAAREKWSKVEFTIEVDDEESFFSCECGMFEHAGTSFGITTSQHRRACGVSPLGSRCRLCWLCCGTFLRREAN

SEQ ID NO: 135771 - protein, 168 aa, Triticum aestivum
  Clone ID: PAT_TA_30189.pep
MDSGGGGGGSHKAASGSAPSAAAAAPNPTAMLSALMGKRAKLQEEVRSIERQVYDMETTYLQESNQFGSVLKGFESFLSSSKNTANLKRSRKFQVDERLFSLSSVTSPAVEEQLAARDEAREYAGRSKGASTPANGQGKPKKGGRPGGRDGKRIRPSNAPDLDDEDDY

SEQ ID NO: 135772 - protein, 128 aa, Triticum aestivum
  Clone ID: PAT_TA_30190.pep
HLFMRRSFWVKMNANPAAPILLLLLLVGCHAFSAHGDDAEGSGGGRRELGDGGGSGSKAQVAGLCVDSPCDADPNRTCFCCTRLANEPCYDTLRQCFSVCPNCNFPVCPPAAASAGRRTRFVLAPASA

SEQ ID NO: 135773 - protein, 215 aa, Triticum aestivum
  Clone ID: PAT_TA_30191.pep
MGEEAPAAVTAAATTSPAPHLLLICFPGQGHVNPMLRLAKRFAAKGLLVTFSSTSYVGGKITASSGVEAGGDGVPLGRGRIRFEFLDDDFDGNDLDDLMRHLETTGPVVFAELLRRQEEAGRPVTCIVGNPFLPWAIDVAHDAGIPTAVLWVQSCAVFSLYYHHVHGLVEFPPEDDLDARVNLPGLPPLSVADVPSFLLPSNPYKLLTDAILEAV

SEQ ID NO: 135774 - protein, 229 aa, Triticum aestivum
  Clone ID: PAT_TA_30192.pep
PPAEEGRGGADPAMFVEKMFAVPMAAGYEGFPFIATQAEKEMAEAFAGKARAERQPYALKAKAEGARFVVKAGCGSKRKAEEDREEDAAFTFKAKSEEEAAFTFKAKSEEEAAFTLKAKSEEEAVFTVKAKAEEEEEEEEDDCDSVEEEGFMVRLIADYNAHADKLRADHPGMKYKDYSTEEYAYMRLQPEEVEDDDCNKIEKLRAEYAYLFCKLEEEGSHGVDGLVRA

SEQ ID NO: 135775 - protein, 80 aa, Triticum aestivum
  Clone ID: PAT_TA_30193.pep
QGHPSLPTEHAGLIPFYLLHMTGLSSCNLFIMIILSSNTCYLEGCSIFFPVFAGVLLLLFPKYIERSWNDVVSRKRCPLD

SEQ ID NO: 135776 - protein, 346 aa, Triticum aestivum
  unsure (1)..(346): unsure at all Xaa locations
  Clone ID: PAT_TA_30194.pep
ARRQPHPERAAVARPVDDASEPVLSVPCPPLGSAAFARAFEAAKAQELYRCFDPVWKYTRLVNVTSETARKRSVCAINDFVHAVIHKEVEQMGRYEHEYAMKENILSXSCLATEKDRGCFHDKSXRDMRPKLRDRGPRHVRRGTLSWVPHTWLCEQAAHLRXKMTTEAGGTTSTRHSRRPSQGIRRCLTKDAISNMPYLHAALTETLRLYPAVPIDVKYCFSDDTLPDGHAVRKGDMVNYQPYPMGRMKFLWGDDAEEFRPDRWLDGDGVFVPESPYKFTAFQAGPRICLGKEFAYRQMKIFAAVLLCLYRFEMWERDSMMGYRPMLTLKMDGPLRVRVSPRRASG

SEQ ID NO: 135777 - protein, 146 aa, Triticum aestivum
  Clone ID: PAT_TA_30195.pep
TMGIRGTVGEVTPAGSASPPAIVWRRQGEGRLGSASLCMAVEVQHRHDVYGFSIFLILPYSQFYKLLCDAQWPRHALVRFKVQLSKSQFEVRCLTSISCCSPARLADERPDPHEVDVTHTALSPPSFLFPTTIMSLYLVILLFHPW

SEQ ID NO: 135778 - protein, 65 aa, Triticum aestivum
  Clone ID: PAT_TA_30196.pep
QEQSPICTSPVLEALQKAQQNQLQLQAFRCSCEVIQQLTILLKHVQLYHLTCFKYLLQQMKVEEH

SEQ ID NO: 135779 - protein, 50 aa, Triticum aestivum
  Clone ID: PAT_TA_30197.pep
MMSLRHARHDARHLLLSLLWAGLCIGITHFVRSNGRVFTNRPRAHKSSRP

SEQ ID NO: 135780 - protein, 264 aa, Triticum aestivum
  unsure (1)..(264): unsure at all Xaa locations
  Clone ID: PAT_TA_30198.pep
YAANFVESEQIMQSKGYTASYVQVRGSMPFLWEQIVDLTYKPSFDLVRQEEAPSVLERHFKDLQKKYGAVLAVDLVNTQGGEGRLHERYAKSIEPILSEDIXHFDFHRICGHVHFERLSQLYEQIEDYLKKHKYFLLNEKGEKIQEQLGTVRNNCIDCLDRTNVTQSMIARRILESQLQQLGVFGGNDTITNDPSYEANFADGTKQDAMDLLQGRYITSVSRDMAPPTGAGFAESNASDRLAFALVSGSNKFTISTQRDAPARC

SEQ ID NO: 135781 - protein, 228 aa, Triticum aestivum
  unsure (1)..(228): unsure at all Xaa locations
  Clone ID: PAT_TA_30199.pep
MCSRRRSVAYFAHGSHRLLPADADDDGEFTCDGCLVAGAGPRYLCGHPGCGFKLHEVCARSFPRTLKSIVHSQHRLKQRESAAAATADHGTGGGNVRCEVCGEDVKGACYGCSTGACASATVVVHPLCVRLPPVARGPAVAHPCGHDAWLVKKSDGGVASMCXGVDVAWRYRCGTCRVDVHPRCFVPPADQCRGGEASAISMGKRCCLVFGQDLTSCLNISYYYRGAG

SEQ ID NO: 135782 - protein, 130 aa, Triticum aestivum
  Clone ID: PAT_TA_30200.pep
MFPSTSATASRLLVPAASRRAMAAAASANPPPPQQSPPKAVRVVVKGRVQGVFFRDWTVETARALGLAGWVRNRHDGTVEALLSGEPARVDEMVSRRLPVGPPAAAVTAVLPSPADPLDPSEGFHRKPTA

SEQ ID NO: 135783 - protein, 74 aa, Triticum aestivum
  Clone ID: PAT_TA_30201.pep
KFHDLESTSTDVCFAYDGGYERPLQPVPGDCGYHLHAHWLVLSHPTTNKMLKITAPLPHILQTREEHCDPQVDT

SEQ ID NO: 135784 - protein, 224 aa, Triticum aestivum
  unsure (1)..(224): unsure at all Xaa locations
  Clone ID: PAT_TA_30202.pep
LGFESFTSPHMRIAPKYASARHPLVRMMLFARNMLDDKFSCPEAMVPRSILDMIRKSRSVSRSTGITGEPPVESIGMYAESELGCTAIPSAIPLAIAAKEDEDAAYHDDAMGGADTLADTESIAAGLTTAASPHEQNEIMNSRINGWDNYTGYMDGVREVTHTEPEHNRIMEAKEKKTSATWVVATAAAYHATGNRXXLFXXTPYQPGGLRLSQPTGRAPMQVL

SEQ ID NO: 135785 - protein, 276 aa, Triticum aestivum
  Clone ID: PAT_TA_30203.pep
PRVRPDTFIFAILLPMQIALSFVRSLSSLSPFSIFADACNVLAMAIVIKEDIRLFDHPFADRSAFNGLWAIPFSFGVALFCFEGFSMTLALEASMAERKKFKWVLSQALVCIMFVYACFGVCGYLAYGEATKDIVTLNLPNSWSSSAVKIGLCIALAFTFPVMMHPIHEIVEARIRSSRCFQKFSQNVGGPNWLALHASRIMVVIILAVVASYVPAFGAFIAFVGSTVCALLAFVLPTAFHLSIVGSSMSLWRRLLDYGFLLFGLVFVVYGTFTAL

SEQ ID NO: 135786 - protein, 169 aa, Triticum aestivum
  Clone ID: PAT_TA_30204.pep
GKSDLLYVRGQVWTSALSPIFIANNHIPVLTFPPSGILTSMLCATAESTRRTSWRPTHRACYPPSQRRPALLAVAASERQDAVLRTWRCWAIGARYASRASCRCHASRRLHKPWRWAQRVGWRRAQRSAKEARGEEPLRVLLLHLRLRRRRRLPEIGADAWADAWADAW

SEQ ID NO: 135787 - protein, 192 aa, Triticum aestivum
  Clone ID: PAT_TA_30205.pep
PAGRALIGARLCHTWGAVSLLASRPASHNLALLPYLADSRPPCVLPRLPLAGSAVLAGRVPASLGPAGAAIACVREFWRSVGCLAPAVCGPRLSRARAPAMPVLCMACSQGSDAFSQSGLYSNPQDIGPRYAGVLLGLASTAGVPPGLWATAAAGSSRPVGPCGRACRGAGLRCLVGTVVWNVFSTGERILE

SEQ ID NO: 135788 - protein, 165 aa, Triticum aestivum
  Clone ID: PAT_TA_30206.pep
LPVPFDLCFSRDRDHDRDRDHDRDYGRGRERDRDRDRGRERDRERDRERDRHRIRDDDYNRDRDRDGRERERRDRDRGRHRSRSRSRSRDRRERDREVGELRKRRGRGSASPPRGRAEDGPREEPKKRRKEKKEKKGSGNGPDPNDPEIIEMNKLRASIGLGPLK

SEQ ID NO: 135789 - protein, 189 aa, Triticum aestivum
  unsure (1)..(189): unsure at all Xaa locations
  Clone ID: PAT_TA_30207.pep
MASLASLSIYTVPGRAVRAESVQAPRRRRMAVVRAKVREIFMPALSSTMTEGKIVSWTTAEGDRVSKGDPVVVVESDKADMDVETFHDGIIAAVLVPAGGTAPVGAPIALLAESEEDVALAQARAQALSKALGEETPPPHAAATAPPTVVPAPXTSKVAPTNGIATPHAKKLAKQHRMDIXNVIGTGLN

SEQ ID NO: 135790 - protein, 112 aa, Triticum aestivum
  Clone ID: PAT_TA_30208.pep
ERVSSDSSTQPNRRTTSRDEMGPFPPGDTNQIHPEWTNSTISEFTGLRADGRGGCCGWWCSVCAWGSAVLLLVKTLQHSSVDLGGKCSHWLHYGVQEFCVNEISAFRFHPLE

SEQ ID NO: 135791 - protein, 58 aa, Triticum aestivum
  Clone ID: PAT_TA_30209.pep
YLSCNGDIIFLVIKTTLLILHKKVIKAVTQIRSTPQFNSNPTSLRCQNGPSIQVKTRR

SEQ ID NO: 135792 - protein, 108 aa, Triticum aestivum
  Clone ID: PAT_TA_30210.pep
MGTFPWIVNSEIYPLRHRGVCGGVAATANWVSNLVPAQSFVTLTGANGPAWTFLIFGCLSVAALAFVLVCVPETKGLPIEEVEKMLEKREVRLKFWAPRGRGSKNDGV

SEQ ID NO: 135793 - protein, 331 aa, Triticum aestivum
  Clone ID: PAT_TA_30211.pep
DNFDERNKLGEGGFGVVYKGILPDNEEIAVKRLSQSSRQGIEELKNELVLVAKLQHKNLVRLLGVCLEEQEKLLAYEYMPNKSLDTILFDPDRSSQLDWGMRFRIVNGIARGLQYLHEDSQLKIIHRDLKASNVLLDSEFNPKISDFGLARLFGSDQSHDVTNRVVGTYGYMAPEYAMRGNYSIKSDVFSFGVLILEIVTGKRNSIAYDSEQAVDLLSLVWEHWTMGTIVEIMDSSMTSHSPGDQMLKCMHIGLLCVQEDPADRPMMSVVTVMLSSSTVSLQAPSRPAFCIQKSGMNYSGMHTDPYPGVTHSTSRSPMSPNEVSITELEPR

SEQ ID NO: 135794 - protein, 205 aa, Triticum aestivum
  unsure (1)..(205): unsure at all Xaa locations
  Clone ID: PAT_TA_30212.pep
MSAETERSSTESSGASGLDFEDTALKLTVRLPGDPDRNRGASSPSRCSLADRSSLLAEAPPAPKARVVASPPVRAFRNARARERRRRVHQGAVRAGQVRQGGPSTARLACRKGEPAGTMPGYDQLLRALQGKFCSPFTIRNFANDEMKLVXTRVNGTEYVPTYEDKDGDWMLVGDVPWKMFEEACQRVRLMKNSEAVNIAPRAAR

SEQ ID NO: 135795 - protein, 128 aa, Triticum aestivum
  Clone ID: PAT_TA_30213.pep
GTQYRGRMEVGRFPSLTSLPIHSTASFSPPAAYKTSSSSMQAIPNEFSLPEEVQKQVQHPLRPCILSYIAWTSSLMVASLPPSVEILVYGIIFNNKDMTSRSTARNAGSLGCTTSIVRCLMGVVLAVE

SEQ ID NO: 135796 - protein, 96 aa, Triticum aestivum
  Clone ID: PAT_TA_30214.pep
GSSNFSCIKLVRVHLWVEMNRIRMRLRCFLRYCSNRICACPSGRSCLQVTPLTGLCFAGVLIHFRSDKFQALDMSYFSKGHAGFVREFWHDLCQNL

SEQ ID NO: 135797 - protein, 68 aa, Triticum aestivum
  Clone ID: PAT_TA_30215.pep
IVIDNDLCKISVEHMSCYLKSFVSCAISGTFGIHATASPCGYYGYMLHVEMLHDLVPSCFLYLFLFCF

SEQ ID NO: 135798 - protein, 116 aa, Triticum aestivum
  Clone ID: PAT_TA_30216.pep
PRVRPRVRLVLDRELPQVVFDRILRRILFTVGVPMASGVALLNVYDALKRGGGAEVPSWVQLLTILLSFGTSALGIAYGTLSASWDPEKEGSLLGIDEARTNWPELWKEEIEKDNK

SEQ ID NO: 135799 - protein, 361 aa, Triticum aestivum
  Clone ID: PAT_TA_30217.pep
MGYLPSLGGKAAHLVSDLATVILNPVSGHERERSSHLPEATEGQENLYGDEESEIPNGPDTSSFRAFLMSFMSASSSSNDSMEIIPEKDLDMEYPTLTPVGRGIKERKGLLSRGKHSIGKIINKAGRLGGFRQKSGHIVDNEIANQIESMSSGFALKVSKGSASNHKLPPMSEPSMLLSEVTRNVLYPSLPVLVQGKNWMLVYSTWRHGVSLSTLYRRSMLCSGDSLLIIGDKKGAVFGGLVEAPLRPIMQRKYQGTKNCFVFTNVAGRPVVYRQTGANNYFTFCSPEYLAMGGGGHFALYLGEDLLNGSSSTSETFNNPCLSLSQDFEVKHVELWGFVNASKYDEMLTVCRTEKPGIWNL

SEQ ID NO: 135800 - protein, 110 aa, Triticum aestivum
  Clone ID: PAT_TA_30218.pep
PTRPLRRRRRQHQQQQTTCSIIWRRRRQQQQTTWPIFWRCSAGAAPQGRQGLCVLVLCVHLGRAALLCSDDSADIEAMESRLESTNVPYVMISGASTSLELINDLPGGFL

SEQ ID NO: 135801 - protein, 173 aa, Triticum aestivum
  Clone ID: PAT_TA_30219.pep
SSSSLPTHTHASPSTQTLLSARARHGHSSGPATWPILWQRRRRRATMWPTLRRRRRTAHRQTTSSNPPRGGGRAENLAAYPTAAGAANNVLEQLAARQAAAEHNAANFRARPAAAAAAAAAAADAAAVAGASALQRRRKEDKDCACLCCVYIFGVLLFFGVMILLASKPWNRG

SEQ ID NO: 135802 - protein, 81 aa, Triticum aestivum
  Clone ID: PAT_TA_30220.pep
TEYIVRMCDALCSKLIRVCVCMQTDSAIFLCRSLSCRGKYSMKLQGDSGKYFQKRDGFISVIYCGKHVLLLSLYCGKFNHL

SEQ ID NO: 135803 - protein, 203 aa, Triticum aestivum
  Clone ID: PAT_TA_30221.pep
MLLAVEGGGFFSSSASGYSHGLALLLLGRKEEEKPVKAWSQYRLVDGEAEHVCHLASTKNQAPRKCAPFICFGSTALELEGASPPKLSSSNTLDSLEEPSRSTKKKVTTNGSITGDERKGCLKSNSKRDSSEHCIVVSEDEEPRESLEEVQTLKSGIERRKVQWTDTCGKKLFEIREFEASDGSLSDDELENEGFRKCECVIQ

SEQ ID NO: 135804 - protein, 193 aa, Triticum aestivum
  Clone ID: PAT_TA_30222.pep
MTGSSSSWSVPPASGECSLQNGERYEITKALLKCKMAEGSSVSQHLVKLVGYMWRLEALGSAIPAWLCTDLILLSLPPSFNGFIMNYMMYKMDKSVNELLGMLKNAEFWIQKDTNHVTKKTTSFKKKGKVKNGKGVSKTDTKGKPKRGPTKETECFFCKDKGHWKRNCKKFLAEKKSGKSSTRTSEDTRTAEE

SEQ ID NO: 135805 - protein, 346 aa, Triticum aestivum
  Clone ID: PAT_TA_30223.pep
RVLDFEGCRGVAQYDMKGMETLFQLKYLSFSGTGISELPSGIVMLRDLETLDLRSTKIRDLPDGIVQLTKLQHLLGNRYEKKKIPIGIGNMTNLREISGFDITMSSIGAVKELGSLINLKVLHVRFRVKGAESQEYKIHAEMFHSSLCKLGSYKLQSVLIEGGNSSLFELLDCWSPLPSCLQRLEMGPYCLSKLPKWIIPALTSLAYLDIDLSVITEEVLGIFGELPALLSLKLYTNTVHKDRLVLPARGFPCLKEFVYKPFGEGAGILLFEEGALPKLEKLHLCFSVQMAKAYGFYLGLEHLPYLKDVRVILQKRYPTSPEVDAAAAAIRKEANLHPNHPRFIVA

SEQ ID NO: 135806 - protein, 310 aa, Triticum aestivum
  Clone ID: PAT_TA_30224.pep
GLRAEISLLAASISDLFFHPRSGPSPSHLRRPRWPAVSGWGARFLCHMYSCSSRTFLHSKPDLRSSFLLRGIFVLAMLTGIKVTGADHMPGSDALPLNKGVDEGYGVLDSDFSSSRVALVFMEKRREAEEVKNAWIWRCMSCISLMWKRIFRSFSISDAAVVVDKEKGRSREMETTDGVRAHHRWCFRQGYGAHDWQPAFLTTPSILLAERRPWLFLPASMPKGRQVSFCSESMSSFFSELGCRRRSHGDCGDPSGFVPRVVVVESDRKLCWTPPPLSFSVWGPNNKSQGLFCSFSFMLGPFVICTAMPI

SEQ ID NO: 135807 - protein, 28 aa, Triticum aestivum
  Clone ID: PAT_TA_30225.pep
GLFFASLVQVNRCMDPLLKLRHRVMSDC

SEQ ID NO: 135808 - protein, 140 aa, Triticum aestivum
  Clone ID: PAT_TA_30226.pep
LRLLKCSSKNSSFSAVAMPPSNEMFKFTDPSGSKLLAADWVPEEKQMGSTKVAGLSLPSINLSIALGSPPCRAISQCCDRTGANPTRAHVVQLVLVIVTLSWTHGLRRRQEQCFWLIRDEQLAGEVYLACQTRNSCDSFS

SEQ ID NO: 135809 - protein, 186 aa, Triticum aestivum
  Clone ID: PAT_TA_30227.pep
MTITEKQKMIRGEVYNPRDEELVQDRRTNMLRLIEFNTSTDDVERLKLARKIFGSFGEGTFINPTFRCDYGYQIFIGNNVEINYDCCFLDIARITIGNNVFFGPNVHLYTVNHPLDPTERRKGVEIPKAITIGDDCWIGGCVVVCPGVTIGKGVTIGAGSVVTRDIPDYSLAVGSPAKVIKTIVPT

SEQ ID NO: 135810 - protein, 197 aa, Triticum aestivum
  Clone ID: PAT_TA_30228.pep
MSSANATSCVYGEIWIDGFARLHKGDDFTSSPSSNTLQEFSDVWLAAAERQLSLRPKSPSPEELTKRRQERKRKGLVIALNTYAKRNNMQLTDLEFVEEKERNQVYGCGALYVHSNFLVKGSDGKPTMFFAEMHPDCTQEEDVVCCTPLEENDYGHCVECDDRAKELRHPSGGGYLGGHDEMIFHFEELDSDDDCFM

SEQ ID NO: 135811 - protein, 143 aa, Triticum aestivum
  Clone ID: PAT_TA_30229.pep
CRTHAGCLINPDAASKAQCPLQVLVTMSKKHQFLMLLGGRLFGHAALLRCRRPRRRRRRTEARPTRLAWPDRMVPAVSWHRHGCCTSEKGCELLMRCLLLLLTSTRLVLPCLISCCASSSLPQSAFPQPLMVRKRKTFLYKSM

SEQ ID NO: 135812 - protein, 265 aa, Triticum aestivum
  Clone ID: PAT_TA_30230.pep
HASAHASDGRPKKGTGKALPPGPPGLLFLARFLALRRSVFHLGPILRDLHARYGPVISVRLSRTLVFVADRRLAHRVLVQGGATFADRPPLSDPGLLFTSGARDISTSPYGAYWRMVRRNLAAEALHPSRVALYAPARRRARDSLVRDLLRARGAGDDVAVRPAFRRAMFELLVYMSLGARLGTETLEEVQELQLRILRSITSFPIFSFFPALTKRLFRRRWNGYVAVGRRQDEIFLPLIRARRERGADGPPCYADSLLALRVAE

SEQ ID NO: 135813 - protein, 302 aa, Triticum aestivum
  unsure (1)..(302): unsure at all Xaa locations
  Clone ID: PAT_TA_30231.pep
STRRTRSAIVTKLAHTDQFRCLDKAAMVAYPKGVRYGGAAAGNTWRRXTVQQVEEVNSRNRLVPVWYTGIIYFVAVVQQTTYCVLSALQSXDRRLGSSFHVPAASFTVFAMLAQTLWIPIYDRLLVPRLRKVTGKDEGFTLLQRQGIGIALSTVAMIISAVVEDRRRDIALNQPTIGTTQTGGGISAMSSFWMVPQLMILGLSEAFNLISQIEFYYKEIPEHMRSVAGALAFCNLALGNYLSGFLTTIVHRTTGGGQNWLAQDLNKGRLDLFYWMIAGIGVFNFVYFMICARWYRFKGTRDA

SEQ ID NO: 135814 - protein, 105 aa, Triticum aestivum
  Clone ID: PAT_TA_30232.pep
EISKSREHTSFHRRRHNLHWGLIQQAKLSTQISTRKQKKDSKSCPMTQGYRFRPNLNLTKQKLKQPKTASSDKLRDCDIEPLLLYKSTQHGAKWNTTSSSWSVTI

SEQ ID NO: 135815 - protein, 389 aa, Triticum aestivum
  unsure (1)..(389): unsure at all Xaa locations
  Clone ID: PAT_TA_30233.pep
MEGYRGRPWTRLPALLLACAAAAAVGECRVVHVGEAHRRSMLANGLGATPPMGWNSWNHFACDGNGEVVIRETADALVSTGLAAAGYKYVNLDDCWAEPERDAKGNLAANKKTFPHGIKALADYVHSKGLKLGIYSDAGYKTCAKAQPGSLGHEEQDAKTFASWGVDYLKYDNCNNGDTKPLQRYPDMSKALMQAGGPICVKLGDCRGMHPARWGAAYGNSWRTTNDIEDTWNSMMSRADQNEVWAEYARPGGWNDPDMLEVGNGGMTNDEYIVHFSIWAISKAPLIIXGCDVRHMSQNTYDILANEGGDSPSTEXSSQVWPGPLXGYRTGVLLLNRHRQGRGPRITAATGPTSGLPRQAAVRWRPRDLRDAQGRLGHLKFTGQDDDST

SEQ ID NO: 135816 - protein, 125 aa, Triticum aestivum
  unsure (1)..(125): unsure at all Xaa locations
  Clone ID: PAT_TA_30234.pep
MAILGTVVQLLLSDPSNILKXVFAPSDSHKKKLHNCIMAVQYMKEAPVLISDADAVRVSAEYILNGDKELILAFLWNMFIHMQVNLHMSFSISLLMLKFYTVLFHLSFVLKRWTNGLTLYFSLTA

SEQ ID NO: 135817 - protein, 63 aa, Triticum aestivum
  Clone ID: PAT_TA_30235.pep
HASERDRGDRDRHRDDRDRHGDYHRHRERDSDRTEDWDRGRSSGRRSRSREVDHSKRRRMSHE

SEQ ID NO: 135818 - protein, 304 aa, Triticum aestivum
  Clone ID: PAT_TA_30236.pep
REQKLELHRGGGRSRTSGSPGLQEFGTRFRSLNPNSQIADPNTNLFYTNMFDAMVDATYNSMKAMNFTDIPVMVTASGWPWHGARKEPAADVDNALAYNTNLIRHVLNNSGTPSQRNNQVSTYLFELFSEDLRSGSVSGESWGIMFSNASAVYSLTFEDVATASTDSPALHGMFCVANSSATHSALKQSLDWVCGPGSANCSAIQPGQQCYKADDIVAVASYAFNDYYHRTQASGGTCNFNGTATISSTDPSHGSCVFAGSNGANGSSGDAAAGPVSQDSFASQSQSCWLTYLAAVLLPVVLLM

SEQ ID NO: 135819 - protein, 208 aa, Triticum aestivum
  unsure (1)..(208): unsure at all Xaa locations
  Clone ID: PAT_TA_30237.pep
NSARGAVEHLSLTXLKEYKGEDCEAIHEAAAFAGEKIENDDGLILPPYSGHVTNSFVLDDLYPANYVSKPKCLHNGLRSNGMTEDGTGTNGVQNRIPIMSSRNSAGGIRSLIGWLAKTAVMIVGAVSIMKAAGYEPTIGRSGIKLDIAGLLGKEAAGAKEQVPPTLQCPPGKVMVLGGDGRAHCVVKERVEIPFGSSLDAPNASYGLG

SEQ ID NO: 135820 - protein, 113 aa, Triticum aestivum
  unsure (1)..(113): unsure at all Xaa locations
  Clone ID: PAT_TA_30238.pep
NLHPYITVYNHLCTVQSGFNPCEVLHSSFPAAIDCNSATATGQKAKHARPSCCSNDNTCSAIPRRVRQHLSGDRDSKSRVLSLIAFKSSQTLLKFKGQQIPCLAKGKXPPGGR

SEQ ID NO: 135821 - protein, 148 aa, Triticum aestivum
  Clone ID: PAT_TA_30239.pep
LKNTRTLKYIHQSRTRVLRILTAADMRGPPERAPPARRRTHRLEKEEREVRRWTGEGHREELRWLVVVHTALGQRYFCTALTPAGCGGNTRRHKDHTDTSFLKDPKSMVIEQINYDSTEIEGDHTLIAGDDMIQSRCDDGSFMGREYV

SEQ ID NO: 135822 - protein, 189 aa, Triticum aestivum
  Clone ID: PAT_TA_30240.pep
DATGLATLYDFAKQRPYASAGVGKFVNRPEVKAALGARPDVTWEECSDAVGAAMHEDIMKSVLPEVEALLRQTRVLLYQGIRDLRDGVVSQEAWMKELKWGGLRAFLDAERAVWRTGEGDGQELAGYVQRSGALTHVVVYGAGHLVPADNGRATQEMIEGWVTQTGVFGGGMRSRGLLPAGNRIKGTAT

SEQ ID NO: 135823 - protein, 103 aa, Triticum aestivum
  Clone ID: PAT_TA_30241.pep
MAMANPTKSGHYAQNKGRSLPKFGEWDVKNPATADGFTVIFQRARDDKKTTAGPGRPGIPPAFRNADGGYGTIKTGYGYKYTRVATPKRSKKKSWFSCTSCRF

SEQ ID NO: 135824 - protein, 106 aa, Triticum aestivum
  Clone ID: PAT_TA_30242.pep
LDGHGEQPQRNPDTTRRNKGRSLPKFGEWDVKNPATADGFTVIFQRARDDKKTTAGPGRPGIPPAFRNADGRYGTIKTGNGYPYARVATPKRSKKKSWFSCTSCRF

SEQ ID NO: 135825 - protein, 106 aa, Triticum aestivum
  Clone ID: PAT_TA_30243.pep
FPMAMAGYTLAISRSSRGVRRREVFIPMKITRTSFRSLAPHAPRPWCPGARSSACAAPLELADAAPRAPGFFALRRPPPTPAGSLASRALAPPPSPSWIYVPEVTG

SEQ ID NO: 135826 - protein, 128 aa, Triticum aestivum
  Clone ID: PAT_TA_30244.pep
VSPALQRAVQSQMSLMSTPFIDNNDLFETGCTGGMSRALINKIPAIRFSAATDSDQETNKSCCSVCLQDLRPQQFVRALPQCQHIFHVRCIDDWLQRNASCPLCRAGVHIDHLCFIIEYPCSRSMIVK

SEQ ID NO: 135827 - protein, 52 aa, Triticum aestivum
  Clone ID: PAT_TA_30245.pep
HIRQVGVFLDIHFINRPEVFTKAHLPPRKFDADGDLMRLGDQGADERWCSAH

SEQ ID NO: 135828 - protein, 387 aa, Triticum aestivum
  unsure (1)..(387): unsure at all Xaa locations
  Clone ID: PAT_TA_30246.pep
SPPRSLVAAPPPLHHLPPLPHAAGAGEQLPPIRELLLLQHSAGGRAGEANRIRYLALLPPDVPWPPRFPFPPTTGASRGPRCSSRSCRRRPRGRPGPDPARPAPTTFDEASMERSKSFVKALQELKNLRPQLYSAAEYCEKSYLHSEQKHIVLDNLKDYAVRALVNAVDHLGTVAYKLTDLYEQQVSEVSTVELKVASLNQQVLTCQTYTDKEGLRQQQMIGNATRHHKHYMXVQRRGNKRMQAFSEMQTDAEFDLKPKPYPSEKTLFWHLAXGQNTKTTGGQQSELGNGATKASARSSSRPKARGGRTLRQRPLPRSLQSNVSSSNIVTRNIGMKDQPGARHLASFSSLDNTRGRQIQKAPVRTKSMLAAFFVRHRSGKMKNVSVR

SEQ ID NO: 135829 - protein, 35 aa, Triticum aestivum
  Clone ID: PAT_TA_30247.pep
KRYGSFFEPCSYLAERAAKGIPLSAPAASQVKARL

SEQ ID NO: 135830 - protein, 189 aa, Triticum aestivum
  unsure (1)..(189): unsure at all Xaa locations
  Clone ID: PAT_TA_30248.pep
FFSQRATSKVPGATDLGLMPRKITKVAILGGGLMGSGIATAMILSNYPVLLKEVNEKFLNAGIDRIKANLQSRVRKGKMTEERYGKALSLLSGALGYEKFKEVDLVIEAVIENVKLKQQIFADLEKYCPSHCILATNTSTIDLNLIGEKTKXQDRIVGAHFFSXAHVMPLLEIVXTQHTXXRFVVDLLD

SEQ ID NO: 135831 - protein, 495 aa, Triticum aestivum
  unsure (1)..(495): unsure at all Xaa locations
  Clone ID: PAT_TA_30249.pep
FILECLCEALEILKSERALARKQSANLDHLVIFIEVIEEGIVSGPRAGLWKEAYAFQGLCFSDTCKSLLHXFFSQRASXRAIPDPEFMTYIQKSRSMAGVTPDAELMKLSDKDIVEMVFFPVINEACRVLDEGIAVKASDLDIASIFGMGFPPYRGGVMLWGDSIGAKYXRQVGGVGEAVRQLLRALLLPCRKSGKRDSSECTSSKSSQGPAIGDGRSAKETVTDCGWTLGRVLCNMRNDSXIILQICSVNSXLSPTVVGNYTGFAVNRMFFPYTQSALLFVDYGMDVYKIDRACTKFGMPMGPFRLADLVGFGAAAAAGIQYRARGPERVYKSMLIPIMMEATRPGEASRKGFYKYEDRRKATPDPEIMTYIQKSRSMAGVTPDAELMKLSDKDIVEMVFFPVINEACRVLDEGIAVKASDLDIASIFGMGFPPYRGGVMLWGDSIGAKYIHGKLQEWAKRYGSFFEPCSYLAERAAKGIPLSAPAASQVKARL

SEQ ID NO: 135832 - protein, 138 aa, Triticum aestivum
  unsure (1)..(138): unsure at all Xaa locations
  Clone ID: PAT_TA_30250.pep
XXAELMRXXPXXXXVSPSLLYEEPVDSRVDPQCAPGRNMENHRAGVIDGRQQIRRTIGMMICKSAAPQPMPSNPAGNNAQNGAGPVGRTVGRQSVVAAPRSDLIWGFHRGTRVLSVWRVLGVIRMTGANCKPPLPPLD

SEQ ID NO: 135833 - protein, 262 aa, Triticum aestivum
  Clone ID: PAT_TA_30251.pep
TAVGLDFDRESLEWCLENNLSKIGADGSSRLLLFDGNVLQPNESRLVKQKISDLVQGLNVTSDDGCTEKNSCEQSDSSFTKCEANSTMSDAVLPGRDIICAFNYSCCCLHKRKDLVLYFRHAFNALSKRGGIFVMDVYGGTSSECKLRLQRRFPSFTYFWEQEEFDIITRETRISLHFQVGKKQMIRHAFTYHWRLWSIPEIKDCLEEAGFKSIHVWVREMPDTKSSGNAEYTADRDVKYEELQHFNQADAWNAYVVGVANI

SEQ ID NO: 135834 - protein, 126 aa, Triticum aestivum
  Clone ID: PAT_TA_30252.pep
MAAQGRGSAAVVVGVLLVCVLLSAAVAQAAVFNVGDRGGWSFNTNSWPTGKRFKAGDVLVFKYDATAHDVVAVSAAGYRACAKPAKGAKVYKSGADRVTLARGTNYFICSIPGHCQSGMKIAVTAA

SEQ ID NO: 135835 - protein, 152 aa, Triticum aestivum
  Clone ID: PAT_TA_30253.pep
LAMLPQASLSPRVCVVLGWHLIGRPVLAKVASNVAARGGRHFQRGRAPCRACSLPSHVGGRRGSTWGTAAGGPAPRAPRPAASPARPGTCLVVRHPEAAHDGRGANEVVCKHCPAPAKGRHEDRRGRRPRSPSPGVQQTTSRCSVPRTLHIQ

SEQ ID NO: 135836 - protein, 150 aa, Triticum aestivum
  Clone ID: PAT_TA_30254.pep
VTVLPVSTLGAAPVSKAASSVPVTLSLLSGDEAQLAILEGLQSVTGTVSIVHVEDLCRAEVFVAENESSSGRYICCSHNITALQLARLMAQKYPQYNVNADRFRGCPEQPKVCISSQKLVGEGFVFKYESLGEILDDLIEYGRATRILLH

SEQ ID NO: 135837 - protein, 91 aa, Triticum aestivum
  Clone ID: PAT_TA_30255.pep
LSVSFLGCLLALMLDVCSLRGGLFIRLQGVLSGSKTCQLDCCSFVIDCIWMMFICHRLYLDDVHFLNATLYVDSSVCLLVWEASVDVFCSI

SEQ ID NO: 135838 - protein, 87 aa, Triticum aestivum
  Clone ID: PAT_TA_30256.pep
KVRKKYCRELSLFPFISSKTMYGFHKTELKRLVQTLMVWDSESEHGIHACSVFLQDLVVSVNVVVKHPGFMLEQLSAIHRTRGRTRG

SEQ ID NO: 135839 - protein, 88 aa, Triticum aestivum
  Clone ID: PAT_TA_30257.pep
MGAQDEGSRRPPPPEPTPGQPAATAGTAPPPITPAQFLSWKQRKDAEEAAEKAEAAQKRAADIASGAVQMNGRELFQHEPWVFDNNIY

SEQ ID NO: 135840 - protein, 90 aa, Triticum aestivum
  Clone ID: PAT_TA_30258.pep
KRKPSRLHRPSSDHFSFPIGSLLAYPNPWTQSFLDFASSALLLNRRGLLLLALGHHAGALRRRRLLRRGRRHNHVDLARCENHAGTEIWC

SEQ ID NO: 135841 - protein, 193 aa, Triticum aestivum
  Clone ID: PAT_TA_30259.pep
MAAPAPRSVGVAERALRGVADLIKLLPSGTVFMFQFLSPLVTNNGHCAAYNKVLSGALLALCGAFCAFSSFTDSYVGSDGRVYYGVVTRRGMRTFSADPDAGATRDLSGYRLRAGDFVHAALSLIVFATLALLDRDTVSCLYPELEAGERTMMAVLPPVVGGVASYAFMMFPNNRHGIGYQPTRATEDFEHKH

SEQ ID NO: 135842 - protein, 81 aa, Triticum aestivum
  unsure (1)..(81): unsure at all Xaa locations
  Clone ID: PAT_TA_30260.pep
MLARYIVDEVKDKSNKEIDISXGTKESIDCIPLQENGLDCGMFMLKYIDFLSRGVSLSFGQEHMEYFRRRTAKEILRLRAD

SEQ ID NO: 135843 - protein, 282 aa, Triticum aestivum
  Clone ID: PAT_TA_30261.pep
HGYSLPNLSLRRGEEHSFILKPAIMSSRDRRINSDVPLTLSLPKMSGAATNTSTPRVSELSTGLTDQYAVLISYRCNYTESKLFFKQATSWQPCAASDLMISVSSELSLRNPSPSARVPQLPVQVLTLEATNMTSENLTLTVLAPEASGSSSVVSLNSAPTTPDGSYDPPTEATGRSGLGKHGTGFRRLNSVVVGSPKESDNGGNRMSTSAGCTHLWLQSAVPLGCVPARSSTTVKLELLPLTDGIITLDTLQITIKEKGLTYIPEHSLEIHASSAVSAGRS

SEQ ID NO: 135844 - protein, 164 aa, Triticum aestivum
  Clone ID: PAT_TA_30262.pep
KETECVFDGTQTDLTEHLRNDHLVTVRTIQYGKVSRFQVTVSTPRLLLVNEDDGRVFVLTVGALGAAATALSVVCARASAATRPRFTCKMWVNLAASAVANGGKADIVLVEMQMRSSTSPGAVVAAGEPTFLAVPQVYLVPGADGGAMEMPLNVRIDKTSPWSD

SEQ ID NO: 135845 - protein, 266 aa, Triticum aestivum
  Clone ID: PAT_TA_30263.pep
TRGRAKVPDSFGNLSGSELKVEVMEEKLLRDLTREVCSVLWVLALPGLNSGLPSLEQLGPVNRIDSSLKSLESFASSSLTGFLMLNVGTALPALRITVEVFSWTDSEAVTKVIPFCGALIHLAVATNRAEGRGFVGNDLFSSIIQGLSVELNAVVSAELIGLCREIYLYLSDKDPAPKQVLLSLSDMKQEDLLAFDDCLSKTASPKEQKQHMRSLLLLATGNKLKALASQKTTNIITNVTTRNRGTVAHHGPSAEEEDRIGLAGLS

SEQ ID NO: 135846 - protein, 204 aa, Triticum aestivum
  Clone ID: PAT_TA_30264.pep
KNFLSNEDPDIRAKACSAIGNMCRHSPYFYGPFAANKVIELVVDRCSDPDKRTRKFACFAVGNAAYHNDKLYEELRRSIPQLTKLLLAPEEDKTKGNAAGALSNLVRNSDVLCGDIVSQGAIQALLKMVSSYSAVALSPSRKDALTESPLRIVLFALRKMCDHTVCRLFLRSSELLPIIVHLRQSPDQTISEYASAIASKANQA

SEQ ID NO: 135847 - protein, 93 aa, Triticum aestivum
  Clone ID: PAT_TA_30265.pep
PVCVRCSSECFSIKGNKKCRRNSGHVMVGREAAVDCGMAKEQRQARTRPQSRGRKGHRPGARRTPPPPAPRSTDPSKAARQSRGRKGMDTTAT

SEQ ID NO: 135848 - protein, 372 aa, Triticum aestivum
  Clone ID: PAT_TA_30266.pep
MDAAAAAGVLAALAPSWSAAVVLASYLAYLAAAGALLPGKLVAGAVLPDSSRLHYRCNGLLSLLLLLGLSALGVYTGWMTPTVVADRGLELLSTTFTFSVIVSFLLYYTGLRSRHQSSSLKPHATGSFIEDWWFGVQLNPHFMGVDLKFFFIRAGMMAWLFINLSLLAKSYLAGSVNRAVILYHSFVGGYIIDYFIHEEFMTSTWDIIAERLGFMLVFGDLVFIPFTFTIQGWWLLGNKVELPLLASVANCIIFLIGYLVFRGANKQKHLFKKDPKAPIWGKPPKVVGGKLLVSGYWGIARHCNYLGDLLLALSFSLPCGASSVIPYFYPTYLLILLIWRERRDEARCSEKYKDIWAEYCKLVPWRILPYVY

SEQ ID NO: 135849 - protein, 74 aa, Triticum aestivum
  Clone ID: PAT_TA_30267.pep
NYLNSRLFVCSKCTIQSHIINSQTFLTSFVIFHAFTDYFELYGPENEKHFKMNSEKVESWHGIIISSTEHVQES

SEQ ID NO: 135850 - protein, 84 aa, Triticum aestivum
  unsure (1)..(84): unsure at all Xaa locations
  Clone ID: PAT_TA_30268.pep
FGTRIFIMEPQPWXSYRKNRLVSEFAKENFKYICIYPEKFREVLLDKVGFRSAEVITNRLVGSVAGFDRPIEVYYICRWFCTPN

SEQ ID NO: 135851 - protein, 135 aa, Triticum aestivum
  Clone ID: PAT_TA_30269.pep
FFFAVPTLLQSFFLLLLGMNQYKDALPINQGLQKQTLDLNPPPLSLSLSLFSHIEYILQKKLFQCCCWGCQCCDKRTPRKAPLQPATRQIGPPDRPPHKARTRTAFSDSTKTEFLPSQFNSYRSTQSRYTLSRPV

SEQ ID NO: 135852 - protein, 159 aa, Triticum aestivum
  unsure (1)..(159): unsure at all Xaa locations
  Clone ID: PAT_TA_30270.pep
PAEISTGIALLGVALLVPFWSLAGAAAIVESTAGPSPLRQSCRLLSGARLAALSAFLVFAAGIGVVLWGFSGVAMETYDAATGWAGMGPAVVKAMVGAAVLAAMMLYGMVINVVLYMHCRALHGELTGEIYNEFASSYVYLPFEXGKDRHIVSVVTLWP

SEQ ID NO: 135853 - protein, 851 aa, Triticum aestivum
  Clone ID: PAT_TA_30271.pep
MALHALHHHLVIMCRIRAPNRNQKVYMRSIDAEEYRQLEGEMLDRHLAPQLPYVKSLFLGWFEPLRDAVARDQDVQRRKRVKHVYAKYLLLLPAEKVAVIVMHKMMGLLMSSKDGCGSVRVVQAAHSIGEAVEREYKVQAFFQKTRRKTRSKTESENDPGLDKEQAKCRKLVKSLVRRRKSTEAQKLVQQEIELEEWGTEAQVKLGTRLIELLLDSAFVQSPADQTPDSSPDFRPAFKHVLRKPIVENGRLKKKHFVIECDPLVHEGFESTARHVEIPYLPMLVPPTKWKGYDKGGHLFLPSYVMRTHGVKDQKEAIKSVPRKQLRKVFEALDILGGTKWRVNRRVHDVVETIWSRGGGIAGLVDKGNIPLPEQPETEDPDEIQKWKWSVKKTKKANRELHAERCDTELKLSVARKMREEDGFYYPHNLDFRGRAYPMHPHLSHLGSDLCRGVLEYAEGRPLGKSGLRWLKIHLANKYGGGIEKLSHESKLTFVEDHLPDIFDSAANPVDGNCWWINAEDPFQCLAACMDLSNALESSSPHGAVSHLPIHQDGSCNGLQHYAALGRDYMGAAAVNLVPGEKPADIYSEIAARVLDVVREDSMKDPATDPSVPLAKVLVDEVDRKLVKQTVMTSVYGVTFIGARQQIMKRLQEKGHITDDKLLYDVSCYATRVTLDALGQMFQSARAIMAWLGDCAKMIASKNQPVRWTSPVGLPVVQPYKKYKNYMIRTSLQCLALRREGDAIATQRQKAAFPPNFVHSLDSSHMMMTAITCKEAGLHFAGVHDSFWVHACDVDKMNQILREQFVELYSMPILENLLEEFQTLFPTVEFPPCPAQGNFDVREVLTSTYFFN

SEQ ID NO: 135854 - protein, 79 aa, Triticum aestivum
  unsure (1)..(79): unsure at all Xaa locations
  Clone ID: PAT_TA_30272.pep
ACPXCIRGDHNSSAYQSGHYSSAGKAGHHYQCENVDEFAATSGGSEKDYYNKTEHELTVASTSQVAPQRAEAERGAERA

SEQ ID NO: 135855 - protein, 131 aa, Triticum aestivum
  Clone ID: PAT_TA_30273.pep
ELSDTEGAMSDHRSALPKGRCPCEIFDQKGTGDGHVTRSGPPVLLSLLHIRFNVTGPGGSTLDGRSLFHRGRSLADDDALILDRNAGEIHVMISSPVAIRFCLIRRCSEVYLESGGGLINGMPSGGSISFL

SEQ ID NO: 135856 - protein, 213 aa, Triticum aestivum
  Clone ID: PAT_TA_30274.pep
FPNSGSLYNGTDSGGECGVPAETMYYAPTEKRDNYWYSMDYGMFRFCVADSEHDWREGTEQYRFLDRCLGSVDRAKQPWVVFIAHRVLGYSSGFFYGYDGMFAEPMARQSLEGLWRRHRVDVAFYGHVHQYERTCPVYEERCVPDGHGTVHVVVGGGGSHLSNFTAVAPPWSVYREMDYGFGKLTASDARSLQFEYRRSSDGKVYDSFTLHRG

SEQ ID NO: 135857 - protein, 209 aa, Triticum aestivum
  Clone ID: PAT_TA_30275.pep
HASAHASGDLRAGAALCARSAALGHVDALRELGHCLQDGYGVRRDPAEGRRLLVAANARELSLALAAAAASATYPFASLPIGAVAGGAGGVTSSPLLSDFGWSPPEAEPHTANQFMSDWWASRGVQACAKKTDAAATGGDGEGELRLCSHMRCGRKETRRHEFRRCSVCGAANYCSRACQALDWKRAHKAQCVPMDRWLVGGAAAAPQQ

SEQ ID NO: 135858 - protein, 303 aa, Triticum aestivum
  Clone ID: PAT_TA_30276.pep
GPAGINVRLRAARAALDEFIDKIIDEHMARGKSPDDVDADMVDDMLAFLPEAKPKKAAGDGGDELQSTLRLTRDNIKAIIMDVMFGGTETVASAIEWAMAEMMHSPDDLRRLQKELADTVGLDRNVDESDLDKLPFLKCVIKETLRLHPPIPLLLHETAEDCVVGGYTVPRASRVMINVFAIGRDAKAWKDPDTFRPSRFVAGEGEAAGVDFKGGCFEFLPFGSGRRSCPGMALGLYALELAVGQLAHGFSWALPDGMKPSELDMSDIFGLTAPRATRLHVVPTPRLTCPLVADVDINGTRQA

SEQ ID NO: 135859 - protein, 225 aa, Triticum aestivum
  unsure (1)..(225): unsure at all Xaa locations
  Clone ID: PAT_TA_30277.pep
DDGDDDDEEDDAPNWSNLETVNSCHPLYFARMIVENASKSSIDWLDRPPASLVVGGGRSAALPAERTRVSRDLRKGEGAXEGRRQGMRGDEPHGGGTEGRGAPCIRDRAQGKERSXRKFRPAIIAHSAPGKISPLRASAVKITQALESVCWRSKAIQVEEAAIIGVDCLGFDLRLCSGTQVQTLRFAFPTKATSEFSAEKQINELLFPRRTHQEGESPQPQQKEY

SEQ ID NO: 135860 - protein, 122 aa, Triticum aestivum
  Clone ID: PAT_TA_30278.pep
SSQFHRQFGTRQREEQAKLIVQGKNMSKPGPSQPLSCCLCLLLSRQLPYPLLTKLVLEQLVVDSFPCQGLLVHLRSLALLLLLGAIEFLESKPVHLLPRSLTPHPLLIPRQRLLRVIEPMVL

SEQ ID NO: 135861 - protein, 221 aa, Triticum aestivum
  Clone ID: PAT_TA_30279.pep
IHMCEQAAEAQKSKGALARRGRTSSEPIGSKIDSISVDAILSKKSSTSVLSGESSSKVYLINCLSAIEEPLMDQEVATSYVKNLRSMIETHTRALVDKEADSILSKCGLSSKMPYMKNYSSTDGEDDARPLADVVETSPQMLLECLKAFYGIVTGTEGSLPEFEQLQVPRLRSDACYGLARALAEAYELIYKAVMDPKNCYPDPRSLVKHSPEQIRTILEI

SEQ ID NO: 135862 - protein, 180 aa, Triticum aestivum
  Clone ID: PAT_TA_30280.pep
VKVYREEVKEYMKGIDGVLIKLSELFSEALGLGSDYLASTRCFNARSMACHYFPICPEPHLTMGGTKHTDLGFLTLLLQDSVGGLQVLHQDVWIDVPPVKGALLANIADMMQIITNGKFKSVEHRVLLRPTVEPRISIACFLSTDDLDRPYGPIKELLSEDNKPIYDQVIFGEYMKKYKL

SEQ ID NO: 135863 - protein, 261 aa, Triticum aestivum
  Clone ID: PAT_TA_30281.pep
GRVGGRVGGADGRVRVSGTLSVGQGASVLNQVWQVGSTVSGDGIPAPHAMGGDNLAAKAKLDLVRQTSTSSDSGGSDLARERNIHGILNAVSWGLLLPMGAIFARYLKTFRSADPAWFYLHVTCQIIGYAVGVAGWATGINLGNASNGVTYGLHRSIGIAVFALATLQVFALFLRPRKDHKCRVYWNAYHHAVGYAVIILGIMNIFKGMAILGVEQRWRTAYVAAVWVLGAVAVTLEAVTWSVVIRRREAEQHGKTFHGAA

SEQ ID NO: 135864 - protein, 103 aa, Triticum aestivum
  unsure (1)..(103): unsure at all Xaa locations
  Clone ID: PAT_TA_30282.pep
RSMANHFDVLGVXFFGTAMRLLNIQIGELSRRAWLGEGADLLNSDNLLRTYNGPAAELGINQQAEWFMSKNAIVSGLELLGIKYGAPKDASPKLRRKRIVRKK

SEQ ID NO: 135865 - protein, 265 aa, Triticum aestivum
  Clone ID: PAT_TA_30283.pep
MDPPSPAGARPAMSHSSAFLLPSSATPAASADAYAVVVLNQRLPRFAPLLWDRAQVRVCADGGANRVFDGMPELLPGHARDDVRSRYKPDVIKGDMDSVRPEVKEYYSNLGTKIVDQSHDQDTTDLHKCVAFITDNSPGPDKSNLCILVLGALGGRFDHEMGNINVLHLFPNIKIVLLSDDCLIFLLPRTHTHNIHIERSVEGPHCGLIPIGAPSTSTTTTGLRWNLDNTHMSFGGLISTSNTVDEDQVMVTSDSDLIWTISLRH

SEQ ID NO: 135866 - protein, 80 aa, Triticum aestivum
  Clone ID: PAT_TA_30284.pep
YCLASPLGEGVGRRAGSKKLWSCQSVNALVTLLLIHTRKAAKLQFVSDVLQFHLYGTRRDSFALLVMLFSLDQRAHHCCV

SEQ ID NO: 135867 - protein, 275 aa, Triticum aestivum
  Clone ID: PAT_TA_30285.pep
RHELRNIRECSLECPVVAAITSYEACMDVTDSDHKPVNCMFSVDLARVNELIRRQEYGKIIESNEKLHCLLQESRHVPDTIISTNNIILENEETVVLRITNNCGSKKSAFEILCEGQSTSKQDGTKTDFIPRASFGLPHWLEVQPSIGLIEPGETMEVNVHHENYYTQEEFVDGVVQGGWCELTRDKEAVLLVNVTGSTSTETVTHRINVRHCCAASSPPAPANVLSITAPPGDAPSSEGPTERSSRKSQSNHLQRSDAHFGASEVHDLHRLRNM

SEQ ID NO: 135868 - protein, 125 aa, Triticum aestivum
  Clone ID: PAT_TA_30286.pep
QRLLPGAAGAAEPADFGQHAGAGPADEAAGGAVRQGRRAVPAEDAKGRRAVPAEVRGREEEQGADQAGLPDGEQGQGGALHAHPLSQAPQAPHAPDDQLVHPWLPAELIKLPLPSVSISICSPTP

SEQ ID NO: 135869 - protein, 234 aa, Triticum aestivum
  Clone ID: PAT_TA_30287.pep
GRPGRYRKIEQGDFRCPSWFSHKLQKLLCKILDPNPSTRASIQKIKESTWFRKGPRGTLAVKERTPSENVTTNAPPTAGVRPRKNTYEDVQPLTVKNLNAFEIISFSTGKHNSTGFDLCGLFIREDCRKETRFTSDKPASTIISKLEYVAKALNLRVRKKDNGVVKMQARKEGRNGAVQLDMEIFEITPSPPLIEMKQTSGDPLEYRELLEDIRPALKDIVWAWHGDDPHQQLE

SEQ ID NO: 135870 - protein, 229 aa, Triticum aestivum
  unsure (1)..(229): unsure at all Xaa locations
  Clone ID: PAT_TA_30288.pep
YDSVSIFFYNTLRPPXLPASGSNKLHVKIGTMTNESLFFEIINGLRAARTDAGSSSTDAHGFRNATTSVVELLSESANQLSIKNDSDLDFLLDENHNLSGADGDSVGLHLQDKTSRHNEESCSYTSSNRESWGRCSSLGAASDGSFSRGLGDKHENMTVNALATPRRHEQRKLAKSSPPKTKEKKIHALWKKLKREREEMGDSLSQRLRMCLGQSPRHRRTQSSSGQQL

SEQ ID NO: 135871 - protein, 270 aa, Triticum aestivum
  Clone ID: PAT_TA_30289.pep
SADAWVGGQGPDAGQTKSDEQQGLADDASVESAATTGPNKHTNEDDTKAPYSNPPASVAEGTQLSRDSDLSPGQPMQAGMPSSGVGVIGRRSVSDFGAIGDNLSGASVVSGHDHLYNLQMLEAAYHRVLQPKESERAKTYIPRHPSVTPASYPQIQAPIVTNPAFWERLGSDTLSTDMLFFAFYYQQNSYQQYLAAKELKKQSWRFHRKYNTWFQRHVEPQVTTDEYERGSYVYFDFHLADDGNGWCQRIKNDFTFEYNFLEDELSVQPN

SEQ ID NO: 135872 - protein, 219 aa, Triticum aestivum
  unsure (1)..(219): unsure at all Xaa locations
  Clone ID: PAT_TA_30290.pep
RVPREWTAQVEPGVHITFVSIPGGAGNDLKRIRFSREMFNKWEAQRWWGENYDRVVELYNVQTFXRESPVVLPPPSATAASRERPITRTTSYKAACHPSTAVPDPSDHVWAHHFNMLNSAAGAGASSMPSSAGAPAPYDPSRATTSSLDEASVSVSNASDLEAAEWVEQDEPGVHITIRELGDGTRELRRVRFSRERFGEERAKVWWEQNRDRIHTQYL

SEQ ID NO: 135873 - protein, 257 aa, Triticum aestivum
  unsure (1)..(257): unsure at all Xaa locations
  Clone ID: PAT_TA_30291.pep
MELLPFLLLLLVGATVASGEPAYPGYGATEAEPACGVKEEAAVPVPERREEFDGGRILDISHYYREDMPAFESAEGTPGFLRLARSMRNGSDIANFSELRLTAHSGTHVDAPGHVFEHYYDAGFDVDTLDLAVLNADVMESLHIPKGVRRVLFRTLNTDRKLIWKKEFDSSYVXFMEDGAQWLIDNTDIQLVGVDYLSVGAYEECIPAHLVFLDKREVILVEALNLEHVATGIYTLHCLPLRLRGAEGSPARCILIK

SEQ ID NO: 135874 - protein, 451 aa, Triticum aestivum
  Clone ID: PAT_TA_30292.pep
MAGDGRRVVVFPFPFHGHATPLLRLASVLHTRGFAVTIFHTELRAPDPAEYPADYRFVPLRVDVPPELMASEDIAGMVTAMSEYSEAPFKERLTAALAEEGAGVRCVIADVAWYKALSVSSALGVPAMGVMTASAANYRVYMAYPMLIEKGYLPVQEARREDLVQELPPYRVKDLLRLEASSLQGFADLLRHTIEAPRQSAGLIFNTLRAIEADDLDTIRQEESLPVFALAPLHKLAPPGNSSSSLYGETQADRECLDWLDTQEPGSVVYVSFGSLAAMDPHEFVELAWGLAASKRPFLWVVRPTLIRGYESGQLPDGLDEQIRDHGRLVSWAPQVEVLAHPAVGAFITHSGWNSTVEAVSEGVPMICLPLHGDQFSNARYVCDVWKVGVEIEASSAAGQNLERGKIKAAIDKIVHDKGIRERMDAFKLAADEAVNSQTEVKALVDLINSF

SEQ ID NO: 135875 - protein, 79 aa, Triticum aestivum
  Clone ID: PAT_TA_30293.pep
SAGGALWLTVYPTDVVKSVIQVDDYKKPRYSGSIDALKKIVAADGVKGLYKGFGPAMARSVPANAATFVAYEITRSALG

SEQ ID NO: 135876 - protein, 296 aa, Triticum aestivum
  Clone ID: PAT_TA_30294.pep
MGDIAKDLTAGTVGGIANLVVGHPFDTIKVKLQSQPSPAPGQLPKYAGAFDAVKQTVAAEGPRGLYKGMGAPRATVAAFNALLLTERGSLETLLRSDPGGSSSITQQVVAGAGAGLALSKVECNTELFKCRWHAQSSLTQAAAACGVALPKGPMDVARHVMRDAGIKGLFKGIVPTMGREIPGNAIMFGVYEAVKQYMAGGRDTSGLGQGSLILAGGLAGGALWLTVYPTDVVKSVIQVDDYKKPRYSGSIDALKKIVAADGVKGLYKGFGPAMARSVPANAATFVAYEITRSAMG

SEQ ID NO: 135877 - protein, 188 aa, Triticum aestivum
  unsure (1)..(188): unsure at all Xaa locations
  Clone ID: PAT_TA_30295.pep
MAENWVEEASKNASAPTSFSGSPPSCQTSSTRRSRQRNIFHLLSHREVSPRTKHQAKRHWNKPPTCGAGYSELRYSATDAKHDLFSWAESQSLHRWSAKYCPLMPPPRSTIAAAFSSDGKTLASTHGDHTVKIIDCQTGKCLKVFGGHRRTPWVGRYHPLHSDILASXGGLDHEVRLWDANTSDCIGS

SEQ ID NO: 135878 - protein, 462 aa, Triticum aestivum
  Clone ID: PAT_TA_30296.pep
MFFLASMYFAFPRRAGAPGQVFAAGLPLWVPNSGRNVFPANYCYRGYLASTAGFRTILLVPFETGVLELGSMQQVAESSDTLQTIKSVFAGTGGNKDIIPSREGNGHIERSPGLAKIFGKDLNLGRSSAGPVIGVSKVDERPWEQRTAGGGSSLLPNVQKGLQSFTWSQARGLNSHQQKFGNGILIVSNEATHGNNRTADSSTTTQFQLQKAPQLQKLPLLQKPPQLVKPLQMVNQQQLQPQAPRQIDFSAGTSSKSGVLVTRAAVLDGDSSEVNGLCKEEGTTPVIEDRRPRKRGRKPANGREEPLNHVEAERQRREKLNQRFYALRAVVPNISKMDKASLLGDAIAYITDLQKKLKDMETERERFLESGMVDPRERAPRPEVDIQVVQDEVLVRVMSPLENHPVKKVFEAFEEADVRVGESKLTGNNGTVVHSFIIKCPGSEQQTREKVIAAMSRAMSSV

SEQ ID NO: 135879 - protein, 248 aa, Triticum aestivum
  Clone ID: PAT_TA_30297.pep
MSPDQQHTVFTAREYNATVEFYWAPFLLQSNADDAVVHKISDRMVRNGSIAHHGRHWEGADVLVFNTYLWWCTGLRFRVVNGPIAGAREEDAAWVSTEEAYGMAFRDMLQWVRDKMDFNTTRVFFTSMSPTHGKSQDWGDAPGGNCYNETAMIEDAGYWGTDGRRSVMRVIREILDGDGADVPLTFLNVTQLSMYRKDAHTSIYKKQWNPLTPEQVADPRTYADCVHWCLPGLQDTWNELLYSKLFYP

SEQ ID NO: 135880 - protein, 178 aa, Triticum aestivum
  Clone ID: PAT_TA_30298.pep
RFPLQSTQSPTSNHPALATTAIRLSIGHPTRFALRRASALSSPSLAMGSAANATFSPLALHVAFSLVAAGSGGATRDQLAAALGSAEKGGAEVLHALAEQVAPVVLADASGARAPRAPVAGFLRGSPFPLPYPRIPHRGGAIRRACVQSLGVCMMCLLWIAALAVTSTITCKWRGFQL

SEQ ID NO: 135881 - protein, 103 aa, Triticum aestivum; identical to SEQ ID NO: 107316
  Clone ID: PAT_TA_30299.pep

SEQ ID NO: 135882 - protein, 230 aa, Triticum aestivum
  unsure (1)..(230): unsure at all Xaa locations
  Clone ID: PAT_TA_30300.pep
PXSXXXXXXRRRGGHPTGGIAGAGGGHARLLLRLGLRDSRGLSMTETHGARGSRTELNGPESTQIPQKPRRISPRNGAGAGRQRVSPPSRTREIIPNSCLTKKGSKEPGSTPRRTRPQNWIPITAKTRPPESFPCREPKCRRRKKERERDRGLGWPGLARRREGRIRAGAAAGARTYSEILEVTKQSAKAGGFERKAWIRARGHHHTTGWLCLLLGRKEGEKRKKHPAGE

SEQ ID NO: 135883 - protein, 120 aa, Triticum aestivum
  unsure (1)..(120): unsure at all Xaa locations
  Clone ID: PAT_TA_30301.pep
PAPALPSRAGTRGHLLRLSLQPAPVPAALRRHRQLVLHRPPRHAGNRPAHRARPPAAAADDNNPMQQHQGGXLNPSVSAIGFGPGVSFSGFRVPARMQGNEEHNGGNGDKPPSVSSASHH

SEQ ID NO: 135884 - protein, 326 aa, Triticum aestivum
  unsure (1)..(326): unsure at all Xaa locations
  Clone ID: PAT_TA_30302.pep
MESGGAGEVRHWNADVNGVSLHVAEQGPAAGPAVLLLHGFPELWLSWRHQMAALAARGFRALAPDLRGYGDSDAPADPAAYTMLHVVGDVVALLDHLRLPKVVVVGHDWGAQVAWHFCLFRPDRVRAVVALGIPFFPRSPRPMAEMFAGRGEGFYITQAXEPGRAVCSVRCRNFATELKKFYSIQLDDLAAPPGVEIIDFFEASSSPLPWMTEEELGQYAEKFQKSGFTGPLNYYRAMDTNWRLTAPWHGAKITEPAKFIGGEKCLVLWCQALHRERESGGFKSSVPGFEVSIIEGPHFLQQEQAERVNSEIPSFLVKLSGEEAHN

SEQ ID NO: 135885 - protein, 514 aa, Triticum aestivum
  Clone ID: PAT_TA_30303.pep
PRAEFGTRHAKIVAALSQEQFCYESQILRDSAFLQRARPLDSARGLWSVDLVGGFKMPLPSECPMEFSCIPEHFLDDAMDLLALTSRIPKALEGFPLDNFLNFNIMFMASSSYIKNPYLKAKMVEVLKSWMPQRSGLKSTASLFEGHQLCLDYLVKNLLKLYVDIEFTGSHTQFFDKFNIRHNIAELLEYLWDVPSHRNAWRQMAKEEEKGVYLNFLNFLINDSIYLLDESLKRILELKEIEAEMANTVAWDSRPAQEREERLRAFHQSENIARFDMKLANEDVGMLAFTSEQIPAPLLLPEMVERVASMLNYFLLQLAGPQRKSLTVKDPEKYEFKPKQLLKQIATIYVHIARGDKEAVFPAAISKDGRSYSEQLFASATNILWKIGVDPQIIQEFMQLAGKAKAAAAEAMDAEAILGDIPDEFLDPIQYTLMNDPVILPSSRVTVDRPVIVRHLLSDSTDPFNRSQLTQDMLIPDTDLKLRIEEFVRSQQSRKRRAVDTETGEPDGAADMVE

SEQ ID NO: 135886 - protein, 141 aa, Triticum aestivum
  unsure (1)..(141): unsure at all Xaa locations
  Clone ID: PAT_TA_30304.pep
LPKYVKLNYXRTDRHVYSKFTVETCVPQVCYRILQMCSLFMFSSLDHAARAVVACKRFYYTQWPYKNHREESLPHLDMQKQVQYKCCLLACYHPGVSRLISKLAVSEQAETPRILLRLRLFWRLTVCWLISFATSVVICIL

SEQ ID NO: 135887 - protein, 127 aa, Triticum aestivum
  Clone ID: PAT_TA_30305.pep
GWDFFEAMYFGGSMTEGFLRGTGTLFGTYAGGFHGEERLGKLGYLVGSQLGSWVGGRIGLMVYDVINGLNYMLEFVRPEEYRSSSYYDSEEGSEYADNYRSGEVYEPTYSETPEEAQEEESGGFSLF

SEQ ID NO: 135888 - protein, 183 aa, Triticum aestivum
  Clone ID: PAT_TA_30306.pep
YRANWVPGPPSEFFFFFFLNEGASCPTYVKLNYKRTDRHVYSKFTLETCVPQVCYKILQMCSLFMFSSLDHAARAVVACKRFYYTQWPYKESQRKESLPHLDMQKQVQYKCCLLACYHPGVSRLISKLAVSEQAETPRIPGRIRHAGRHPVCRLLASAPAADSRMARALRRYGRRPPAVDRTP

SEQ ID NO: 135889 - protein, 179 aa, Triticum aestivum
  unsure (1)..(179): unsure at all Xaa locations
  Clone ID: PAT_TA_30307.pep
MPWRRWGPSVMFMAYATLAVAALRARLSYKWPAHAARRLWRWADAWARPYQCSSVRRFAASGGNDGAENPLFPACSPPVASLPSLRCSYAPGVLSSTSKSNDFSLQLGAGHTAHDAFLGARLAWTNPPERSTFRVRPHDRTRVLRPYLQHVESVADEMELRRRELRLYANTGXRRFALG

SEQ ID NO: 135890 - protein, 227 aa, Triticum aestivum
  Clone ID: PAT_TA_30308.pep
KPVDPASSSAMAAAALLLVAALVALGSGHGGEAFDPNPLQDFCVADATSKVRVNGLSCKDPAAVVSDDVFFAGADKLRDEVSERYGYSALTVQIPGLNTQGQRYARVDLAPGAIFPPHYHPRAAETALVLEGSVYFGFVSSYPDNKLFAKVLSKGDVFAVPQGLMHFLYNNGTAPATLYASLSSQNPGLVLLGNSLFAGALPDDLVAKTLLTDQHGGETIKANFRRP

SEQ ID NO: 135891 - protein, 228 aa, Triticum aestivum
  Clone ID: PAT_TA_30309.pep
RSLPFCWSRRFAMAAATFLLALAVVALGSGHVDAFDPNPLQDFCVTDPTSKVHENGLACKDPAAVVAEDFHFGGLDKPGGTTSKRFGFTANQVQIPGLNTLGESHVRLDVAPGAVFPVHYHPRAAETALVLEGSVYFGFVSSYPDNKLFAKVLRKGDVFAVPQGLMHFLYNNGTAPAALYASLSSQNPGLVLLANALFAGALPDDLLAKTLLTDKHTVDNIRANFRRS

SEQ ID NO: 135892 - protein, 369 aa, Triticum aestivum
  Clone ID: PAT_TA_30310.pep
MVPCRPARAAACLPLVLILCLLSCAAARPAPAPAPVHGRHHGQGWHSFKRLLDALRGTRVTGLGDLKRYLAMFGYMPKHAGPEHGGDPTDAFDEHLEAAVRRYQSRLSLPVTGQLDVVTLDQMMSPRCGVQDDHGASVSPEHGGAVSRFTFFKGKPRWTRRSDPDPVVLTYAVSPTATVGYLPADDVRAVFRRAFERWARVIPVAFVETDDYDEAEIKVGFYGGSHGDWVPFDGPLGVLGHAFSPKNGRLHLDAAERWAVDFAGETKASAAIDLESVATHEIGHVLGLGHSTSPQAVMYPSIKPLEKKADLTVDDVEGVQLLYGSNPDFRLSSLYDATDTSGSPAGSSWAASSAGVVLCAVLVILVTHL

SEQ ID NO: 135893 - protein, 234 aa, Triticum aestivum
  unsure (1)..(234): unsure at all Xaa locations
  Clone ID: PAT_TA_30311.pep
RVRRPARRIRRPPSPRQRRRRPPHTSSLSAHRTRHASPPVHSPPHRRSALAPDLLAGPPNHPKNFQSSSKPAAQKKYQVTXAASPAKAISPKTIKHIHPKQLTLSRESTGQLASFCQNNRALAGMQQISKAKCPFVWNSIQALQVLGYPPFRWIQRWAPLKFVVQGIQKLSTPLLFLSVTSALGDLSSKSDETDDGPSSTTGAPDLPAESNETSSTSDTREAADGDGTKDIVVS

SEQ ID NO: 135894 - protein, 191 aa, Triticum aestivum
  unsure (1)..(191): unsure at all Xaa locations
  Clone ID: PAT_TA_30312.pep
EPALDPAYERAPDPPCGPAPDLAYEPASEPAYEPAPERPFPALEPAXEPAREPAYDPASPGPAFEPAPDSAYEPALDPADDDPEPDPDQDPDPEPEPDPDPEPEPEXDPDPDPEPEPEPPPPPPPPMPTPIPEPIPTPPPVPTPRPPPVPTPRPPPPPRSRPSPRSFRAARPSVARTNAARTAAPNTMAFT

SEQ ID NO: 135895 - protein, 97 aa, Triticum aestivum
  unsure (1)..(97): unsure at all Xaa locations
  Clone ID: PAT_TA_30313.pep
CTSGILAGGVVAMTSSRTVSMSATKANLNRFSPDLVRVALDDGNNAVATMTMTRIHAAPMFLAGAITLVDKESGRGTIQQDVASFNEIDAYAPRGLX

SEQ ID NO: 135896 - protein, 357 aa, Triticum aestivum
  Clone ID: PAT_TA_30314.pep
RKPAREEIEVRNTPPARSPGATGVRPPAAPRVQALASSLGALPPEFVRPEHEQPRATTFRGAAPPEIPVINMSSPGAWRRMAEAAAEWGIFQVVCHGVPAEAVAELQRVGRGFFALPQEEKQRYAMDPAEGKTEGYGSTLRKGDLEGKKAWADFLFHNVAPPAAVNHAVWPESPEGYREANEAYCGHMLRLTRELFGRLSAELGLQEGAMAEAFGGDDVVLLQKINFYPPCPQPELALGLAPHTDMSTLTVLLPDEVQGLQVFKDGCWYDVNYVPGALIIHIGDQIEIMSNGRYKAVLHRTTVSREKTRMSWPVFVEPPPEHVVGPHPQLVADEFPAKYKAKKFKDYKYCKINKLPQ

SEQ ID NO: 135897 - protein, 97 aa, Triticum aestivum
  Clone ID: PAT_TA_30315.pep
VMFVIDANKEELAIKEANTLGIPVVAILDSNVDPAGIAFPVPANDDASRAIRLYCESAAQAATKGGQDARGAAGVDLGAMAEPPVEDVVAEVEAPTA

SEQ ID NO: 135898 - protein, 106 aa, Triticum aestivum
  Clone ID: PAT_TA_30316.pep
YPSAVAFGSRDPPSGTFTEREEGVVVDVVNHSGIGSGLGVAGWQSRLAGSGEARCSGTTAAAFGARRWKKRAGSTMEGVPAPASGRGRPSRWWWSSGTRRRGTGCW

SEQ ID NO: 135899 - protein, 92 aa, Triticum aestivum
  Clone ID: PAT_TA_30317.pep
FEVSFPRSNGRTVLIVLYPRVSRAVYFDPSRDYEKKDYTHIMNILDDALQGFSIRGGHMQIKKQRNKKMGFAHKTNFSCIHVPKPNKKDGFY

SEQ ID NO: 135900 - protein, 86 aa, Triticum aestivum
  Clone ID: PAT_TA_30318.pep
ALAEPASPWPPRPRAHRAPRAQAPRPRASPTSTLSTMSTSWSREPLDRRVRRRLQPPATATPSTNSAPSLHPRPSRARLRHRCEMT

SEQ ID NO: 135901 - protein, 137 aa, Triticum aestivum
  Clone ID: PAT_TA_30319.pep
ARSPPPGAPSPQPAPPALTKSTTAPSLRRLVASSLGAAPSPRPLSTSPWSLDVGYRLPLTPASTTIATLRLPETPSTTTVLTTRPSCQSNQMFEPRSQTPPSTMTTTTWEVPTTTCSPLTTTRSILGGSQAGGMCLF

SEQ ID NO: 135902 - protein, 170 aa, Triticum aestivum
  Clone ID: PAT_TA_30320.pep
HEYISSNANESAEATISEYIHKLNKFALRRLAQKQHRPKRQGLLPGSLLTTPSHPRSPSRGSRHPRGSSSRQRCHLAPGFCHLVALARRGRQHRSRTGFRRQSRGVEPVDEQSGLGEAPARPNRRRRAARCRGGDELDGDARGPPSLLRWLESTEKRTAVPLGIFVVARG

SEQ ID NO: 135903 - protein, 84 aa, Triticum aestivum
  unsure (1)..(84): unsure at all Xaa locations
  Clone ID: PAT_TA_30321.pep
FISLPASLLYSFPLCIIPQLTINHIACKLIVMCITEEGHRYSPTIRSDKPNSIYATQQTHRRHCRHXITLXTCDLVHKMSSESE

SEQ ID NO: 135904 - protein, 89 aa, Triticum aestivum
  Clone ID: PAT_TA_30322.pep
SALPWQWGIYSQLICSSSWLEPRLKPSLLSRVKPRNGTNDCGPGARTIGPGSCLEPGQMGQYEPGPMPTRPRPAPRLMNRDEFPMGPGS

SEQ ID NO: 135905 - protein, 70 aa, Triticum aestivum
  Clone ID: PAT_TA_30323.pep
KGMMCCLMSYLLKCLVICSKNPQLLSHIHICPKPKVKLGLTEISYPAPPSSLDIATAKNPSHFGLTDRDL

SEQ ID NO: 135906 - protein, 111 aa, Triticum aestivum
  unsure (1)..(111): unsure at all Xaa locations
  Clone ID: PAT_TA_30324.pep
AYAXXXMSXXNIXXDLXPQXXWAXPHFRGDHHEALHQHLXLREHCVXTAXGRXVSSXSSLSLDLIHVLLGVLGXFSMYNFLRCVSRXRXCGFMINYLWILFGSPLILICMI

SEQ ID NO: 135907 - protein, 84 aa, Triticum aestivum
  Clone ID: PAT_TA_30325.pep
ISAFRTNPSGLYRHRGNLGFTKSRLHKKEIYISELPSLPSTQRRVPPGHGTKSSILYLHNPTARHKYIVRLSEDPLIQDSLSIP

SEQ ID NO: 135908 - protein, 150 aa, Triticum aestivum
  Clone ID: PAT_TA_30326.pep
RLTRDMVLSMYPHMYLSFLSIPFLAWIINDYHEQGNIIIINLLLPLGHISNRKVIIELWEAGCPLCSTDMETADHMLFRCPFVSFFCYRVRGGPHRCVGVRPFTSSKPHAKVGTPFLGTFVILFCLHLSEHRDAWSSKGYSSPLPRVRPP

SEQ ID NO: 135909 - protein, 114 aa, Triticum aestivum
  Clone ID: PAT_TA_30327.pep
NFTYKIGQVAEVLKTQGAQLILPVALLHAVAFALGYWISKWSSFGESTSRTISIECGMQSSALGFLLAQKHFTNPLVAVPSAVSVVCMALGGSALAVFWRNRGLPADDKDDFKE

SEQ ID NO: 135910 - protein, 122 aa, Triticum aestivum
  unsure (1)..(122): unsure at all Xaa locations
  Clone ID: PAT_TA_30328.pep
LIHVSPLPGVPLSSSAQLPNASVAIVAVDLATIVAPTPSWEVPRNRCRLLRLPRPRAQARSHRIVRIELHLPRSPPAFFFKFVQSCAPNLPPGLLVLHILRRCCXCDRLLERRPPSLQKQPD

SEQ ID NO: 135911 - protein, 130 aa, Triticum aestivum
  Clone ID: PAT_TA_30329.pep
LPSRSPSLCPSPTRPSSSALLSPYRRRRRGHRPPGTIGECPGAPPACHASPTWINSISEQPPRPDRRLLLPRSSLLLFIDPSPLQLLSHQRASVCLRDAGVQEPDATVDDDSYYTGGAYYYVQPADDDQE

SEQ ID NO: 135912 - protein, 128 aa, Triticum aestivum
  unsure (1)..(128): unsure at all Xaa locations
  Clone ID: PAT_TA_30330.pep
WIPGLTGRCTRTQRHAASSLTRSGTTPSRPKAPRSCASTSSTSTATGSSWSAPEPQPWTPPLRPGMSAPPRRSATSGPPRTTPSSPPLXPRCRNQTLEPRIQTPPSMTTTTLEVPTTTCRPLTTTRSS

SEQ ID NO: 135913 - protein, 109 aa, Triticum aestivum
  Clone ID: PAT_TA_30331.pep
NFRDRDFPTERDPGDLDPTPRSARGGHEGGGRVPLPRGALRAPPTYSFLLYIPTYPRTIRTGAKNLIPPLQLSVSTRSHLGACSGGPPEGASTMEGFYIITIAPPMKCE

SEQ ID NO: 135914 - protein, 74 aa, Triticum aestivum
  Clone ID: PAT_TA_30332.pep
QSISYHEVWMHRRSLHRLSRWERPMHGIEEASNDGRVRVRIIHGLNISHKEPTYLLQKSTSHQKPSTTRMLLGG

SEQ ID NO: 135915 - protein, 139 aa, Triticum aestivum
  Clone ID: PAT_TA_30333.pep
AARRRQKGLGASVSTIPKTLCNVLGFRQFDDCSLNLHLADSTIKKPMGRINDVLIVANRNFLPIHFIVLDIDFNPTCPIILGRPFLRTVGAIIDMKEGNIILQFPLRKGMEHFPRKKIKLPYESIMRVTYGLHTKDDNT

SEQ ID NO: 135916 - protein, 88 aa, Triticum aestivum
  Clone ID: PAT_TA_30334.pep
TKMKEGMPFGGIPKLRLLAILEYLGVPWASPSLGSCHSLFYSPSNLYPKLENFTTQNSTGNLISSVSARKKNHHIRYCNELILYLYWC

SEQ ID NO: 135917 - protein, 62 aa, Triticum aestivum
  Clone ID: PAT_TA_30335.pep
SMDSTLVIKNSHTYCKKIISPQSKVLLCMLLGERLVGVNHHALPTFTQRKKIKNKLSSNFVA

SEQ ID NO: 135918 - protein, 111 aa, Triticum aestivum
  Clone ID: PAT_TA_30336.pep
EGWHKSNMIEEARPPAWDLLTTPGLQRPPCSSCRRGWHLAPRIHHHGTMDVVEEAGEGLTMRNLTNASGVPRLKKTCWWRRNVAPVEQFHGIDVEEDGATPGRPPGRRGGR

SEQ ID NO: 135919 - protein, 77 aa, Triticum aestivum
  Clone ID: PAT_TA_30337.pep
KLHNTKLKVENLVSSVSERKQKTTSRYCNELIIYLYWCYNYCIPTSLWFKNYFTSHRFIKIRKQHTKNRICQKQNSL

SEQ ID NO: 135920 - protein, 142 aa, Triticum aestivum
  Clone ID: PAT_TA_30338.pep
IRHEDHRRFGRARVPNRHGRRLSHGHRTPRRLGACAAAPSRSSASSTPPYRGRGPSPATLAPSSSAMAVRRRRSIRTIPATSGLPDLAIELATMELRSQTPPLTTTPTTLEEPTTTSRLLTTTSTSLGGSQAGGLCLFRSVS

SEQ ID NO: 135921 - protein, 119 aa, Triticum aestivum
  unsure (1)..(119): unsure at all Xaa locations
  Clone ID: PAT_TA_30339.pep
GRALVACRPSRPPPTPTXPSPTPGTKPRPYPPSPRPSLCLAPPHLARAPPCPLPHEARDHSPHRASPTCPRSCASTPSSSPWTQASSEASEHRLHHRLQPREPTIAAFDSRPPEPPRAS

SEQ ID NO: 135922 - protein, 131 aa, Triticum aestivum
  unsure (1)..(131): unsure at all Xaa locations
  Clone ID: PAT_TA_30340.pep
LAPLAQDHLSPSADLEEGPARPSPTTSLHRGHRRPRTPPTNPGDPASTTTSPSPTRPRRXTTASPPCRLLPPRTSSTSPTIPTAASPPRARFRTTTGPHTETDVTPPSTTTPITLEVPTTTCSPLTTTRSS

SEQ ID NO: 135923 - protein, 136 aa, Triticum aestivum
  Clone ID: PAT_TA_30341.pep
WQWFLGWQRQNRRWRHHRRRRRWRTACSDSVEGCQKGVPMLPTMDQQPTRPRKTQMSLSLDPICSQNFVYSSKLTCDAALQLLTLQSWLVRPGCSRAGLVVGGQLGGAGLAQADVRWSSRRRLEERAPAFAEAAQG

SEQ ID NO: 135924 - protein, 211 aa, Triticum aestivum
  unsure (1)..(211): unsure at all Xaa locations
  Clone ID: PAT_TA_30342.pep
MNLKFKAPWKKELVALGKANVNGEDKTITIRNDYPDYPVPYFQVTEGFNLRKVKELMLERNVKIAKSIANDIIIPDPAPQWVADNFLDKYAELEPILVKDSARCFLQLFQNCRGRGMSSDLTITAQTLTFIVSFNALRCAKVVLEGMAPELYGMHANPNCINKYGYFPLHEAAERFSLDMIKLLLRHGALPNVRTVGXDVIKNLLPLLFAV

SEQ ID NO: 135925 - protein, 128 aa, Triticum aestivum
  Clone ID: PAT_TA_30343.pep
FVPLAQRIRLTPSPLSCTEAAPGHSEVSSRGVVAVSVGYVNEPDRSRPATSGSNSSSTSTPKSCRRQIRLRRTLPDHAVYSCPTATTRLTPLLMPRSTTLLMTPRCQSNQEPEDPEDVSTWSSASRSS

SEQ ID NO: 135926 - protein, 128 aa, Triticum aestivum
  Clone ID: PAT_TA_30344.pep
YKLYITSQGPRGIEYISSKTQESVEATISEYRHKLDKFALRKLAKKQHRLKRQGFLPGSLLTTPGRRRSPRSSRHPQCSSSRRQRWRLDPGFHHRGAVGVLGEMPEWSEQSSWAMARRRPRLKKRTLG

SEQ ID NO: 135927 - protein, 193 aa, Triticum aestivum
  Clone ID: PAT_TA_30345.pep
PPRHRPTPWRPSGRRPQPTRPRCPSLNLARSPLPLLAPPSPYPRLPRGNPTPLPEAAVAASPSLSYMLPSATFVVRWRPGGSPSSPTSSTHHRSSPGPLHRADRTLLQPSSTGAPPSTPSSSCAPGPHRAFSALPDSETDADAPVVDYVTDDPSLLPEQPENGALEPDATVDDDSYYTRGAYYYVQAADDDQE

SEQ ID NO: 135928 - protein, 82 aa, Triticum aestivum
  Clone ID: PAT_TA_30346.pep
HLRINLTRMPLLGNVVISKKILRTRKIMVMHSNERGECLPRTLVDRKRKCYDNAVDVSYIFTIDRSKYRTYGTSAICTRSAW

SEQ ID NO: 135929 - protein, 198 aa, Triticum aestivum
  Clone ID: PAT_TA_30347.pep
MSTEVAAADIPVPQVEVAADAAVDTPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAGEEGGPRQEARGQEGQEVEPGMTGPRWPGG

SEQ ID NO: 135930 - protein, 88 aa, Triticum aestivum
  Clone ID: PAT_TA_30348.pep
NTLCASLISFELYSFCSIASLISFRARWWICFIETIFFSCFTYIILRVLQNSMVIFFNYDRHPRLVKKNLMSVLNTMRSLMLDNCFEI

SEQ ID NO: 135931 - protein, 99 aa, Triticum aestivum
  Clone ID: PAT_TA_30349.pep
HASGSTMLQVLVSIQALILNEKPYFNEPGYAGSANTATGQQHSIEYNKTTFLHSCRTMLYSLRRPPEWLECTWSPPPCSGVWVGLWACFSLGPNKQPAW

SEQ ID NO: 135932 - protein, 79 aa, Triticum aestivum
  Clone ID: PAT_TA_30350.pep
TERWKFHGNISRNGYGNAIIGSYGGCFEEQYMVGLMHRQKLHGTRQASNGGRVRVRMIHGLNISHKELTYLLQRIISHR

SEQ ID NO: 135933 - protein, 179 aa, Triticum aestivum
  Clone ID: PAT_TA_30351.pep
MAAEGSSGVGVGGRKTSLSHNPRERGVAKFLTGLPARGNFSSSSISSNLGGLRVYVCEHDTNPPEGQVIETDTTNILIRHLQLKKKESEAKDAGSRTPGESGKGKRCAARSLGVQKSSKKPNLGSSSGLSSSDEAISGFSQHTLQSFTVERLRALLRQSGLTTKGKKDELITRLREAQS

SEQ ID NO: 135934 - protein, 66 aa, Triticum aestivum
  Clone ID: PAT_TA_30352.pep
CLYNDYCLDIVTSIWSSINYPTVICLPTVCYFSREKPLVKPTALWSSFSYICLYDLFFLCFYFQIY

SEQ ID NO: 135935 - protein, 116 aa, Triticum aestivum
  Clone ID: PAT_TA_30353.pep
HQSNTIEEARPPACDLLTTPGRRRSPRSSIHRRWHLAPRIHHLVAQARRRGRHRRSRSQGHQLQPRGVEAHGGRRELRSAGVVAGVEEGGDDPGRTEVEDGEAAGTRVAFGPSSHT

SEQ ID NO: 135936 - protein, 92 aa, Triticum aestivum
  Clone ID: PAT_TA_30354.pep
RYLAAEVLELAGNAAKDNKKTRIVPRHLLLAIRNDQELGRLLSGVTIAHGGVIPNINPVLLPKKAAEKAEKAGTAAKSPKKATKSPKKATKA

SEQ ID NO: 135937 - protein, 157 aa, Triticum aestivum
  Clone ID: PAT_TA_30355.pep
SPLAPPRSLSCPRTRHLLQIHRRARSLPLASLCHGQQAHLASPLRPQRPPSSAASTTETKRAGTPSIVEPALCFHLRPPKAAAVVLLHRASPEPAHAHLQVRDPETAADAAMFEYIDDDPSLPEQPDGGVQEPDATFDDGCYPEGAYYHVTVADDQE

SEQ ID NO: 135938 - protein, 142 aa, Triticum aestivum
  Clone ID: PAT_TA_30356.pep
TADAWMPIGTSRKGGKGPGRVSPLVPVQSRTGTNGALDPVHEPRGAAGPRGPLVPVRLDLLVPVGGTNRDQWAWLLAHHHWSRFVARTGTKGSHLVPVHAMNRDQWCCLYITLAPEQSTLVLCFSGPARGGVCGALSHLLCT

SEQ ID NO: 135939 - protein, 45 aa, Triticum aestivum
  Clone ID: PAT_TA_30357.pep
VLGYGLSSVVYLPLHVNRFISIVFLQNSHVLKTFIKIAYSPPPSR

SEQ ID NO: 135940 - protein, 59 aa, Triticum aestivum
  Clone ID: PAT_TA_30358.pep
RDRLVGKDHRSSRPPFIRMHNLRTPHVSNLLHNFNHTCMLWDLLNSTQAFFKFIITQLA

SEQ ID NO: 135941 - protein, 70 aa, Triticum aestivum
  Clone ID: PAT_TA_30359.pep
SILINFKLCESLSKGVYIKDDCGKLKIKDSNHTIRYKQNTYHVVNKNIVPSKVTDRRRRKRGCLPGHPQA

SEQ ID NO: 135942 - protein, 121 aa, Triticum aestivum
  Clone ID: PAT_TA_30360.pep
SLLFPSGAVLHQIEPRSRAPMAAPSTLARTPASPRLSSRSRRRAPSPSSSTTSRASRDALTPPQSSIPIVGRRFYLVVDPPLPALPFIRRATMCSLMVDPWSQMPPPMDATTWRPPMTRSS

SEQ ID NO: 135943 - protein, 147 aa, Triticum aestivum
  Clone ID: PAT_TA_30361.pep
KFPTEDISNQKKEGLKTPAEDISNQKKEEGFKTPAEDTSNQKKEQELEIKGDIMTDDQKANTDNVNQQEVIEQKDPKIDETNEKSDQKKDDNETKDKDQKMDSKKKSPIDTKKKKKSDEPPKHPGFILQAKKSKGYKLRSTSLSLDG

SEQ ID NO: 135944 - protein, 146 aa, Triticum aestivum
  Clone ID: PAT_TA_30362.pep
EIDISVSPSLPSMPRKVPSGHGTKSSILDLHSPGVWPKAIVRPSGHPLIQDSLIDLLHRTVHPESLWSPPYTPAITPLASRSTATPETPPNMRKSRAPAASKSKSNKNKKLGMVATKLFKAHNTKITKNEMGPFLICFPYLDPILV

SEQ ID NO: 135945 - protein, 94 aa, Triticum aestivum
  Clone ID: PAT_TA_30363.pep
VHGLYALSPFHHCYPLRYRALPFLTLRVGENFAGASKPRDMIHSFTHKPPYIFLKTATIPTYYGISIAIPRYIAMQLSTISFIMTHSSLSYCLA

SEQ ID NO: 135946 - protein, 127 aa, Triticum aestivum
  Clone ID: PAT_TA_30364.pep
HSAPNPPSRQAPSPTGQTLALHPTLPPPPSSLAAAAAVLPPSSLPYNHAGGRKPPFVAPYHCRCAVHASFPTAPPSSSLGTAAACYSPPPRCYLWVESSIGGSELKLKAETGLGELIPSAGSPSPRA

SEQ ID NO: 135947 - protein, 171 aa, Triticum aestivum
  Clone ID: PAT_TA_30365.pep
DEKHDEESEEQKEEERISYPCPPSKESNPPTHTLFNSPSCLPKDDCYDDCYDPLNLFEISLFDDACYACGQDANMNYAYGDELAIVPYVKHEIVAIAPTHDSPIIFLNSPYYTISEKFVLTKAYIDGLPFTITHDDFDRYNMHVLAAPTCNYYERGTISPPLYVSNMIKLQ

SEQ ID NO: 135948 - protein, 245 aa, Triticum aestivum
  unsure (1)..(245): unsure at all Xaa locations
  Clone ID: PAT_TA_30366.pep
LHGKFRTDDKEMPKRTPEGMSEYLKVCSLHKRKRTVFTDNQGXNIMLENGEFSNLTDDLFIPEIRFPADCVPESAIPRESGISISNKIEVHGVLDNLPAPVSRNTAMLERFGMMPEYYKTGNKYRGKDVSKVEGKSLSQEQALLIIRKLVARYLALAGFESGTAGSVDDFSEIIVKHISKLGRSLKLITDSYRKQFSSIELLKMFLQTVGYSNIGPLMEITKMXSRVASHPVHQDAQVQNQNNLL

SEQ ID NO: 135949 - protein, 223 aa, Triticum aestivum
  Clone ID: PAT_TA_30367.pep
GSTGSYNKSYGNYNKMPSDFESNIKGFISSQKNFNAMIEEKLLKIDDLARNVDRIALDVDALKLRSIPPKHDINESLKAMRISIDECKERTARMRASKDAFIKSCSSNSYENQDEDLRIIDVSPIKSLFCNINIDETEYDLPLPRRRSKNSEYLDLNDEIDESGIERNKNLDVAKPTILDFKEFNYESCSLIDCISLLQSMLNFPHAYSQNKAFTEHIVDALM

SEQ ID NO: 135950 - protein, 101 aa, Triticum aestivum
  Clone ID: PAT_TA_30368.pep
LLLVVVSGLHVVVGTSSVVGVVVDGGIWLLNSSISWRTRITSLESIMRSQQTDEVGRRASLPECKDPPSWPCPCSSLSIIFVFLWLAGSDMAGHHLHSSSL

SEQ ID NO: 135951 - protein, 126 aa, Triticum aestivum
  Clone ID: PAT_TA_30369.pep
LLLVVVSGLHVVVGTSSVVGVVVDGGIWLLNSSIWLLWQVGGVVDSVVELGSSSVGLVVSWRTRITSLESIMRSQQTDEVGRRASLPECKDPPSWPCPCSSLSIIFVFLWLAGSDMAGHHLHSSSL

SEQ ID NO: 135952 - protein, 68 aa, Triticum aestivum
  Clone ID: PAT_TA_30370.pep
HYGSCIIDLDIRKSSALGFLLAQKHFTNPLVAVPSAVSVVCMALGGSALAVFWRNRGLPADDKDDFKE

SEQ ID NO: 135953 - protein, 275 aa, Triticum aestivum
  unsure (1)..(275): unsure at all Xaa locations
  Clone ID: PAT_TA_30371.pep
KAKAAKAKKPSAPRKPRAAPAHPTYAEMVSEAITALKERTGSSPYAIAKFVEDKHKAHLPANFRKILSVQLKKLVASGKLTKVKASYKLSAAAAKPKPAAKKKPAAKKKAPAKKTATKTKAKAPAKKTATKTKAKAPAKKSAAKPKAKAPAKTKAAAKPKAAAKPKAKAPAKTKAAAKPKAAAKPKGRPAKAAKTSXKDAPGKKAPARRGPKKPRRRKXPTKKPPPVKKAAPAKKAAPAKKGPRPQERPEGKSLEEEPKALADRFSRAVFFWSGL

SEQ ID NO: 135954 - protein, 49 aa, Triticum aestivum
  Clone ID: PAT_TA_30372.pep
RSMNSRIIMQLCEDSLTFNNFSSWYFIQTASKTKENKMMLQAKHISRGE

SEQ ID NO: 135955 - protein, 76 aa, Triticum aestivum
  Clone ID: PAT_TA_30373.pep
MDAKKFLQMVEDKKKRLLEKKEAPLKWQQKLEAAIKATEEKEKKLKSKKHRRRSYSSSESDSESESDSDGKHRKRK

SEQ ID NO: 135956 - protein, 110 aa, Triticum aestivum
  Clone ID: PAT_TA_30374.pep
YSRTTKQLSLGMLRKASPLSSSFIGNFTWSYIFIHHMIRVLLGESFYFVSFCFLLVRIVFFFFSFNKKSRIAFAMLILLVRMLLLKTESLPLLQHSLEKSEHGLTLNLFA

SEQ ID NO: 135957 - protein, 62 aa, Triticum aestivum
  unsure (1)..(62): unsure at all Xaa locations
  Clone ID: PAT_TA_30375.pep
WHXXMVEIXXVVCAVWEXRRLCCRRMITXWCIVSLTIXXWKGMHVRRGCHVESKVHLPWVHX

SEQ ID NO: 135958 - protein, 63 aa, Triticum aestivum
  Clone ID: PAT_TA_30376.pep
KHKTTSKQRPYELFITKQEQKARNQNKIGLPPNKRYRLMPLARHDDLNDAHIKDKNCNIKRAS

SEQ ID NO: 135959 - protein, 154 aa, Triticum aestivum
  unsure (1)..(154): unsure at all Xaa locations
  Clone ID: PAT_TA_30377.pep
PSRRPQPPSSFSRPDSSPSHEELSRRRVVVGFVVYTTGSEPGGRLDDAPSPSTSTATATPSPDSPPSAPTRPPRAALPLRXSPTMLTTPLSCQNNQTLEPRSQTPSSTTTTTTREVPTTTCSPLTTTSSNLGGSQAGGLRLFQFVSQFVLAFLR

SEQ ID NO: 135960 - protein, 81 aa, Triticum aestivum
  Clone ID: PAT_TA_30378.pep
SSINCPIVICSPTICYFSREKPLVKPMAPRSLSHIFAFAIYFFLAFIFRSIKPKIQKYIAVFYFYLFIWRSIYQSITIFSR

SEQ ID NO: 135961 - protein, 165 aa, Triticum aestivum
  Clone ID: PAT_TA_30379.pep
APSRPRPLLAVGAPIGSHRARPRRCPPSPRPLLPPRPRPRVEDRLNVEIDAAPPRRPSPPSATVAVVFHGSGTALQLLSRRRATLCPATMEPRSQTPLSMTTTTTREVPTTTCSPLTATRSSLGGSQVGGLRLFRSVSLFVLAFLRQTCLTYVCTQILLLPLTCL

SEQ ID NO: 135962 - protein, 172 aa, Triticum aestivum
  Clone ID: PAT_TA_30380.pep
NKSYKHHITSQGPRRLEYKSSIIDKSAEATISEYRHKLNKFALRRLAQTGIQIERDAGLLPGILLTTPGRRQRASRSSRHLRCSRSRRRGWRLAPGLQHLLLRGSCWIRVVKEEIPPHRRVEATRIPARPIVNLMLYFCCRSLPLPASKRGVPRPLPPPRRTSSSRPRGGKA

SEQ ID NO: 135963 - protein, 114 aa, Triticum aestivum
  Clone ID: PAT_TA_30381.pep
QVTIRWLAQTGIQIERGASLLPGILLTTPGRRQPARSSRHLRCSRGRRRRWRLAPGLQHLVAASKKKRGKGEQSNREYSSKVLASNDLHYICMGICEKRQCRWIELQNARIRGG

SEQ ID NO: 135964 - protein, 80 aa, Triticum aestivum
  Clone ID: PAT_TA_30382.pep
NGMRSCLMACLLKMLSDMLQNPQPLSQFQTCPKPKVKLSLTDLIHPAPPSSLDIAIARNPNQFSLTDRDLGLTEMGLQTL

SEQ ID NO: 135965 - protein, 58 aa, Triticum aestivum
  Clone ID: PAT_TA_30383.pep
IKRAPTSSQSGSPYVHAMGITNFNTSIPQIHDYSTSMTLISPSSYLKTIIKHQIDPSV

SEQ ID NO: 135966 - protein, 186 aa, Triticum aestivum
  unsure (1)..(186): unsure at all Xaa locations
  Clone ID: PAT_TA_30384.pep
XXEGFXRVIXPRXPSXLXEPWXXWTXXGLYGPPXLIXRSTGVNWTHLNCLPNHVSPIMXYLXNXSFPHTMXMLFVLCLRTLIEISKILQFNFFSLFVFILCYPVITLSVLLCLSSFHHDDHACILLCLLLSTYYYASISSLRNFLTCKFLSEEFIKIAYSPPSSRYNALSLGGNQILFLFLVFVPV

SEQ ID NO: 135967 - protein, 135 aa, Triticum aestivum
  Clone ID: PAT_TA_30385.pep
PRPKPNSTAPRPLICVPPPVLWSPRATSSPTLASLPAGHHPPGSSSSVRHAEGAAAPSTAAEDPLLICLHVRPLFHLISFAPPRLQNSRCKLLVCGGGKSRFYAGSVTGTEDSPPKLLNGTICNVIINIGCIRLS

SEQ ID NO: 135968 - protein, 138 aa, Triticum aestivum
  Clone ID: PAT_TA_30386.pep
LPAVPAFSRRTTADYLVYWSHLLELKLSASTTTMSSSSSSPTAALLLIPLSPNLPRATRASSSSPPALPMTTRLTLLLPSSTTELTTPPSCQEQPDYETDAAAVQFDYGVDDPSFLPKQPVVEAQETDATVDEDSYYH

SEQ ID NO: 135969 - protein, 60 aa, Triticum aestivum
  Clone ID: PAT_TA_30387.pep
YRSNINGSTGGANIDMKEGNIRFQFPLKKGTEHFPRKKFKLPYESIMCATYEFSAKDGTR

SEQ ID NO: 135970 - protein, 150 aa, Triticum aestivum
  Clone ID: PAT_TA_30388.pep
ALSQAFPSLVLSHSRTPPVTAVVVDLTATVAPTPKLGGPADLPSCASSSSPTSSSPEPPHRPDRHHLLPRSSPLFFVDPSPLQLLRHQRAFVCLCDYETDVAAGAPIDYAVDDDPSLPEQPDDGAQEPDDATDDYYYPEDAYYYMKTADD

SEQ ID NO: 135971 - protein, 163 aa, Triticum aestivum
  Clone ID: PAT_TA_30389.pep
AHSLWTLSLPRRSLPHASECCHGGASAKLAATSHPGPREGVRELLSACHRSSSPSPIIVSPPRICFLGASSTSRACRREPLCRSPGASCHSQCLLLHGDRRRPGVVRRLPGRRPCLFDRCCFCAGLLKANLSNSCLYSDIAASADPCVFELMYSSPRGPWLVI

SEQ ID NO: 135972 - protein, 66 aa, Triticum aestivum
  Clone ID: PAT_TA_30390.pep
FCIDSFCCRLIETFYRTSYFGRSFRVPEVYVSYRFLQTVLFLTYSVFSVLFAYFDASMASIKWYEP

SEQ ID NO: 135973 - protein, 172 aa, Triticum aestivum
  unsure (1)..(172): unsure at all Xaa locations
  Clone ID: PAT_TA_30391.pep
MQSYDEKLNLEVSIPRKLNDEWEPTIKIRIKDHECFALCDLGASVSTIPKTLCDILGFHDFDDCSLNLHLADXSTIKKPIGRINDVLIVANRNLVPVDFIVLDIDCNPSCPIILDRPFHRTIGAIIDMEEGNIRFQFPLKKGMEHFPRKKIKLPYESIMKATYGLRTKDGNT

SEQ ID NO: 135974 - protein, 275 aa, Triticum aestivum
  Clone ID: PAT_TA_30392.pep
MSTDVVADVPAPEVAAAADPVVETTAEPAAGDANAAKETKAKAAKAKKPSAPRKPRAAPAHPTYAEMVSEAITALKERTGSSPYAIAKFVEDKHKAHLPANFRKILSVQLKKLVASGKLTKVKASYKLSAAAAKPKPAAKKKPAAKKKAPAKKTATKTKAKAPAKKSAAKPKAKAPAKTKAAAKPKAAAKPKAKAPAKTKAAAKPKAAAKPKGPPAKAAKTSAKDAPGKNAGAAAPKKPAARKPPTKRSTPVKKAAPAKKAAPAKKAPAAKKAKK

SEQ ID NO: 135975 - protein, 146 aa, Triticum aestivum
  Clone ID: PAT_TA_30393.pep
LDTQELAEATKFEYRHKLNQDALRRLAQTSMIEEARPPTWDLRTTPGRRRSPRSSIRRRWHLAPGIHHLVAQTRRRGVVDVVDLNGISSGLGVMLLQVCTSGLGEGSRSPDLASAAGEAEEEGGLGAASRGGIGEEVEDGEALGGE

SEQ ID NO: 135976 - protein, 43 aa, Triticum aestivum
  Clone ID: PAT_TA_30394.pep
GGQSNNTSCFKFVTQHLSYVHATGLANFSTSISQFHTNQLARL

SEQ ID NO: 135977 - protein, 70 aa, Triticum aestivum
  Clone ID: PAT_TA_30395.pep
NCAPTSSQSSSLYVHATGITTLNTGIFIITSTSMTLISPSPYLKTIIKYKTSHSIQHTHKNFFINLECLT

SEQ ID NO: 135978 - protein, 76 aa, Triticum aestivum
  Clone ID: PAT_TA_30396.pep
VCELFMTNVESMDYTHSHPSIIASLFGTVHCPFSPRELVQTSLVHLNPVIRYALSHISLLISSSKQPPYLPIMAFP

SEQ ID NO: 135979 - protein, 69 aa, Triticum aestivum
  Clone ID: PAT_TA_30397.pep
VSSSNCQKVKVQLRVILLQRDTAIRIDKLPCRGAPHFPTRSIPFGRTHLPRSCPALGDQHVAALPRHNR

SEQ ID NO: 135980 - protein, 145 aa, Triticum aestivum
  Clone ID: PAT_TA_30398.pep
DENELQTTNGNVLPGTVVDTVVVDGSHDDFFLCSHDGLHGTSRPTHYYMLKNGHAFKPVDLQKLVYSMCFMFARCTKPVSLTAPIKYADTAAYRGRDYYDSRMVSQQFQVQEPGPSSSASVPAGAPLFRDMPEVHADLKDSMFFI

SEQ ID NO: 135981 - protein, 188 aa, Triticum aestivum
  unsure (1)..(188): unsure at all Xaa locations
  Clone ID: PAT_TA_30399.pep
VPLLPRSPRAATHSRTRRAAPSPVRLLPPAPSPASDDQRRPSWPPSSLFPELRPSSPSSARSIHGRPDLLPQRRRPPSPRRVGNHAPTSPEHLAASTTTPPSSPSSPCRPRPPXPERPPRTSTPPCSPTPTSRPTPPATQYDYGVDDPSFLPEQSDAGAQDPYATVDDDSYYTGGAYYYVQPAGDDQE

SEQ ID NO: 135982 - protein, 159 aa, Triticum aestivum
  Clone ID: PAT_TA_30400.pep
DKDAAPLRRLGPLPHLPPRSPLRPPLSLSPDPFLPCAHPTRPLLPPRRDHGRRPPRAKRRHPGASSASPASTTASSASWEALLPRILVVFHLRHRRRHRLIVSVASVVPFVRACASRPRRARPRLPWDDGVQEPDATFDDCYYHEGAYYLMKTTTTRSS

SEQ ID NO: 135983 - protein, 122 aa, Triticum aestivum
  Clone ID: PAT_TA_30401.pep
LMDIAAIIKKTKLHRLLLLVQLIPMDITLPRHKGYTPGTDRSDLQPTAAQDTVKKLLTDNTEQRIRLLNTTARASRSVMRGSTSWPSWPRASWPARPSSPESNPNSPSPVTTMVGPYPTIES

SEQ ID NO: 135984 - protein, 131 aa, Triticum aestivum
  Clone ID: PAT_TA_30402.pep
RPPASYHHAKKSRSSTIAVSFTLSEGFELGGPVRSPSPSSSPTAVASRRRARRIWTSPGSLTAPTSFVTLEPWSHTPPSTTTPTTLEVPTTTCSPLATTRSSLGGSQAGGMCLFLSISQFVLAFLRQTCLT

SEQ ID NO: 135985 - protein, 48 aa, Triticum aestivum
  Clone ID: PAT_TA_30403.pep
AVAGCAAAEASPPPTIPTAGQALRRWQPHTTAEPVNPRSPLRAGFHCR

SEQ ID NO: 135986 - protein, 158 aa, Triticum aestivum
  Clone ID: PAT_TA_30404.pep
THAVSSLLTSPSASMAASSTCTRATGPPSSTPTGPGGPPWTSSSPAPSRPSRRARGTAIALFCTASAAVDPRRTPPLRRHPVLPESSVSIAMLESRSQTPPSTTTPTTLEVPTTTCCPLMTTRSSLGGSQEGGLRLFRSVPQFVLAFLRQTCLTYVCT

SEQ ID NO: 135987 - protein, 69 aa, Triticum aestivum
  Clone ID: PAT_TA_30405.pep
DARFPSVALHSCPSAVLYYRAVITWAVITGIYLYTIYMTHVMTKVGSARRSTRKWIFVAERQGRLRPPT

SEQ ID NO: 135988 - protein, 128 aa, Triticum aestivum
  unsure (1)..(128): unsure at all Xaa locations
  Clone ID: PAT_TA_30406.pep
EAPFARHRRRLPRVHRRPSPDAAPPDHPRPPRARPPPQHPXLPATPSSTTVLTAPPCQSNQMLEPRSQTPPSTMTPTTPEVPTITWRPLTTTRSSLGGSQAGGMPLFRSVSQFVLAFLRQTCLTYVCT

SEQ ID NO: 135989 - protein, 180 aa, Triticum aestivum
  Clone ID: PAT_TA_30407.pep
FFLSEHRLKLDKFALRRLAQKQHRSKRQGLLPGSLLTTPGHRRPPRSSKHRRWHLAPGLRHLVALARRGCRRRSRSHGQHRSRGYGEVVDELEGVGDARGRPKASGSTRWTTATVVGEEGRWRWLQLLRLDLALADSAEADGDAPRLPPEHRGGYRPRARRRHDDCGRVTEEGRERARRM

SEQ ID NO: 135990 - protein, 124 aa, Triticum aestivum
  Clone ID: PAT_TA_30408.pep
LMFSPWIIRTITLPPLLASLVLRNFHRYHKPTIYLPQNSHHTYLLRHFHIHSEIYCHANFHRSVCYDMLHHCHIAMDDHVVDIIFVAKPPFIIFSYMSLLIHCISRYTAGGIHIKSYFVLSIEL

SEQ ID NO: 135991 - protein, 158 aa, Triticum aestivum
  Clone ID: PAT_TA_30409.pep
RHEAPLSLALPHLDRGGVRPRRRRPGNPIAHAVAVLGSSSPAPPTLTASPERRPRHPPRPPLPNPYGHYTETDAAAGAPTDYAIDDPSYLPEQSDAGVQELEIPRMILRGVRLRGVVRRSQAGGLAFSIVATFVLAFLRQTCLTYVCTKILLLPPTRL

SEQ ID NO: 135992 - protein, 84 aa, Triticum aestivum
  Clone ID: PAT_TA_30410.pep
VLLTNVESMDYTHPFTPPLLLASLVSCNFRRYHTPTIYLPQNSHHTYLLWHFHIHSEIYCHATFHRSIYYDTFHHCHIALCMIM

SEQ ID NO: 135993 - protein, 174 aa, Triticum aestivum
  Clone ID: PAT_TA_30411.pep
HASAPSLAPLSSFLFAPERCPPWPSSSSPPLSSPCGEAMLGRSFAFQYVFLEEQIEQGSPKLTDRADPLLCCRRRSSTIPAPSAAPNLPTSHRALLHDGAQEPDASVDDDYYYYSGGAYYYMQHADNERSSLGGSQAGGLRLFRSVSQFVLAFFRQTCLTYVCTQILLLPLTRL

SEQ ID NO: 135994 - protein, 95 aa, Triticum aestivum
  Clone ID: PAT_TA_30412.pep
GRQTINKIVLQLHHKAVHHLCMLRESQTSTQAFFKFIITPTSIALILSPPYLKTIIKHQTYLTIQCTQKKVSHILNTKYIIFKQITMLLNTLKII

SEQ ID NO: 135995 - protein, 91 aa, Triticum aestivum
  unsure (1)..(91): unsure at all Xaa locations
  Clone ID: PAT_TA_30413.pep
SAPEPPPWTPPLRPGTSALPRRSATSGPPRTTPSSPPPXPSMPEPRSQTPPPTTTPTTLEVPTTTCRPLMTTRSSLGGSQVGGLRLFRSVS

SEQ ID NO: 135996 - protein, 145 aa, Triticum aestivum
  Clone ID: PAT_TA_30414.pep
ALSPSRRPCVAVVASSSSPRSPTAPRCTTTCRSSVMFVYVIYGHPFKLGTSTSPGSTASSPRPSVPLRRISALSAAPGNQRASVSSLDYETDVAAASIDYGVGDPSFLREQPDVGAQEPDATATDDPYYTEGAYYYVQAADDDQE

SEQ ID NO: 135997 - protein, 127 aa, Triticum aestivum
  Clone ID: PAT_TA_30415.pep
IRVSYDTPTIPNEKNFAYVESSKFSMLVDHEKNALCDGYIVEFIHDATENYYEGGIYACRSCNNIKFPLYVLKILKLCLFCLPMLVDYCSHKLFAHKIPMHRKWVRLKCASHILHDALFMFQFLSFM

SEQ ID NO: 135998 - protein, 135 aa, Triticum aestivum
  Clone ID: PAT_TA_30416.pep
LRRHGRRQPRAHRHPRHLGLHQGLRRPRPSQLQAPVRDHRPSVDWIDLVFFHGLRRRSSTVPSALLLLSHRRTPVCLPDPEANVDAAVIDYVDDDPSSLSAELPDDGSQEPDVTPADNYYPEGAYYYVEAADDQE

SEQ ID NO: 135999 - protein, 129 aa, Triticum aestivum
  Clone ID: PAT_TA_30417.pep
RSSRDFYRVLCCGVFKFWVNSFDGLWNKEWKEPKLGDAHVTHKIIQGHQKFKAWGCPGRHPLFRLLPSVIYLELYFYSPHDMCFAWSVLYYLCLCLLVYHNHPCCTQLFERAIHDLKFDRILYVLPYIF

SEQ ID NO: 136000 - protein, 163 aa, Triticum aestivum
  unsure (1)..(163): unsure at all Xaa locations
  Clone ID: PAT_TA_30418.pep
PRAAAHVVDLVLRSRPAPRPRASPSTSPSPGYSESSRDAXASSPCSPSSLPQSPXASASIRPTTTSPGFPKTASTTTTPWRLPMPLXATTSPTTPPSCLSNQMLEPRSQTPSSTTTPTTPEVPTTTWRPPPTTRSSLGRSQAGGLCLFRSVSQFVLAILWQLV

SEQ ID NO: 136001 - protein, 98 aa, Triticum aestivum
  unsure (1)..(98): unsure at all Xaa locations
  Clone ID: PAT_TA_30419.pep
LMLSPWIIRALTLLPLLASLVSRNFRRYHTPTMYLPQNSXHTYPLRQFHSQFRDIWXSNFPRFRSYDMHYFVNIAPSXXMXLTXXLXQXNLKILXKSX

SEQ ID NO: 136002 - protein, 104 aa, Triticum aestivum
  Clone ID: PAT_TA_30420.pep
GRPDFDEYNMHVLAAPTCNYYERGTTSPPLYVSNTIKLKETIYTMHWPLLCEHELFFHDMPMHRKRVRLRYCLIYVTLCSLLNYKSLFIKIGFDIPWDPGGSIT

SEQ ID NO: 136003 - protein, 139 aa, Triticum aestivum
  Clone ID: PAT_TA_30421.pep
PRAQCQFLFFPCFRVSQKRKIKWSLVDLKLHGTYFWTRRSPRSIGDGPEESQAAHDGGGVLTPPARAPCLVDSPEIHRRTSSSYIYPYTLKTSRSTTKNYFHRHNLLYPRDPILEPSPALHRRGNRSRRASTSFLRPFR

SEQ ID NO: 136004 - protein, 154 aa, Triticum aestivum
  Clone ID: PAT_TA_30422.pep
VAAMAIVVVAAIGLPSPESMPWSFSASDSTDYVHRFELGRPAASPSRRLLRHRRRISSSSSSRPGHPRAPRPRHRTCTLEPRSQTPPLTTTTTTREVPTTTCSPLATTRSSLGGSQAGGLRLFRSVSQFVLAFLRQTCLTYVCTQILLLPLTRL

SEQ ID NO: 136005 - protein, 65 aa, Triticum aestivum
  Clone ID: PAT_TA_30423.pep
IDISEAREFNSFYKRYAHALINISEAKEHSTNGGFLCEEKQAIQTSNDISEAHEAFYKAILKRYK

SEQ ID NO: 136006 - protein, 124 aa, Triticum aestivum
  Clone ID: PAT_TA_30424.pep
PTPALAIVILLAPEYVVAMAELNRNGYRAPRRVIHCQEASSSSSPSSSLLDRGQHAASPSLRRSSSTSVPRRPPPSICVTSSIPASQSTPPTSTTPRPLLVPLIDYVVDDPFLPEQPGARGSRG

SEQ ID NO: 136007 - protein, 65 aa, Triticum aestivum
  Clone ID: PAT_TA_30425.pep
FFFEIIQVLYYKPGASRARIHSSIHKRSTEATISEYRHKLNKVFLKKASTKATRLKRQGLLPGTS

SEQ ID NO: 136008 - protein, 145 aa, Triticum aestivum
  Clone ID: PAT_TA_30426.pep
LLLPHTPDPAPPHTSSISCSGAVPRRVQEPHRRRLLRLGTPNRAGTHRIIALFAVFSATVATASASIRPTTTSPGFPKTASTTTMLEPRSQTPSSTTTPTTPEVPTTTWRPPPTTRSSLGRSQAGGLCLFRSVSQFVLAILWQLV

SEQ ID NO: 136009 - protein, 105 aa, Triticum aestivum
  Clone ID: PAT_TA_30427.pep
PTHDSPIIFLNSPDYTISEKFALSKDYIDGLPFTIAHDDECNMHVLATPTFNYYERGTISPPLYVSNTIELQETVILCIGLYLVCMNCSFMTCQCIGRELNFVVA

SEQ ID NO: 136010 - protein, 85 aa, Triticum aestivum
  Clone ID: PAT_TA_30428.pep
VKHESLILSTKDHALTNISEAKEHSTNISFLCEEKQEIQTSNDISEAHEAFYNTSRKGANGPGRSSPLVPVQSRTGTNGGIGPGS

SEQ ID NO: 136011 - protein, 136 aa, Triticum aestivum
  Clone ID: PAT_TA_30429.pep
EDAALEARAERSTRVHWFGCGVRLPSPQGLASGGNSRGGEASAAAQPAMGGRSMRHDRRCFGWLEQEDQRLKKHYGRWMDIVRSLELESFILTKLIKPFIPINLVGPLVSLPPRWVPASRGSIHFFVRNKEALPMG

SEQ ID NO: 136012 - protein, 80 aa, Triticum aestivum
  Clone ID: PAT_TA_30430.pep
GRQSKNTSGFKFVTQWLPYVHAMGLANFSTSTQIHNYSTSTNLISPSSYLKKIIKHPTSHSIQRTFYDSSYYTHLGCLSY

SEQ ID NO: 136013 - protein, 94 aa, Triticum aestivum
  Clone ID: PAT_TA_30431.pep
SSKGLAIPLLFRHSAVQSTYDSFIPVDTNACICSVAPCLRVLWMSTHGCFLPLFPLSLLPGCRNQMLEPRSQTPPSTMTSTTPEVPSTTCWPST

SEQ ID NO: 136014 - protein, 204 aa, Triticum aestivum
  unsure (1)..(204): unsure at all Xaa locations
  Clone ID: PAT_TA_30432.pep
GSTGLYMMQPEGFVDPKNADKVCKLQRSIYGLVQASRSWNIRFDEMIKAFGFMQTYGEARVYKKVSGSSVAFLIFYVDDILLMGNDIELLDNIKAYLNKCFSMKDLGEAAYILGIKIYRDRSRRLIGLSQSTYLDKVLKKFKMDQAKKGFLPVLQGVKLSKTQCPTTAEDRENIXKMFPMLQAIGSIMYAMLCTXPDVCLAIKS

SEQ ID NO: 136015 - protein, 76 aa, Triticum aestivum
  Clone ID: PAT_TA_30433.pep
QRSKRQGLLPGSLLTTPGRRRSPRSSRHPRGSSNHQWCRLAPGICHLVATIGYGGKRGSKATVSTHPKYSQDLHQI

SEQ ID NO: 136016 - protein, 89 aa, Triticum aestivum
  Clone ID: PAT_TA_30434.pep
LLKCTPCITDCVMAELEKLGQKYRVALRIAKDPRFQRLACTHKGTYADDCIVERITQHKCYIVATCDRDLKRRIRKVPGVPIMYLGRDH

SEQ ID NO: 136017 - protein, 149 aa, Triticum aestivum
  unsure (1)..(149): unsure at all Xaa locations
  Clone ID: PAT_TA_30435.pep
ASCLXLXTTPXPGRSPRSSMHRRWHLAPGLRHLVALARRVVVDVADHNGSINLGVPGRPWTSLARPGGAGGGDRRRWWGRPTGEDRAMARQQAVRAPTDSRWRRRRRWRSSWTSWRDEGRPVATGSTTMTTTARSASSRSSNTYEGEGY

SEQ ID NO: 136018 - protein, 80 aa, Triticum aestivum
  Clone ID: PAT_TA_30436.pep
INHAPTSSHNSSPYVHATGITNFNTSISQIHNYSTSMTLISPSPYLKTIIKYQTSLSIQCTYMKVFIMPKSKFPCCSKGL

SEQ ID NO: 136019 - protein, 74 aa, Triticum aestivum
  Clone ID: PAT_TA_30437.pep
AWGALEASLLSPTFRYLTWIMFSFVTCMCFAWSINYFVSIFLLLFRIMFCIFYFNKSGIDSLYYAYFTSLHVAV

SEQ ID NO: 136020 - protein, 122 aa, Triticum aestivum
  Clone ID: PAT_TA_30438.pep
FEVSFPRSNGRAVLIVLYPQVSHAVYFDPSRDYEKKDYTHIMNILDDALQGFSFRGGHVQIKKQRNKKMGFAHKTNFSCIHVPKPSTKDGFYIVHLMIQFNTDHQKLRINSRNDDRNHKWLE

SEQ ID NO: 136021 - protein, 132 aa, Triticum aestivum
  Clone ID: PAT_TA_30439.pep
RSLPNTTAAMRRSIPRPPAPLRPRTLPGRRAGRRLFFLNHWLKPGRSTAKESGPSSSSAAASSPTNPGAVGPPRGRCPPLLNHNPEVVAEGPVIDYVDDDPSFPEQPDVGAQEPDATAMLTTTWRPPTTRSS

SEQ ID NO: 136022 - protein, 84 aa, Triticum aestivum
  Clone ID: PAT_TA_30440.pep
RLMHSINSFLQFYRIGNIERWRYSSSLIIIVSRSSKHMHIISIRIIMYNGKRKPINIILNKCKLLRYSVVGRIQKDNRTIMRGC

SEQ ID NO: 136023 - protein, 116 aa, Triticum aestivum
  Clone ID: PAT_TA_30441.pep
GDKLVGKDHRLSPTATHKEDNQSINHAPTSSHNGSPYVHATGITNFNTSISQIHNYSTSMTLILSPPYLKTIIMLQSFLSMQHTQKKVSQILNTKHIIIKQITMLLRDSQNNLSEA

SEQ ID NO: 136024 - protein, 91 aa, Triticum aestivum
  Clone ID: PAT_TA_30442.pep
CHGRHAGVVAAATVRFFAGGDVQQNHRRPLLHLHPRDRARSHRIDRTRSSSSSAPPLVIFDFDLIEASPSPLTFSTAAIHWSPGARRHRRR

SEQ ID NO: 136025 - protein, 91 aa, Triticum aestivum
  unsure (1)..(91): unsure at all Xaa locations
  Clone ID: PAT_TA_30443.pep
NASCASLISFEVWIACFSSHRKPFFIECSFASLIFIRAWSYVEIIKLSCFTYIYLESXQELXICMVSHKILHKTCGSLNMICLIPCNSFAI

SEQ ID NO: 136026 - protein, 96 aa, Triticum aestivum
  Clone ID: PAT_TA_30444.pep
LQVKLPMNEDERGDAIRGIPKLRLLVILGFYLGVPWASPSLGSCHSLFHNPSNLYPKLENFTTQNLTENLVSSVSERKQSTTLRYCNELIIYLYWC

SEQ ID NO: 136027 - protein, 192 aa, Triticum aestivum
  unsure (1)..(192): unsure at all Xaa locations
  Clone ID: PAT_TA_30445.pep
VFFXFFXTQLNYXSFILQAQGSKGSIQAHYTTVSGGNNILSTDIKLNKDALRRLAQKQHNRRGKASCLGPPKLLLGRRRAPRSRRHPLGSSSSLRGWHHLGTWDPPSGCSHKKEGRRRRSRSQGHQHRSRGGRCREGPGTARGARGGADRRRAPGASGGGRRCRRRRCGALRVSWFDGEGAEDEAELVVTSA

SEQ ID NO: 136028 - protein, 168 aa, Triticum aestivum
  Clone ID: PAT_TA_30446.pep
SPPSPTLLGWTGEALYARHSRRLRHVHRRSRRRFTPLRSTLGLLDHAPELATTRLTPLLVPRSTTLLTTLLSCQSNQAMESRSQTPPLMTTPTTLEVPTTTCRPPTTTKSSLGGSQARGMRLFQYVSLFVLAFLRKTCLIYVCTQILLLPLTRLLSSSCIRALEAPGL

SEQ ID NO: 136029 - protein, 90 aa, Triticum aestivum
  Clone ID: PAT_TA_30447.pep
YSYPQIESLNKQTYANNANITAICQNSIVCKECKIHHTSLTRKIIRKILCCRRFIRAQYEKDSTLYHSLTFLGNFCNNGKLSVFKQQHVY

SEQ ID NO: 136030 - protein, 130 aa, Triticum aestivum
  Clone ID: PAT_TA_30448.pep
PRRQPRPPSSPACRSTSGRFAAAGSVRSGDQLKPGRSMCSQSSPSPSRTSSTRRRSHCSGPLPDLLTSSTRTGTPRLPATPSSTTELVTPPCQSNQMLESRSQTPPSTMTPTTPDVPTTTCSPLTMTRSS

SEQ ID NO: 136031 - protein, 155 aa, Triticum aestivum
  Clone ID: PAT_TA_30449.pep
SYEEKLELEVSIPRKLYDELEPTIKIKIKDHECYALCDLGASVSTIPKTLCDMLGFREFDDCSLNLHLADSIIKKPMGRINDVLIFANMNYVPVNFNVLDIDCNPSCPIILSRPFLRTIGAIIDMKEGNIRFQFPLRTDMENFPRKKLNYLINLL

SEQ ID NO: 136032 - protein, 69 aa, Triticum aestivum
  Clone ID: PAT_TA_30450.pep
GRQSINTSCSNIITERFTIRACYGNHKLQHKYFYNAQLTSSTTLISPSLYRKTVAGNQTYHIQRFTSFM

SEQ ID NO: 136033 - protein, 155 aa, Triticum aestivum
  Clone ID: PAT_TA_30451.pep
EFGRGNPPPPLSTRLHRCPRPKPNSTAPPPLICVPPPVLWSPRATSSPTLASLPAGHHPPGSSSSVRPRRGAAAPSTAAEDPLLICLHVRPLFHLISFAPPRLQNSRCGGGKSRFYAGSVTGTEDSPPKLLNGRVGIPLVQLQAGGRMELDQYRD

SEQ ID NO: 136034 - protein, 127 aa, Triticum aestivum
  Clone ID: PAT_TA_30452.pep
RPSPTPTCSPLPLASPSSRSPPPERGRRRSPRSTAAINAPASICQVRKLRSPSPPTPTTRGGRERPERPHRRLLPPLSRRTSLTTPTPAGLPEPAALHDRLLVDATRWWIPGARCHCRWMLLREDRR

SEQ ID NO: 136035 - protein, 192 aa, Triticum aestivum
  Clone ID: PAT_TA_30453.pep
GPRGLEYISSNIQESAEAIISEYRHKLNKFALRRPTQKHLRSKRQGLLPGSLLTTPGCQRPPRSSRHRRWHLAPGLRHLVALARRGRRRRSRSQGQHRSRCGEPVGVHSVLGEGAEAMNSGNGVGGAEKGNDSIRSKQRHSARVLQRRGSSGGGRISWRNPRWWGGQWPRDRRGPWRRRSWAHPEREEGVRS

SEQ ID NO: 136036 - protein, 127 aa, Triticum aestivum
  Clone ID: PAT_TA_30454.pep
LYMNASGGAPGWCNESRVTCMKNNAWWLCHKYDVNYMIMQWQYDKSKVCHDDDEWNGGKLHGNISRNGYGNAIIGRYGGCFEEDIRRFMCDRAYCITGFGCTGEVCTNSQGEKGQCTVPKRLAMMGR

SEQ ID NO: 136037 - protein, 163 aa, Triticum aestivum
  Clone ID: PAT_TA_30455.pep
AGTFPEAPSLSAASTTPPDRGREATSSTGSTHLLPRSSPLPFIDPSPLQLLSHQRASVCLRDYETDTAAAQFDYGADDLSLLPEQPDAGVQEPDATVNDDPYYTGGAPTTCSLLTTTRSSLGGSQAGGLRLFRSVSQFVLAFLRQTCLTYVCTQILLLPLTRL

SEQ ID NO: 136038 - protein, 177 aa, Triticum aestivum
  Clone ID: PAT_TA_30456.pep
PRTPPPLPRPSSSRRPAVVSRKSAVVRFFTFVNWIQPDSTVPSGSSFFFNFGRRHPPRRSARHRLSPASSSPPRAALPRDRCRYPRSTTVLTTPTCQSNQMLEPRSQTPPSTTTPTTPEVPTTMCCPLTTTRSSLGGSQEGGLHLFRSVFQFVLAFLRQTCLTYICTQILLLPLTRL

SEQ ID NO: 136039 - protein, 337 aa, Triticum aestivum
  unsure (1)..(337): unsure at all Xaa locations
  Clone ID: PAT_TA_30457.pep
VHGNVTIYKARLVAKGFRQVQGVDYDETFSPVAMLKSVRIMLAIAAFYDYEIWPMDVKTAFLNGFLEEELCMMQPEGFIDPKNANQVCKLQRSIYGLVQASQSWNIRFNEXLTGXGFMQTYGEACIYKKVSGSSVAFLILYVDDILLMGNDIELLDSIKAYLNKCFSMKDLGEAAYILGIKIYRYRSRRLIGLSQSTYLDKILKKFNMDQSKKGFLPVLQDVRLSSAQCPTTAGDKEEMSVIPYASAIGSIMYAMLCTRPDVNLAVSLVGRYQSNPGKEHWTTVKNILKHLKRTKDMFLIYGGDKELIVKGYVDASFDTDLDDSKSQTGYVYILNGG

SEQ ID NO: 136040 - protein, 72 aa, Triticum aestivum
  Clone ID: PAT_TA_30458.pep
GRQSKKHPMLQICHTMVTIRACYGTCKPQRKCLYNPQPPTSMTLISPSLYRKTIARNQTYHIQRSTSLCRIL

SEQ ID NO: 136041 - protein, 130 aa, Triticum aestivum
  Clone ID: PAT_TA_30459.pep
ASQMKHASRRPASPPMIHLYLTHIMAPPWLVCVSSSLGMPRSKKTADKNREWPPGRQRRLHEDQPAASPVPASSIFPLPLSLLSPPLPSWSLTRDGPTTACHVRLPPVPLRPTTRPYLRQIWIQAPPMTG

SEQ ID NO: 136042 - protein, 119 aa, Triticum aestivum
  unsure (1)..(119): unsure at all Xaa locations
  Clone ID: PAT_TA_30460.pep
SYNNLSGPIPSGQQXQALDNQMYIYIGNPGLCGDPVGRNCSTHDAEQIGLEDIDHMPSVYLAMSIGFVVGLWTVFCTMLMKRTWRAAFFQFVDMMYDMVYVQVAVRWAHMLEKNQDGAP

SEQ ID NO: 136043 - protein, 168 aa, Triticum aestivum
  unsure (1)..(168): unsure at all Xaa locations
  Clone ID: PAT_TA_30461.pep
GGRKTPLPHNPRERGAAKFLTGLPSRGNFSSSSISSNLGGLXVYVCEXXTNPPXGQXXXXDTTNILIRHLQLKKKDSEAXTQGSRTPGESGKGKRCAARSLGVQKSSKKPNLGSSSGLPSSDEAISGFSQHTLQSFTVERLRALLRQRGLTTKGKKDELITRLREAQS

SEQ ID NO: 136044 - protein, 128 aa, Triticum aestivum
  Clone ID: PAT_TA_30462.pep
NKSYKHYITSQGSRGLEYKSSIIDESVEATISEYRHKLNKFALKRLAQIGIQIEKRRMPPAWDPPKLLLGRQRATHSSRHLQCSRSRRRRWRLAPGIHRREEVGGELVLGRGGRGDADQRRGRGEDKQ

SEQ ID NO: 136045 - protein, 176 aa, Triticum aestivum
  Clone ID: PAT_TA_30463.pep
IRHQAPLIDFGGKIVGMVNGNTSGSFIPSSILVKCLHLWRKFQRIPRPQLGMKFWSIKFVDIALAENILCKCNIDDGLIVKRVSYGSPAEKLGILVGDVISCFNGEHISTTVELENMMLSKCEDENNSLNSELNVKLDVFHIRKSRWSDRTLTVKVSDDSEVVATGVTYPFVEGTP

SEQ ID NO: 136046 - protein, 122 aa, Triticum aestivum
  Clone ID: PAT_TA_30464.pep
ARNTMDAPPSLTRPPPPPRCTTMSRGTNVISYAVYNTNSTPGSLTTMGSRSSSTSVPPPSVVRSATDDASPASTRPPRAPQPETAVEPLIDYFTFEGPFLSTEQPGARGSRGCFYVEFGFEE

SEQ ID NO: 136047 - protein, 66 aa, Triticum aestivum
  Clone ID: PAT_TA_30465.pep
IPINVCLSQKVCTARMIVVKLKIKDSNHTRRSKKNTYHVVNKNIASSKVTDGRRRKRGCLPGHTQA

SEQ ID NO: 136048 - protein, 88 aa, Triticum aestivum
  Clone ID: PAT_TA_30466.pep
TKTKEGMPSRGIPKLRLFAILEYLGVPWASPSLGSFHSLFHSPSKLYPKYENFTAQNSTGNLISSVSERKQNHHIRYCNELILYLYLC

SEQ ID NO: 136049 - protein, 94 aa, Triticum aestivum
  Clone ID: PAT_TA_30467.pep
GRQSKNTSCFKFVTQRLPYVHATGHANLNTSISQIQNYSTSMTLISPSSYLKTIIKHQTSHSIQCTYMKVFIISLLDAYHIRTKFITKANYHAV

SEQ ID NO: 136050 - protein, 97 aa, Triticum aestivum
  Clone ID: PAT_TA_30468.pep
LLLVFGGLHVVVSVGGGIWLQGSTIWLLRREGGVVGDVVDHSGIDSRLGVGRLTEAGVRLVAAGVAGGEEGRRRVRGGRRRRRSRRLGGCSPARSSA

SEQ ID NO: 136051 - protein, 105 aa, Triticum aestivum
  Clone ID: PAT_TA_30469.pep
RRSGGCCSFVFFDHEHGFVWRCNTPTDRSSSSPSAAAQPRLDSSPPELPRPSRARQSPPDPETAVDVPVIDYVTDDPFFPFIGASRCRSPRARCHRQCLLLRGDR

SEQ ID NO: 136052 - protein, 130 aa, Triticum aestivum
  Clone ID: PAT_TA_30470.pep
VPGDWRWCPIHHEAAPILPAIHRSSPMTTLTCCTSSSPTSRSTAATQLQLLLLQPPAPTISATPSLLFIAAERERIDQRPGASGLLVLHARSSPACFCFYSSSPATSTASNRRSSRPIGSELLSSLVPVL

SEQ ID NO: 136053 - protein, 91 aa, Triticum aestivum
  Clone ID: PAT_TA_30471.pep
PQPPPSLNPSDASMSPTTSTWAGSSWASLHRADRRHPPPRAPPPSSSTSSSSYALTPPRACSCTTTGPMTDPRSQKTPLMTTSTRRMPTTT

SEQ ID NO: 136054 - protein, 155 aa, Triticum aestivum
  Clone ID: PAT_TA_30472.pep
MDAKKFLQMVEDKKKRLLEKKEAPLKWQQKLEAAIKATEEKEKKLKSKKHRRRSYSSSESDSESESDSDRKHRKRKDRRRHRKHGHSDSDGARRRKHRSKRRSSDSSDESDSDEYDSESEEERRRKKHSHRRKHRRHSSRSESDASDYSSDDDER

SEQ ID NO: 136055 - protein, 136 aa, Triticum aestivum
  Clone ID: PAT_TA_30473.pep
LASSGSWDPSSGCSGKEGGRSRRSRSQEQHRSRGQRWREAGGRRGSGSAGDGEAGTGQSDARVRRRRRTASSDGGTGCRRGRGECHRGGCRGGKVRGDVDHPDPVERGEGVEEGEASGEGGSFGRRRRPRVRPRVR

SEQ ID NO: 136056 - protein, 150 aa, Triticum aestivum
  Clone ID: PAT_TA_30474.pep
PLSPRSLRLPHLAECSQGLAAVGAAAIVLRTPRDPAQKTRRRTLLPLRPGTRAGEPSIAGSPSTSSPTPTNSVAPIRRPPALLSPSPATVCLTTSRLPATPSSTTELMTPPCQSNQMLESRSQTPPSTTTPTTLEVPTTTCSPLMTTMSS

SEQ ID NO: 136057 - protein, 82 aa, Triticum aestivum
  Clone ID: PAT_TA_30475.pep
YVFCLERLVLFVSLCFSKTQSSLLYTPFERAIHELKFDRILYVLHLYLLSYVVLLYVLHLYLLSYVFLLYVLHLYLLSYVIL

SEQ ID NO: 136058 - protein, 169 aa, Triticum aestivum
  unsure (1)..(169): unsure at all Xaa locations
  Clone ID: PAT_TA_30476.pep
MGKSKSKGAKFAAVKKIISKKTIKKYKEEVLDPRKKDTEKEKLGRNVPQVSSALFFSYNMALGPPYRVIVDTNFINFSIQNKLDLEKGMMDCLYAKCTPCITDCVMAELEKLGQKYRVAXLRIAKDPRFQRLACTHKGTYADDCIVERITQHKCYIVATCDRDLKRRIR

SEQ ID NO: 136059 - protein, 119 aa, Triticum aestivum
  Clone ID: PAT_TA_30477.pep
VELGSPTTSASSSSSSSARRRSPPTPAALLLLSFRQAPLCLLHVGAQDPDATVDDDSYCTGGAYYYVLPADDDQEYLGGSQAGGLRLFRSVSQFMLAFLRQTCLTYVCTQILLLPLTRL

SEQ ID NO: 136060 - protein, 107 aa, Triticum aestivum
  Clone ID: PAT_TA_30478.pep
ELVQTSLVHPNPVICYALSHINLLISSSKKPPYLPIYGISIAIPRYVAMQLSTVLFIMIMTYITFATLSLHGHVLDIVFVVKPPCIIFLNMSLLIQCAIPVRRRGHS

SEQ ID NO: 136061 - protein, 82 aa, Triticum aestivum
  Clone ID: PAT_TA_30479.pep
LYLELYFYSPHDMCFAWSVLYDLSLFFLVYHNHPCCTHILRETHDSEIIGILYVLHLYLLSYIVFALVLHLYLLEHGGGFVL

SEQ ID NO: 136062 - protein, 86 aa, Triticum aestivum
  Clone ID: PAT_TA_30480.pep
HFSDSFRVLGFSCTYNKGEPWRSGINSLLQKCRERLRTIDPKWSDPSPDPAQARATCTGAALYFVSSVSQCCSNCSILSLFSPRVS

SEQ ID NO: 136063 - protein, 254 aa, Triticum aestivum
  unsure (1)..(254): unsure at all Xaa locations
  Clone ID: PAT_TA_30481.pep
GNVNIYKARLVARGFRQVQGVDYDETFSPVVMLKSVXIMLAIAAFXDYKILQMDVKTAFLNXFLEEELYMMQPENFIDTKDANKVCKLQRSIYELVQASRSWNKRFDSVIKAYGFIQTFGEACIYKKVSGSSVAFLILYVDDILLIGNDIEFLDSIKGYLNKSFSMKDLGEADYILGIKIYRDRSRRLIGLSQSTYLDKVLKRFKMDHAKKGFLPVIQGVKFSRTKCPTTVEDREKMKEVPYASFIGSIMYTML

SEQ ID NO: 136064 - protein, 115 aa, Triticum aestivum
  Clone ID: PAT_TA_30482.pep
LLLVVGVRHVVVGTLGVVAIFKGVIWLGEPVGVHSMLGEGAEAMNSSNGVGGAEKGNDSIRSKQRHSARVLQRRGSSGGGRSSWRNPRWWGGQWPRDRRGPWRRRSWAHPEREEG

SEQ ID NO: 136065 - protein, 159 aa, Triticum aestivum
  Clone ID: PAT_TA_30483.pep
SLDSRRGCIMGSEQERRQRIHVWVSSMSRHPAADLHVQITKYITSFLVHIPLVLQDQQHGGVGCTHHHFMCAELPKPHPWSPLLPPIQLAAPCSVLTGTIRRPALVEAQPGCSISHGFPFPGLNPVQKLPQQHNRSIDWALSPCIPGATASTLVFAGVS

SEQ ID NO: 136066 - protein, 77 aa, Triticum aestivum
  Clone ID: PAT_TA_30484.pep
MDAKKFLQMVEDKKKRLLEKKEAPLKWQQKLEAAIKATEEKEKKLKSKKHRRRSYSSSESDSESESDSDRKHRKRKD

SEQ ID NO: 136067 - protein, 55 aa, Triticum aestivum
  Clone ID: PAT_TA_30485.pep
ERPPGQVQGEGDHNAKLGITILGEAVDVEDEVVVTNSIVLPNKTLNASVQDEIIL

SEQ ID NO: 136068 - protein, 88 aa, Triticum aestivum
  Clone ID: PAT_TA_30486.pep
GFGRHADMTETTLRSITNRVIWIPMLAPTCSSMISSNEPRCRGFNQPRIQFPLSIDTLLARDLIVGIPIVTAPDQPLFVFALASMQHV

SEQ ID NO: 136069 - protein, 128 aa, Triticum aestivum
  Clone ID: PAT_TA_30487.pep
RHEAPRSLRLPHLAECSQGLAAVGAAATVLRRPRDPAQKTRRRPLLPLRPGTRAGEPSVAGSLLTSSPTPTNSVAPIRRPPALLSPSPATVCLTMLEPWSQTPPSMMTPTTPEVPTTTCSPLTTTRSS

SEQ ID NO: 136070 - protein, 147 aa, Triticum aestivum
  Clone ID: PAT_TA_30488.pep
SFAPLPLRLVRPSTVVDALPSIPRPPATPTCATASRRPTVLVSFLYALRFVTRPPPRSPSRVFSATAVITSPLDPLVSDQPRSPRPRHRARDPETDAAPVIDYIADDTSSFSADLPDDRSQEPDDTTDDYYYPEGAYFYVMATDDLE

SEQ ID NO: 136071 - protein, 121 aa, Triticum aestivum
  Clone ID: PAT_TA_30489.pep
RSPSPVTEAARRHHRHHLVDPVATGLPSSRQGVQELLHRRLLRLRALNRAGTPVRSPSSSSPSRTSPMFVVVAAAPVHLRPPRPRHRACDPEIGADATEYDYVTVDPSFSAELPGARGSRG

SEQ ID NO: 136072 - protein, 157 aa, Triticum aestivum
  Clone ID: PAT_TA_30490.pep
ARGLVPNSARGFFTIVHERHWIVVCANLIHKQWNVFDSINAKGKASPLKKQANNLTPRPTPLLPSTTTVLTTPPSRLSFQMMEPRIQTPPSTTTPTTPEVPTTTCCPLTTTRSSLGGSQAGGLRLFRSVSQFVLAFLRQTCLTYVCTQILLLPLTRL

SEQ ID NO: 136073 - protein, 130 aa, Triticum aestivum
  Clone ID: PAT_TA_30491.pep
VASGRLLRRIFHNSRARAAARHGHRRSRGQHARCRLRRGAGGRTYSSTSSTPPDRRRRTPTPLPASSSSSDAVGPPRQIRRRLQLLTFHRPFLCPAMLEPRIQTPPSTTTPTTPEVPTTTCSPPTTTRSS

SEQ ID NO: 136074 - protein, 166 aa, Triticum aestivum
  Clone ID: PAT_TA_30492.pep
MSTEVAAADIPVPQVEVAADAAVDTPAAKPAKAAKVAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSRGQEGQEVEAA

SEQ ID NO: 136075 - protein, 149 aa, Triticum aestivum
  Clone ID: PAT_TA_30493.pep
EGLAQKQQRSKRQGLLPGSLLTTPSRQRSSRSSRHPRGNSSHQWCRLAPEIHHHERDGEAGEAGDGSEQWQTMADGDDVHGEDDVDGECTGRPGLCWSLDRRIRPRRTSWTCSRMPETTVMTSTIVARGSDLEFEQMRRGVMGDQGGNG

SEQ ID NO: 136076 - protein, 106 aa, Triticum aestivum
  Clone ID: PAT_TA_30494.pep
VFVGFNIVEGEPAPPARFILSSYIPNTHDTIRSITYKISLYLPKNSHHTYLLWPFHSHSEIYFHETFHRFFYYDTFHHCHIALHDHVVDIVFVAKPPCIIFHTCHS

SEQ ID NO: 136077 - protein, 196 aa, Triticum aestivum
  Clone ID: PAT_TA_30495.pep
SSPSLSLDKIARVAAMAIVVVAATGLPAAGARVQEDLRHRLLRHVHRFELGPLQASPSSSSLPWTSPSRRRFASPTPLQPPRALHRPPPNPETDAAPVIDYVDDDPSLPEQPDVGAQEPRCQRRCLLLRGDRRRPGVVRRLPGRRPCLFDHRCFCASLLKANLSNSCLYSDIVASADSCVFEPSRPLACNIKLVFF

SEQ ID NO: 136078 - protein, 118 aa, Triticum aestivum
  Clone ID: PAT_TA_30496.pep
PRPPSSPRPLSASFRSIVDHCLNHNHQMYQGAPTSTGSRSSSTSAPPLTVFDSASPEPPRARFAHLQDRYPKTAGDPQFDYCVDDPCLLPEQPDDGVQDPNATIDDDSYYAGGAYYYV

SEQ ID NO: 136079 - protein, 231 aa, Triticum aestivum
  unsure (1)..(231): unsure at all Xaa locations
  Clone ID: PAT_TA_30497.pep
QNLTAQQQHQLLQQQQWMRRNQMTGPRGALTMSDKAQALVNVKLENTMDSQIDSPYGSLTRQQQQMQQLRHHQLLQQQQQKQVQQQQLLQLQQQXKQQQQQQLQPQQQQXKQQSKPQQQQQXKQQQQQHHQQQQLLQQQHHQQQQQFQQQLGMSGNQSAQAQLAQQQQQQQQQLGMSGNQSAQAQLAQQFKQVPQSMNSYGMRVPPVKVEAFHELVSGDSSSDTSKLTSPK

SEQ ID NO: 136080 - protein, 117 aa, Triticum aestivum
  Clone ID: PAT_TA_30498.pep
SEHLSKSSNEEKHNESNYMNQAIISTSQLSTAEQFTEWNYPIIINVSELLPRASCPRLIPLPSSLEPPVPASSLWSLTRDGPTAACPWSPASTAPFAPPPGSPNLRQIWNQAPPTTG

SEQ ID NO: 136081 - protein, 202 aa, Triticum aestivum
  Clone ID: PAT_TA_30499.pep
PRPALLPPRLSPPRPDLDRGRARSRRRRPSPTPPLPPTTPPPGTTPPRSASARRRHDLAGLLLSVDLVPGILPAPPQLRRHPSSPSPTPSLPEHAAPSLLPATPRPTPLLPGSTTSVDDHSLLPRATKMLEPKSQTPTSTTTPTTPVVPTTSCCPLTTTRSSLGGSQAGGLRLFRSVSQFCASLLKANLFNLCLYLDIVCFH

SEQ ID NO: 136082 - protein, 129 aa, Triticum aestivum
  Clone ID: PAT_TA_30500.pep
LAPISLARSLFPFLHRPTTTIAMAAPLLWPLMLPAPPGDVQEVRHPPMPRLPHELKPGTPASTGSRPSSSSGTTASAVDPPPLLLLSHRRATLVLPDDGAQEPDATVDDDYYYSGGAYYCVQPADDDQE

SEQ ID NO: 136083 - protein, 146 aa, Triticum aestivum
  Clone ID: PAT_TA_30501.pep
PFPRSLSSPRVKPLLPSPWPRPPCSPRREKTPRRTATVHFVHPEDRIERGRPVHSPSPPSSSCTSPRPRRRSASPRPSRPRTSSPPTSSRPRDDADAPVIDYVTDDPSFSPEQPDDGVQEPDETFDYCYYTEGVYYHVTKTADDQE

SEQ ID NO: 136084 - protein, 226 aa, Triticum aestivum
  Clone ID: PAT_TA_30502.pep
PLPPDPPSLLVPHSSFLPSARDSPCRACPSPATSPGRAHQGPQRLRMCRAAASSSTTSATWTGSTPGAPASPPRLVFFFLGSDALRDGSGASEPSPSFLLHTYRLPTPRPTPLLPSTTTVLTTPLSCQSNQTLESRSQTPPLMMTPTTREVPTTTCSPLTTTRSSLGGPKQEDAPLSICIPVCATFLKANCLTYVCTQVLLLPADSSMILLYSDLPWLYDAWYDYF

SEQ ID NO: 136085 - protein, 131 aa, Triticum aestivum
  Clone ID: PAT_TA_30503.pep
FVFASIIASLWTTSLSPSLTLRLLFCRSHSASSWQLLLELNTCGTSTNISSDSRGSRKTAALASQRRILSLCSVENLSFIKLYTSKYILPLFLNIWHFLQSVELQKRLIFKNKVVYVNVVSSYELLTQRFM

SEQ ID NO: 136086 - protein, 66 aa, Triticum aestivum
  Clone ID: PAT_TA_30504.pep
VQITHGYLFFCLQAMCGRRCTHRKTIVLCINHVLRFTSVMHIYFSVLGLKSIHCNEFGCMGITYLT

SEQ ID NO: 136087 - protein, 82 aa, Triticum aestivum
  Clone ID: PAT_TA_30505.pep
TFIMQSIAFISSTSQDRINLIFSHTNKSYIFREQFLLLTPMTTYLKDLTQSIGRYGGLSWQKLGLRIFGSTSSISTWCKEFG

SEQ ID NO: 136088 - protein, 111 aa, Triticum aestivum
  Clone ID: PAT_TA_30506.pep
LSNRAATGLFVEADGSGERLDAEHLAPLLGAVREKPRVALPRHWESGGLILHFAGVACGEEKGGSHDHHEGGHDEAQGAPVLPRYRHGVQYRRRLATLTYVLQFLPSLCLI

SEQ ID NO: 136089 - protein, 217 aa, Triticum aestivum
  Clone ID: PAT_TA_30507.pep
AWSRPRYIFTSRTSAITTSLWIFTTRTSVFTHDLDREVRNAGSCCSDRACTVAACMFVLLISRFMLAHLSVYVICILSGYCDSYVSYGSPAEKLGILVGDVINCFNGERISTTVELENMLLSKCEDENNSLNSEVNVKVSFFYDFLYTYYSCYDFLYRPKVVGPFPGPCASGSYMHQLDVFHIRKSRWSDRTLTVKVSDDGEVVATGVTYPFGEGTP

SEQ ID NO: 136090 - protein, 91 aa, Triticum aestivum
  Clone ID: PAT_TA_30508.pep
VLCSRARGIYSQLIGPGSCHEPGLKGNLWSRFTPPTGTNGGGPGARRIGTGSSHQPEPKGPDEPGPMAHVARPAPGAHEPGPMPPLVPVLD

SEQ ID NO: 136091 - protein, 71 aa, Triticum aestivum
  Clone ID: PAT_TA_30509.pep
MCHDEWNDGKLHGNISWNGYGNSIIGRYGGCFEEDIRRFMCERAYHITGFGCTGKVCANSQCEKGLAMMER

SEQ ID NO: 136092 - protein, 233 aa, Triticum aestivum
  unsure (1)..(233): unsure at all Xaa locations
  Clone ID: PAT_TA_30510.pep
TIDNYHEQGNIIIPILLLPLGHISNSSSIAAPPPVSSSSIAAPPPAPAAPSSASSAPXSSVACAAQLHCSSVVGVERSIAAPSPAPRSSIAAPSSASSAPLXAPSPAPSSSIAAAPPAPSSSIAAPPSASSAPLQLRRLRRAAPPAVARVWRPSTRSCVAAPAFVDERRFLSPAAPPGSPAVVVVLTMTPFHGRCFAAMPHPAMQRKSSGCWCRHAASKLFHLPSCCGGARPD

SEQ ID NO: 136093 - protein, 135 aa, Triticum aestivum
  Clone ID: PAT_TA_30511.pep
GRVGGRVGSTLFLSVLSDGAPSAPLPWPPTLPRHADEPWRTAVVYLTLCATGLEPGVPISVTHIVFVSGRLRSAPPRASPASPSSLLHDYRPPWWIPRARCHRRWMLLHGGHRRPGVVRRSQAGGLASSIVLLLC

SEQ ID NO: 136094 - protein, 129 aa, Triticum aestivum
  Clone ID: PAT_TA_30512.pep
QAKTNIIHDAPSKTHIMWQIKILLQVKLPMNEDERGDAFRGIPNVRLLAILEYPGVPWASPSLGSCHSLFHRPSNLYPKLENFTTQNSTGNLISSVSARKKTHHIRYLMNSFFIYIGVKTTVFQLIYGL

SEQ ID NO: 136095 - protein, 64 aa, Triticum aestivum
  Clone ID: PAT_TA_30513.pep
TKSKDSNHTRRSKQNTYHVANKNIASSKVTNERRRKRGCLLGASPSLGFWLLLNILGCHGHPQA

SEQ ID NO: 136096 - protein, 71 aa, Triticum aestivum
  Clone ID: PAT_TA_30514.pep
INHAPTSSHNGSPYVHATGITNLRTSISQIHNYSTSMTLISPSSYLKTIIKYQTSHSIQHTHKRILLFLNT

SEQ ID NO: 136097 - protein, 135 aa, Triticum aestivum
  Clone ID: PAT_TA_30515.pep
PLRYRALHFLTPRRGANFAGASKPRDMIRSITHKPYYIFLKTATIPTYYGFSMAIPRYIAMQLPPLPFDDLSIHCHIALHHHIADIVVVAQPPFIIFHTCYARSLHILVHARGIHIESYFVIGIELYFLFLLSYK

SEQ ID NO: 136098 - protein, 95 aa, Triticum aestivum
  Clone ID: PAT_TA_30516.pep
NKSYKHHNTSQGPRGLEYKCSIIDESAEATISEYRHKLNKFALRRLAQTGIQIERGAGLLPGILLTTPGRCQRAARSSRHLQCSRSRPSTVASGS

SEQ ID NO: 136099 - protein, 92 aa, Triticum aestivum
  unsure (1)..(92): unsure at all Xaa locations
  Clone ID: PAT_TA_30517.pep
RXPMXYTHPQPSXNCXPLXNLHALXPPRGGPVPIXXKXVXLAXXXPXFKTPDXETWXYQLNACXNPLPNWVIQXAHDXLQHXNLMQWTXLRX

SEQ ID NO: 136100 - protein, 126 aa, Triticum aestivum
  unsure (1)..(126): unsure at all Xaa locations
  Clone ID: PAT_TA_30518.pep
YSYSSISIKKDVGYYLHREGPNLGKTLCPLPPITISLRRIDRGPPTPRSAGFDTDIGCFWRXLYVRPLRGPMVPSIRQTTTWSKVSLSPRYXFQCSGGSHYGQFXGHPGRFDXTPCQQXRXKXXNT

SEQ ID NO: 136101 - protein, 56 aa, Triticum aestivum
  Clone ID: PAT_TA_30519.pep
ERPSLVLDRPLIRMHKPGTLHVSNLLHNFNHTCMLRDLLTLTQAFFKFIITQLALL

SEQ ID NO: 136102 - protein, 91 aa, Triticum aestivum
  Clone ID: PAT_TA_30520.pep
LNITFQIKMTAVLVSAKVSVFYSKFNKTFPKSSQRFYLAQTLIKHKKTQPKQRLDNLFITKQEQKTRNKNKIGLPPNRRYRLTPLARHNKQ

SEQ ID NO: 136103 - protein, 66 aa, Triticum aestivum
  Clone ID: PAT_TA_30521.pep
PIIVEEERWDAYRGIPKLGCLRLIEILSWGALGIPKLELLCLLNSFYITASLHLKNFIHTKLNKNS

SEQ ID NO: 136104 - protein, 102 aa, Triticum aestivum
  Clone ID: PAT_TA_30522.pep
LMLSPWIIRTLTLPPLLASLIPRTFRQYHTPTIYLPQNIHHTYLLWHFHSHSEIYCHATFHHLVHHDTLVIVILHILVHRRMHSHRVIFCSKYRVVIVELYE

SEQ ID NO: 136105 - protein, 71 aa, Triticum aestivum
  unsure (1)..(71): unsure at all Xaa locations
  Clone ID: PAT_TA_30523.pep
MIETMIPPQVGMRLRTLQKKKKRKAKNKKKAKEKKKKKKXKIKEKKEKKKKMREKERRDNATVLLPHLCSK

SEQ ID NO: 136106 - protein, 69 aa, Triticum aestivum
  Clone ID: PAT_TA_30524.pep
YFSREKPLVKSTGLGSLLYYICLCDLFLFSFIFGYINPKIQKYLAALYFNLLLFEIYLSNLSYFYPVDP

SEQ ID NO: 136107 - protein, 82 aa, Triticum aestivum
  Clone ID: PAT_TA_30525.pep
INHAPTSSHNGSPYVHATGITNFNTSISQIHNYSTSMTLISPSPYLKTIIKYQTSHSIQCTYMEVFIMPKSKLPCCSKGLSK

SEQ ID NO: 136108 - protein, 101 aa, Triticum aestivum
  Clone ID: PAT_TA_30526.pep
PLQYRALPFLTSRVGANFSDASKPHDMICSITHKPPYIFLKTTTIPTYHGISIAILRYIAMQLPPLRFYDIHIHCHIALHDHKKASMIFPWLVCFLISLLR

SEQ ID NO: 136109 - protein, 157 aa, Triticum aestivum
  Clone ID: PAT_TA_30527.pep
DITTQLYNINKPYKHHNTSQGPRGLEYKCSIIDKSAEATISEYRHKLNKSALRRLAQTGIQIERGAGLLHGILLTTLGRRQRAARSSRHLRCSRSRRRQWRLAPGLQHVEPVDEQSGLGEAPVRPNPRRRASRCRGADELDGDARGPPSLLRWLKST

SEQ ID NO: 136110 - protein, 84 aa, Triticum aestivum
  Clone ID: PAT_TA_30528.pep
QTFSTWIICTYDWNSSKHPQLLKIIKVKPNHSIKVSSPLYPIRNNSLTRVCVSVTHATHYKRIMNILQHPTAGIPHACATRRAP

SEQ ID NO: 136111 - protein, 70 aa, Triticum aestivum
  Clone ID: PAT_TA_30529.pep
NTLCASLTSFELSSFALCASLISFELDNFAPCASLISFEHYNFALCSSLRSFRAQWWICFKETIDLSCFT

SEQ ID NO: 136112 - protein, 98 aa, Triticum aestivum
  Clone ID: PAT_TA_30530.pep
IMLSPWIIRTLTLPPLPASLVPRNFRWCITPTIYLPQNSHHTYLLWHFHSHSEIYCHATFHRFIYDTLHHCHIALHDHVVDIVFVAKPSFIIFHTRHS

SEQ ID NO: 136113 - protein, 178 aa, Triticum aestivum
  Clone ID: PAT_TA_30531.pep
NSAHSTMLQVLVSIQALILNEKPYFNEPGYAGSANTATGQQHSVEYNKNTFLHSCRTMLYSLRRPPEHFGDLVAGHFRERGRTILAACKHYLEGNMVGSEVPEEEEVEYDGTGASSSSSSSSVPKKQEVMRVDPLGRRTQFIDNLKTLFEDLLMEFNVKGADTRKFLEDKVKKNLPAA

SEQ ID NO: 136114 - protein, 222 aa, Triticum aestivum
  Clone ID: PAT_TA_30532.pep
MATQSAVRLIGGAGAGGWTKDFGAFDSPLGNLPGEGLGFVENGSGIYGGWGESVPNRSGSAPPSMEGSLAALGNLIGQRSGNFDTSLGNLDNVTGSSTAEEQLRADPAYFDYYGSKVNLNPRLPPPLISRESRRFMNRVGKVKEWRVVSQDDSNKGSLFIPRSTLSTHKEEPEDDKSPRLDSSSADDEQMNLVDFVQESFQQNPDSLYDNSSHLSSSSIGDG

SEQ ID NO: 136115 - protein, 140 aa, Triticum aestivum
  Clone ID: PAT_TA_30533.pep
EAPFARHRRRLPSVHLVRRQMPLLPTIPDLLELAHRLNTSRPLPMFVCSTTSKTTPLSCQSNQMLEPWSQTPPSTTTPTTLEVPTTTCSPLTTTRSSLGGSQAGGLRLFRFVSQFVLAFLRQTCLTYVCTQILLLPLTRL

SEQ ID NO: 136116 - protein, 96 aa, Triticum aestivum
  Clone ID: PAT_TA_30534.pep
PLRSRGRSTLVTSTSSISIKQDVGFYLHQEGPNLGKTSCPLSPVTIRLDAQFGTPYPRSAGFDTDMEHHEEITCLNLAIHCGVNGLVKMCLRVAHP

SEQ ID NO: 136117 - protein, 217 aa, Triticum aestivum
  Clone ID: PAT_TA_30535.pep
MFEPLIFDLWYFGHFLNPARKAARIPPHPSLSAAGKLMEPNADKLRGLRITSLDDEDDDEIELPATVAAAASGYDDDDEDEDEEAEVMLGFLEKPKHPGLLRHLFPSKAGGIPAWLDPVNLPSGNSSCCGFCGEPLHFVLQVIALCLEAIVPVIYAPIESNAAAFHRTLFMFMCPSMACLHRDSTNSGHATKQPRRSVRVPVPAASYNCLPSKLQSQ

SEQ ID NO: 136118 - protein, 130 aa, Triticum aestivum
  Clone ID: PAT_TA_30536.pep
FGTRLSCPRTRHLLQIHRRARSLPLASLCHGQQAHLASPLRPQRPPSSAASTTETKRSGTPSIVEPALCFHLRPPKAAAVILLHRASHEPAHAHLQVRDGGVQEPDATFDDCYYIEGVYYHVTETADDQE

SEQ ID NO: 136119 - protein, 108 aa, Triticum aestivum
  unsure (1)..(108): unsure at all Xaa locations
  Clone ID: PAT_TA_30537.pep
LMLSPWIIRTFTFPPLLASSVPCIALSHLESWCKTSPVHPHPVDTIRSVTHKPPYIFLKTAPYQPIMDFIAIPRYIAMQLSRPSHHHDILTCQLHCRYVVNXFVESTS

SEQ ID NO: 136120 - protein, 78 aa, Triticum aestivum
  Clone ID: PAT_TA_30538.pep
MCHDKWNGGKLHGNISRNGYGNAIIGRYGGCFEEDIRRFMCERAYHITGFGCTGEVCTNSQCEKGQCTVPKRLAVMER

SEQ ID NO: 136121 - protein, 72 aa, Triticum aestivum
  Clone ID: PAT_TA_30539.pep
IKHALTSSHNGSPYVHATGITNFNTSISQIHNYSTSMTLISPSPYLKTIIKYQTSHNIQCTCMKVFIIAILF

SEQ ID NO: 136122 - protein, 85 aa, Triticum aestivum
  Clone ID: PAT_TA_30540.pep
HCPFSLFLPFFSFFQFFIFFVWDSLASFFIWASLASFAHMGQFSNNDDHHTFIYLQLKNYNSILEQNMTPYECLKKCTWMCNDLA

SEQ ID NO: 136123 - protein, 99 aa, Triticum aestivum
  Clone ID: PAT_TA_30541.pep
CIFFLLTYFIVLICQQNSLLRCNYKAYTSVISVFLYHNSFEIGLVIIVQDILGKIPCADGLVSHVNSSFMVFCDNHGRLKICYLCGIIGPLKIKLRLAL

SEQ ID NO: 136124 - protein, 47 aa, Triticum aestivum
  unsure (1)..(47): unsure at all Xaa locations
  Clone ID: PAT_TA_30542.pep
IYAIGAGITAAAGTRLALQWILVKXLDCTHSNYQTLMRPXIVIYCHY

SEQ ID NO: 136125 - protein, 194 aa, Triticum aestivum
  Clone ID: PAT_TA_30543.pep
SCRIRHETHSLILLPDKQRLRPPHCIPPPAQGPSLAARCFGRDCPSASPLPMAAETAALLLPLHLRPRRRRLPLHQILGRGLDMRAGGLPYAYLLLPRDKTQNRSERRGSPARTPCSDGLGVSRASPWPSTTCSRVDGRRPPHLATSPMTGTVCSWVLVFSYSAGKQAWIHWMMYTHQVHLAFIIASNLILRFF

SEQ ID NO: 136126 - protein, 76 aa, Triticum aestivum
  Clone ID: PAT_TA_30544.pep
INQAPTSSHNGSPYVHATGITNFNTSISKIHNYSTSMTLISPSSYLKTIIKNQTSHSIQCTLYESFYYTHLGCPSY

SEQ ID NO: 136127 - protein, 112 aa, Triticum aestivum
  unsure (1)..(112): unsure at all Xaa locations
  Clone ID: PAT_TA_30545.pep
AQCEKXXSLSFSLFLSFFPFPXFFFFXWPSLFFLXAFLIFFXIFLXFLFXKVRKFILDYGGIIVXHHPFXHLGHVLINEDHHTFMDLQSKKNKYALYECPPAMYRGYAMNQE

SEQ ID NO: 136128 - protein, 98 aa, Triticum aestivum
  Clone ID: PAT_TA_30546.pep
RDVLPSDLHGDLCRPNSPHMHVIPVCWRRDPALLGYFSSPPTSAVPASRPCSVSSSVKARVRQLQARPTPPLLSTLDVPNLHHQVRSNLSFSILSVLR

SEQ ID NO: 136129 - protein, 108 aa, Triticum aestivum
  Clone ID: PAT_TA_30547.pep
YRTTFAGTINPSFIFLKTATIPTYYGISIAIPRYIAMQLSTVPFIIIMTYITFVILPLHNHVVDIVFVAKPPFIILSYMSLLIHCTSRYTAEGIHIESYFVLISSCNH

SEQ ID NO: 136130 - protein, 94 aa, Triticum aestivum
  Clone ID: PAT_TA_30548.pep
LQVKLPMNEDERGDARGIPKLRLLAILEYLGVPWASPSLCSCHSLFHSPKNLYPKLENFTTQNSTGNLISSVSERKQNHHIWYCNELILYLFWC

SEQ ID NO: 136131 - protein, 147 aa, Triticum aestivum
  Clone ID: PAT_TA_30549.pep
PTNRRPSLNCCFFCLFQCFEEKEYQMESKRNETFGSDLFGTNAIHETWSGRQEAAEADTRQEGAPYGGRPPPTLVGPSWLLWPTSFAYIYPRTPKTSRSTTENLIPPLQPSVSARSHLGAFTSAPLEGESTMESLYIISKALPMSCE

SEQ ID NO: 136132 - protein, 91 aa, Triticum aestivum
  Clone ID: PAT_TA_30550.pep
LFDYSLIFTYIFQSSLSFALVLHLYPFRARRWFYFEEIDELSCFTYIILRVINSMVICFGYETSPNMIGIQDGYNKNFHIECIEYYEKFDT

SEQ ID NO: 136133 - protein, 106 aa, Triticum aestivum
  unsure (1)..(106): unsure at all Xaa locations
  Clone ID: PAT_TA_30551.pep
GKDDEGYDPPNKSRMRLXNFYXKKRKRERRKNLERPKKKKEKEAKEEEKEKRKXEKKIXKLNERKRERTRYXXFPTWXKYTCXKIXSXVHSXQXEFHXXGCNQEGS

SEQ ID NO: 136134 - protein, 156 aa, Triticum aestivum
  Clone ID: PAT_TA_30552.pep
LPSRSPSLCPSPTRPSSSALPSPYRRRRRGHRPPGTIGECPGAPPACPASPTRINSSSEQPPRPDRPLLLPRSSPLLFIDPSPLQLLSHQRASVCLRDYEADAAAGTPIDYGVDDPSFLSEQPDAGVQELDATVDDDSYYTGGAYYYVHPADDDHE

SEQ ID NO: 136135 - protein, 83 aa, Triticum aestivum
  Clone ID: PAT_TA_30553.pep
AKHIEYSKNSKSCMALSKSVYRKDDCGKLTSKDSNHTRRSKQNTYHVVNKNIAPSKVTDRSRRKRGCLLGHPQALAFRCSYIR

SEQ ID NO: 136136 - protein, 166 aa, Triticum aestivum
  Clone ID: PAT_TA_30554.pep
NRILNKTHPSKFHRQPSDRFSAGRRGEDRRVELCYAMRLEMRLEMLPGYATWRRYLEDFNLLSSTCCKMEVARSVVFDRISYPPLILAFCSSVHRYAPLHIYPCICSVAPCLRVLWMSTHGCFPPSFPPFLSTWLSQLDAGAQEPDATIDDDSYYTGGAYYYVQPA

SEQ ID NO: 136137 - protein, 128 aa, Triticum aestivum
  Clone ID: PAT_TA_30555.pep
ISYDTPTIPNEKNFPYVESNKISMLVDHENNALCDGYIVEFIHDATENYYEGGIYACRSCNNIKFPLYMLKILKCCLLYLLCKLILVHISCLLTKSLFIGSGLDLNVLVIFFMMLSLCYNSYPLCEHH

SEQ ID NO: 136138 - protein, 216 aa, Triticum aestivum
  Clone ID: PAT_TA_30556.pep
MELKFDALWKRDLLALSKYNVNGKVKAITVRNDYPDYPVPYFQVTEGFDLKKVKKLMLERDVEIAKSIANDIIIPDPAPQWVADNFLDKYAELEPILVKDSAWCFLRLFQNCRGRGMSSDLTITAQTLTFMVSFNALRCAKVVLEGMAPELYGMHANPNCINKFGYFALHEAAERFSVDMIKLLLRHGASPNVRTVRNDVIFDVIENLLPLHVAVE

SEQ ID NO: 136139 - protein, 156 aa, Triticum aestivum
  Clone ID: PAT_TA_30557.pep
LLFVARSSWSSLPRRSRGHRHPRHLRACPGASAPPTPPTTCIGLSSDALLPRHRVVFSAPVVASRRRARRVRPPPCSPTSPSDLHPETAGDPQFDYGVDDPSFLPEQPDAGVQELEIPRMILRGVRLRGVVRRSQAGGLAFSIVATFVLAFLRQSC

SEQ ID NO: 136140 - protein, 59 aa, Triticum aestivum
  Clone ID: PAT_TA_30558.pep
GSYMVGVWYRRKVHDTREVSNGRRVRVRIIHGLNISHKELTYLLQKSISYRNKVLHTCS

SEQ ID NO: 136141 - protein, 64 aa, Triticum aestivum
  unsure (1)..(64): unsure at all Xaa locations
  Clone ID: PAT_TA_30559.pep
RWREVLVKIAVMMMMMATAAFRRHRRRXGEGPPSSSSSLTSSLDGRRVSPLVLGLHGMGGARAP

SEQ ID NO: 136142 - protein, 100 aa, Triticum aestivum
  Clone ID: PAT_TA_30560.pep
MVALPQIRCQLHDHAKEYDNDDACHNKWNGGKLHGNTSRNSYGSAIIGRYGGCFEEDIRRLMCDRAYHITGFGCTGEVCTNSQGEKGQCTVPKRIAMMEG

SEQ ID NO: 136143 - protein, 60 aa, Triticum aestivum
  unsure (1)..(60): unsure at all Xaa locations
  Clone ID: PAT_TA_30561.pep
WKSTVGKWSRVQGEGDHNAKLXVSPILGEAVDVEDEVVVTNSIVLPNKTLNASVQDEIIL

SEQ ID NO: 136144 - protein, 76 aa, Triticum aestivum
  Clone ID: PAT_TA_30562.pep
TIDNYHELENIIITILLLPLGHISNTNFIRNIYSADVGFTCLNLQTFWVCIHFFQAIKHCAPSASFLYGSKEGSLN

SEQ ID NO: 136145 - protein, 76 aa, Triticum aestivum
  Clone ID: PAT_TA_30563.pep
INYAPTSSQSGSPYVHATGITNFHTSIPQIHNYSTSMTLISPSSYLKTIIRNQTSHSIQCTLYESFYYTHLGCLSY

SEQ ID NO: 136146 - protein, 100 aa, Triticum aestivum
  Clone ID: PAT_TA_30564.pep
FGTRVEEKSVGKEGKISGSQKGDSAKHDVVDKDLLQAFRYFDQNRVGYIKVDDLRCILHNLGKFLSNRDVKDMVQIALAESNSARDGRIIYTKLVKKADL

SEQ ID NO: 136147 - protein, 199 aa, Triticum aestivum
  Clone ID: PAT_TA_30565.pep
MGKSKSKGAKFAAVKKIISKKTIQKYKEDVLDPRKKDTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 136148 - protein, 168 aa, Triticum aestivum
  unsure (1)..(168): unsure at all Xaa locations
  Clone ID: PAT_TA_30566.pep
MASVRPPLRRLALLLNSRIRANNRFLASASASTSSYPTAAAAGTATTETPAPEEPEVVSMXDNCVRRLKELHTKEPSGXKGNMLRLSVESWWAVLDSKYTFSLDSKENADDRVFEKNGVKLVVDNVSYDFVKGSTIDYVEXLISSAFVVSXNPSAVGGCSCKSSFMVK

SEQ ID NO: 136149 - protein, 117 aa, Triticum aestivum
  unsure (1)..(117): unsure at all Xaa locations
  Clone ID: PAT_TA_30567.pep
PTLKVINGKHGTEEASNDGRVRVRIIHGINISHKELTYLLKKSTSHQKPSTTRMLLGDRLVGKDHRSXPTVTHKEDNQRTPHVSNLLHNVYHTCMLRDLQTSTQVFLKFTTTQLAQL

SEQ ID NO: 136150 - protein, 187 aa, Triticum aestivum
  Clone ID: PAT_TA_30568.pep
MGWRWHDDVEGDGGRGGLGDIPDLAGRGGGEGAHVGTRRVVQSRCHTEEVEPGRFVRKCEKTEQLLRDCVGRPSELVESKTENTEEDVTDEMTGGASRSLGFPTKEPFAFPGLRSDIEAIEKGFGSFLDEAERMTNEFFKSFGFPTIHDGDSRPFPRQPAERHVGEGTVKKPNENEYSEFGSQITDV

SEQ ID NO: 136151 - protein, 151 aa, Triticum aestivum
  Clone ID: PAT_TA_30569.pep
VKQVAIRWLAQTGIQIERGAGLLPGILLTTPGRRRQPARSSRHLKCSSHHRQWRLAPGLQRLVVLARRMSRQHRSRTGVPGSLGVTARRAMAAVVEEEDGDACVAGDEEAVRRGGVEDDGAATDPGGDGDRSMGSIPPIQSGGRGRSGVWG

SEQ ID NO: 136152 - protein, 90 aa, Triticum aestivum
  Clone ID: PAT_TA_30570.pep
SMDSTLVIKNSYTYCKNLQAIKNQSITRMLLGDRLVGKDHRSSPTATHKEDNQITPHVSNLLHDVYHTCMLRDLQTSTQALLKFTITLQA

SEQ ID NO: 136153 - protein, 157 aa, Triticum aestivum
  Clone ID: PAT_TA_30571.pep
HGAIKNYRYIGDVSLGTSRVVVVVIDGGVWILGSNVWLRHLVALARRGHLRCSRTHGHRHRSQSRGEGGGELGVVRGGPEVADRRGGADIPGRRGGVHGCGSGALQLEPVAVEVEDVEAQLLGAFGRDGVVPERVNDEAALTAAYGCLSRSGRRGKG

SEQ ID NO: 136154 - protein, 112 aa, Triticum aestivum
  Clone ID: PAT_TA_30572.pep
IHSCTTHIININQAGVGFYLHREGPNLGKNIVSLVSCYHPPRRTVRDPYPRSAGFHTDKDLKLIDVSPIKSLFCNMNLDETEYDLPLPRRHSKNSEFLDLDDEIDESGIEKQ

SEQ ID NO: 136155 - protein, 137 aa, Triticum aestivum
  Clone ID: PAT_TA_30573.pep
LIDFCNKYVSSLCLMLSPWIIRTLTLLPLLASLIPCTFHRYHTPTIYLPQNSLHTYLLWHFHSHSEIYCHATLHCSVYYDTLHHYHIALHDHVVDIIFVAKPPFIILSYMSLMNHCTSRYTAEGIHIESYLFLSIEL

SEQ ID NO: 136156 - protein, 121 aa, Triticum aestivum
  Clone ID: PAT_TA_30574.pep
VLCCEVFKFWMNSFDGLWNKEWQEPKLGDAHGTPKIIQGHQKVKAWGSPGRHPLFRLLPSVIYLELYFYSLHVMCFAWSVLYYSRLCLFVFHNHPCCTHLFREPYMIWNLLEYSMCFTYIF

SEQ ID NO: 136157 - protein, 429 aa, Triticum aestivum
  Clone ID: PAT_TA_30575.pep
GPTGITLKNDIMNFKQFDHEHVAQSWERMKLMLRNCPTHGLNLWMIIQNVYARLNFASRNLLDLAAGGTFMEITLGEATKLHDNIMANYSQWHTERSTSKKVHAIEEINVLSGKMDELMKLFATKSAPIDPNDMPLSSLIENNNESMDVNFVGRNSFGNNAYRGNFNARPFPSNSSNNYGNSYNNSYGNFNKMPSDFENSVKQFMISQKNFNALLEEKLLKVDDLARNVDRISLDFDSLKLRSSPPKHDINESLKVMRISFDECKERTARLRAKKDSFIKACSSFHENNDEDLKVIDVSPIKSLFCNMNLDNDGTGDDSTLVKRRPNDSEFLDLDTKFGKSGTGEVKTLHSIEPTIMDFKEFNYDNCSLIDCISFLQSVMNSPHAYSQNKAFTKHTGDALMQSYEEKLESKVSIPRKLYDEWEPTIKIK

SEQ ID NO: 136158 - protein, 100 aa, Triticum aestivum
  Clone ID: PAT_TA_30576.pep
RWLCHKYDVNYMIMQKQYDNDGACHNKRNGGKLHGNISRNGYGNAIIGKYGGYFEEDIRRLMCDRAYRITGLGCTGEVCTNSQGEKGQCTVPKRLAKAKR

SEQ ID NO: 136159 - protein, 139 aa, Triticum aestivum
  Clone ID: PAT_TA_30577.pep
RPMHSINSFLQFYRVGNIKRRRCSSSLIIIASRSSKHMHIMFIKIIMCNGKRQPINIILTKRKLLRYSVVWRIQKDNRTIMRGCNSNNFMFNIRNYSKFMSIRIIPIGILATSIASIIKKGYFKQIQGIITIIIAIILR

SEQ ID NO: 136160 - protein, 106 aa, Triticum aestivum
  Clone ID: PAT_TA_30578.pep
AVPIFNSKIYLLCLEKVERQGYSDVLQYLICPLISTLTRMSASSDSTTCVRCSASASSPSSHRAARSPARPKQLTHDRPYIKCHCGFVNSDIALGFPSPFIFLVCS

SEQ ID NO: 136161 - protein, 241 aa, Triticum aestivum
  Clone ID: PAT_TA_30579.pep
KSIDMDPLKVFYLDLLRSLCARAETPTSLVDGKSLDEHAHFVRHRLSEKGRLLWDQINILLCYAWNLCEIYDFTCCSKNPKKHLPYLCEFNDNEILSSYAKGVYNYYDVQQIEEFVAFKGAYEIASLIEKYDATLYKYENFAIVKYCYDNYASNAYVKPYIKVYSAVQEETNILQESMEEEIDETVSSLDEKDEEESEEKKEEERISYPCPPSNESNSSTHTLFKFPSCLTKDDCYDPVDP

SEQ ID NO: 136162 - protein, 95 aa, Triticum aestivum
  Clone ID: PAT_TA_30580.pep
AGTPSIVEPALFFHLRPPKAAAVVLLHRASPEPAHAHLQVRDPVVAADAAVIDYVTDDPSILSEQPDGGVQEPDATFDDWYYTEGVYYHVTETAG

SEQ ID NO: 136163 - protein, 119 aa, Triticum aestivum
  Clone ID: PAT_TA_30581.pep
SMGCFFDCLPYEWRSGTSDGLFLPIYPPRGMRSSTLLRGIINFCNKYVSSLLLMLSPWIIRTLTLPSLLASLVSRNFRRYHKPIIYLPQNSHHAYLSWHFHSHTEIYCHATSIIIIYMT

SEQ ID NO: 136164 - protein, 129 aa, Triticum aestivum
  Clone ID: PAT_TA_30582.pep
TSQRKQPYLSTDISKQVCLKKASRNWGTDRKRRRPPAWDPPKLLLVVVSGLHVVVGTSGVVGLVIDSGVCLLGSNIWLRQPGRKVRGKKREKSNREYSSKVLASKELHYICMGICVKGHIGGLNCIMPE

SEQ ID NO: 136165 - protein, 61 aa, Triticum aestivum
  Clone ID: PAT_TA_30583.pep
INHAPTSSHNGSPYVHATGITNFNTSIYTNPQLLTSMALISPSPYLKTNASIKLIIVFNAL

SEQ ID NO: 136166 - protein, 263 aa, Triticum aestivum
  Clone ID: PAT_TA_30584.pep
MDAKKFLQMVEDKKKRLLEKKEAPLKWQQKLEAAIKATEEKEKKLKSKKHRRRSYSSSESDSESESDSDRKHRKRKDRKRHKRHGHSDSDGARRRKHRSKRRSSGSSDESDSDEYDGESEEERRRKKHSHRRKHRRHSSRSESDASDYSSDDDERRSTRKDHSRSRRRRHRSSDDESEEKIRSRHRKRHHRSSDEDKPSDSDNHKRHRSRSMSLDDGAAGEPDKMNDGKGSHKSRHHRRHHHHHDHRVNSAEPSDGKQLRVSC

SEQ ID NO: 136167 - protein, 94 aa, Triticum aestivum
  Clone ID: PAT_TA_30585.pep
HIDRSVILLLLSSCQIHIPSTMRLCNSRIPEEYLVCYQTSQCNWVIIKMLYRHLRRCLLGWHKSRLGFVTPSIGEVSLSPLGNTHHKKPCKQCD

SEQ ID NO: 136168 - protein, 100 aa, Triticum aestivum
  Clone ID: PAT_TA_30586.pep
VHGLYVLLPFHHCQPLRYRALPFLTLRVGANFASASKPRDMIHSITHKPPYIFLKTATIPTYLWHFHSHSEIYCHATFQRSVHHHHDIHYFVICHCMISS

SEQ ID NO: 136169 - protein, 91 aa, Triticum aestivum
  unsure (1)..(91): unsure at all Xaa locations
  Clone ID: PAT_TA_30587.pep
PSLCGKXVXGPSXXXDXEQSXXEXXDHMPSVYLAMEHWIVVGLWTXFCTMLMKRTWRLPSSQFVDMMYDMVYVQVAVRWAHMMEKTQDGAP

SEQ ID NO: 136170 - protein, 87 aa, Triticum aestivum
  Clone ID: PAT_TA_30588.pep
GGQSKKHLMRQICHTTFTICACYRICKLQHNISQIHNYSTSTTLISLSPYLKTIINYQTSLSIQCTYMKVFIMPKSKLPCCSKGLPK

SEQ ID NO: 136171 - protein, 132 aa, Triticum aestivum
  Clone ID: PAT_TA_30589.pep
LQHKDYNSKLRTRYDYMNASDGVPGWCNESRVTCMKNNAWWLCHKYDVNYMVMQWQYDKSNVCHDDKRNGGKLHGNISRNDYGNAIIGRYGGCFEEDIRRFMCDRAYHITGFGSTGEVCTNSQGEKGQCTVP

SEQ ID NO: 136172 - protein, 295 aa, Triticum aestivum
  unsure (1)..(295): unsure at all Xaa locations
  Clone ID: PAT_TA_30590.pep
MTPALLPLAPSPPYPKPPRLCHKPTPARPLYRCDATRRDFAVYTASAAAAAMSPAAATAADEALPSASQSPTPHPPNGGATSLLVGIANTRSWSQYYGSXFSIRVPPSFDDILEPEDFSAAMTYYGDKAKVRAYAARFASPDXGRLELVSVVIKPSNQLKITFLEAKDITELGTLKEASKLFVPGGAKIYSARTIKVKDQEGIRLFLSIFKGILQKAMASVVKLLYEIIFCRTYYFYEFRFDRQHVALMATVDSGKGKAAYYRPKVVGPFPDPAQAGATCTGLPFSSCILCCYFL

SEQ ID NO: 136173 - protein, 172 aa, Triticum aestivum
  Clone ID: PAT_TA_30591.pep
RPIMHNSKSPETSRKSVLDYIKNIGRRKDWRGATHHPRGRGACPNPLGVPPVSWAPLAGLWCPSLAIWSLSRLEKMISKLSGQNTAAMRQNLGETNLGLSLSCSSGETSLQEGEIITIVISIDPLIGRGSISINIFTSTTSSQTLVHLLYSIFCLKTLDWYMWVASSVDYSL

SEQ ID NO: 136174 - protein, 88 aa, Triticum aestivum
  Clone ID: PAT_TA_30592.pep
LLLVIGGLHVVVGILQVVVDISGIVWLLGSVIERPRKALDSFVAAGDDEDGGGHRRRRRRRRARSARCRARRLRWLGSGDAAEGGEAP

SEQ ID NO: 136175 - protein, 88 aa, Triticum aestivum
  Clone ID: PAT_TA_30593.pep
QQGMTKTAAITGDAEDGDELDPLDAEPVVSGGSAQATQRRAAKLRDISPGLGVVRERGIDGGERRRLSGVGGSSKGKRGNALRALGFV

SEQ ID NO: 136176 - protein, 135 aa, Triticum aestivum
  Clone ID: PAT_TA_30594.pep
LNCATAPDLRAAARPLVPSCHIISDPGLPPRRAPSAREQQLRPPRRGAAAPSTAAEDPLLICLHVRPLFHLISFAPPRLQNSRCKLLVVEASQDFTPVLLQEQRIVLPKLLNGRVGIPLVQLQAGGRMELDQYRD

SEQ ID NO: 136177 - protein, 83 aa, Triticum aestivum
  Clone ID: PAT_TA_30595.pep
PLRYRALLFLTLRVGANFTGASKPHDTIRSITHKPPYTFLKTATIPIYYGISIAIPRYIAMQLSTISFIMTGFVIVILPCMIL

SEQ ID NO: 136178 - protein, 78 aa, Triticum aestivum
  Clone ID: PAT_TA_30596.pep
LQVKLPMNEDERGDAIRCIPKLSILVVLEYYIGVPWASPSLGSFHSLFHSPSNLYPKLENFNHTKLKTKLVSSVSMRK

SEQ ID NO: 136179 - protein, 75 aa, Triticum aestivum
  Clone ID: PAT_TA_30597.pep
KHKTTSKQRLDELFIANLYYHATFTGTINPPYTFLKTATIPTYYGISTAIPRYIAMQLSTVLFIMTRPICHIAFA

SEQ ID NO: 136180 - protein, 104 aa, Triticum aestivum
  Clone ID: PAT_TA_30598.pep
TNTSANNRRMNNNSKLEQNMTLYECLRRCTGMGNESRVTCMKIYAWWLCHKYDVNYMIMQGNMIMVMCVIKIKWNGGKLHGNISRNGYGNAIIGRYGGCFEEGK

SEQ ID NO: 136181 - protein, 88 aa, Triticum aestivum
  Clone ID: PAT_TA_30599.pep
TKTKEGMPSGAIPKLRLLAILEYLGVPWASPSLGSCHSLFHSPSNLYPKLENFTTQNSTRNLISSVSERKQNHHIRYCNELILYLYWC

SEQ ID NO: 136182 - protein, 169 aa, Triticum aestivum
  unsure (1)..(169): unsure at all Xaa locations
  Clone ID: PAT_TA_30600.pep
FVTFPYFIQVRPKTWFPIPLPPFSHSYTVRARTPSPHQPPSATPSIAAXPPPHPSPXPPPHPSPPSSTMPERLPRPRRPLLEMDVSHPRRQTNSLASRPLASSAPSSSLPGPLTRPSLPPQRDLSPDAPVYRRRSASTPPIAIAPPMPTRRRKRGGSSYLLNFLISTRK

SEQ ID NO: 136183 - protein, 164 aa, Triticum aestivum
  Clone ID: PAT_TA_30601.pep
PKEEIQNGARLRIPGMRRTLRVGSMDLLLPVSSVPPISCCSLTPRAAAARRHGLPLPQLRVLQLLLASRRHKQSLPQRLALRILLLAAAVAYRMVSELAKKTENLSEKFLGKKFSEKKQGKKIRSRNKKLQRENTRKDSTPSRRGSLPSRRPSSPKSQPVLDLQ

SEQ ID NO: 136184 - protein, 91 aa, Triticum aestivum
  Clone ID: PAT_TA_30602.pep
VYEFFMTNVESMDYTHSHPSTFASLSNTAHLSLVSYTYHIPSSNSHHTYLLWHFHSHSKIYCHATFHHLVHHDTLHHCHIAYPGTPPDAFT

SEQ ID NO: 136185 - protein, 107 aa, Triticum aestivum
  Clone ID: PAT_TA_30603.pep
TKWCASNLLAQETSVFEEPIIGLYKPSSIMKFPLVYESDNSRDSLYEEHGATLKHKCGKRIVTLSLLSFSLIFLSFFLFFWWASLAFFFIWASLASFILITSHGTMF

SEQ ID NO: 136186 - protein, 160 aa, Triticum aestivum
  Clone ID: PAT_TA_30604.pep
APHLRPLALSLAHALVTSSRSIAERGRCRSPHSAMASRHISPRRCVHKDRRRPLRLLRRRNDPEPLPSSSRPSASTSRPPKAAAVILLHRASHEPAHAHLQVRDPVAAADAAVIDYVTDDPSILSEQPDGGVQEPDATFDDCYYTEGVYYHVTETVDDQE

SEQ ID NO: 136187 - protein, 207 aa, Triticum aestivum
  Clone ID: PAT_TA_30605.pep
TSWIEGQVTINQVIFRKKEKRIRLATEILFTSSVEPQEEIQNGARLRIPGMRRTLRVGSMDLLLPISSVPPISCCSLTPRAAAARRHGLPLPQLRVLQLLLASRRHKQSLPQRLALRTSAAGRRRCIPNGVRVGEKNRKPQREIFRKEIFREKTRKENTITTPQRENLRNKNLQRENTRKDSTPSRRGSLPSRRPSSPKSQPVLDLQ

SEQ ID NO: 136188 - protein, 78 aa, Triticum aestivum
  Clone ID: PAT_TA_30606.pep
SFQVLGKVLMDHEIRIGKSLTLGMPMEPKYNSRTTKSLTLGMPRKASPLSSSSISNFTWSYIFIHHMICVLLGPSCMI

SEQ ID NO: 136189 - protein, 77 aa, Triticum aestivum
  unsure (1)..(77): unsure at all Xaa locations
  Clone ID: PAT_TA_30607.pep
SRGPRDRGRAXQGGALLSRGVLEYLLTWSPRLQDDILPKNHIAEGFIPFGLRLIFLFFEILKQAIKQQYGLGLQLIG

SEQ ID NO: 136190 - protein, 106 aa, Triticum aestivum
  Clone ID: PAT_TA_30608.pep
AGKRGCAPSLSPIRTPHGRGRATSWLLPSLSPQGPLRPNTSPGGSGNPSGTPVLSETSPEHFRCPNIVVQYINLYVSSISRLLVMSVITSGTPNNLRYIKTYKLII

SEQ ID NO: 136191 - protein, 124 aa, Triticum aestivum
  Clone ID: PAT_TA_30609.pep
LMLSPWIIRTLTLPPLLAILIPHTFRRYHTPTIYLPQNSHHTYLSWHFHSHSEIYCHATFHRSVYYDTLHHCHIALHDHVVDIVFVAKPPFIILSYMSLMIHCTSRYTAGGIHIESYLVLSIEL

SEQ ID NO: 136192 - protein, 99 aa, Triticum aestivum
  Clone ID: PAT_TA_30610.pep
KFNSEKVASLAYGRIQGRNALISHFQNSSLMNEDKRCRPILFHSNGPETGNQEPFPNGICIHMPLDGGAGSSKEPLGFEEDDNPNEMKISGEKSMAGSL

SEQ ID NO: 136193 - protein, 106 aa, Triticum aestivum
  Clone ID: PAT_TA_30611.pep
SPSSFPHLGQCSNNDGHHTFITYNSRITTQYLEQNMTLCECLRRCTGICNESRVTCIKNHERWLCHKYDVNYMIMQSNMTMMERVIINGTVVSCMAIYLGMAMEMP

SEQ ID NO: 136194 - protein, 160 aa, Triticum aestivum
  Clone ID: PAT_TA_30612.pep
EPSLDAPLSAMNPSSLHFPLWRRSPPNRAAFESSHGCAVDVGADTGLPSPIQQVQETRTFTLFVYDKSREQGRPHAAAIVDPHRRPSLLPRRRPAAACAPVHSKSHHVLPDPMTATDVAVIDYVDDDPPSRLSNQMVDPWSQMPPPMDATTWRPPMTRSS

SEQ ID NO: 136195 - protein, 164 aa, Triticum aestivum
  Clone ID: PAT_TA_30613.pep
VKRVCLKKASTKWDTDRKRRRPPAWDPPKLLPVVVSGLHVVVGTSSVVGVVANGGVWLLGSIVTELVDVIRERGSGRMRRARRRTVAAVTNNRLDPERTARPSSNQRRLVKESSTRELLGIFPCVGEACGRDGDYGTTTEASAPLPDRVRGGKEGTGGLARPGR

SEQ ID NO: 136196 - protein, 109 aa, Triticum aestivum
  Clone ID: PAT_TA_30614.pep
VGIFGLFYFYKVRSLIPTCGGIIVFIILSSLGQYSNKEDHDTFMDLQIKNYNLKLEQDMTLCGCLRRCTGICNESRATCMKIMKVALPQIQCQLHDHAKSNVTKVMRVI

SEQ ID NO: 136197 - protein, 188 aa, Triticum aestivum
  Clone ID: PAT_TA_30615.pep
GRRAILEEVSIDYDENKVATYDNYCDDMYAIQSSDDYIKTCHDYDYPFSEYYSFNVETIYSIRVSYDTPTIPNEKNFAYVESNKISMLVDHENNALCNGHIVEFIHDATENYYEGVIYACRNCNNIKFPLYVLKVLKLCLFFPPMLVDYCSQKLFSQKIHMHTKWVRLKCASHILHDALFMLQFLSFM

SEQ ID NO: 136198 - protein, 199 aa, Triticum aestivum
  Clone ID: PAT_TA_30616.pep
MGKSKSKGAKFAAVKKIISKKTIKKYKDEVLDPRKKHTEKEKLGRNVPQVSSALFFSYNMALGPPYRVIVDTNFINFSIQNKLDLEKGMMDCLYAKCTPCITDCVMAELEKLGQKYRVALRIAKDPRFQRLACTHKGTYADDCIVERITQHKCYIVATCDRDLKRRIRKVPGVPIMYITQHRYSIERLPEATIGGAPRI

SEQ ID NO: 136199 - protein, 138 aa, Triticum aestivum
  Clone ID: PAT_TA_30617.pep
TRRTLARVQIHLAVRPHHHGRPHPHTHLAPRCTCFLQKNNRRLPRLLEPPVGVEALCINHDDVFFILVTDRCPAVDSPISEPPQSHPGLVELATGPPHDYETDVAAAQFDYGVDDPSFLPRATRLRDRRCCCPVRLRS

SEQ ID NO: 136200 - protein, 244 aa, Triticum aestivum
  unsure (1)..(244): unsure at all Xaa locations
  Clone ID: PAT_TA_30618.pep
SRTPSPTTAEDREKMKVIPYASAIGSIMYXAMLCTRPDVCLAISIAGRYQSNPGVEHWTAVKNILXYLKRTKDMFLVYGGEKELIVNGYVDASFDADPDDSKSQTGYVFILNGGAVSWCSSKQSVVAGSTCEAEYIAASKAANEGVWMKEFISDLGVIPSASGPMKIFCDNTGAITXQKESRFHKRTKHIKRRFNSIRDLVQVGDIEICKIHTDLNVANSLTKPLPRAKHDQHQGSMSVRIITV

SEQ ID NO: 136201 - protein, 141 aa, Triticum aestivum
  Clone ID: PAT_TA_30619.pep
HKSNTIEEARPPAWDLLTTPGHRRSPRSSIRRRWHLAPRIHHLVAQTRRTVIVDVVDHRDINIGLGVGVGEQGGVEAWGRPMGRRTKTRRRRRGGGEQRRHGVRARGAAGSSRRFSPRRGGGIVREEMACGGVGRLRRGGP

SEQ ID NO: 136202 - protein, 151 aa, Triticum aestivum
  Clone ID: PAT_TA_30620.pep
GLCIWRCTKIAYCHLSPFLGSIASAALIVKQQGSSRFFVEADCSGERLDAELFAPRLGAVREKPRVALPRHGESDGLILHFAGVARGEEKGGSHDHHEGGHDEAQGARVLLQDRHGVRYRRRLATLTYVLEFFALADAWADAWRRIPKPGP

SEQ ID NO: 136203 - protein, 78 aa, Triticum aestivum
  Clone ID: PAT_TA_30621.pep
GEGGEVGVQAWGCPSKYARRLKCLILGYPGRHPIFLQQVSICFSFRFVHVICLNLGVSFVFSFCFLFYAQCWYDIVHG

SEQ ID NO: 136204 - protein, 178 aa, Triticum aestivum
  Clone ID: PAT_TA_30622.pep
MDVDRQETMEETILVGDDLMRGPPSPVVPKEIASHVLEGVELCDGILKNLFLCLQINDIEPFCQDEIVLYKQCAEKRDKEIRERLQDSEYKLGFSMPLEDAKERVTQLQSELTLLERRMILASGLPGMEGFRQRWSLHGQLGDTRKRLEALNSGMAKRESPSPPGEGTTPAVKKRWFF

SEQ ID NO: 136205 - protein, 132 aa, Triticum aestivum
  Clone ID: PAT_TA_30623.pep
ARGSLSPSPQISHAPSTSMAASSSFPWPEPSPTREVMLCSSVGLVCIAYNLRFELKPSTTSPSGRLPRHGHGAIAVDLHHRRLPAVPGTSTTSLETPRSTPLLPKYDYGVDEPSLLPRATRCWSPGARRQHR

SEQ ID NO: 136206 - protein, 471 aa, Triticum aestivum
  Clone ID: PAT_TA_30624.pep
NKKVHAIEEINVLSGKMDELMKLFANKSVSSDPNDVPFSTLIENNNESMDVNFVGWNNFGNNAYRGNFNPRPYPSNPSNNYGNSYNNSYGNYNKMPSDFESNIKEFISLQKNFNAMIEENLIKIDDLSRNVDRIALDVDALKLRSIPPKHDINESLKAMRISIDECKERTAMMRASKDAFIKACSSNSYENQDEDLKFIDVSPIKSLFCNMNLDETEYDLPLPRRRSKNSEYLDLNDEIDESGIERNKNLDAKPTILDFKEFNYESCSLIECISLLQSVLNSPHAYSQNKAFTEHIVDALMQSYEEKLELKVSIPRKLYDEWEPTIKIKIKDHEFYALCDLGASVSTIPKTLCDLLDFRNFDDCSLNLHLADFTINKPMGRINYVLIVANRNYVPIYFIVLDIYCNPTRPIILGRSFLRTIGVIIDMKEGNIRFQFPLRKGMEHFPRKKIKLLYESIMRSTYGLHTKNDNT

SEQ ID NO: 136207 - protein, 78 aa, Triticum aestivum
  Clone ID: PAT_TA_30625.pep
YDNSNACHDDKRNGGKLHGNISRNGCGNAIIGRYGGCFEEDLRRFMCDRVYHITGLDAPAKFAATLKVRKGNARYRRG

SEQ ID NO: 136208 - protein, 91 aa, Triticum aestivum
  Clone ID: PAT_TA_30626.pep
LMLSPWIIRTLILPPLLASLILRTFRGYHTPTIYLPQNSHHTYLLWHFHSHSEIYCHATYHRSIYYDMLHHCHIALHDHVVHIVFMAKPPS

SEQ ID NO: 136209 - protein, 148 aa, Triticum aestivum
  Clone ID: PAT_TA_30627.pep
SARGLDRDRGSEPDPIIAIAPPPSPRRRPRRLDTACRYSTPSPSSPRFPRLLSVCRPRTSPFDATPLRPEVVVATASSSPPRRSRHRVPPASGLPFNADPETATDAAVIDYVDDDPPSCLSNQMVDPWSQMPPSMDATTWRPPTTRSS

SEQ ID NO: 136210 - protein, 163 aa, Triticum aestivum
  Clone ID: PAT_TA_30628.pep
SLFFFFFFGDNALLMAIITLLFIYNSMNYNSILEQNMTLYECLRWCTGMGNESRVTCMINYAWWLCHKYDVNCMIMQWQYDKSNACHDDKWNGGKLHGNISRNGYGNAIIGRYGGCFEKNIRRFMCDRAYHITGFGCTGEVCTNSQGEKVQWTEPKRLAMMER

SEQ ID NO: 136211 - protein, 263 aa, Triticum aestivum
  unsure (1)..(263): unsure at all Xaa locations
  Clone ID: PAT_TA_30629.pep
SPLSVPQCQGRLSPRFPGNGAASGPTGWPPEPRQVASRTTRRPRAAARSSSASATPPPLPPPTTGLEILCLDIRWDVXKADTSKRYLEGWHKKQSSTDDVRKSKSGYFTAFGVDLSPDNMAVAIVYFMQGVLGLARLAVSFYLKDDLHLDPAETAVISGFSSLPWLIKPIYGFISDSIPLYGYRRRSYLILSGFLGTLSWSLMATVVNSKYGAGFSILLGSLSVAFSDVMLESRSQTPPSTTTTTTPEVSTTTCRLLTTTRSS

SEQ ID NO: 136212 - protein, 108 aa, Triticum aestivum
  Clone ID: PAT_TA_30630.pep
GLHRVGYIRRNLHNRSPSLPSMPSRVQSGHGYGLRPSCLHGPSVRPIDSRPDARGPLSPGNRTLPRPQLDQEYEGRHQAKCVLNVEVPYVRYLDPLDREEVRLHQPRY

SEQ ID NO: 136213 - protein, 660 aa, Triticum aestivum
  unsure (1)..(660): unsure at all Xaa locations
  Clone ID: PAT_TA_30631.pep
MEAFGGFFVDEKAARVENIFLEFLKRFKEPDAAEPFYDVEMEAMRSRESTTMYVDFAHVMRFNDVLQKAISEEYLRFEPYLRNACKRFVMEHRAGENRAPIISDDSPNKDINIAFYNIPMLKRLRELGTAEIGKLTAVTGVVTRTSEVRPELLQGTFKCLDCGNVVKNVDQQFKYTEPIICVNATCQNRSRWALLRQDSKFTDWQRVRMQETSKEIPAGSLPRSLDVILRHEIVEKARAGDTVIFTGTVVAVPDVMALTSPGERAECRREGPQRKNGSGVQEGVKGLKSLGVRDLSYRLAFVANSVQVADGRRDVDIRDRDIDGDGSERQKFTEEEEDEVVRMRNTPDFFNKIVDSICPTVFGHQEIKRALLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHYIVRVHQKREEALXSPHLALAKLKRYFVVAKFLNLNLXSEAKKVLVESYFGPXKDPILPVTKVSYRMTISHLRLLFSLSKLLSLVFWKNGFPRSRPLGRLISSHLLF

SEQ ID NO: 136214 - protein, 66 aa, Triticum aestivum
  Clone ID: PAT_TA_30632.pep
KNSEKIQILFIDRLDHKPTIHRSQQTHAKRRLHRIVLHKRGGELCIEIQKERRSHLATNYGPVGLR

SEQ ID NO: 136215 - protein, 196 aa, Triticum aestivum
  Clone ID: PAT_TA_30633.pep
KRVAHLLRVTLIAAAISSAAATESLPTHSSPLIILPSVTGKKVRLNCAATAFASTNLSMLPSSPPSPVCLCSDSILGAGRTRFRCRAPTSSRKTRRCSASDHLPYARLSASPRSNVSLIVGTQNGPTAAVGGRRGGESDSISEQDFQRDSTFGANTSAYQSNICSSAPHAFDTPKARLSARCASTWTSWRFCFTWT

SEQ ID NO: 136216 - protein, 99 aa, Triticum aestivum
  unsure (1)..(99): unsure at all Xaa locations
  Clone ID: PAT_TA_30634.pep
KLPGCIQTPXIRYALSTHNLPLIFLQNSTIPTYPWIPIPFPNILPYTSXIIIYITWTLMXXALQDRKIRHEFKGCPFXXMHPDNDTGXLGXSISXXVTX

SEQ ID NO: 136217 - protein, 120 aa, Triticum aestivum
  unsure (1)..(120): unsure at all Xaa locations
  Clone ID: PAT_TA_30635.pep
RXXKINRDSREVSQHTLKHNKSYSIIIQARASRARIHCSIIDESAEATISEYRHKLNKFALRRLAQTGIQIERGAGLLPGILLTTPSRRQRPARSSRHLQCRRRRWRLAPGLQHLVATTR

SEQ ID NO: 136218 - protein, 106 aa, Triticum aestivum
  Clone ID: PAT_TA_30636.pep
SPSSFPHWDSALIMKIITLLFTYNSRITTRYLEQNMTLCECLRRCTGMCNESRVTCMKNYERWLCHKYNVNYMIMQIKMTMMKSVIINGTVESCMAIYLRMAMEMP

SEQ ID NO: 136219 - protein, 91 aa, Triticum aestivum
  Clone ID: PAT_TA_30637.pep
RLIYWKVMYGHRNSSEEVPGFFGVLGGYRNPPGKLMGLMGHSGEETGHKRWRPPMAVRIGQGVGGADPLSFSLSPSFPFLLSVGRRGESTR

SEQ ID NO: 136220 - protein, 120 aa, Triticum aestivum
  Clone ID: PAT_TA_30638.pep
TKKQRLISYPMLQAKHISCGNKNIAPSKVTNERRRKRGCLPGASPKLRLLDILEYLGVPWASPRLGFCHSLFRTPSKLYPKLENFTTQNSTGNLISSVSERKQNHHIRYCNELIIYLFWC

SEQ ID NO: 136221 - protein, 89 aa, Triticum aestivum
  Clone ID: PAT_TA_30639.pep
SVVAAEVLLLLAAAVAYRMVSELAKKTENLSEKFLGKKFSEKKQGKKIRSRNKKLQRENTRKDSTPSRRGSLPSRRPSSPKSQPVLDLQ

SEQ ID NO: 136222 - protein, 179 aa, Triticum aestivum
  Clone ID: PAT_TA_30640.pep
MAAEGSSGGGGGGRKTPLPHNPRERGAAKFLTGLPSRGNFSSSSISSNLGGLRVYVCEHDTNPPEGQVIETDTTNILIRHLQLKKKESEAKDAGSRTPGESGKGKRCAARSLGVQKSSKKPNLGSSSGLPSSDEAISGFSQHTLQSFTVERLRALLRQRGLTTKGKKDELITRLREAQS

SEQ ID NO: 136223 - protein, 68 aa, Triticum aestivum
  Clone ID: PAT_TA_30641.pep
IVKLSLLFFSLIFIYIFYIFLFGPFHFFMASFYLGFFGLFYVYEVRSLIPTYGGIIVSIILSSLGTML

SEQ ID NO: 136224 - protein, 216 aa, Triticum aestivum
  unsure (1)..(216): unsure at all Xaa locations
  Clone ID: PAT_TA_30642.pep
VSCCPGGQASNVATYISKGNVALSVLMTTCSTIGAIAMTPLLTKLLAGQLVPVDAAGLAISTFQVVLVPTIVGVLAHEYFPKFTERIISITPLIGVILTTLLCASPIGQVAEVLKTQGAQLILPVALLHAVAFALGYWISKWSSXFGESTSRTISIECGMQSSALGFLLAQKHFTNPLVAVPSAVSVVCMALGGSALAVFWRNRGLPADDKDDFKE

SEQ ID NO: 136225 - protein, 140 aa, Triticum aestivum
  Clone ID: PAT_TA_30643.pep
FQIPFLSLSHYARDLVATPSSIPRPPTPHRRIAMSMRFSVDYFIISTTGSSPGSHTDDAPVFFFAHGHRGPSPSISTTGASRPRRARPRPPRDPETDAAPVIDYIDDDPFLPEQIVDATRCRSPGARCHRRCLLLRGDRR

SEQ ID NO: 136226 - protein, 203 aa, Triticum aestivum
  Clone ID: PAT_TA_30644.pep
TRVEPTHQTSPPALLPPFPNSPGGAPHISGDIGRRWPRLGPLSAASRYCLTAASAPTTASSPPPPPPPPRPPTPPPRQPAPPPLRRRAPEGPEVVSMTDNCVRRLKELHTKQPSAKGNMLRLSVEAGGCSGFQYTFSLDSKENADDRVFEKNGVKLVVDNVSYDFVKGSTVDYVEELISSAFVVSTNPSAVGGCSCKSSFMVK

SEQ ID NO: 136227 - protein, 86 aa, Triticum aestivum
  Clone ID: PAT_TA_30645.pep
DSLYEEHGATLKHKCGKRIVTFPLLSFSLIFFNFFFHFFYFFGGLLWPLFLIWASLASFIFLSPESHPDLWGNHSLCHPFLTGAML

SEQ ID NO: 136228 - protein, 104 aa, Triticum aestivum
  Clone ID: PAT_TA_30646.pep
LHDHAKQYDNDEVCHSKRNSGKLHGNISQNGYGNVMIGRYGGCFEEGIWWVYDIGERCAVLERLAMVEGRKVRIIHGLNISHKELIYLLQKSKSYQSKVLRACS

SEQ ID NO: 136229 - protein, 107 aa, Triticum aestivum
  unsure (1)..(107): unsure at all Xaa locations
  Clone ID: PAT_TA_30647.pep
GTRTIPWFPTPRPDVDRGRSPPPRPXVTAPPRAPTPAPSPVPPXPPTPRLLPEPPSPAPXPPRRPVHDRAVGGPRPELPRPRLPNAASPNCPVLGSSPSPLPIPTTA

SEQ ID NO: 136230 - protein, 122 aa, Triticum aestivum
  Clone ID: PAT_TA_30648.pep
SIAPSEERMMETMIPPQVGMRLRTRNKKKRKICHEKREKAPKNKKNERKREKGQCYFPFTTLVLQSSTMIFMLESLLCCHLHILVGIFHYRTWLVYSNDGLPQNALGLREQASWMHTHLVSF

SEQ ID NO: 136231 - protein, 126 aa, Triticum aestivum
  Clone ID: PAT_TA_30649.pep
RIPGEPFAAKPSKDAEMEKIMRSMEGMPGAPNMKMYSRDDLMKNNFGVDGDEDDEDDDEEEDNLPKNLGNILKNKGPQKKDLKQQVVEQIKDTGKKLKGHVSKVSKVVKNWWKGKKKPVKSSKSEL

SEQ ID NO: 136232 - protein, 419 aa, Triticum aestivum
  unsure (1)..(419): unsure at all Xaa locations
  Clone ID: PAT_TA_30650.pep
MEPNADKLRGLCITSLDDEDDDETELPNQPLPASTVTVAAAASGYDDEDEDEEAEVMLGFLEKPKHPGLLLRHLFPSKAGGIPAWLDPVNLPTGNSSCCXFCGEPLHFVLQIYAPIESNAAAFHRTLFMFMCPSMACLHRDQHKQWTRNQGNPRRSVRVFRCQLPRTNVFYSSEPPSRNNSDKPLCAGAALCHWCGTWKGDKICGGCKKSRYCSEKHQALHWRSGHKNDCLQIINSSEASSSVLPAVGKVPARTSWPEYQIAIDDEVDLDSDGCDENSSKSLVMQKHGKPDDTMQSWMDQFEADADNQCWAYFQERISRAPEQVLRYCRDPNVKPLWALSAGRPSNPDIPSCSYCKGPLCYEFQIMPQLLYYFGVRNEPDSLDWATIVVYTCKGSCDQSTSYKEEFAWVQLYPTSISRP

SEQ ID NO: 136233 - protein, 102 aa, Triticum aestivum
  unsure (1)..(102): unsure at all Xaa locations
  Clone ID: PAT_TA_30651.pep
SYNEKFPLVYESDKIGDSPYEEHGATLKHKCGKRIVTMPPSLFVFLFXLMGFFGPLFYLGFFGLSFFFLFFFFFMEQCSIMMIITLLFTYNSILQLDTRTKI

SEQ ID NO: 136234 - protein, 83 aa, Triticum aestivum
  Clone ID: PAT_TA_30652.pep
SFKCNYYEDHTELKKLSTDTMKGSLGAVVKLLPCDHEVTGSSPGNSLLQKCRERLCTIDPKWSDPSPDPAQAGATCTGAALFL

SEQ ID NO: 136235 - protein, 178 aa, Triticum aestivum
  Clone ID: PAT_TA_30653.pep
KKTKDMFLVYGGNKELVVNVYVDASFDTDPDDSKSQTGYIFLLNGGAVSWCSCKQSVVAGSTCEAEYIAASEATNEGVWMKEFISDLGVIPSASGPMKIFCDNSGAIALAKESRFHKRTKHIKRRFNSIRDQVKEGDIEICKIHTDLNVADPLTKPLPQAKHDQHQDSMGVRIITYVI

SEQ ID NO: 136236 - protein, 120 aa, Triticum aestivum
  Clone ID: PAT_TA_30654.pep
VRGTFQEPPTGLIPWFSKTEGNTYATIAASSFPLQGKPTQAQDVARRIYGTVVWEVFAQVKTYQVPITNSSPSHLHYLPFASRFSVPHFTLAVLFALSFPFVLLFASVAMCLLYDCIFAC

SEQ ID NO: 136237 - protein, 70 aa, Triticum aestivum
  Clone ID: PAT_TA_30655.pep
NNNDFLSTPIAPLNDVESCEINTALLNLVMKDQFTGLPSEDAATHLSCGLLMNLVPKMALLISIFTFRPS

SEQ ID NO: 136238 - protein, 142 aa, Triticum aestivum
  Clone ID: PAT_TA_30656.pep
LRSSLSLPRPPSPPSRGKTSRRSAAVVFVFPVHQIEPGRPIRPPSPTSSPRTSPSSAIVCHSSGPSPPPRPRYRFLNYETDAAAAPLDCGVDDPSFLPEQPDPKTAADALVIDYVTDDPSTLSAELPDAGAQEPDATIVDDS

SEQ ID NO: 136239 - protein, 87 aa, Triticum aestivum
  unsure (1)..(87): unsure at all Xaa locations
  Clone ID: PAT_TA_30657.pep
TTPVARVIRXTIGRLVPAPPXGSPLVNLRPPVYFYHICFSTYLLPCLFSDLLFQKPRNTLLHFFFTYFISCFIQIYLSNLIQINLSF

SEQ ID NO: 136240 - protein, 272 aa, Triticum aestivum
  Clone ID: PAT_TA_30658.pep
NYEINALIKKVSAVQEETNILQESMKEEVDDTVSSLDEKDEEESEEQKEEERIDHPCPPSNESNSSTHTLFNSPSCLPKDDCYDDCYDPVDSLEISLFDDACYACGQDANMNYAYGDELAIVPYVKHEIVAIAPTHDSPIIFLNSPDYTILEKFALIKDYIDGLRFTTTHDDFDEYNMHVLDAPTCNYYERGTISPPLYASHMIKLQETVYTMHWPLLCVHELFFYDMLMHRKRVRLCCCMIYVTLCSLLNYKSLLIKIGFDIPWDPGGFTT

SEQ ID NO: 136241 - protein, 138 aa, Triticum aestivum
  Clone ID: PAT_TA_30659.pep
AQGPAGPRGPLVPVRPDLLVPDAFGPGSCHQPGPMMVPIYTPSRKSRAHCSVFSGPRGRGHLGALAHLLCTQGVRWNARATLLKVSPLQARPSNFIFLNICLGLAVCHAPSPSSLPSITRAELIAGTTVVSLLFLSSF

SEQ ID NO: 136242 - protein, 97 aa, Triticum aestivum
  Clone ID: PAT_TA_30660.pep
GYRLVGKDHRSSPTATHKEGNQKIKHALTSSHNGSPYVHATGITNFNTSISQIHNYSTSTTLISPSLYLKTIIKHQTSHSIHNTHKKVFTILEHQAY

SEQ ID NO: 136243 - protein, 97 aa, Triticum aestivum
  Clone ID: PAT_TA_30661.pep
SKEPVREATEVGITHQGAPRWVVPPSGTPLVFSQARLGGLCPPQASLWYFFGPSCVYWSRKITKKFCCIWTPFGIDFPRCKKLGKKEQLALGTGSIG

SEQ ID NO: 136244 - protein, 151 aa, Triticum aestivum
  Clone ID: PAT_TA_30662.pep
NDAPSKTHIMWRIKIYPQVKLPMNEDERGDAFRGIPKLRLLVVLEYYLGVPWASPSLGSCHSLFHSPSNLYPKLENFTTQNSTENLVSSVSERKQNTTSRYCYELILYSYWCNIYCIQTSLWFLSSDTTHRFIKISKQHNENRICQKQNSL

SEQ ID NO: 136245 - protein, 186 aa, Triticum aestivum
  Clone ID: PAT_TA_30663.pep
HEYKGVEGKKIISADWLFLPLLLAAFHYSPTTRSNKVDQGGTSRITRSKERERGRRGCRETGGGARSTMKLPRTDRRSTAPLQLRRRPAALPRLQRRRRPASLSRLQPQDRPLLLSSNSCCCDLPDRRSLPLLLSPSSLLRGRGSTRGQGRRAFWCSTQDRLQRASAATLLCLQHLQLRIEDHQDP

SEQ ID NO: 136246 - protein, 187 aa, Triticum aestivum
  Clone ID: PAT_TA_30664.pep
MGWRWHDDGEGDGGRGGLGDIPDLAGRGGGEAAHVGTRRVVQSRCHTEEVEPGRFVRKCEKTEQLLRNCVGRPSELVESKTENTEEDVTDEMTGGASHSLGFPTKEPFAFPGLRSDIEAIEKGFGSFLDEAERMTNEFFKSFGFPTIHDGDSRPFPRQPAERHVGEGTVKKPNENEYSEFGSQITDV

SEQ ID NO: 136247 - protein, 188 aa, Triticum aestivum
  Clone ID: PAT_TA_30665.pep
MSAAATSVDIPVPQVEVAADAAVDAPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAHQEGDAGEEGRSGQEARGQEGQEVEAA

SEQ ID NO: 136248 - protein, 84 aa, Triticum aestivum
  unsure (1)..(84): unsure at all Xaa locations
  Clone ID: PAT_TA_30666.pep
GGLLWPLFLFGLLWPLLFIFKVWSLIPTYGGIIVSIILSSLGQCSNNDDHHTFIYLQLNIIXGYLEQSMLYMNASGGVPGCAMI

SEQ ID NO: 136249 - protein, 103 aa, Triticum aestivum
  Clone ID: PAT_TA_30667.pep
MAAATILPTPRDPAQKTRRRPLLPLRPRTRAGEYSVAGSPSSSSPAPTNSATPIRRPPVLLSPSPATVCLTMVEPRIHTTPPMTTTTPRVPPTTWRPPTTRSS

SEQ ID NO: 136250 - protein, 223 aa, Triticum aestivum
  Clone ID: PAT_TA_30668.pep
MVSEQTPVATEPELESGDAAPEVIKAEEPAEDGAPVVEDVKEGDGDEEEEEDEDDDEDDEDEDGELGVAGSEGSKQSRSEKKSRKAMMKLGMKPVTGVSRITIKRAKNILFVVSKPDVFKSPTSETYVIFGEAKIEDLSSQLQAQAAQQFRMQDLSKAMRPDAAAAAGAGAPADEEEVVDETGIEARDIDLVMTQASVSRAKAVKALKAHDGDIVSAIMELTA

SEQ ID NO: 136251 - protein, 100 aa, Triticum aestivum
  unsure (1)..(100): unsure at all Xaa locations
  Clone ID: PAT_TA_30669.pep
VLMSKQSWMHTHLVSFVELSYIYSSSASVAWQSLLLALTSIDGHLPSPLISHVNVRLYPFFCLLHTTPIILFYSTHRGMSMAHAHVMPLKVEKXPRLTKV

SEQ ID NO: 136252 - protein, 76 aa, Triticum aestivum
  Clone ID: PAT_TA_30670.pep
SVALPQIRCQLHDHAKKYDNDEACHNKRNSGKLHGNIFRNGYGNAIIGRYGGCFKEGIWWVYGTAVPTEAARYKRG

SEQ ID NO: 136253 - protein, 154 aa, Triticum aestivum
  Clone ID: PAT_TA_30671.pep
RPSPSSPSPPLDFVHTRDHSCCCLLDPVATGLTSSRQDVQELLHRLLLRPRLRARARRAGTLDIEHIFVGTSPGVRRRLPRLRSTSGLPDHIFELATPRPTPLLPSTTTVLTTPLSCQSNQMLEPRSPDATFDDDSYYTGGTYYYVQAADDDQE

SEQ ID NO: 136254 - protein, 103 aa, Triticum aestivum
  Clone ID: PAT_TA_30672.pep
WTKRLVRPTPRENTTEVDGDGLAGMKQGDLIIWYVEQQNAQGAYSSTEEVKEEVKCIKAIIERLIQREGHLVVIDEGTAAAEGATARASEHRILAVNPNYVID

SEQ ID NO: 136255 - protein, 81 aa, Triticum aestivum
  Clone ID: PAT_TA_30673.pep
LFLCLQINDIEPFCQGEIVLYKQYAEKRDKEIRERLQDSEYKLGFSMPLEDAKERVTQLQSELTLLERPRDEADAPVRLRS

SEQ ID NO: 136256 - protein, 88 aa, Triticum aestivum
  Clone ID: PAT_TA_30674.pep
IVGVTHWHARLGHPATPIVRSILHSHNLPIVSNKDAATVCDACQQGKSHQLSFSDSSRVVKTPLELIFSDVWGHAQTSVRVIIISQFY

SEQ ID NO: 136257 - protein, 153 aa, Triticum aestivum
  Clone ID: PAT_TA_30675.pep
YAIKNKDNHENCHHDFNFQLEYASHYSYFVEFAPTTIHEKKFAFVESNKISMLVDHEKNALCDSYIVEFIHDAIENYYEGGIYACRNCNNFKFPLYVLKIVKLCLFCLPMLVDYCSHKFFAHKIPMHRKWVRLKSASHMLHDAPVMFQFLSFM

SEQ ID NO: 136258 - protein, 103 aa, Triticum aestivum
  Clone ID: PAT_TA_30676.pep
NKEWQEPKLGDAHGTPKIIQGHQKVKAWGCPGRHPLFRPLPSVIYLELYFYSPHDMCFTWSVLYYLCRCMLVYHNHPCCTHLLREPYMIWNLLEYSMCFTYIF

SEQ ID NO: 136259 - protein, 213 aa, Triticum aestivum
  unsure (1)..(213): unsure at all Xaa locations
  Clone ID: PAT_TA_30677.pep
ERAKGLPWKEHRRQERDRSQREEDARTLAGMAEAIPESNVGFKMLKQMGYDPAARGAGAEPVGIEIRRSRAGLGAEPDASVAPLPQPSEPKTREEEERERKRQEEMVVXLRSRKSTQWKGRRLVWDFRKAEAALAHXENREVEPPAPDGEEKEKGEDEEEEVITEEGXKPYWISCVFNTTIAFTVDASLNQQEHWQMNALGLMKMITDPLCQW

SEQ ID NO: 136260 - protein, 146 aa, Triticum aestivum
  Clone ID: PAT_TA_30678.pep
RSVTPRPRLHRRRSPAPISSPAPPCAMVLVSAPVGPRPVYDSDVEVCESEMPTDPIVERLNLVEEENNLLKVKIKKKIEEEKMILELHVADVVDDHKIKMDAMRLKIRKIRKYAIHTEAWYHYAVGSIVTLVAIMIAFVFALKCFT

SEQ ID NO: 136261 - protein, 166 aa, Triticum aestivum
  unsure (1)..(166): unsure at all Xaa locations
  Clone ID: PAT_TA_30679.pep
MALASLALVAAVAPATTHLRFYMHDIVTAVAPSAATAVRVVRGLTPLPNDPTNRFGDMYTIDDALTEGPGAASPVIGRAQGFYLFASXTDAALLLSANMLFTAGKHNGSTVAVFARDAILDTVRELPVVGGTGAFRGAAGYGLLRTNTYNATTNNAVLQIDMYLHV

SEQ ID NO: 136262 - protein, 290 aa, Triticum aestivum
  Clone ID: PAT_TA_30680.pep
FLLRIDRLFSKKPQSKSRNDIKKTDEIIEDTEEQELFVERIRLEKIELSIKNLMSKMTIQEPTFDRMIVVYRQAGMKAKPSRGIFVKHFKNIPMADMEIVLPEKKNPTLTPMDWVKFLISAVIGLVTLVGSLEMPKADVWVVIAIMSGVIGYCAKIYFTFQQNMTLYQNLITKSMYDKQLDSGKGTLLHLCDDVIQQEVKEVIISYYILMEQGKATIQDLDLHCEELIKEEFGAECNFDVHDAVKKLEKLGIVHRDSIGRILCAPLKRANEIIGTTTEEMVMRAQQNPAS

SEQ ID NO: 136263 - protein, 201 aa, Triticum aestivum
  Clone ID: PAT_TA_30681.pep
HCPLFIFLFSFFWPFIFWPFFLFRIFFFFFFSFFFLFLAFLFYLFIWGQCSNNDDHHTSIYLQLMNYNSKLEQNMTLCECLRRFTGMGNESRVTCMINYAWWLCHKYDVNYMIMQGKYDNDDVCHDDKRNGGKLHGNISRNGYRNAIIGRYGGCFEEDIRRFMCEECMIITGFGCTGEVCTKSQVEKGQCMVLKRLAMMEG

SEQ ID NO: 136264 - protein, 74 aa, Triticum aestivum
  Clone ID: PAT_TA_30682.pep
EKPLVKPMAPGSILIILIFQHLAIFFAFYFTLHLYHKNTKNIILSYLSDLTLVSDRVGIDNPLSRWLRGFICFV

SEQ ID NO: 136265 - protein, 438 aa, Triticum aestivum
  Clone ID: PAT_TA_30683.pep
MSPIGMCPSMMSNALKIAPIGKDNNWSKYDQVFSNSNQSLGAAFQHSQSYQDRKSDHMSSSPGTLTGPEFLWGSPKPYPEHSQSSSMWRPPPVGHAMSSSSRPQGQGFLYGSRQASLFGSLDQNRHHVGSAPSGAPFESHFGFLPESPETSFMNQVRFANMGNIGGANRNGGSLMLNMASRASLNPVSALSGSLTDNNSTNFRPVPSPRLGQPPFFGNTTYQGPGYYGLDSSSIERGRNRRVDSSAFQADSKKQYQLDLDKIRKGEDTRTTLMIKNIPNKYTSKMLLAAIDELHKGTYDFFYLPIDFKNKCNVGYAFINMISPVHIVSFYQAFNGKKWEKFNSEKVASLAYGRIQGRNALISHFQNSSLMNEDKRCRPILFHSNGPETGNQEPFPNGICIHMPLDGGAGSSKEPLGFEEDDNPSEIKISGEKSMVGSL

SEQ ID NO: 136266 - protein, 79 aa, Triticum aestivum
  Clone ID: PAT_TA_30684.pep
LMLSPWIIRTLTLPPLLASLIPCTFRRYHTPTIYLPQNSHHTYLLWHFHSHSEIYCHATFHRSVYYDTLYHCHIACMIM

SEQ ID NO: 136267 - protein, 92 aa, Triticum aestivum
  Clone ID: PAT_TA_30685.pep
PPPVLHAMAMLKKNTSSLSFVMVALMVVMAATLLYSCDARKVKDKPTAFPVAGKCFSRFFANCTEPRCKKFCVQPLPGAVCIDKNHCCCPIA

SEQ ID NO: 136268 - protein, 226 aa, Triticum aestivum
  unsure (1)..(226): unsure at all Xaa locations
  Clone ID: PAT_TA_30686.pep
MAAAAAAVRCAEQLVEREMSGRDASHDAAHALRVRDLALSLAAEQGVSSPDRLLIVELAALLHDIGDYKYTKDNVEDMSIVKRFLEEVGLEEGQREEIVAIITGMGFKNEVSNKLNAEPTLEFAIVQDADRLDAIGAIGVARCFTYGGSKNSALHDPNVLPRDNLSKEKYMSKEEKQTSINHFHEKLFKLKDMMKTXEAGKKRAEKRHKFMENFVAEFYEEWSGRA

SEQ ID NO: 136269 - protein, 88 aa, Triticum aestivum
  Clone ID: PAT_TA_30687.pep
TKTKEGMPSGGISKLRLLCTLEYLRVPWESPSLGSCHSLFHSASNLYPKLENFTTENSTGNLISSISERKQNHHIRYCNELILYLFWC

SEQ ID NO: 136270 - protein, 96 aa, Triticum aestivum
  unsure (1)..(96): unsure at all Xaa locations
  Clone ID: PAT_TA_30688.pep
GKPIVGIYKPKXYNEKFPLVYESDNIRDSLYEEHGATXKHKCGKRIVTLTLFXLXFSFSFFWVGFFGPLFYLGFFGLSFFFSFFSFFFFFSWGNAL

SEQ ID NO: 136271 - protein, 94 aa, Triticum aestivum
  Clone ID: PAT_TA_30689.pep
ELTIPRSLTSTHKEGNQKNTPCFKFVTQRLPYVHATGLANFNTSISQFHNYSTSTTLVSLSPYLKTIIKYQTSHSIQCTLYESFYYIPLGCPSY

SEQ ID NO: 136272 - protein, 414 aa, Triticum aestivum
  Clone ID: PAT_TA_30690.pep
SAHNKQQALDGNMFINYIGRKCCDLGIQMNKTACFVHLSAMSVLSDPHQLYEELNKAKQAAVKKNQKLQLLFCPMSEQHPGYKTLKLICETQLGIQTQCFLSHLANKTQGQDQYMSNLALKINSKLGGINVQLQDKLPLDNGVPYMFIGADVNHPSPGNVESPSIAAVVASMNRGATKYVPRIRAQPHRCEVIKNLGEIVQELIGVFEKKAAAKPQRIIYFRDGVSDGQFEMVLNEELADMEKVIKVKGYSPTITVIVAKKRHHTRLFPKEHNEPLQTKNGNVLPGTVVDTRIVDPVTYDFYLCSHNGLIGTSRPTHYYNLMDEHGYGSDDLQRLVYNLCFVFARCTKPVSLATPVYYADLAAYRGRLYYEGMLASQPQVRSSSSSASSAAAGASDFSNFPMLHVDLQDNMFFI

SEQ ID NO: 136273 - protein, 124 aa, Triticum aestivum
  Clone ID: PAT_TA_30691.pep
LMLSPWIILTLTLPPLLASLIPRTFRRYHTPTIYLPQNSHHAYLLWHFHSHSEIYCHATYHRSVYYDTLHHCHIALHDHVVDTVFVAKPPFIILSYMSLLIHCISRYTAGGIHIESYFVLSIEL

SEQ ID NO: 136274 - protein, 152 aa, Triticum aestivum
  unsure (1)..(152): unsure at all Xaa locations
  Clone ID: PAT_TA_30692.pep
VPPWPHSRSHPLPPSPRRSPLQFRPTPERLRCRCCRRPRXHHRPPRRAGRSGGTAVVYFVFLAHEVKPGAPTSTGSRSSSTSAPLLAVFDSASSEPPRARFAHLQARYPETDVDVPVIDYIDDDPPSCLSNQARPPPFDHPDIAHPILSCLH

SEQ ID NO: 136275 - protein, 85 aa, Triticum aestivum
  Clone ID: PAT_TA_30693.pep
LYMNASGGVPGWCNESRVTCIKNNAWWLCHKYDVNYMIMQWQYDKSKGCHDDDKRNGGKFHGNISRNGYGNAIIGRYGGCFEEGI

SEQ ID NO: 136276 - protein, 157 aa, Triticum aestivum
  Clone ID: PAT_TA_30694.pep
RTLARVQIHLAVRPHHHGRPHPHTHLAPRCTCFLQKNNRRLPRLLEPPVGVEALCINHDDVFFILVTDRCPAVDSPISEPPQSHPGPPSSSPPALPMTTRPTLLLPSSTTELTTPPSCQEQPVVEAQGDGRHCRRRLLLPLEVPTTTCRPLTMTRSS

SEQ ID NO: 136277 - protein, 155 aa, Triticum aestivum
  Clone ID: PAT_TA_30695.pep
EKPLVKPMAPGSSFSYYLPLRSTFLLHLFLDLLIQKTLKYLAAIFPYLFYLAFDLSINYNLSHVCLPILRCRTPKGIDNPFNTSGCKDLLSVSRGCLRCVAWFSYWFDNLGFISEGNTYRRYAASSLPLWGNNDVASSRIMHPGLDLHLFVVPFA

SEQ ID NO: 136278 - protein, 116 aa, Triticum aestivum
  unsure (1)..(116): unsure at all Xaa locations
  Clone ID: PAT_TA_30696.pep
PGQGQQIGQWQQXGYYPTSPQHPGQGQQPGQVQKIGQGQQPEKGQQLGQEQQIGQGQQPEQGQQPGQGQQPGQGQQGYYPTSLQQPGQGQQPGQXQQPGQGQQGYCWKYALEAIIN

SEQ ID NO: 136279 - protein, 171 aa, Triticum aestivum
  Clone ID: PAT_TA_30697.pep
MQSYDEKLNLEASIPRKLNDEWEPTIEIKIKGHECFALCDLGASVSTIPKTLCDILGFHDLDDCSLNLHLADSTIKKSMGRINDVLIVANRNLVPVDFIVLGIDCNLSCPIILGRPFLRTIGAIIDMKEGNIRFQFPLKKGMEHFPRKKVKLPYESIMRATYEFNAEDGTR

SEQ ID NO: 136280 - protein, 184 aa, Triticum aestivum
  Clone ID: PAT_TA_30698.pep
DYLLLFVFPTPPIPIPRPWRPGACDVGPNSPYSESLINFHHENSHPPFTPFSSSFFFSAFGAGVSVFPLYLLIMMGLLFRYSRFCRFCSFSVFFVCADWSLHFLLAPLMLSQSPTHSIHPPHISHITLLSSLSSPPAYLFFFSLYLFLFASRVRSQSCFSSFHLFLFSPLPLTISLFVLCLFFY

SEQ ID NO: 136281 - protein, 97 aa, Triticum aestivum
  Clone ID: PAT_TA_30699.pep
VCEFFMANVDSMDYTHSHLPPLLASLTPRTFRRYQSPTIYLPQNSHHTYLLWHFHSHSEIYCHATYHHSVYYDTLHHCHIALHDHVVDFIFVANPPS

SEQ ID NO: 136282 - protein, 222 aa, Triticum aestivum
  Clone ID: PAT_TA_30700.pep
MVSEETPVATEPELESGDAAPEVVKAEEPAEDGAPVVEDVKEGDGDEDEEEDEDDDEDDEDEDGELGVAGSEGSKQSRSEKKSRKAMMKLGMKPVTGVSRITIKRAKNILFVVSKPDVFKSPTSETYVIFGEAKIEDLSSQLQAQAAQQFRMQDLSKAMRPDAAAAGAGAPADEEEVVDETGIEARDIDLVMTQASVSRAKAVKALKAHDGDIVSAIMELTA

SEQ ID NO: 136283 - protein, 118 aa, Triticum aestivum
  Clone ID: PAT_TA_30701.pep
YPILHLCFKVAPCFSYGRVSLCCHFHILVGIFNIGLDAHPLSFFLSFHTFIALVHPLHGNPYSLTLIYIDGHLHSPLIRLVDVRISSPFCLLHNHHSIPPIVLYPWLTLMYCVKIEKV

SEQ ID NO: 136284 - protein, 191 aa, Triticum aestivum
  Clone ID: PAT_TA_30702.pep
WRLKRWGVEWASHPVHQDAQVQNQNNLLQAQQALVNVKLENTMDSQINSPYGSLTRQQQQQMQQLRHQQLLQQQQQKQLQQQHVLQLQQHHQQQQQQQQQLQQHHHHQQQQLQQHHHHQQQQLQQHLGMSGNQSAQAQLAQQFKQASQSMNSYGMRVPPVKVEVFHELVSGDSVQRHQQTHISQVDHPSLC

SEQ ID NO: 136285 - protein, 104 aa, Triticum aestivum
  Clone ID: PAT_TA_30703.pep
YKLYITSQGPQGLEYISSNTQESVKATISEYRHKLDKFALRRLAQKQQRLKRQGLLPGSLLTTPDCQRPSCSSRHPHGSSSHQRCCLAPGIRYLVATIGYGEKD

SEQ ID NO: 136286 - protein, 431 aa, Triticum aestivum
  unsure (1)..(431): unsure at all Xaa locations
  Clone ID: PAT_TA_30704.pep
MAGSEQRVVAVIMVGGPTKGTRFRPLSLNVPKPLFPLAGQPMVHHHISACRRIPNLAQIYLIGFYEEREFALYVSSISNELRIPVRYLREDKPRGSAGGLYSFRDYIMEDTPAHIVLLNCDVCSSFPLPDMLEAHKKYGGMGTLLVNKVSAESANQFGELVADPETNELLHYTEKPETFVSDLINCGVYIFTPKILIAIEDVLKQKKDRANLRRVSSFEALQSATKAIPADYVRLDQDILSPLAGKKELYTYQTLDFWEQIKTPGMSLRCSXGLYLSQFRHTSPHLLASGDGKKGATIVGDVYIHPSAKVHLTAKIGPNVSISANARIGAGARLISCIILDDVEIMENAVVIHSIVGWKSTVGKWSRVQGEGDHNAKLGITILGEAVDVEDEVVVTNSIVLPNKTLNAKCAKMRSSYNIPCTTTYLYLIPE

SEQ ID NO: 136287 - protein, 120 aa, Triticum aestivum
  Clone ID: PAT_TA_30705.pep
LSNRAATVGFVDADGSGKWLDAELLAPLLGAVREKPREALPRHEESGGLILHFAGVARGEEKGGSHDHHEGGHDEAQGARVLLQQRHGVQYRRRLATLTYLRTTVVAFVVFDIGVPGLAG

SEQ ID NO: 136288 - protein, 382 aa, Triticum aestivum
  Clone ID: PAT_TA_30706.pep
FCLVQKVGQTVIVGKRPLKGHGSVIIQLGVPIIEGPLEDENQRETTRVEPVPGLLHDLFDRFFRQGIVPFKPDYCVVDFYYEEEYSHPQQPPSWYGRPLCTLCLTECDMVFGRVIFGERGDNRGPLKLSLSTGSLVVLQGRSADVAKRAIPATRKQRILLTFGKSVARKVAPSESASRPTAPLTPPSMPWGPPSRPANVRPHSPSPQHFGYTPTSSVLPAPTTGPHHIPPSDGMQPLFVAPAPVAAAAIPFPAAVPLPNATAAWMPEAAPRPAPPRFPVPGTGVFLPPGSAHQLPHQMIQASQAHAEPNSPRGSAAYVHNKGTVMEVANGSASPKSSGTTKRADTTEAKPECNGSSSSVGEEQQNGGMKNAGLSKVEPSAAK

SEQ ID NO: 136289 - protein, 112 aa, Triticum aestivum
  Clone ID: PAT_TA_30707.pep
LSNRAATVGFVDADGSGEWLDAELLASLLGAVWEKPREALPRHGGSGGLILLFAGVARGEEKGGSHDHDEGGHDEAQGARVLLHYRHGVQYKMRCYTYVRTYYSSCLLCVLI

SEQ ID NO: 136290 - protein, 446 aa, Triticum aestivum
  Clone ID: PAT_TA_30708.pep
EDTQKKEQELEIKGDIMTDDQKANTDKVNQQEVVEQKDPKNDETAGKSVKKMDDNETKDKDQKMDSKKKSPIDTKEKKKSDEPPKHPGFILQAKKSKEYKLRSTSLSLDGLLDYTANDTEESVFELSLFAESFSEMLQYRMGCVILSFLEKLYRQYVVRRNQRKRQREEDLKKEDTISLEKRLKTTDENVTGSTSGNPGKNDETIKEGGEKIIGDNSSASHEQLVKEDDEKMSTDHAAQDEMMKEGEEKIDADQSAAACDEPKADEKMEEEDPEYEEDPDEVEYEGDEDMDDATAEEPAEAQNEDNSNERETKPEEVTAEDDGKRTTENLKLEKTEEDKQSVAEKGDLKEVEEKSVGKEGKISGSQKGDSAKHDVVDKDLLQAFRYFDQNRVGYIKVDDLRCILHNLGKFLSNRDVKDMVQIALAESNSSRDGRIIYTKLVKKADL

SEQ ID NO: 136291 - protein, 203 aa, Triticum aestivum
  unsure (1)..(203): unsure at all Xaa locations
  Clone ID: PAT_TA_30709.pep
PGEVPQKYPRGGSTWTAVQGTSLKYLXRLKDMFLXVYGGDKELIVRGYVDASFDTDLDDSKSQTGYVYILNGGAVSWCSCKQSVVTGSTCEAEYMAASEAAHEAIWVKEFITDLGVIPNASGPIKLFCDNTGAIALAKEPRFHKKTRHIKRRFNSIRENVQDGDIEICKVHTDLNVADPLTKPLSRAKHDQHQNSMGVRFITM

SEQ ID NO: 136292 - protein, 676 aa, Triticum aestivum
  unsure (1)..(676): unsure at all Xaa locations
  Clone ID: PAT_TA_30710.pep
MAQDNTKLCDFSNTDNNDFLSTPIAPLNNDESFEINXAVLNLVMKDQFAGLSXEDAATYLNNFVDLCDMQKKKDVDNDIVKLKLFPFSLRDRAKTWFSSLPKNSIDSWNKCKDAFISKYFPPAKIISLRNDIMNFKQPDHEHVAQAWERMKLMIRNCPTHGLNLWMIIQKFYAGLNFASRNLLDSAAGGTFMEITLGDATKLLDNIMVNYSQWHTARSTNKKVHAIEEINVLSGKMDELMKLFATKSVSSDPTDMPLSTLIENNNESMDVNFVGRNNFGNNAYRGNFNPRPYPSNPSNNYGNSYNNSYGNYNKMPSEFETSVKEFMNSQKNFNALLEEKLLKVDDLSRNVDRISLEIDSLKLKSIPPKHDINESLKAMRISIDKCKERTARMRAKKDAFMKACSSSSYENNDEDLKVIDVSPIKSLFCNMNLDNDRTEYDPSLPRRRSKNSEFIGPDAKFDKSGIEEIKTLDVAKPTISDFKEFDYDNFSLEGCISLLQSVVNSPHAYSQNKAFTKHIVGALMQSYDEKLNLEVSIPRKLNDEWEPTIKIRIKDHECFALCDLGASVSTMPKTLCDILGFHDLDDCSLNLHLADSIIKKPMGRINYVLIVANRNLVPVDFIVLDIDCNLSCPIILGRPFLRMISAIIDMKEGNIRFQFPLRKCMENFPRKKIKLPY

SEQ ID NO: 136293 - protein, 117 aa, Triticum aestivum
  Clone ID: PAT_TA_30711.pep
KDSSIFPYIYFFIFYLAFPFFIWPFFFIWPLLFLAFLLFLGQCFNNDDHHTFIYLQLNDYNSILEQNMTLYECLRRYTGIGNESRVTCMKNYERWFCHKYDVNYMIMQSNMTMMNMS

SEQ ID NO: 136294 - protein, 125 aa, Triticum aestivum
  Clone ID: PAT_TA_30712.pep
DPGRQEEVRNGPEVKIYIWEVLFWSPEKFRVISVMYLDHREGPGGPPSGATSPRRLRGPSVGGDQPRVGWCAPHQGPRRMGEWEGANPRSRWALRPTLVAPPSPPLGRPPRWDVGLAASPWGWKP

SEQ ID NO: 136295 - protein, 237 aa, Triticum aestivum
  Clone ID: PAT_TA_30713.pep
MSTEVAAADIPVPQVEVAADAAVDTPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAAAKPKAAAKPKAKAAAKKAPAAATPKKPVARKPPTKRATPVKKAAPAKKPAAKKAKK

SEQ ID NO: 136296 - protein, 148 aa, Triticum aestivum
  Clone ID: PAT_TA_30714.pep
ARAEFGTRIFSPLLCPSLSSPRSTATVAVNAGAHAPHHALRACPLGAAPSSASTPTAGTIQERPRPRERPRPRLPRRRLRRAALSPSCATKLSQAFLSRPTTRPTLLPPRSTTELTTPPSCQSNQMTDPRSQTTPPMTTTTRRMPTTA

SEQ ID NO: 136297 - protein, 84 aa, Triticum aestivum
  Clone ID: PAT_TA_30715.pep
CTFIVTQLRCDVWYTQSTPTVSGSYTISWSKEKILDIGKALANELHDLCAMLRIGSCPSHHSPNDVIPLSMTSNVHSQETMTIC

SEQ ID NO: 136298 - protein, 306 aa, Triticum aestivum
  Clone ID: PAT_TA_30716.pep
MARGSAAPVVVAVALAAVLLLLVAPAAEAAGQKKPATAARREDVPYIRCQVCERIAREISAQVAAKQQALPPSKKVPEIEIIDIAENVCNLKKQEADWMLRIDIVEKGDRLELVDQDEEGHCNSECKTIERACQEVMGYADTDVAEFVYTNKPSVDQLIKFVCKDITKACAADPPPVPKDRVPGEPFAAKPSKDAEMEKIMRSMEGMPGAPNMKMYSRDDLMKNNFGVEGDEDDEDDDEDEDSLPKNLGNILKNKGPQKKDLKQQVVKQIKDTGKKLKGHVSKVSKAVKNWWKGKKKPAKSSKSEL

SEQ ID NO: 136299 - protein, 138 aa, Triticum aestivum
  Clone ID: PAT_TA_30717.pep
STDRSVSVCGAPSTIFHLGHIVAEFRRSPAPVEHHHSHHAVRANGTHPRSFAGSEPGDSHRAERVLNSEVSYVRYLDRSDREDVRLHQPRCHNASAFGLQWYVKYTLLPSRCYAITMILRVRRKFFEITTFPNSGIRA

SEQ ID NO: 136300 - protein, 99 aa, Triticum aestivum
  Clone ID: PAT_TA_30718.pep
DKLPTHHRRGYGVDVEALYDRCPSSGAPEQAPRWDLTGTEGCGGGIRFLAPYLVVWGYVGIYRRKKYVGGATWGPRGWRARRGGRHAPLPRGFLVDVLM

SEQ ID NO: 136301 - protein, 114 aa, Triticum aestivum
  Clone ID: PAT_TA_30719.pep
IKSDMYERIMKVALPQIRCQLHDHVKQYDNDGACHNKRNGGKLHGNISRNGYGNAIIGRYGGCFEEGTMVGCRSRGKLCTREARNGGRLRVRIIHGLNVSHKELTNLLQTSSSH

SEQ ID NO: 136302 - protein, 178 aa, Triticum aestivum
  Clone ID: PAT_TA_30720.pep
GRVGGRVGRKILSVQLKKLVASGKLTKVKASYKLSAAAAKPKPAAKKKPAAKKKAPAKKTATKTKAKAPAKKAAAKPKAKAPAKPKAAAKPKPKAAAKPKAKAAAKPKAAAKPKGRPAKAAKTSAKDAPGKKAPAAAAPKKAAARKPPTKRSTPVKKAAPAKKAAPAKKAPAAKKAKK

SEQ ID NO: 136303 - protein, 177 aa, Triticum aestivum
  Clone ID: PAT_TA_30721.pep
IRSFYPRKLYDEWESTIKIKNKNHEGYALCDLGASVSTIPKTLCNVLGFREFDDCSLNLHLADSTIKKPMGRINDNLIAENRNYVPVDLSVPDIDCNPSCPIILGRPFLRTIGAIIDMKEGNIRFQFPLRKGMEYFRRKILNYLMNLSCGLLMDCLPKMAIPRSILRLLCLARGVKR

SEQ ID NO: 136304 - protein, 290 aa, Triticum aestivum
  Clone ID: PAT_TA_30722.pep
MSTDAAAADIPVPQVEATADPVVETTTDAPAGDAKTTKATKAKAAKTPKAPKVKKPSAPRKPKAAPAHPTYAEMVAEAIAALKERGGSSTVAIAKYIEDKHKAHLPANFRKILLTQIKKLVAAGKLTKVKGSYKLTKAPAAPKKPKTKAPAKKKPAAKKAPAKKPAAKSPAKKKPAAKPKAKAPAKTTKAAAKPKAATKPKAAAKTKAPAKTTKAAAKPKPAAKTKAPAKPRGRPAKAAKTSAKDAPGKKAPAAAATPKKAAPRKPPTKRSAPVKKAAPAKKTPAKKAKK

SEQ ID NO: 136305 - protein, 135 aa, Triticum aestivum
  Clone ID: PAT_TA_30723.pep
LAIPLLFRHSAVQSTYDSLIPFDTNAYICSVAPCLRVLWMSTHGFFAPPFPPIPSTWLSQPDVGAQDPDATVDDDYYYSGGAYYYVQTADDDQEWFGRIPGRRPAPLSICIPVCDSLLKATCLTDVCTQDIVAFR

SEQ ID NO: 136306 - protein, 263 aa, Triticum aestivum
  Clone ID: PAT_TA_30724.pep
MDAKKFLQMVEDKKKRLLEKKEAPLKWQQKLEAAIKATEEKEKKLKSKKHRRRSYSSSESDSESESDSDRKHRKRKDRKRHRKHGHSDSDGARRRKHRSKRRSLDSSDESDSDEYDSESEEERPRKKHSHRRKHHRHSPRSESDASDYSSDDDERRSTRKDHTRSRRRRHRSLDDESEDKIRSRHRKRHRSSDEDKPSDSDIHKRHRSRSMSLDDGAAGEPDKMNDGKGSHKSRHHRRHHHHHHDHHGNSAEPSDGEATRVSC

SEQ ID NO: 136307 - protein, 113 aa, Triticum aestivum
  Clone ID: PAT_TA_30725.pep
NLRQRDLLTERDPGDLDLTPRSFQGGHEVGGRPPGRAPCLVGPSELHRRSPSSYIYLRTPIRPKREPKNLIPPPQLPVSTRSHLGACSGALLARASITEGFYINTIALPMKCE

SEQ ID NO: 136308 - protein, 79 aa, Triticum aestivum
  Clone ID: PAT_TA_30726.pep
PIAGPGCPYWLLHILRRSLSVRPHNNIRCSLCHRYVTCLRLDRRYPIPSSISLPASLFTRFVIHHFATNSLVIMLARLM

SEQ ID NO: 136309 - protein, 148 aa, Triticum aestivum
  Clone ID: PAT_TA_30727.pep
KPAAKKKAPAKKTATKTKAKAPAKKTATKTKAKAPAKKSAAKPKAKAPAKTKAAAKPKAAAKPKAKAPAKTKAAAKPKAAAKPKGRPAKAAKTSAKDAPGKKAPAAAAPKKPAARKPPTKRSTPVKKAAPAKKAAPAKKAPAAKKAKK

SEQ ID NO: 136310 - protein, 223 aa, Triticum aestivum
  Clone ID: PAT_TA_30728.pep
EERISNPCPPSNESNPPTHTLFNSPSCLPKDDCYDDCYDPLNLFEISLFDDACYASGQDANMNYAYGDELAIVPYVKHEIVAIAPMHDSPIVFLNSPNYTISEKFVLIKDYIDGLPFTTTHDGFDEYNMYVLAAPTCNYYERGTISPPLYVSNTIKLQETVYTMHWPLLSVHELFFYDMPMHRKRVRLRCCMLYVTLCSPLNHKSLLIKIGFDIPWDPGGSIT

SEQ ID NO: 136311 - protein, 455 aa, Triticum aestivum
  unsure (1)..(455): unsure at all Xaa locations
  Clone ID: PAT_TA_30729.pep
MDTECRGPQQGGSSCWATGAAAWSSSQQKRQRCEGSSSDQVGSSTSASVQMSESELPDTDYAENEEEDYYMDDDDDDCDDDNGDDSEYEFDEADFNQQLADKFDDLDLPPGVEATVPWLQKLAANDEQDGASDELVEDEITRKYKAFQQFYTVQNFSDHHYANKSVGKTSREWAKRIQHDWKLLEKDLPASIFVRVAEDRMDLLRAAIIGPKGTPYHDGLFFFDAHFTSNYPSEPPLVYYHSGGLRLNPNLYNCGKVCLSLLGTWSGSGCEKWNSAHSTMLQVLVSIQALILNEKPYFNEPGYAGSANTATGQQHSVEYNKNTFLHSCRTMLYSLRRPPEHFGDLVAXHFRERGRTILAACKHYLEGNMVGSEVPEEEEAEYDGTGASSSSSSSRSSSSVPKKQEVMRVDPLGRRTQFTDNLKTLFEDLLMEFNVKGADTRKFLEDKVKKNLPAA

SEQ ID NO: 136312 - protein, 127 aa, Triticum aestivum
  Clone ID: PAT_TA_30730.pep
LYMNASGGVPGWCNESRVTCMKNNAWWLCHKYDVNYMIMQWQYDKSKVCHDDDERNGGKLHGNISRNGCGNAIIGRYGVCFEEDIRRFMCDRAYHITGFGCTGEVCTNSQGEKGQCTVPKRLAKVER

SEQ ID NO: 136313 - protein, 433 aa, Triticum aestivum
  Clone ID: PAT_TA_30731.pep
INLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALSPAFSTAELKRYFAFAKSLKPQLSSEAKKVLVESYVVLRRGDSTPGTRVAYRMTVRQLEALIRLSEAIARSHLERIVLPAHVRMAVKLLKTSIISVESSEVDLSDFQDAPLDHDDEQPVQGDATQQDGPDEPAEVIKKKLVITEEHFQRVTQALVMRLRQHEESVKKDGDVLAGMKQGDLIIWYVEQQNAQGAYSSTEEVKEEVKCIKAIIERLIQREGHLVVIDEGTAAAEGAAARASEHRILAVNPNYVID

SEQ ID NO: 136314 - protein, 293 aa, Triticum aestivum
  Clone ID: PAT_TA_30732.pep
MRSSRLLLVPHPHPHASHRTRPTSSGTCAPRTRLHAPPEKRNAQIPYTRYPNRRREEKESELCGGAMSGAGEYQEMAASVPPALKAITLTHVRYHRGDRVGLFLAWVSLIPVFISLGGFISHFMFRRELQGICFALGLLVSQVLNELIKHSVAQSRPASCELLETCDSHGWPSSHAQYTFFFATYLSLFVLRRSPASRVMAAFSWPLAFLTMLSRVYLGYHTVPQVFAGAVVGLVFGAIWYWFANTVLAQYFPMIEESAIGRWFYIKDTSHIQDVLKFEYDNARAARKKVATD

SEQ ID NO: 136315 - protein, 285 aa, Triticum aestivum
  unsure (1)..(285): unsure at all Xaa locations
  Clone ID: PAT_TA_30733.pep
MSTDAAAADIPVPQVEATADPVVEXTTADAAAGDAKATKATKAKAKAAKTPKAKKPSAPRKPKATPAHPTYAEMVTEAIAALKERNGSSTVAIAKYIEDKHKAHLPANFRKFMLTQIKKLVAAGKLTKVKASYKLTKAPAAPKKPKTKAPAKKKPAAKKKAPAKKPAAKSPAKKKPAAKPKAKAPAKTTKAAAKPKAAAKAKAPAKTTKAAAKPKPAAKTKAPAKPRGRPAKAAKTSAKDAPGKKAPAAASTPKKAAPRKPPTKRSAPVKKATPAKKAPAKKAKK

SEQ ID NO: 136316 - protein, 261 aa, Triticum aestivum
  Clone ID: PAT_TA_30734.pep
MDAKKFLQMVEDKKKRLLEKKEAPLKWQQKLEAAIKATEEKEKKLKSKKHRRRSYSSSESDSESESDSDRKHRKRKDRKRHKRHGHSDSDGARRRKHRSKRRSSGSSDESDSDEYDGESEEERRRKKHSHRRKHRRHSSRSESDASDYSSDDDERRSTRKDHSRSRRRRHRSSDDESEEKIRSRHRKRHHRSSDEDKPSDSDNHKRHRSRSMSLDDGAAGEPDKMNDGKGSHKSRHHRRHHHHHHDHRANSAEPRDGKQLV

SEQ ID NO: 136317 - protein, 146 aa, Triticum aestivum
  Clone ID: PAT_TA_30735.pep
SRGRSTLVILISSRSIKQEVGYYLHREGPNLGKHRVPCLLLPSGLDAQFGTPYPRSAGFDTDTHVLLQLPCSHADTSCPNCPVRRLPCAAFQDPGRSRHAPEMELRRSSPPPIASALARTSRPRPPRQTVSPLPSPASSSRPQRPR

SEQ ID NO: 136318 - protein, 174 aa, Triticum aestivum
  Clone ID: PAT_TA_30736.pep
CLYNDHCLDIGIITRCFINCPTVICLPIICYFLREATSEIYGSRVYFPIIYLQIYIAICLFLYLHLLFSDLYYQKPKKYLAEFYLSLFYLHLPNLSIYPIFYPRGIDNPSYTSSCKYLFFVCRYRLHMLLGSPTQTNKNLATNAIKGLSIPSRSLTRVRSDRYDKINIFGIFMI

SEQ ID NO: 136319 - protein, 127 aa, Triticum aestivum
  Clone ID: PAT_TA_30737.pep
LYMNASGGVLGWCNESRVTCMKNNARWLCHKYDVNYMIMQWQYDKSNVCHDDDKWNDGKLHGNISRNGYGNAIIGRYGGCFEEDIRRFMCDRAYRITGFGCTGEVCTNSQGEKGQCTVPKRLAKAER

SEQ ID NO: 136320 - protein, 77 aa, Triticum aestivum
  unsure (1)..(77): unsure at all Xaa locations
  Clone ID: PAT_TA_30738.pep
GKDDEDYDSPTSRDETSDFTKRKRKRKKRERPKRKKRKAKEKKRKKKXNKRKRXXINERKREKGQCYYIFFHTCASK

SEQ ID NO: 136321 - protein, 114 aa, Triticum aestivum
  unsure (1)..(114): unsure at all Xaa locations
  Clone ID: PAT_TA_30739.pep
ASKLDAHPLSFFLSFHILIALVHLLHGNPYSFTLISIDGHLHTPLISRVTVRLSSFFDFPLLMSITTFYSTPKCYRHGLRSCIAWRLKKLKRVKRYEPIGSACHXGCTWTNTLG

SEQ ID NO: 136322 - protein, 140 aa, Triticum aestivum
  Clone ID: PAT_TA_30740.pep
DFRLYKKKQKGKKKKKKKKDQKKEEGQRKKKKKKRKGKNKMREKERRDNATISFSTLVLQSSTMIFMIESLLCYHFHILVGIFHYRTWLVYSNDGLPQNALGLREQASWMHTHLVSFVELSYIFIALVHPLGWQSPTHSH

SEQ ID NO: 136323 - protein, 290 aa, Triticum aestivum
  Clone ID: PAT_TA_30741.pep
MSTDAAAADIPVPQVEATADPVAETTAAAAAGDAKPAKATKAKAAKTPKAPKAKKPSAPRKPKATPAHPTYAEMVSEAITTLKERGGSSTVAIGKFIEDKHKAHLPANFRKIMLTQIKKLVAAGKLTKVKASYKLAKAPAAPKKPKTKAPAKKKPAAKKKAPAKKPAAKSPAKKKAAAKPKAKAPAKTKAAAKPKAAAKPKAAAKTKAPAKTTKAAAKPKPAAKAKAPAKPRGRPAKAAKTSAKDAPGKKAPAAAATPKKAAPRKPPTKRSAPVKKATPAKKAPAKKAKK

SEQ ID NO: 136324 - protein, 291 aa, Triticum aestivum
  unsure (1)..(291): unsure at all Xaa locations
  Clone ID: PAT_TA_30742.pep
MSTDVVADVPAPEVAAAADPVVETTAEPAAGDAKPAKETKAKAAKAKKPSAPRKPRAAPAHPTYAEMVSEAITALKERTGSSPYAIAKFVEDKHKAHLPANFRKILSVQLKKLVASGKXLTKVKASYKPVCPPRPSPSPAAKKKPAAKKKAPAKKTATKTKAKAPSQEDRYQDQGQGXAKKSAAKPKAKAPAKTKAAAKPKAAAKPKAKAPAKTKAAAKPKAAAKPKARPAKAAKTSAKDAPGKKAPAAAAPKKPAARKAPTKRSTPVKKAAPAKKAAPAKKAPAAKKAKK

SEQ ID NO: 136325 - protein, 113 aa, Triticum aestivum
  Clone ID: PAT_TA_30743.pep
INFPAGVHHIAQHARSHSAGHTFLGHARPRKINTSQPYLSTTERSARRSKPKRAGVWAHRPEHTCTLRGRPKADLALVAFQSNSARAAPSLTSEVLRLIPRCRDTHNYSHVDG

SEQ ID NO: 136326 - protein, 237 aa, Triticum aestivum
  Clone ID: PAT_TA_30744.pep
MSTDVAAADIPVPQVEVAADAAVDTPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAAAKPKAAAKPKAKAAAKKAPAAATPKKPAARKPPTKRATPVKKAAPAKKPAAKKAKK

SEQ ID NO: 136327 - protein, 238 aa, Triticum aestivum
  Clone ID: PAT_TA_30745.pep
MSTEVAAADIPVPQVEVAADAAVDTPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAASKPKAAAKPKAKAAAKKAPAAATPKKPAAARKPPTKRATPVKKAAPAKKPAAKKAKK

SEQ ID NO: 136328 - protein, 238 aa, Triticum aestivum
  unsure (1)..(238): unsure at all Xaa locations
  Clone ID: PAT_TA_30746.pep
MSTEVAAADIPVPQVEVAADAAVDTPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKKAAAKPKAKAPAKAKAVAKPKAAAKPKAAAKPKAKAAAKKAPAAATPKKPVARKPPTKRATPVKKXAAPAKKPAAKKAKK

SEQ ID NO: 136329 - protein, 219 aa, Triticum aestivum
  Clone ID: PAT_TA_30747.pep
HGAIKNYRYVGDVSDAHAGRSTRVDWFGCGVRLPSPQNNRGWVCRLMAWPAVGIVGGGEASAAAQPATGGRSMRHDRRCFGRLEQQDQRLKKHYGRWMDIIRSLELESFILTKLTKHSIPFNLVGPQVILPPRWVPTSRGSIHFFVRNKEALPCGRRGPSCQPLHVQYSSDGSRSLTMLSTPRREHQGGGRWRGLGRGRRRAGEDAAVEARTERSTRVH

SEQ ID NO: 136330 - protein, 413 aa, Triticum aestivum
  Clone ID: PAT_TA_30748.pep
MAPSATCPLHSMASVSRALRPRPRLAAPRLGCGLRVGCSVPAYGSAATEKAEWGLAIAPSPATTLVPVVRSRQIFCKAEANISSNLPASKPTGASQYEKIVELLTTLFPVWVILGTVIGIYKPSMVTWLETDLFTVGLGFLMLSMGLTLTFEDFRRCLRNPWTVGVGFLAQYLIKPMLGYAIALSLKLSAPLATGLILVSCCPGGQASNVATYISKGNVALSVLMTTCSTIGAIAMTPLLTKLLAGQLVPVDAAGLAISTFQVVLVPTIVGVLAHEYFPKFTERIISITPLIGVILTTLLCASPIGQVAEVLKTQGAQLILPVALLHAVAFALGYWISKWSSFGESTSRTISIECGMQSSALGFLLAQKHFTNPLVAVPSAVSVVCMALGGSALAVFWRNRGLPADDKDDFKE

SEQ ID NO: 136331 - protein, 202 aa, Triticum aestivum
  unsure (1)..(202): unsure at all Xaa locations
  Clone ID: PAT_TA_30749.pep
MTVRQLEALIRLSEAIARSHLERIVLPAHVRMAVKLLKTSIISVESSEVDLSDFQDAPLDHDDEQPIQGDATPTXGADEPAEVIKKKLVITEEHFQRVTQALVMRLRQHEXESVKKDGDGLAGMKQGDLIIWYVEQQNAQGAYSSTEEVKEEVKCIKAIIERLIQREGHLVVIDEGTAAAEGAAARASEHRILAVNPNYVID

SEQ ID NO: 136332 - protein, 361 aa, Triticum aestivum
  Clone ID: PAT_TA_30750.pep
MDRRKGSGSRDANGGLAEATASRLRFEDADEVAGEVGMEVEESPAAPGEEVIGNDKTSADYYFDSYSHFGIHEEMLKDVVRTRSYQNVITQNNFLFKDKIVLDVGAGTDILSLFCAKAGAKHVYAIECSQMADMAKEIVKTNGFSEVITVIKGKVEEIDLPVPKVDVIISEWMGYFLLFENMLDTVLFARDKWLADDCEELKIEFWNNVNGFDMSCIKKQAMMEPLVDTVDQNQIVTNCQLLKTMDISKMSSGDASFTVPFKLVAERNDFIHALVAYFNVSFTKCHKLMGFSTGPRSKSTHWKQTVLYLEDVVTICEGETLSGSMTVANNKKNPRDIDITLKYAINGNRCKVSRTQHYKMR

SEQ ID NO: 136333 - protein, 117 aa, Triticum aestivum
  Clone ID: PAT_TA_30751.pep
MSDKVRASHLLIKHSGSRRPASWKDPEGAEITKRTKEQAIAILQGHRDAIVSGKANFADLAKQHSDCGSAQNGGDLGEFGRGAMQKPFEDATYALKVGELSGIVDTDSGVHIIQRTA

SEQ ID NO: 136334 - protein, 148 aa, Triticum aestivum
  Clone ID: PAT_TA_30752.pep
MAHMRVVHRDEEGHKVAEKLPVPETRRPDTARHVERKLEEQGLHRLERHPANAPRGVGIGAPPPKSGRGGKYTWEGPEGLVDSELDPAPAAIDRNDPNYDEEEGGEQDEVAKEVVVGEVEVAKVAQARAGVARVEVAPPLLQDHDHQQ

SEQ ID NO: 136335 - protein, 122 aa, Triticum aestivum
  Clone ID: PAT_TA_30753.pep
SKIPGATMTHLIEDSDMELLMAMASTHGHHHLAVGVATYRTTIPFSISRDAARRRWRHAPAASSIAPPPTSTLCRRPPPHMDFAVPPPSPWIDKALIPIVGAASSRCSAAPSSTSSCLTQLS

SEQ ID NO: 136336 - protein, 227 aa, Triticum aestivum
  unsure (1)..(227): unsure at all Xaa locations
  Clone ID: PAT_TA_30754.pep
PHAQNERQSEQSRAEPSPSPSPQRANAHTQPQWRAPALSASRCSASSRRTPPSPRRPRPRPPRPPPPPPRRRLPPRRRPRPAAAPXPRPSPPPHRPQRLPPPPQPPPPPRRHPPRPPRHQPRLPPQRRPPRPPPRPLPRLPRPALRRSRLPSPLLLLPSPRHPPPSPPSPTPPRPPRPRRRRSRPPRRRRARPRPPLPSPPRPPPSPRRPRPPRPPTTPKPPAPHSM

SEQ ID NO: 136337 - protein, 179 aa, Triticum aestivum
  unsure (1)..(179): unsure at all Xaa locations
  Clone ID: PAT_TA_30755.pep
PARGPAARPACAAGSAAPPPGQPAAPPPPLPPLLPRPPPRPPPRPQRRRRPVREPPACAAGRSCPAGAPASSPSPSPPAAPPPASASSSPSAPAAPAAAPPPPRPRPPSRPPRRCRRPWPRGRPPPQAQPPAXPRGSSSSPWPRRRPPRPRPHPPPAPAAPPGATATTASGDVTSRGRD

SEQ ID NO: 136338 - protein, 323 aa, Triticum aestivum
  unsure (1)..(323): unsure at all Xaa locations
  Clone ID: PAT_TA_30756.pep
MTSIPVRRSCACTTLLNAAEPRYSVMRYLPATTESTTIGMDVCLKIIKNDKDFFDQSLDEIKLLKFVNKHDPADAHHILRLYDFFYYQEHLFIVTELLRANLYEFQKYNQESSDEVYFSLPRIQAIARQCLEALVYLHDLNIVHCDLKPENILMKSYSRCEVKVIDLGSSCFLTDNLSLYVQSRSYRAPEIILGLPYDQRIDIWSLGCIFAELYSGEVLFPNESVSTILAXMIGTIGPIDTQMLALGQETPKYFTEEYDLFQXNEETGQLEYLIPEKSSLRRHLRCSDSKFVDFLSCLLQINPRKRPTAREALRHRWFSHKYR

SEQ ID NO: 136339 - protein, 423 aa, Triticum aestivum
  unsure (1)..(423): unsure at all Xaa locations
  Clone ID: PAT_TA_30757.pep
LGLHGQVQPGLLSLTGQSASGEPIATSIIVSGGXEDDDDRGDVLVYTGHGGRDPNLHKHCVDQKLEGESCPRAHMAYGIEIRVIRAVKSKRSPVGKVYFYDGLYKVVDYWLDRGKAGFGVYKYKMIRIEGQEPMGSVNYRAAEHLKVDALSMRPTGYLSFDISMGREIMPVALYNDVDDDRDPLLFEYLARPIFPSSAIQGKFAVGGGGCGCIENCSIGCYCAERNGGEFAYDKAGVLLRGKPLLYECGPYCQCPPSCPNRVSQKGLKNRLEVFRSRETGWGVRSLDLIKSGTFICEFSGIVLTHQQSEIVAASGDCLVHPNRFPSRWLDWGDISDVYPEYVAPNHPATTDLNFSIDVSRARNVACYFSHSCSPNVFIQFVLFDHYNVSYPHLMIFALENIPPLRELSIDYGMIDEWVGKLTM

SEQ ID NO: 136340 - protein, 270 aa, Triticum aestivum
  unsure (1)..(270): unsure at all Xaa locations
  Clone ID: PAT_TA_30758.pep
DLAEKVPYAESKMEIIEWLSEAGAKNAVNVGKVDEASXLRRTVSDIKHNVQAQLSENMKTNKRVTGIAKELRKLHREAVQNTINSVTLVATLIASIAFVSIFNLPGQYYQDTKRGGEIGEAYISKLTGFRVFCLLNAIALFISLAVVVVQITLXVAWETGAQKQIIKIVNKLMWTACLSTCAAFVSLAYVVVGPQHAWMAFTISAVGGPIMIGTLLFLAYLLLRPRFSFGEDRQRRIRRGSGSKSFSWSVREGLSDLEAVEDHEKKIYAL

SEQ ID NO: 136341 - protein, 151 aa, Triticum aestivum
  unsure (1)..(151): unsure at all Xaa locations
  Clone ID: PAT_TA_30759.pep
MSTTAGYLARRAGXKERVRLLYRRALKDTLNWXVHRHLFYQDVVRSSRDNVPEANQDMVEVPWHVIDRLHRGRGGASKERTSEHPDPXIVPLASCRGTKFTKEPYVHPEGIEXFIYNYGKIRPNETRNHALVYAGAWHLRECERTYFHFSR

SEQ ID NO: 136342 - protein, 110 aa, Triticum aestivum
  Clone ID: PAT_TA_30760.pep
RRETNQSTSAWPWPSSSPVPAKLASKAATSSTSTAGHGEYDYLGRQVVHRFRQPSPCMAISAVLIQCIRLQKLSMENACMKPHQVVRSVRLLKIDGFSLTRSLSSEYRFH

SEQ ID NO: 136343 - protein, 331 aa, Triticum aestivum
  unsure (1)..(331): unsure at all Xaa locations
  Clone ID: PAT_TA_30761.pep
MKNSHCSSLLLVCSVLVLCLVTGGARCDKLSSNFYDWTCPGVYNIVQQHVFSAMREELSMGASLLRLHFHDCFVNGCDGSILLDGADGEKFALPNRNSVRRYEVIDAMKGDLENMCPGVVSCADVVALAAGYGVLFSGGPYYNVLLGTRDGLKPNXQGADNGLPSPYEPISSILNKFADVGLDTKDVVVLPGAHMIGRARCVLLSHRRASTKRPANPTLDATMAANLQKLCTGGVGFRSAALAASSADVFDKQYYHNLLSKKGLLPSDQGLFSADEDVVASTTKALVQTYSDDGEQFFSDFGASMVKMGSIPLPAGSAGEIRCNCRVPNPK

SEQ ID NO: 136344 - protein, 142 aa, Triticum aestivum
  unsure (1)..(142): unsure at all Xaa locations
  Clone ID: PAT_TA_30762.pep
EAPATIVHTSVPVILSLLTGDDEKIRSLELVDRASGSIPMVHVHDLCRAKIFLAEEEAASGRYICSCPGLDPPSXELATFLTAKYPQYNVNSDRFGGRPEKLRVCISSAKLVKEGFEFRYKALDEIYDDVVNYGRSLGILPY

SEQ ID NO: 136345 - protein, 79 aa, Triticum aestivum
  Clone ID: PAT_TA_30763.pep
LRHEGSESERARAGGSPAREKAQLRPAVRRQRRWRPPRPRPRPSPAGSWPWPWPSPSPPSFPPPPPPGRSRPPSPPWIQ

SEQ ID NO: 136346 - protein, 240 aa, Triticum aestivum
  unsure (1)..(240): unsure at all Xaa locations
  Clone ID: PAT_TA_30764.pep
MEGRSKAAAMPSEPVRLIGCFASPVVHRAELALRLKGVPYELIEEDLNNKSELLLTHNPVHKTVPVLLHGDRSIPESLVIVEYVDEAFXGPPLLPVDPLARANARFWARFLEEECKKPLWMALWADGEAQAAAARETKEKLTLLEAQLPEGKRFFGGDAIGFLDIAVGGALAHWMGVFEEMAGVRLLTEEAHPALCRWAREYRADETVRQCLPDRSRVLAALAARKDLYVSIAKAMAAQK

SEQ ID NO: 136347 - protein, 405 aa, Triticum aestivum
  Clone ID: PAT_TA_30765.pep
DPVTVAQQPTSLGPGVITTPASAGFHDQMYYVNQELSVEDFLYDDDYKINLPGSNPEILNNLEGIGHQEYLQFNLPQELPPNAYLDMNNYGQNAGDGFLHMSDLLTTMSPAPASFLRPKCALWDCPRPAQGSESWQDYCSMYHAELAVKEEGPPGTMPVIRPRGIDLKDGPLFAALSAKIQGKHVGVPVCEGAATTKSPWNAPELFDLYIFEGESMREWLFFDKPRRAFDSGNRKQRSLPDYNGRGWHESRKQVMKDFGGLKRSYYMDPQPSSSYEWHLYEYEINDRDAFALYRLEFKSSEAKKSAKSKFTCSPLIEIQQQMVRLSADGHVENKRTARVRTQDVSTNIYPVQNNTAQANAPDAYQAASQVDQMTFLNGSVVYGPHLPYGYSTEGGDFYWNSNDGA

SEQ ID NO: 136348 - protein, 174 aa, Triticum aestivum
  unsure (1)..(174): unsure at all Xaa locations
  Clone ID: PAT_TA_30766.pep
VEALADRNTVAMVLVNPGNPCGNVYSYDHLAKVAETARKLGIFVIADEVYAHLTFGKNRFVPMGVFGSVAPVLTLGSISKRWVVPGXWRFGWIVTNDPNGVFRRTKLVESIKSYLEISCDPATFVQGAIPELLENTKQEFFRXKTVDILRQTADISGRSKGSSDISKETGDPSV

SEQ ID NO: 136349 - protein, 255 aa, Triticum aestivum
  Clone ID: PAT_TA_30767.pep
ESCKVMYKQLYSIQFSIQAREHKNRSLDKISHNSPGLASGKFCHGPWMCFCLMDNFNFNNVDVDVFFCGLCSQRQSLSRHNCSSSPPRPAHLLPTMPYPADLQIRPEGHQRSRRTPWWPARVVVDLNEQPLLWSLGVHASSSSPWASCLIHRPTRTMTGASMVSCQTTGRGDTAHRRCGSNARRLGDVVARLWMHTMDGLQPRSRRRQSRGSRRRWQTRRWSTSASAPARREHQPPHADLGGGCRRSRWRRRQGG

SEQ ID NO: 136350 - protein, 351 aa, Triticum aestivum
  Clone ID: PAT_TA_30768.pep
MTTGGEEQQGRRLFGVSLTDRPVWQQFLICSSGFFFGYLVNGICEEYVYNRLQFSYGWYFTFVQGFVYLALIRLQGFTMKHMVNPWRTYVRLSAVLMGSNGLTKGSLAFLNYPAQIMFKSTKVLPVMIMGAFIPGLRRKYPFHEYVSAVMLVIGLILFTLADAQTSPNFSMIGVAMVSSALIMDAFLGNLQEAIFKMNPDTTQMEMLFCSTVVGLPFLAVPMVLTGELTTAWSACSQHLYVYAVLVFEAMATFVGQVSVLSLIALFGAATTAMVTTARKAVTLLLSYLIFTKPMTEQHVTGLLLITMGIVLRLLPEDKEKKGMAERQQAKAQRGEEKRRGDGVEEETSPLV

SEQ ID NO: 136351 - protein, 313 aa, Triticum aestivum
  unsure (1)..(313): unsure at all Xaa locations
  Clone ID: PAT_TA_30769.pep
PLRFNHRGLLACANAGTPHSNGSQFFITLDRCDWLDKKNTIFGKVTGDSIFNLLALADIETDKDDRPVYPQKILSVEVLWNPFDDIVPRQLKKIQPAPKADPRVRPEVGAVKQLNVLSFGDEVEEEENEAASFVNDKIKSIHDVLDDSRFLKVEPQVEQLSKEEEEKKNETVLSIREALISKKADSREPEHDPENDDSPEDENEEDFDNRMRSRILKKRRELGDFRQIQSSKEDKSHQXYKELSTHRSYDDADDDDDDDDHQLSKSXKLSLKKKVIDSEAITIEKYNVDVILRLLHAFEHEKHSIKTVFKQKP

SEQ ID NO: 136352 - protein, 230 aa, Triticum aestivum
  unsure (1)..(230): unsure at all Xaa locations
  Clone ID: PAT_TA_30770.pep
MGRKRRQPSPPPXRLRRRSLPPTSPARRRRRRRRRRRRPPPRPKIPPNPLPPPRPTTPRPTPIRRMKVTRSPPSRARSTPRPSSCARSPPPSSNPTPVSPRRRPRTRRRVSLWRSPLRPARPRRQRPGWRRRHSPSSLLPARVRRSARPSRRRLRRGPSLEKPGQPRRWTTGGRDQDPGRRWVATARPMAPSRALVSSLLRLVPASEGRTSPRRKCMGRCGISCSDIRKE

SEQ ID NO: 136353 - protein, 341 aa, Triticum aestivum
  unsure (1)..(341): unsure at all Xaa locations
  Clone ID: PAT_TA_30771.pep
MEQSQMARVKLGTQGLEVSKXGFGCMGLTGVYNDPVPEDAGVAVIRRAFDAGVTFFDTADAYGPHTNEVLLGKAPRHVPPXCVQVADRLAMACFDPGGLCVKGTPEYVRASCEASLVRLGVDYIDLYFQHRIDQSVPIEETMGELKKLVEEGKVKYVGLSEASADTIRRAHAVHPITAVQMEWSLWTRDIEEDIIPLCRELGIGVVPYSPLGRGFFAGRAAVESLPSGSLLSKHPRYTGENLEKNKVLYTRLEILSTKYGCTPAQLALAWVLHQGDDVVPIPGTTKLKNLDDNIEAVKVKLSKEDLKEISAAVPAGEVAGSRIIGILEPYSWRVANTPPQK

SEQ ID NO: 136354 - protein, 120 aa, Triticum aestivum
  Clone ID: PAT_TA_30772.pep
TCLGRRSPSRGGLLSIAGCVAQLMQAMMLMFNSFPCSSRVLRGSSSASSSAMGDLDMPMARPGPSAIRPPVDVAVVGSGNGNRHLTDHMVRTNSGVNSASGNKIKLLKDAHSWADSNLIE

SEQ ID NO: 136355 - protein, 205 aa, Triticum aestivum
  Clone ID: PAT_TA_30773.pep
MADAGSHIAAVVATSTCTHCQREIPSSNIDLHSVHCARNLQKCEHCGEMVPRKLMEEHYNENHAPVNCSLCKETLRPEILDLHKSEQCTQRMVACAYCEYELPAIDIHEHQDVCGNRTEFCQTCKKYIRLREWIGHEMQCHVSSNGSEESSSARTIPEREVRPPPPVRPARAVPAAQHRRLLFTIAVTGIAVMVGSILFQKEESF

SEQ ID NO: 136356 - protein, 230 aa, Triticum aestivum
  unsure (1)..(230): unsure at all Xaa locations
  Clone ID: PAT_TA_30774.pep
SSSPSSPARYLEAAVPKPEYPPPPIPPALGTPERQPRLLGRPQRKPDPPHPLLPRPPRPVAPTXPNEPEQPHPVLPTVPXREHPAHPAMPELPEPALPKPAVPEKPQELEEPHTVDPPTQPKQQRPHTAVPQTLKELQVPHVLELPVTKKPNVPHPVVPKEPPQPAPRDPRKTQWPRPVVPHKARPTDTKHPQMLCRPQPKESAFPSPTATEDRKNEXPPCPICPHAPKY

SEQ ID NO: 136357 - protein, 57 aa, Triticum aestivum
  Clone ID: PAT_TA_30775.pep
SLVHRGRRQLGVARKHQKSSRKWTCIGIGILLVVILIIVIPIVLKNTNKSNNNNNQQ

SEQ ID NO: 136358 - protein, 317 aa, Triticum aestivum
  Clone ID: PAT_TA_30776.pep
MNNLFSSSWKRAGAGGDGGDLESGGVEMTAPPGAAAGASLDRFFEDVESIKDDLRELERIQRSLHDANESGKSLHDASAVRALRSRMDADVAAAIKKAKVVKLRLESLDRANAANRSVAGCGPGSSTDRTRTSVVAGLRKKLRDAMEAFSSLRSRITSEYRDTVARRYFTVTGAQPDEATLDTLAETGEGERFLQRAIAEQQGRGEVLGVVAEIQERHGAVADLERSLLELQQVFNDMAVLVAAQGEQLDDIEGHVGRARSFVDRGREQLQVARKHQKSSRKWTCIGIGILLVIILIIVIPIVLTNTNKSSNNNNQQ

SEQ ID NO: 136359 - protein, 341 aa, Triticum aestivum
  unsure (1)..(341): unsure at all Xaa locations
  Clone ID: PAT_TA_30777.pep
MSGGGSPSGPDSRVETISRLAQWRIDTFGPCSYRRSDPFKLGIWNWYLSVEKSRSVYVRLFPEPGRLAKEQPPLARFVLRVSWVGPPRRSSVSPVFEQLLRSSDDFVWQVDVMSHGRFTIDVEFLDLKIATNNGTESSSSIWPNEGMVQGVASKSTLGCLSRMLTESIHADVTINTTDGVLKAHKSVLAACSPVFESMFVHDLKEKSSSTIDIGDMCVESCSALLGFVYGTIRQEQFWKHRLALLAAANKYGLGEVKSCCEESLLEDISSGNVLERLHVAWLYQLERLKKGCLAYLFVFGKIYDVRDEISGFFHHADRELTLEMFQEVLSVWKPXLKLVCT

SEQ ID NO: 136360 - protein, 167 aa, Triticum aestivum
  Clone ID: PAT_TA_30778.pep
MARCTPLLASLLLLALAGVASAEKAPEGGFIVTGRVYCDPCRAGFETNVSKSVEGATVAMDCRPFGGGESKLKAEATTDNKGWYKIEIDQDHQDEICEVVLTKSPDASCAEIEEFRDRARVPLTSNNGMKQQGTRFANPIAFFPKEPRKECGGILQAYDLKDAPENP

SEQ ID NO: 136361 - protein, 115 aa, Triticum aestivum
  Clone ID: PAT_TA_30779.pep
FLLSQKNTAKSAWEALKTMHIGDQRLRDAKLQTLKLEFEGLRMKETESTDDFAVRLTTVVNKIHALGERIEEPYTVKKFLRAVPNKYLQIASTIGQFGDLNTMTLQEVIRPVKVH

SEQ ID NO: 136362 - protein, 113 aa, Triticum aestivum
  unsure (1)..(113): unsure at all Xaa locations
  Clone ID: PAT_TA_30780.pep
SGEPGVNSPSXLSESAVDKPPAMSFNFAEEVQVNQKEIMDMYMKSMQQFTESLAKMKLPLDMDNGSDKSGSGPAAASPTDSSGTDSSAATKKPTAGAAQEKSPKVFYGSRAFF

SEQ ID NO: 136363 - protein, 275 aa, Triticum aestivum
  Clone ID: PAT_TA_30781.pep
MAGVVVVFDFDKTIIDVDSDNWVVDGLGATDLFDRLLPTMPWNTLIDTVMGELHAQGRTLRDVADVLRAAPIDPHVVAAIRAAYSLGCDLRVLSDANRFFIEAVLDHHGLRGCFSEINTNPSRVDADGRLRIAPHHDFHAAPHGCGLGTCPPNMCKGQVLDRIRASAAAADGARKRFIYLGDGRGDYCPSLRLAREDFMMPRKGFPVWDLICENPGLLQAEVHPWSDGKDMEETLLRLVSRVLVEESTLLPLDCKLESLPVTVQDGMPMPLGVKN

SEQ ID NO: 136364 - protein, 141 aa, Triticum aestivum
  unsure (1)..(141): unsure at all Xaa locations
  Clone ID: PAT_TA_30782.pep
MPIDATIEAGKFSYAVVVIGEXPYAESLGDRTDLSIPFNGSDLITRVANKVPTLVIVISGRPLVIEPQVLEKVDALVAAWLPGSEGMGVADCLFGDHDFVGTLPVTWFRYDDQLPINIGGANYDPLFPFGYGLKCSKAMEI

SEQ ID NO: 136365 - protein, 351 aa, Triticum aestivum
  unsure (1)..(351): unsure at all Xaa locations
  Clone ID: PAT_TA_30783.pep
RSAAGGFLGRGVPLASPVASKPKKQWPPSPPGRRPSSASPSCSVSSPARRARSSSLPSFYSRSCPNLASIVRSGMTAALQTERRMGASILRLFFHDCFVNGCDGSILLDDTSTFTGEKNAGPXRQLGPRGFEVIDAIKTRVEAACRATVSCADILALAARDGVNLLGGPTWSVPLGRKDSRTASQSAANANLPGPGSSLATLITMFGNKNLSPRDMTALSGAHTIGRSQCQFFRNRIYNERNINASFAALRQRTCPRSGGNRRRPPRDVQTADRFDNAHHLLPVPRRAARHXGPRALERCVAGSHGALVRQHTSSPSRRSPDVVTAMLKMGGLLPSSGTQTEVRLNCRRPN

SEQ ID NO: 136366 - protein, 307 aa, Triticum aestivum
  unsure (1)..(307): unsure at all Xaa locations
  Clone ID: PAT_TA_30784.pep
MRNLLSNSFELNKEERPPGNVDIELGLQGDLSGSAQPGFDGFYEQVREIDKLLETLTKLLKXNLQNSNEESNVVTKASAMKDIKRRMEKDVNEVTKVARLTKSKLQQLNKENLANREKPDFHKGSGVDRSRTSVTITLTTRLRERISEFQTLREAIQTEYREVVERRVFTVTGERADEETIDKLIETGDSEQIFQRAIQEQGRGRVLDTLQEIQERHDTVKEIETKLLELQQIFLDLSVLVEAQGEILNNIEVQVTGAVEHVQTGTNLLQKARVLQKNTRKWTCIAIIILLIIVLVIVLSLKPWAKK

SEQ ID NO: 136367 - protein, 151 aa, Triticum aestivum
  Clone ID: PAT_TA_30785.pep
RDGSPCCRCGLTGDLRYHSLPWLIHFDPWYENLASSQQTDDARRSLVNHELDPTSCFSHGQDRRHRIDRSTGPAIRRHPRSASPTATFDPATAQDYIDTSGGVPCLDDGDVTRPIQRRHASGGPVGPAAGRRRRRGCPAARFGRAMGRGGN

SEQ ID NO: 136368 - protein, 159 aa, Triticum aestivum
  Clone ID: PAT_TA_30786.pep
MASFGPTGLPNSEHLRHTNKGTMIFSYTCVGLTGAALFSVIFFFCYQLRNRAPVAAAGAETGRRRTVDLAKLPEFAYTHSARHSGKEGGGEGAQCSVCLGTVQAGEMVRLLPLCKHLYHVECIDMWLASHDTCPLCRAEVEPQPPEDDGQPEVTTELPV

SEQ ID NO: 136369 - protein, 134 aa, Triticum aestivum
  unsure (1)..(134): unsure at all Xaa locations
  Clone ID: PAT_TA_30787.pep
DSDDEEGLGGLSRRVAGLDCGAGDRAIPKAEVMSGSPQSTLCVLQASGEDSPTGGASQVSSPPSSPLEQQPADPWDLLHEAAGQVARLGVDSIPVPVNPPPIHGAGVAPPARKPSPPLLPSPKPXGHYQFPPNN

SEQ ID NO: 136370 - protein, 387 aa, Triticum aestivum
  unsure (1)..(387): unsure at all Xaa locations
  Clone ID: PAT_TA_30788.pep
MEALKKQASKLREHVAKQQQAVRKTFSARHNQDTSLVDEAELECHQNLQKLYNTTRAAKHFQRTIVRGLEGLVAVSTKQMEIVKKLAEDCCKYGXNNNQNVGFVLGKASVEFGKSHNQMEIEREKLLRVLGEQVFEPLREMIMSAPLEDARLLTYRYQRIRQDMESQIADVVRRQLKSKESSGNTDSVKLQHAESKLSELRTTLAALGKEATAAMEAVEAQQQQITFDRLLAMVDAERTYHQNVADILNKLHDEMLNARPHEESDNNDDVPSSDPSSEPKVSSPKVSPTHVHSNSISEDPALTETSEPTRNGQEVHYVGEVIHPFDGQADGELSISVGDFVVVRQVSPNGWSEGECKGKAGWFPSAYVEERDKAPASKVIEPGRLTA

SEQ ID NO: 136371 - protein, 81 aa, Triticum aestivum
  Clone ID: PAT_TA_30789.pep
KLFDRLFRLLLTLPVSTASAERAFSTLRIIKTRLRKTVQDENLANRSLVKIGGGTTQKYLRRDPARRLGPPGRRAGWPATS

SEQ ID NO: 136372 - protein, 72 aa, Triticum aestivum
  Clone ID: PAT_TA_30790.pep
MYIDPREKVTARYQLICPSKREVMIFGSLKQAGTFLPKAPKGWGWRTAILFDELADLLQGGALRIAAVVQLV

SEQ ID NO: 136373 - protein, 556 aa, Triticum aestivum
  Clone ID: PAT_TA_30791.pep
MASSSTVDCSMGKGKSLMNETGEKQLMESELQKLKLHDNMPSKTANNIIDVPNVVIPQDSTPHSIPQNAEASKRMENDISTGGPSAESTSYQFNENMWLSNEQTKNYFSRTSSSNGLVPCEWGRPTAPLWGGRVVGRRQVRCSRGSSLSADEYNTFMNIFERDSLLYCNMSFDALLSVRKQLEEFEFPCKAVNDGLWLQMLLCHRVQAIVADTCRNCCLTSNSCACKQAYVGTHSHYRQEHDRTSASGTAGSIYLADAQGDGNGMFSPVRVNVRGAVDGLAGIGRGNSNVPGAAWAPTRYVFSRVPYGLGSRNGQQSFANDESEPRVDHNGDIPGDGLTALVNLSQESNASHHQAESIFEAGMQTRYSGAATVSTPGGSSLQMQESKEHELGSSWESADNTAISLDMRTPLSHFPPFRFGVEFEDVHRLADGQVKHSAEVFYAGSLWKVSVQAFNDEDPHGRRTLGLFLHRRKAELLDPLRKAHMYIDPREKVTARYQLICPSKREVMIFGSLKQAGTLLPKAPKGWGWRTAILFDELADLLQGGALRIAAVVQLV

SEQ ID NO: 136374 - protein, 56 aa, Triticum aestivum
  Clone ID: PAT_TA_30792.pep
DVFLHDVDRRVERMYAEEFLCERFRVGATGRLWHFRIPPVSRRNGTAAGGDKRPFC

SEQ ID NO: 136375 - protein, 146 aa, Triticum aestivum
  Clone ID: PAT_TA_30793.pep
RKLIRFPFSMHNPATAPSCNPISHHSTSLSRRSTRSASPSAPLSTPLRLMISPREASVPCPSPDVDVLVRRRRPANRRPHAFIGERRWLPVTRRPYARLGERPWPPVSEAGENDNRATRTNTNERNICLGLSIIVIDKKCTNLWQT

SEQ ID NO: 136376 - protein, 160 aa, Triticum aestivum
  Clone ID: PAT_TA_30794.pep
MNGKSKKSKGTPLLGKYELGRLLGRGTFAKVYFAHPVTGGEPVAVKVIDKAEVMGMEGMAPRVLREVVAMRRLRHPGVLRLHEVLATRSRIYLVMELAPRGDLQSMLAALPNRRFSEKAARRVFVQLTAALAHCHARGVTHRDVKPQNVLLDSARNLRCP

SEQ ID NO: 136377 - protein, 73 aa, Triticum aestivum
  unsure (1)..(73): unsure at all Xaa locations
  Clone ID: PAT_TA_30795.pep
RFYPVGPLKPQQTFLKPWSEACTLNGSNMPRYIFLLQESGLFAGARRQVKSCXXIIKTPAGTTSMLLLLXXWP

SEQ ID NO: 136378 - protein, 110 aa, Triticum aestivum
  Clone ID: PAT_TA_30796.pep
SGRRKVFELRPSIMWDKGKALEFLLESLGFASCSDVLPVYIGDDRTDEDAFKVLRKRGQGVGILVSKCAKETSASYSLQDPAEVMEFLLRLVEWKRRSSTAAPPMVRPRV

SEQ ID NO: 136379 - protein, 337 aa, Triticum aestivum
  Clone ID: PAT_TA_30797.pep
MAPRAAAAVAVVALVCAVQSSLSGAAVPGLSPGFYKTTCPGLEQIVNAQVTATFNKDQGVAPALLRVLFHDCFTQGCDASVLIKGRGTEQIPGGANGTLRRVALDLIDRIHREAQAACGRVVSCADVTVLATRDALFKAGGPRFNVDLGRLDSFAPAPDRVKDLPSPFDGADRHIEAFKARKLSADDLVSLSGAHTFGVAHCGVIPPRGTHSMDPQLAKQLQEKCTKPTATTTQDLDVLTPHVFDNKYYVGLTQKKGMFLSDQSLIDHPLTKNLALAFSKNQTAFFIEFGKSMTKMTEMGVITSKLQGEVRADCTVAGKPPRIEAATAADQGFTADM

SEQ ID NO: 136380 - protein, 168 aa, Triticum aestivum
  Clone ID: PAT_TA_30798.pep
MARRLHSAIIATFVLLAVGQCSNAVPTEAEVYWRTVLPDSPLPDPILKLLHPETSSVKKPKDDTVAEAYSLTWLMWGLRSRSGPTKHSSPRPSSKDETVAEAYSLTWLMWGLRSLSGPKKHSSPGPSHDRDHSADEYLARGLFFHEEAVQVGKTMTLYFPLAASAPLG

SEQ ID NO: 136381 - protein, 133 aa, Triticum aestivum
  unsure (1)..(133): unsure at all Xaa locations
  Clone ID: PAT_TA_30799.pep
RAAARAGAKQGDAIETGSIIRLQHMRTRRWLHSHLHASPLSXGNLEVSCFGGDGQSDTGDYWRLEIEGKDKVWKRDQKVRLRHVDTGGYLHSHNKKYNRLGGGQQEVCGVRDKRAENIWSTAEGVYLPVDESK

SEQ ID NO: 136382 - protein, 72 aa, Triticum aestivum
  Clone ID: PAT_TA_30800.pep
EWHQISGKTIARSSHSNKLRCKTILLLVSSQFQCFITAPGVDFCFSSACSSPSSLGSITDKLRLQCKIWHVN

SEQ ID NO: 136383 - protein, 303 aa, Triticum aestivum
  Clone ID: PAT_TA_30801.pep
MASTAAAAAAAAPVVMVTNDDGIDAPGLRFLVDQLVAQGRYRVLVCAPDTDRSGVSHCITWRSALRCKRVNINGATAFGVSGTPADCASLGISGKLFDGLVPDLVLSGINIGNNCGLHVVYSGTVAGAREAFIYGIPALAMSYNWVAGQSSVNDLKVAAEVCIPLINAVMVEIKSGTYPKGSFLNIDVPSDAAHHKGYKITKQGKYMARIGWEQTVYQKPSVESYQTASMVIDGEKDRDIDTSSANDLLFKRVIVKRSYDEEEGEDMDYKSLADGYITVTPLGALSRAEADVIPYYKACLSRI

SEQ ID NO: 136384 - protein, 177 aa, Triticum aestivum
  Clone ID: PAT_TA_30802.pep
METRKGILELRDRLDKTLACSDLADEGSLKSLVKKQILESSLPGSDQGNIDLIAEARAKEVSNFLEMLDTSGNERASDIRGPQQKEWKVKQDTDQLRVMYREGPDGTPFHTLLAEGFADGPIDVCTCVSWESGLYTKWFPQYNLPTFKIAQSGCLKKIRIGEEISLIRYPIWIISVC

SEQ ID NO: 136385 - protein, 211 aa, Triticum aestivum
  unsure (1)..(211): unsure at all Xaa locations
  Clone ID: PAT_TA_30803.pep
KGVSPAFIRQPKLWPTKPAAFTDTLERYSAEVRALCHRLLEHIAETLGLAPGTFAGMFGDAVQAVRMNFYPPCPRPDLVLGLSAHSDGSAVTVLQQDAGRAGLQVLRDGAWAPGLPVPPARVVVLGDSLEVLTNGRYKSVEHRAVTNGEQDRLSIVTFYAPAYDVELGPLPELVADGEPCRYRRFKHGEYSRHYVTSKLXGKKTLDFAKIS

SEQ ID NO: 136386 - protein, 236 aa, Triticum aestivum
  Clone ID: PAT_TA_30804.pep
MAGEDELKLLGTWASPWVSRVKLALHLKGLSYEYVEQDLDNKSDLLLTSNPVHKKVPVLIHNGKPICESVVILEYIDEAYGTTGPSLLPTDPYERAIARFWVDYIDQKLVIPWKVAFTADGEEEKTEGIKQMLAVVQTLEGALKECSKGKPFFGGDSVGYVDIALGGLLAFLQGTEELCGTKPFDIANTPLLLAWVERFTTLDAAKAALPDANKLVVFARTRRARIAATINVSVKN

SEQ ID NO: 136387 - protein, 76 aa, Triticum aestivum
  Clone ID: PAT_TA_30805.pep
QSSALQVGDGLASACSCQASLLHAGAGPAWIDVFLHSSSQCNTEICCSLASTTIRDCNERTKTSDEHLSCFPVEHP

SEQ ID NO: 136388 - protein, 145 aa, Triticum aestivum
  unsure (1)..(145): unsure at all Xaa locations
  Clone ID: PAT_TA_30806.pep
AQXSFLYPXGVDRFKRQFAHLEEHYSKGERGSPLQRKXASLPRQRVGASNDGNNEQHISDQEMSAEPDAHGAVSPQKSQDAPGVGQNGLSPTSLSSRTYLKSASISASKCVVVNPNKQPEYDDAISEETEGAVDGLSEKVSKMHA

SEQ ID NO: 136389 - protein, 582 aa, Triticum aestivum
  unsure (1)..(582): unsure at all Xaa locations
  Clone ID: PAT_TA_30807.pep
MGGGNGIVDGFRRLFHRRTPSGSVLGSSNQSSAGEDSSDVEAAEGLDLVGLRPIRVPKRKMPLPVESHKKNIMEKEFFTEYGEASQYRNQEVVGKGSYGVVAAAIDKRSGERVAIGTINHVFEQDAAGVRQNGVIHLSLSLRTSVKSESMSVSKCAVLNPIKXAISMTPASLSRQKEPSMDYPRRSQRCMPSAATTTEVGTAFLISVKVLQRVLRPKNILANADCKLQICGSGXLPRVSSNERAXPAIVVGRHSYATRGLMAPPXCGSFFLSKHTPAIDIWSIGCIFAELLTGRPLFPGKNVVHQLDIITDLLGTPSSETLSRIRNEKARRYLSCMRKKHPVPLTQKFPNADPLAVRLLGRLLAFDPKDRPSAEEALADPYFASLANVEREPSRHPISKLEFEFERRKVTKDDVRELIYREILEYHPQMLEEYMKGGDQISFLYPSGVDRFKRQFAHLEEHYSKGERGSPLQRKHASLPRQRVGASNDGNNEQHISDQEMSAEPDAHGAVSPQKSQDAPSVGPNGLSPTSLSSRTYLKSASISASKCVVVNPNKQPEYDDAISEETEGAVDGLSEKVSKMHA

SEQ ID NO: 136390 - protein, 358 aa, Triticum aestivum
  unsure (1)..(358): unsure at all Xaa locations
  Clone ID: PAT_TA_30808.pep
MDDAKPRNLGGSLPVPNVQDLAARPDDLTLTPTLLDRYVRPQPNTVDLRPDAPAGEEQEHVPVVDLGRLLRTASPXGRGEEAARLRSACEDWGFFQLVNHGIPEETLEEMKRNVMGFFALPLAEKAALAQQPGEIEGYGQAFVVSEEQTLDWADMFFLLTQPPSYRDLRLWPSNPSTFKNCLENYSEEVQRVAGELLGAMAEILGVRDHSDMTRLAASQSVRMNYYPPCPEAHVDSVLGLSPHSDAVGLTLLLQVSKVPGLQIRRKGGWVPVTPLPGALVVNVGDVIEVFTNGXYRSVEHRAVVNARHERMSIATFHSGRFGTMYGPLEEVVXDREPRYRSVSVQEYVKLVVPSKLDG

SEQ ID NO: 136391 - protein, 190 aa, Triticum aestivum
  Clone ID: PAT_TA_30809.pep
RRCHRLVASPSSYATSATTAPGSLQHHHPSYAAPAAGTPLHCSAAAINLSRRRPRMQRRRQQRQLHCSAGDRNARSIAAPPAAAPPSSYAAPPAGTPAPLQRHRPRHAAPPPLQRRHARLVMPPTIAPVHCSAGVLICSAAASAASRWLLQGFAVLRRRAQSSRDWRGREIWCAATRIGIGEKRKAASCR

SEQ ID NO: 136392 - protein, 142 aa, Triticum aestivum
  Clone ID: PAT_TA_30810.pep
GFPRPPSVILFYVRQRKATCIYSSYLPGRPLDVVAAEVQIVFREDFGTDGRGGYFDQYGIIRDIIQNHLLQVFCLVAMEKPVSLSPEHIRDEKVKVLQSVSCINHDEVVLGQYDGYKDDPTVPNESNTPTFASVVPARAAAR

SEQ ID NO: 136393 - protein, 64 aa, Triticum aestivum
  Clone ID: PAT_TA_30811.pep
CGLAGLAAGMAIGIVGDAGVRANAQQHKLFVGMILILIFAEALALYGLIVGIILSSRAGQSRAD

SEQ ID NO: 136394 - protein, 63 aa, Triticum aestivum
  Clone ID: PAT_TA_30812.pep
GLAGLAAGMAIGIVGDAGVRANAQQPKLFVGMILILIFAEALALYGLIVGIILSSRAGQSRAD

SEQ ID NO: 136395 - protein, 165 aa, Triticum aestivum
  Clone ID: PAT_TA_30813.pep
MASTFSGDETAPFFGFLGAAAALVFSCMGAAYGTAKSGVGVASMGVMRPELVMKSIVPVVMAGVLGIYGLIIAVIISTGINPKAKPYFLFDGYAHLSSGLACGLAGLAAGMAIGIVGDAGVRANAQQPKLFVGMILILIFAEALALYGLIVGIILSSRAGQSRAD

SEQ ID NO: 136396 - protein, 165 aa, Triticum aestivum; identical to SEQ ID NO: 136395
  Clone ID: PAT_TA_30814.pep

SEQ ID NO: 136397 - protein, 115 aa, Triticum aestivum
  Clone ID: PAT_TA_30815.pep
MARAAATQLVLVAMVAAMLLVATDAAISCGQVTSALSPCISYARGNGANPTAACCSGVRSLAGAARSTADKQAACKCIKSAAGGLNACKAAGIPSKCGVSVPYAISAKVDCSKIR

SEQ ID NO: 136398 - protein, 79 aa, Triticum aestivum
  Clone ID: PAT_TA_30816.pep
FGTRVFSTYPPVSVSGTGTLLLKVVRAFPGSMASVTYFSAVAPGMSLVEKQSLVHGAHTSALQRLVLGPRLEFFFFFFK

SEQ ID NO: 136399 - protein, 73 aa, Triticum aestivum
  Clone ID: PAT_TA_30817.pep
RNSARGHPPAACCSGVRSLAGAAQSTADKQAACKCIKSAAGGLNAGKAAGIPSKCGVSVPYAISSSVDCSKIR

SEQ ID NO: 136400 - protein, 115 aa, Triticum aestivum
  Clone ID: PAT_TA_30818.pep
MARGAATQLVLVAMVAAMLLVACDAAISCGQVTSALSPCISYARGNVANPPAACCSGVRSLAGAARSTADKQAACKCIKSAAGGLNAGKAAGIPSKCGVSVPYAISSSVDCSKIR

SEQ ID NO: 136401 - protein, 312 aa, Triticum aestivum
  unsure (1)..(312): unsure at all Xaa locations
  Clone ID: PAT_TA_30819.pep
MPAWWKGKGRSKSKAPAPAGDAGTIPAVRDGEKDRKNKKATSFDEALIGREGRGKQLQQPAPAVGHPLPRXPAFMPSASAPASASASASSGGSSSLGSSAASDEPLDLGIYRISDANRTPAIDSRKQSLVLEEGRFVVHNLASENNRSCEPSVSPRKEFQSNILDLPSDRTTYCHGRKSTEIVFATRMPSSPPSSRGKNCPTSPVHSRAFGQCPGSPTAWQEDARSSSSPHPLPLPPGSPCTSSRSLHSQWKKGKLLGSGTFGQVYLGFNSEGGQMCAIKEVKVIADDSNSKECLRQLNQEMLLLNQLSHPN

SEQ ID NO: 136402 - protein, 188 aa, Triticum aestivum
  Clone ID: PAT_TA_30820.pep
FLLNESFLKLCLQRDPAARPTAAQLIEHPWVKDQASVRSSRSGSGITRDMFSTSTDGSKATVKTSIELSSYRSLSPLRDTNLRLRNLVVPASSIPSISTRKASAISASNVRMNMSLPVSPCTSPLRQYRQSNRSCLPSPPHPAYSAGAANYSPINNMLYPTRPSNYLTDPWLETPRQKTQTFDSPRRL

SEQ ID NO: 136403 - protein, 165 aa, Triticum aestivum; identical to SEQ ID NO: 136395
  Clone ID: PAT_TA_30821.pep

SEQ ID NO: 136404 - protein, 165 aa, Triticum aestivum; identical to SEQ ID NO: 136395
  Clone ID: PAT_TA_30822.pep

SEQ ID NO: 136405 - protein, 115 aa, Triticum aestivum
  Clone ID: PAT_TA_30823.pep
MARSAVAQVVLVAVVAAMLLAVTEAAVSCGQVSSALSPCISYARGNGASPSAACCSGVRSLASSARSTADKQAACKCIKSAAAGLNAGKAAGIPTKCGVSVPYAISSSVDCSKIR

SEQ ID NO: 136406 - protein, 165 aa, Triticum aestivum; identical to SEQ ID NO: 136395
  Clone ID: PAT_TA_30824.pep

SEQ ID NO: 136407 - protein, 517 aa, Triticum aestivum
  Clone ID: PAT_TA_30825.pep
MSGGSDVSSPSSGRISTSSLSDLKDLELSSESGCLSIVVLGASGDLAKKKTFPALFNLFQQGFIQSGEVHIFGYARSDISDEGLRERIRGYLKGASDEHLSQFLQLIKYVSGSYDNGAGFELLNKTISENETSENNQPGNSRRLFYLALPPSVYPSVCKMIRSYCMTPSSHTGWTRVIVEKPFGKDLDSAEELSAQLGELFDEEQLYRIDHYLGKELVQNLLVLRFANRFFLPLWNRDNIDNVQIVFREDFGTDGRGGYFDQYGIIRDIIQNHLLQVFCLVAMEKPVSLSPEHIRDEKVKVLQSVSCINHDEVVLGQYDGYKDDPTVPNESNTPTFASVVLRVHNERWDGVPFVLKAGKALSSKKAEIRVQFKDAPGDIFRCKKQGRNEFVIRLQPSEAMYMKLTVKKPGLEMATEQSELDLSYGLRYQDVKIPEAYERLILDTIRGDQQHFVRRDELKAAWEIFTPLLHDIDAGRLKALPYQPGTRGPLEADELSKRMGYVPTLGYVWAPPTLAKF

SEQ ID NO: 136408 - protein, 522 aa, Triticum aestivum
  Clone ID: PAT_TA_30826.pep
LENNRSCEPSVSPRKEFQPNILDLPSDRTTYCHGRKSTEIVFPTRMPSSPPSSRGKHCPTSPVHSRAFGQCPGSPTAWQDDARNSSSPHPLPLPPGSPCTSSRSLHSQWKKGKLLGSGTFGQVYLGFNSEGGQMCAIKEVKVIADDSNSKECLRQLNQEMLLLNQLSHPNIVQYYGSELSSETLSVYLEFVSGGSIHKLLQEYGPFGETVLRNYTAQILSGLAYLHGRNTVHRDIKGANILVDPNGDIKLADFGMAKHISAYTSIKSFKGSPYWMAPEVIMNTNGYSLSVDIWSLGCTILEMATARPPWSQYEGVAAIFKIGNSKDIPDIPDHLSSEAKSFLKLCLQRDPAARPTAAQLIEHPWVKDQASVRSSRSGSGITRDMFSTSTDGSKATVKTSIELSSYRSLSPLRDTNLRMRNLVVPASSIPSISTRRASAISASNVRMNMSLPVSPCTSPLRQYRQSNRSCLPSPPHPAYSAGAANYSPINNVLYPMRPSNYLTDPWLETPRQKTQTFDSPRRL

SEQ ID NO: 136409 - protein, 83 aa, Triticum aestivum
  Clone ID: PAT_TA_30827.pep
KAKPYFLFDGYAHLSSGLACGLAGLAAGMAIGIVGDAGVRANAQQPKLFVGMILILIFAEALALYGLIVGIILSSRAGQSRAD

SEQ ID NO: 136410 - protein, 165 aa, Triticum aestivum; identical to SEQ ID NO: 136395
  Clone ID: PAT_TA_30828.pep

SEQ ID NO: 136411 - protein, 123 aa, Triticum aestivum
  Clone ID: PAT_TA_30829.pep
RAHQVSLSTFAPTARGDVLARPHVAAARVTFPTAYRGSGALSCRAGGPATPPGISDKMSDSIKEAQETCSEDAASGECAAAWDEVEELSAAASHARDKLKDSDPLENYCKENPETDECRTYDS

SEQ ID NO: 136412 - protein, 119 aa, Triticum aestivum
  unsure (1)..(119): unsure at all Xaa locations
  Clone ID: PAT_TA_30830.pep
MARGAATQLVLVAMVAAMLLXVASDAAISCGQVTSALSPCISYARXGTAPTPPGGLAGSGVRSLGRVQPRAPLDKQAACKCIKSAAXGGLKRLGKAAGIPSXKCGVSVPYAISSSVGLF

SEQ ID NO: 136413 - protein, 115 aa, Triticum aestivum
  Clone ID: PAT_TA_30831.pep
MARSAVAQVVLVAVVAAMLLAVTEAAVSCGQVSSALSPCISYARGNGASPSAACCSGVRSLASSARSTADKQAACKCIKSAAAGLNAGKAAGIPTKCGVSVPYAISSSVDCSKIH

SEQ ID NO: 136414 - protein, 115 aa, Triticum aestivum
  unsure (1)..(115): unsure at all Xaa locations
  Clone ID: PAT_TA_30832.pep
MAHSAVAQVVLVAVVAAMLLAATEAAVSCGQVSSALSPCISYARGNGANPSAACCSGVRSLASSARSTADKQAACKCIKSAAAGAQXGKAAGIPTKCGVSVPYAISSSVDCSKIR

SEQ ID NO: 136415 - protein, 509 aa, Triticum aestivum
  Clone ID: PAT_TA_30833.pep
MAGTDSSASSRQSSFNSLAKDLELPLEQGCLTIVVLGASGDLAKKKTFPALYHLFEQGFLQSGEVHIVGYARTNLSDDGLRGRIRVYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 136416 - protein, 115 aa, Triticum aestivum
  Clone ID: PAT_TA_30834.pep
MARAAAAQLVLFTLVAAMVLTATDAAISCGQVSSALSPCISYARGSGSSPPAACCSGVRSLAGAARSTADKQAACKCIKSAAGGLNAGKAAGIPSKCGVSIPYAISSSVDCSKIR

SEQ ID NO: 136417 - protein, 73 aa, Triticum aestivum
  Clone ID: PAT_TA_30835.pep
TKLNISKKKKKKNTVEISAEVPMKGLALECEDDDVRFDDNLVDIVPGEVVKIGIKGAKKDTVLKTHYLGMQYA

SEQ ID NO: 136418 - protein, 88 aa, Triticum aestivum
  Clone ID: PAT_TA_30836.pep
VFSTYPPVSVSGTGTLLLKVVRAFPGSMASVTYFSAVAPGMSLVEKQSLVHGAHTSALQRLVLGPRLEAFSLPLLTLKKQGHLVSLNL

SEQ ID NO: 136419 - protein, 115 aa, Triticum aestivum; identical to SEQ ID NO: 136405
  Clone ID: PAT_TA_30837.pep

SEQ ID NO: 136420 - protein, 115 aa, Triticum aestivum
  Clone ID: PAT_TA_30838.pep
MAHSAVAQVVLVAVVAAMLLAATEAAVSCGQVSSALSPCISYARGNGANPSAACCSGVRSLASSARSTADKQAACKCIKSAAAGLNAGKAAGIPTKCGVSVPYAISSSVDCSKIR

SEQ ID NO: 136421 - protein, 115 aa, Triticum aestivum
  Clone ID: PAT_TA_30839.pep
MARGAATQLVLVALVAAMLLVACDAAISCGQVTSALSPCISYARGNGANPPAACCSGVRSLAGAARSTADKQAACKCIKSAAGGLNAGKAAGIPSKCGVSVPYAISSSVDCSKIR

SEQ ID NO: 136422 - protein, 162 aa, Triticum aestivum
  Clone ID: PAT_TA_30840.pep
MIPELNVLDTQSSLDVAGDGFLSQEQPLLTVNSTTPIEYPATASSSSSTPHPPPTIRTKSPTSTSAIPGTSTFSLHPSPSSSSSSSSSRKRKSSPEEEDSAVTLKRQRNTLAARKYRQKRIDRITELEEALAAKAKECDDWKLKFMRKEAENDTLREMLAKK

SEQ ID NO: 136423 - protein, 126 aa, Triticum aestivum
  Clone ID: PAT_TA_30841.pep
MASALTNVSLSTFAPTARGDVLARPQVAPARVTFPTAYRGSGALSCRAGGPATPPGISDKMSDSIKEAQETCSEDAASGECAAAWDEVEELSAAASHARDKLKDSDPLENYCKENPETDECRTYDS

SEQ ID NO: 136424 - protein, 115 aa, Triticum aestivum
  Clone ID: PAT_TA_30842.pep
MARAAATQLVLVALVAAMLLVATDAAISCGQVSSALSPCISYARGNGANPTAACCSGVRSLAGAARSTADKQAACKCIKSAAGGLNAGKAAGIPSKCGVSVPYAISASVDCSKIR

SEQ ID NO: 136425 - protein, 513 aa, Triticum aestivum
  Clone ID: PAT_TA_30843.pep
MAGTDSSASSRQSSFNSLAKDLELPLEQGCLTIVVLGASGDLAKKKTFPALYHLFEQGFLQSGEVHIVGYARTNLSDDGLRGRIRAYLKGASEEHVSEFLQLIKYVSGSYDSGEGFEKLNKEISDYEMSNNSGSSRRLFYLALPPSVYPSVCKMIRTYCMSPTSRAGWTRVIVEKPFGRDLDSAEELSSQLGELFEEDQLYRIDHYLGKELVQNLLVLRFANRLFLPLWNRDNVDNIQIVFREDFGTDGRGGYFDQYGIIRDIIQNHLLQVFCLVAMEKPVSLKPEHIRDEKVKVLQSVNPIKDEEVVLGQYQGYKDDPTVPDDSNTPTFASIVLRVHNERWEGVPFILKAGKALNSRKAEIRVQFKDVPGDIFKCKKQGRNEFVIRLQPSEAMYMKLTEFVQVKKPGLEMATEQSELDLSYGMRYQDVKIPEAYERLILDTIRGDQQHFVRRDELKAAWQIFTPLLHDIDAGKLKAVSYKPGSRGPKEADELSEKVGYMQTHGYIWIPPTLA

SEQ ID NO: 136426 - protein, 535 aa, Triticum aestivum
  unsure (1)..(535): unsure at all Xaa locations
  Clone ID: PAT_TA_30844.pep
MLSDILSEMPGGVAGPPALQERAPLPRCAVGKVTRAAATCGLARTSPLAVGAKVDRLTLVSADAIAGCGGSTEILSRAEFGTSSCRIRHEIGLPPTPCFIGTVPPSPPHRMAAALASSRCCRRPSLLTIDRRRSSVARCALSGGKGNSFSWKECAISVALSVGLITVPPTFGWSAHAYPLEPVIPDISVLISGPPIKDPGALLRYALPIDNKAIREVQKPLEDITDSLKVSGVRALDSVERNVRQASRALTNGRSLILSGLAESKRANGEKTLDKLAVGLEELQRIIEDRNRNAVAPKQKELLNYVGTVEEDMXVDGFPYEVPEEYNNMPLLKGRATVDMTVKIKDNPNVEDCVFRIVLDGYNAPVTSGNFVDLVERKFYDGMEIQRADGFVVQTGDPEGPAEGFIDPGTXKSRTIPLEIMVDGDKAPIYGETLEELGLYKAQTKLPFNAFGTMAMXAREEFDDNSASSQVFWLLKESELTPSNSNILDGRYSVFGYVTENEDFLADLKVGDVIESIQVVSGLDNLVNPSYKILG

SEQ ID NO: 136427 - protein, 115 aa, Triticum aestivum
  Clone ID: PAT_TA_30845.pep
MARGAATQLVLVAMVAAMLLVASDAAISCGQVTSALSPCISYARGNGANPPAACCSGVRSLAGAARSTADKQAACKCIKSAAGGLNAGKAAGIPSKCGVSVPYAISSSVDCSKIR

SEQ ID NO: 136428 - protein, 126 aa, Triticum aestivum
  Clone ID: PAT_TA_30846.pep
MASALTNVSLSTFAPTARGDVLARPQVAAARVTFPTAYRGSGALSCRAGGPATPPGISDKMSDSIKEAQETCSEDAASGECAAAWDEVEELSAAASHARDKLKDSDPLENYCKENPETDECRTYDS

SEQ ID NO: 136429 - protein, 242 aa, Triticum aestivum
  Clone ID: PAT_TA_30847.pep
ATTTNPATTNPPTTSNPPATTTIPPATIPPTTAIPPTTPIPPTTIPTTTIPPTAIAATGILTTTNLPATTTTPPATTNPPATTTISPTTTIPPATTPPTTSISPTAIASLSPSPAEFNTITTANSIGMARGAAIPLVLVAMVATMLLVATDAAISCGQVTSALSPCISYARGNGANPTAACCSGVRSLAGAARSTADKQAACKCIKSAAGGLNAGKAAGIPSKCGVSVPYAISANVDCSKIR

SEQ ID NO: 136430 - protein, 218 aa, Triticum aestivum
  unsure (1)..(218): unsure at all Xaa locations
  Clone ID: PAT_TA_30848.pep
MAKTRPPKKILESYTIKGSDKVIKPGDCVLMRSADTSKPPYVAKVESIEAAGSRGTNVRVRVRWYYRPEESIGGRRPFHGSKEVFLSDHYDVQSADTIEGKCNVHSFRSYTKLDSVNAEDFFCRFDYKSAXGSFVPDRIAVFCKCEMPYNPDDLMIQCEECSDWFHPSCIGMTIKEAKKREHFFCQSCTAENGKTTENFHEATAESEEKLVESKRRRR

SEQ ID NO: 136431 - protein, 195 aa, Triticum aestivum
  Clone ID: PAT_TA_30849.pep
MGSGNLVMKKVVKPSSFDLDIQLDKSWTEDVTCPICLDFPHNAVLLRCTSYEKGCRPFVCDTDKSRSNCLERFKSAHGQPVNVKVSAVNIAVRDSIHFISSNTNNHPACPLCRGDVIGWAVIGEARQHLNQNRVGWENCRRSYVGIFHELPKHTQQKHPNSRPSEIDPARRVDWENFQQSSDSHRCPGHATRAPV

SEQ ID NO: 136432 - protein, 205 aa, Triticum aestivum
  Clone ID: PAT_TA_30850.pep
MSSSEYDYLFKLLLIGDSSVGKSCLLLRFADDAYVDTYISTIGVDFKIRTVELDGKSVKLQIWDTAGQERFRTITSSYYRGAHGIIIVYDVTDRESFNNVKQWLSEIDRYASDSVCKLLVGNKCDLVDSKVVDTEEAKAFAESLGMNFLETSAKEAINVETAFLTMSSEIKNKMASQPTAERKSTVHVHMKGQPIQQQNSSCCSS

SEQ ID NO: 136433 - protein, 136 aa, Triticum aestivum
  unsure (1)..(136): unsure at all Xaa locations
  Clone ID: PAT_TA_30851.pep
RDSMHKRRATGGKQKAWRKKRKYELGRQPANTKLFKQQDTLRRVRVRGGNVNWRATRGLDTGNFSWGSEAXTRKTRLLDVVYNSSNNELVRTQTLXVKNAIVQVDAAPFKQWYLTHYGVQIGRKKKAAAAAKNGTC

SEQ ID NO: 136434 - protein, 106 aa, Triticum aestivum
  Clone ID: PAT_TA_30852.pep
RPFGRTAGRSPLSIRRGGRDLIPCPSGRTVGLDRRSDSPPMDLQFRHDHRSASDGSPRLFYRQTHPQADLCMDWHSQVSTPALLNHKFTRNVSMHYVLALVDTVSI

SEQ ID NO: 136435 - protein, 307 aa, Triticum aestivum
  Clone ID: PAT_TA_30853.pep
WILANSKPCPKCKRPIEKNQGCMHITCTPPCKFEFCWLCLGPWSDHGERTGGFYAGHRAGAAGRLGPLQAPDRRRDASGSSEMRPSRLPARCRANQSSRQKALGDLQSLQNDKLEKLSDIQSQPESQLKFIIEAWLQIVECRRVLKWTYAYGYYLPDHEHAKRQFFEYVQGEAESGLERLHQCAEKELQIYLDADCPSKDFNDFRTKLAGLTRVTRNYFENLVRALESGLNDVGAHSGQGACSKAVSSKNLGGKSKSGKNKAPVGASKSGSSTRGMDDGNIWACDQCTFANPRSARSCQVCDHQQHR

SEQ ID NO: 136436 - protein, 346 aa, Triticum aestivum
  Clone ID: PAT_TA_30854.pep
MGADEAGPGGGGGIRVLLRRKQVDSDRARAAGGQQLAKELSITQLIAIGVGSTVGAGVYVLVGTVAREHSGPALTLSFLIAGIAAALSAFCYAELASRCPSAGSAYHYSYICVGEGVAWLIGWALILEYTIGGSAVARGIAPAPALFFGGPNSLPWILARHELPWLDVVVDPCAAALVFLVTALLCVGIKESTFVQGIVTVLNCCVMLFVIIAGSYIGFQTGWVGYKVSGGFLPYGVNGMLAGSATVFFAYIGFDSVASTAEEVRNPQRDLPLGIATSLTICCSLYMLVSVVIVGLVPYFAMDPDTPISSAFARHGMQWAMYLVTSGAVLALCSTLMGSLLPSTRP

SEQ ID NO: 136437 - protein, 247 aa, Triticum aestivum
  unsure (1)..(247): unsure at all Xaa locations
  Clone ID: PAT_TA_30855.pep
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCLMEWVLNSKHYTTKVISAVVVVAAGVGICTVTDVEVNAKGFICACVAVFCTSLQQIIIGSFQKKYNIGSFELLSKTAPIQAVSLIILGPFVDYYLNGRWLLNYSFSTGATFFILLSCSLAGXCNMSQYLC

SEQ ID NO: 136438 - protein, 345 aa, Triticum aestivum
  Clone ID: PAT_TA_30856.pep
PPWSPSAPPVARKQLAPSARSPPTRRPHAPRAPLPSSPPRSLCYAPTSGISAAEKIPPAEPVLRARGMNLLRALGFFMPDAQPFTSAGYLFPLATSVRVFHFTVMALVRWISMVTGYPASKHFPIWVLAWFSLLANASMALMNLSRMLHSVGVYYIPKLTMIRTALLDIMIGSFQKKYNIGSFELLSKTAPIQAVSLIILGPFVDYYLNGRWLLNYSFSTGATFFILLSCSLAVFCNMSQYLCIGRFSATSFQVLGHMKTVCVLILGWVLFDSALTIKNILGMLLAIMGMVVYSWAHGVCRRRPPRPIPQEQERHAGMGSDVPLKSRTSGIPLSSDDLEEGPMKN

SEQ ID NO: 136439 - protein, 166 aa, Triticum aestivum
  Clone ID: PAT_TA_30857.pep
PPPLPPRSSSVSHRVSSSSTPDPATNPAIRRARSASDGVRGDLRHLLPRRLHRLPLLAPLLQPRRLHQHIPFDTGYYRYSLLLDDVGNRVPRPDEAFDQPHPERRVSPALPCHVRQLKYPLLNVSLFGSRTSIHFVAAMITEIKRTCCEILLLRPSSGEHFRGGTL

SEQ ID NO: 136440 - protein, 140 aa, Triticum aestivum
  Clone ID: PAT_TA_30858.pep
MAPKAEKKPAPEKTPAGKKPAAEKRPAAGKTASKEGGGEKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 136441 - protein, 114 aa, Triticum aestivum
  Clone ID: PAT_TA_30859.pep
HASDFVNHGQFDLDDPSGRKRSFDDRFVEAAFGQNPSSSITSRPMADYDVDSFQHGHNTTSHWRSSIDGVFYNHNDTALDELRKILSVVERGMGLLTAEIDRINTAIRFDPTAA

SEQ ID NO: 136442 - protein, 103 aa, Triticum aestivum
  Clone ID: PAT_TA_30860.pep
MGNCKSSSRALLGKAHVVPDAEWRMQDFVKTHVPDPEWRIHDFSSLLETGAKSATSATFYCSGYNWQLQVIPMHKETGSETPYVALHLMTSPERMVPGHTMHV

SEQ ID NO: 136443 - protein, 99 aa, Triticum aestivum
  Clone ID: PAT_TA_30861.pep
MGNCRSSSRALLGKTHVVPDSEWGIQDFGKTHVPVFEWRIQDFSSLLKTGAKSTISGAFHCSGYNWFLQVIPMHKEAGAGTPYVALRLMPSQLSLVPGH

SEQ ID NO: 136444 - protein, 299 aa, Triticum aestivum
  unsure (1)..(299): unsure at all Xaa locations
  Clone ID: PAT_TA_30862.pep
MGNCKSSSRALLGKAHVVPDPEWRIRDFGKTHVPDFEWRIDDFSSLLKTGSKRATSGPFHCSGYNWDLQVSLMHKEAGAGTPYVALRLASSQLSLVPAHTVHAVFELSICNHTKXNVLWMQSVYLKAASYNFDFKNTYSKERCLIPLQELLKSSAFLVDDSCVFAVEILKIDVSSPEKKAVVVQKKATIVQNLFVQSKGFIKGTYTWTMNNFLELDLKHFIQSPTFEVGGQKWYIGMYPRGDKYSTDCLSLYLYPDVSDELQLESKKVAVMTLSILDQKNGKHFTRTSGSTFLSKYQCY

SEQ ID NO: 136445 - protein, 231 aa, Triticum aestivum
  Clone ID: PAT_TA_30863.pep
MWFFELSIYNHTKGMYCGCKDTYNFHFKNIYSKEQCLIPLQELLKSSAFLVDDSCVFGVEILKIDVSSPEKKAVVVQKKDTTVQNLFVQKKGFVKGTYTWNMNNFLELDLDHFVRSPTFEVGGHKWYVCIYPRGDKYSTDCLSLYLYLDASDELHLESKKVVVMTLSILDQKNGKHLTATSGLLVFTGGRGWGWADFLGLKKLKDPAGGYVVGSSCVVKADLTIVGSSNDG

SEQ ID NO: 136446 - protein, 97 aa, Triticum aestivum
  Clone ID: PAT_TA_30864.pep
RRLPPWRPRHRRITTTRRLRRLVSPPRARRRCHLPGAGPTRMPAVTAERRPPPSSTPRLGQPRRSTAAPRLSQTRRRLGASLWLCSGGKAASLAPAS

SEQ ID NO: 136447 - protein, 219 aa, Triticum aestivum
  Clone ID: PAT_TA_30865.pep
MPISSSLSARLGPGPAPAPARWGPYARPSEPRRTGAGSGCAKASRPPLRLEPATERLLGPARRAESRGSSRGAAAPTPARRRLGDLKKSDPKTDPKPAGTNPEPIQEPRVEESRGCGGFAFLCALAGHEEAITGISMPMGSDKLYSGSADGSVRVWDGNSGKCVDVIKIGGKIGCMITHDKWVFIGIPKSVEAWNIQTGMKLSLQGPSGLVCSMTIKDE

SEQ ID NO: 136448 - protein, 83 aa, Triticum aestivum
  Clone ID: PAT_TA_30866.pep
AGLPACTVEKRKEGSFQVLMKSKRASKFYTLELAYTRSQSSCPGLHQSYFLCWKPKTTKIFNPPRLIKICLKWNGWSSLLTKL

SEQ ID NO: 136449 - protein, 228 aa, Triticum aestivum
  Clone ID: PAT_TA_30867.pep
DAWVRTRGRTRGQQPQTQSPFRLQQMSSSAAQTYADHGLKPILGGRTPPDPYGLLGLLGVIRMNDPDLSSLALGIDLTTLGLNLNSPDNLYKTFGSPFSNEPAKGEPEYTTPACYVAEQPPALQPMHFQKFQTLILLYIFYSMPKDEAQICAANELYNRGWFYHKEARQWFTRIPNMEPLVKTPTYEQGSYAFFHQGNWETVRKDNFVLHYELVEKRPSLPSASQIVR

SEQ ID NO: 136450 - protein, 114 aa, Triticum aestivum
  Clone ID: PAT_TA_30868.pep
MSAMKFCRECNNILYPKEEKERKVLLFACRNCEHQEVAGDNCVYRNIVHHEAGERTQVLQDVASDPTLPRTKDVRCAACGHGEAVFFQATARGEEGMTLFFVCCNPSCGNRWRE

SEQ ID NO: 136451 - protein, 227 aa, Triticum aestivum
  unsure (1)..(227): unsure at all Xaa locations
  Clone ID: PAT_TA_30869.pep
MTDVFQGYERQYCEMWGSLSRKCTGAASQEGEKLKQKASEIKSGIDGAEALIRKMDLEARNPRVRPSVRPRVXAGQLAKLREYKSDLNNLKGVLKRITAGNGQQGAREELLESGMADTLVVSADQRSRLLRTTERQNQTTDRIRDSHRTMLETEELGVSIMHDLHQQRQSLLHANDTLHDVDDNIGKSRKIMGAMVRRMDRNKWIIGLLIALLVLAILVVLYFKFVH

SEQ ID NO: 136452 - protein, 202 aa, Triticum aestivum
  Clone ID: PAT_TA_30870.pep
MAAPKPITRLISHVILDLDGTLLNTDCIVSQVLKPFIVKNGKKWDSKKAHKFVGKTPYEAAAVVLEDYGLPYSTEEFLSLINPMFSEQWGNIKALPGANRLIKHLKSSRVPAALASNSSRSNIESKISCQQGWKEYFSAIVGADEVESGKPSPDIFLEAAKRMNADPSNCLVIEDSVPGVTAGKAAGMHVIAVPSVPRPRPR

SEQ ID NO: 136453 - protein, 103 aa, Triticum aestivum
  Clone ID: PAT_TA_30871.pep
NKEDSPKSRAVNAGFRSSQPGQQKPPCKGNRDELSSLNKILDQICQIHSTPDKPANHTHRECWVFKQSGKLNAEHKGQDTTSEDETSRKGAFSPGPKKKAGIP

SEQ ID NO: 136454 - protein, 189 aa, Triticum aestivum
  Clone ID: PAT_TA_30872.pep
MDDKSEKGKEKDGSASTPPNRRKAGLKFSPKVPTKKTPKIVPKMEPEEESELDPIDKELLMKLRIPQSQGALERRSKAEKSEACVQVAFGQVNSSTARSFPNPKSSSSVKQEQEVNLFSKYMMSGVTSSAAKLPKQFTGPQDFTHHSYNYPPITLPLRRPHSADPEDFDKDAFGEFSSSRTQDGELTAA

SEQ ID NO: 136455 - protein, 94 aa, Triticum aestivum
  Clone ID: PAT_TA_30873.pep
STGASGAPIDALHMIHSSRHSLAFCMPKDFSSSALMIVYYCVSLLIFIGPFGMNPVTRVLLQPSQQHQTRTETLGCHWCQQTREYNTGIVMIFL

SEQ ID NO: 136456 - protein, 239 aa, Triticum aestivum
  Clone ID: PAT_TA_30874.pep
MASLGLPGPSSYHDLCCYGAGIAGNIFAFVLFISPLPTFRRIVRNGSTEQFSATPYIYSLLNCLVCMWYALPFVSYGVVLVATVNTIGAAFQLAYTAVFIAYADAKKRLKVSVLLAGVFCVFGLIVYVSMALFDHKPRRTFVGYLSVASLIFMFASPLSIINLVIRTKSVEYMPFYLSLSMSLMSMSFFAYGALLDDFFIYVPNGIGTVLGVMQLLLYAYYSRKGSRDEARRPLLVTHT

SEQ ID NO: 136457 - protein, 111 aa, Triticum aestivum
  Clone ID: PAT_TA_30875.pep
VSLLKLRRLVCSSSGNPRIHESQSPFPHPLLAKMTSWKRFVKASTMAAPPPPRAPRLHQELGRLHRECRHIRIERSRFHREGVYGSRQGCSYCYDGSCKLQECSSCRPSVT

SEQ ID NO: 136458 - protein, 353 aa, Triticum aestivum
  unsure (1)..(353): unsure at all Xaa locations
  Clone ID: PAT_TA_30876.pep
MAAAWLKLSVALTCALLLSSSACHGLQVGYYKKTCPRVEAIVRDEVKRFVYKNAGIGAGLIRMFFHDCFVQGCDGSVLLDPTPANPQPEKLSPPNFPSLRVLEVIDXFAGRAAAYFLTTLTLKINMPAGRLDGRVSNSTEALDNLPPPVFNLDQLIASFAAKGLXAEDMVVLSGAHTIGVSHCSSFVSDRLAVPSDINTGFANVLRRQCPASPSPDNDPTVNQDVVTPNALDNQYYKNLLAHNALLTSDASIHEMPRTRCILRSDAHLPPTRRRPEIGARQRQHYPGELGSQVQQGHGQRWEAIEVKDRLTGRDPGGTAGSSTTEPTNHHGVLFLFVHFFFCTGGVTYLSDFR

SEQ ID NO: 136459 - protein, 75 aa, Triticum aestivum
  unsure (1)..(75): unsure at all Xaa locations
  Clone ID: PAT_TA_30877.pep
LHYWXNTAYPLHYXHMDVFQFPFICSAIPPAXVAGPFDLEPGPGQATSTLPSGWESNFEILACHFFFRWRDDARE

SEQ ID NO: 136460 - protein, 263 aa, Triticum aestivum
  unsure (1)..(263): unsure at all Xaa locations
  Clone ID: PAT_TA_30878.pep
MGRLFAVDAAAAAALNGAVDWWKDVNDSPMWQDRIFHALAVLYGVVSVVALVQLITIECRVPEYGWTTQKVFHFLNFIVNGVRAIVFVLRRNVQLIQPEILQHVVLDMPGLAFFTTYALLVLFWAEIYYQARAMSTDGLRPTFYWINGVVYAIQIILWLVLWWKPVRIMVILSKMFFAGVSLFAAFGFLLYGGRLFLMLQRFPXVESKGRRKXITGADLDVLSHPILNFFYYLLVEIVPSAMVLFILRKLPPKRGITQYHPIH

SEQ ID NO: 136461 - protein, 283 aa, Triticum aestivum
  unsure (1)..(283): unsure at all Xaa locations
  Clone ID: PAT_TA_30879.pep
MPSLRAAMADGADRVEATTIGNDKETLLSLLRAKSERSAEAEEKVEWVRSQMVGRDAEFDTPFGRRALVYADHTASGRGLRYIEDYILTQVLPFYGNTHTEDSYVGSRTTKMVRTAASYIKRCMGAGADDALIFCGSGATAAVKRLQEAMGMAAPAGPLLRARLLAQLRAEERWVVFVGPYEHHSNLLSWRQSLADVVEVGAGDDXLVDLAALRRALGSPEHTKRPMLGSFSACSNATGIVTDTRAIARVLHQHGAFACFDFAARYVHVANPNVLVLYCAPTP

SEQ ID NO: 136462 - protein, 86 aa, Triticum aestivum
  unsure (1)..(86): unsure at all Xaa locations
  Clone ID: PAT_TA_30880.pep
MEANKPSYYLFVFVFAALLLSSMAGXAQRKLLMNEDDAGSTMQQEDDEVLVVVHGGRILRQVKTNDYGTYDSTPTMAKPHFKDIPN

SEQ ID NO: 136463 - protein, 144 aa, Triticum aestivum
  Clone ID: PAT_TA_30881.pep
KNTIDKDGWLHTGDIGYVDDDDEIFMVDRLKEIIKYKGFQVPPAELEALLITHAEIKDAAVVSMQDELTGEVPVAFIVRIEGSEISESEIKQFVAKEVVFYKRIHKVFFADSVPKSPAGKILRKDLRAKLAAGFPGSGSTQSKS

SEQ ID NO: 136464 - protein, 78 aa, Triticum aestivum
  Clone ID: PAT_TA_30882.pep
MFSLVKYLDLPMNNCYLGTRFFVDGELELVTKMHYTLQQVVFYKRIHKVFFTDSIPKNPSGKILRKDLRARLAAGIPS

SEQ ID NO: 136465 - protein, 505 aa, Triticum aestivum
  unsure (1)..(505): unsure at all Xaa locations
  Clone ID: PAT_TA_30883.pep
MISRNSSQRRFFSTRGATKAFFTGASPAEPVRQQPEEALAEPGSAPAPLVAVSLLGAARLGAXTTTANPFFTSHETHRQTDAAGAMLIVTEACAVDKVLEYAAGKGLPVVTVDGKGDGCVEFSELIAGEELPEADEAGIHPDDVVALPYSSGTTGLPKGVMLTHRSLITSVAQQVDGENPNLYFSKEDVLLCLLPLFHIYSLNSVLLAGLRAGSAMVIMRKFDIGALVELVRAHGITIAPFVPPIVVEIAKSPQVTACXLASIRMVMSGAAPMGKDLRDAFMAKIPNAVLGQGYGMTEAGPVLSMCLAFAKEPFRVKSGSXGTVVRNAELKIVDPDTGASLGRNLPGEICIRXGKQIMKGYLXNDPESTKNTIDKDGWLHTGDIGRVDDDDEIFIVDRLKEIIKYKGFQVAPAELEALLITHPEIKDAAVVSLKDELAGEVPVAFVMRIEGSEITEDDIKKFVAKEVVFYKRIHKVFFTDSIPKNPSGKILRKDLRARLAAGIPS

SEQ ID NO: 136466 - protein, 132 aa, Triticum aestivum
  Clone ID: PAT_TA_30884.pep
LLSSIQSYKVGGCKNRGTRSKSRSANTSIRGAIFATRRLGGRYREGNQLVLKLKEVHGQKILEQHLLPFCFHLGNLPNYANFFLQFSRFIAWSARRIADTFAFSKKYSPRFYVLISRPFYYVFQCARRASQR

SEQ ID NO: 136467 - protein, 76 aa, Triticum aestivum
  Clone ID: PAT_TA_30885.pep
QLALEPQVMPKYMPKEGVADDGSKTAGQSSTEEARAADALALRGRLGGRLGAPRSMRDVGMSSTSFLLLTRTNYPS

SEQ ID NO: 136468 - protein, 89 aa, Triticum aestivum
  Clone ID: PAT_TA_30886.pep
ALTSFQNTTSLLTYTTSLDQLPQLVRVRRGKEVLDMPTSRTECGAPNSPPSLPHSASASAARASSAELCPAVLEPSPATPSFGICFGIT

SEQ ID NO: 136469 - protein, 125 aa, Triticum aestivum
  Clone ID: PAT_TA_30887.pep
RCCRRAPAWSEARRRRAPAGPWGAAARPRPAFRRPRRAARGPAAGPAALGAGWGRDWCCWGRTRRAVRITKMNMSILSNHAHRHGRESTNDPFISKEKGECPNQFWKHSHRVQMLNLLAKVVPVC

SEQ ID NO: 136470 - protein, 196 aa, Triticum aestivum
  Clone ID: PAT_TA_30888.pep
VLYVAFGSQAELSRAQLEEIAVGLDSSGVDFLWVVRSKWLNPDDRFNQRFGDRGKVVEGFINQLGVLGHKSVKGFFTHCGWNSVLESITMGVPILAFPMAAEQKLNAKFVVDVIHVGLRVRPKEDASKGGSGLVMGGDVQALARELILGEEGKRAAARAGELSMSSRKTMDIGGSSFENLARMVQEVSETHANNGE

SEQ ID NO: 136471 - protein, 309 aa, Triticum aestivum
  unsure (1)..(309): unsure at all Xaa locations
  Clone ID: PAT_TA_30889.pep
MASLTLPPAPPNPRQDAIDLHKAFKGFGCDTTTFQSILAHRDSMQRGYIQQGIQNYVILKELSTSVISPSQLGFSVLLERDATVLXKKLVSAESLDLQPATDIIGSSTPPHTLILVESFYPKGRTXLAHNIPKRTSGSQQNILLAYXTTSFFFRLVYACXKVTNDEMDLWTAGEKKPGTDAKMAFRIFTERSWAHMAAVASAEHHMYVXSLQKVVKNETSGNFEVALLTILRCAENPAKYFAKVLRKSMKGLGTDDKTLVRVVVTRTEIDMQYIKAEYYKKYKKPLADAIHSETSGGYRTFLLSLVGSH

SEQ ID NO: 136472 - protein, 312 aa, Triticum aestivum
  unsure (1)..(312): unsure at all Xaa locations
  Clone ID: PAT_TA_30890.pep
AQSSQRTTLAARANKPEKKMQGLNXKLESLQKANGEQKRMIQKTESTRKVGGEELMRLQLEATTKAKQLTEVHGAWLPPWLVTHSAQYLEVVSGHWNEHGKPAMDIFLQKASEKSAHAKKWAEPHIETAKLKLVPVKEKLAVLKKNAEPYVEKASAKSVEVYEASRDAITPHFVKFKEVSDPYFQEAKKISKPYIDQVAEVTKPHVEKVRSTLKPYTKRAVHVYGTFLESATTYHRQAQATISDYLHQHEITKSLVTKELVWFLASALLALPVFIMYRLLVDTFCTKKQKRSPLNGNGNNGNRRHKRRHAEK

SEQ ID NO: 136473 - protein, 222 aa, Triticum aestivum
  Clone ID: PAT_TA_30891.pep
MALVPLLLSLLLVSCAAQSPSASKAAPVGAFPPQTFAAAPTTVKSPPQASSPSQVSAAPPTFSAASPSQVSAAPPTTSAASPSQVSAAPPTTVAASAPQVSAAPPTVTASAPQAAAVAPPTTAASPQFAAASAPTKSFAAAPLTATSPAASTVASPPFTATSSQPVSAPPLAVTAAPPAMPPTVAAPLPAPVRVPMATPHPWAPHAMARFTLLIPPAATPIP

SEQ ID NO: 136474 - protein, 353 aa, Triticum aestivum
  Clone ID: PAT_TA_30892.pep
MEHGEQEQHAMDLPPGFRFHPTDEELITHYLAKKVADARFAALAVSVADLNKCEPWDLPSLARMGEKEWYFFCLKDRKYPTGLRTNRATESGYWKATGKDKDIFRGKALVGMKKTLVFYTGRAPKGDKSGWVMHEYRLNAKLHAASTSRGSLSGGRAASSRNEWVLCRVFKKSLVGGVVSSAPASSAAKKSGVEMIEEIGSSVAAVTPLPALLDMSGSGASFDPAAHVTCFSNNALEAGQFFNPTVTGGCATDTDNHGLASSYSPLASFTQYGGQLHHGVSLSLVQLLESSGYHRGLADDMAPCGNQQQPAACKGERERLSASQDTGLTSDVNPEISSSFGQKFDHEPAPWGY

SEQ ID NO: 136475 - protein, 228 aa, Triticum aestivum
  Clone ID: PAT_TA_30893.pep
LAVGSSPLRPPKFRSLEITSNFSSVAKQYFSDCHSLNLLFSDASTGASNGAAVAVDQMYSKKHDAGDGIANSWVPVKGQAIANSDIILPEAPREVLPLMTPSNLTADKKKEFQLIEGNQYLRSTVSDLSLAVDDLIIPWSELVLKEKIGAGSFGTVHRADWHGSDVAVKILMEQDYHLDRFKEFMREVAIMKSLRHPNIVLFMGAVTEPPNLSIVTEYLPRGRSYKLF

SEQ ID NO: 136476 - protein, 222 aa, Triticum aestivum
  Clone ID: PAT_TA_30894.pep
CDHLRGKNGAGETLSWATRVRIVLEAAQGLDYLHKGCSLPIIHRDVKTNNILLGQNLKAKIADFGLCKTYLSDMQTHISTNAAGTAGYMDPEYYHTGWLTESSDVYSFGVVLLEVATGEPPVLAGHGHIVQRVKQKIATGNITTVADAHLGGEYDVNSMWKLVDTAMACTADAAVRRPTMATVVAQLKESLALEEGREDSSARGSITSTTAAPMSAFGPSAR

SEQ ID NO: 136477 - protein, 335 aa, Triticum aestivum
  unsure (1)..(335): unsure at all Xaa locations
  Clone ID: PAT_TA_30895.pep
MGGLSLQHPWAFAFGLLGNVISFMTYLAPLPTFYRIYRRKSTQGFXSVPYVVALFSAMLWIYYAAAQRLTKCLLITINSAGCVIETIYIIIYLTYAPKQAKLFTAKILLLLNXGLCSALSSCSPCTCRRHARAGSCSGARVSVFVAPLRVIRPVLRTRCLEFRPFSLSPSLTATAVVWFLYGLLIKDKYVALPNILGFAFGVIQMGLYALYRNATPRPAPKEVDAPVSDDGAVKPSEHVVNIAKLGPAATAIELNTHYPVDPPSPREGGPGKENGVGLRQAEKKLDKGNHVRASLGMHAFNDTDVYMSCIPNLAMTGIVSKQAWENACMHAWGPC

SEQ ID NO: 136478 - protein, 234 aa, Triticum aestivum
  Clone ID: PAT_TA_30896.pep
RMLVTGLGIQCFQQITGIDALVYYSPTIFRDAGVTTESQLLLATVAVGFFKTAFIALAIVLIDRVGRKPLLYVSTVGMTVCLVILASTLWLLAHGAVPKALGVAVAVVAVCGDVAFFSVGIGPVCWVTSSEIFPLRLRSQAAALGAAVNRVTSGTVAMSFLSVSRAMTVAGAFSAFAAISALSVVFVHRFVPETKGKTLEEIELLFGGGEGGEGVTVSPGEVELGDAEHLVRKG

SEQ ID NO: 136479 - protein, 321 aa, Triticum aestivum
  unsure (1)..(321): unsure at all Xaa locations
  Clone ID: PAT_TA_30897.pep
MAARAIVVLSLILALVAIASGGASAQLSSGFYSRSCPGMLKAVRSALHPAIAXERPGGPPTVRLFFPAAFVRGGDASLLLDDAPGLRGEKNATPNKNSARGFEVIDAVKAGVEGCCPGVVSCADILAIXAEESVVFLGGPSWEVKMGRRDNTTASFNGADNHIPPPTSGLANLTSLFAAQGLSQKDMVALSGAHTIGLARCTNFRDHIYNDTNIDAGFARSRQSGCPHATGSRDNNLAPLDLQTLTVFENHYYKNLVQKRGLLHSDQELFNGGAADALVREYVGSQSAFFQDFVEGMIMMGDITPLTGSNGQIRMNCRRIN

SEQ ID NO: 136480 - protein, 155 aa, Triticum aestivum
  Clone ID: PAT_TA_30898.pep
MEFDKRTGTPSPLLPRSASTVTYCCGRCGYDLKLSSSARDTAGIVGAGAGGARRRGWRSAAVVVFDAIDDARFGHLDEFRCLDLRARRLFARRTRLLCRKCGAHVGFGYDDNTTATRPPRYHIKIRALHPASSDDAFSGAATPPPPSHAPADPRS

SEQ ID NO: 136481 - protein, 315 aa, Triticum aestivum
  unsure (1)..(315): unsure at all Xaa locations
  Clone ID: PAT_TA_30899.pep
WKLWEDAIQKDTAXNGPKKVNNVHDFEFIREHFKGIGKDSRILSWLHSFFKQFYGSVSKTDYTTMRLGFIMTHCRGNLKFDFHKYMLRVLESDFKKVVGISWYLWVFVVIFLLLNVNGWHTYFWIAFIPLILLLAVGTKLEHVIAQLAQDVAEKHSAVEGDLIVKPSDDHFWFGRPRIVLFLIHFILFQNAFEIAFFFWILTTYGFNSCIMGQVGFIVPRLVIGLIIQLLCSYSTLPLYAIVTQMGSFYKKEIFNEHVQQGVLGWAQKAKMKKGFKKSNGAAQSTSPVGSAGPSAKVEMVRRPARQGNDAGESIE

SEQ ID NO: 136482 - protein, 194 aa, Triticum aestivum
  Clone ID: PAT_TA_30900.pep
FGSGGSLTVEQTAELAAGLEASGHRFLWVVRMPNLDGHDHEDKQNPLAWLPAGFLERTADKGLTVAAWAPQVRVLAHPATAVFVSHCGWNSALESVSAGVPMVAWPLYAEQRMNAVVLEGSVGVALRPRARERGEIAAVVKELMEGADKGRAVRRQAGDLQQAAARAWSPEGSSRRALEQVAATWKKVTLAKVK

SEQ ID NO: 136483 - protein, 279 aa, Triticum aestivum
  Clone ID: PAT_TA_30901.pep
DKGDLSTANEGSPSEDGDRKRGGGHRRGSKGTRKRMAMEAELSCKLVDFGNACWTYKQFTSDIQTRQYRCPEVLLGSKYSTSADLWSFACICFELASGDVLFDPHSGDNFDRDEDHLALMMELLGMMPRKIALGGRYSRDYFNRYGDLRHIRRLRFWPLSKVLVEKYEFSDIDAIAMSDFLVPILDFVPEKRPTAAQLLQHPWFDAGPLRRQPRALADTAENPVDGAPENKGKEKDDERDAMAAELGNIAIDGASSSKTVKDPQASSKQKIANGTPSKK

SEQ ID NO: 136484 - protein, 115 aa, Triticum aestivum
  Clone ID: PAT_TA_30902.pep
TAGTPPTGGVWRAKLQLKDRSRIVDMIIETLKTRLTLPAPEDLNQLREIVVRYEKRIYIEATNQSDYLPKISLKMLSMEKKKTQQVPRNAHRISDQNNSRKPHTQASQKRARLNY

SEQ ID NO: 136485 - protein, 207 aa, Triticum aestivum
  unsure (1)..(207): unsure at all Xaa locations
  Clone ID: PAT_TA_30903.pep
MRGRRRGSSGTATDFLVCFPPRAHLALMPPKTACSPSRPSASSERRHSTSGARPSSSSSRAATNRNPSRRHHAVDVGEDNEPSSPKVTCAGQIKVSRSAKPKAAGAGGKKKATWMQALGIKKDALPFLNALHGAFRLNVSGCFGRFPGAVVEYTSGEEDEEEEEHVERAXKEXDRRHGDALAKWFMVLEEGKRAPNKNQEHELPHEE

SEQ ID NO: 136486 - protein, 118 aa, Triticum aestivum
  Clone ID: PAT_TA_30904.pep
CATDVASQLELLSDDSGVAERPRWTSAIGDYGRSRRDKLQGGRGKCDAGLASREGLYSRPVSIGFLVISPSRVGSSRRNLRGYAWNELTDDSLAPPFGQKNAPARCISLRCTPTAIAV

SEQ ID NO: 136487 - protein, 196 aa, Triticum aestivum
  unsure (1)..(196): unsure at all Xaa locations
  Clone ID: PAT_TA_30905.pep
ECLCAGIGGGALXMSIRVGLGFDVLGVESDCVVLDVARNYFGLVEDEFLHVRVGDAIQMIQDFAHGDEPDSKFSAIMVDLDSPDAMCGVSAPPLEMTHRSILLAARRILHHDGVLVLNVIPPAADASFYKGLIDVLHQVFSELYEIDVGNGENFVLVARVSPTESTLLDSSRLFRTELRKLTGDFLERIRKVEIPS

SEQ ID NO: 136488 - protein, 216 aa, Triticum aestivum
  Clone ID: PAT_TA_30906.pep
MAKTKQGKRDIDSYTIRGTTKVVRVGDCVLMRPSDTDNAPYVARVESLESDGRGSVRVRVRWYYRPEESKGGRRQFHGAKELFLSDHFDTQSAHTIEGKCIVHSFKNYTKLDNVGPEDFFCRFEYKAATGAFTPDRVAVYCKCEMPYNPDDLMVQCEGCKDWFHPTCMGMTIEQAKKLDTFLCADCAKENGAKRPSNSYPSSPSSDSKVEPKRRKW

SEQ ID NO: 136489 - protein, 284 aa, Triticum aestivum
  Clone ID: PAT_TA_30907.pep
PTRPPTRPIMSGGEPEVSSPRANNEPSELVRALDPKSKRQSLGRTSTFKEPEESLHPQASTPSWRRSKSKSRTEKAWPGLTATNDTKSSKGTTTHDKEDTSSTISDPGPAWDTGPKWDMEPKWDNQPNWEPETPIELHGPSDDIELGLTKELVPSLDERWVIRKGRYLGVLVCNHSCKTVQSLSSQIVAPKAEYDDNCLDLLLVGGSGRLRLLRFLVLLQFGKHISLPNVEYVKVRSVRLKAGPNTHDGCGIDGELLHVKGQVRCSLLPQQSRLIGRPAKNTVQ

SEQ ID NO: 136490 - protein, 236 aa, Triticum aestivum
  Clone ID: PAT_TA_30908.pep
ATATPAMPTMPNNSDSTTATDFYFGLRGMPAAVPSPVDVNMTPQLGLGQLPCDAAQTNCSVNAFAAAMNGVSFRLPTQMSLLEAQFGNASGVYTADFPDGVPPNGTAMVEGTKVRSLPYNSTVEIVLQNPMAFPSESRPIQRHGLNFFVLAQGLGTFAPGNTSAYNLIDPVARNTISVFVVLAAVIRSFAPGPRMRLSTWSIPWHVPMGLGMVLAVANGATADSMLPPSLADLPMC

SEQ ID NO: 136491 - protein, 64 aa, Triticum aestivum
  Clone ID: PAT_TA_30909.pep
FIFFFFFFFFFFFFFFLFKRFLHSESNHRVNDEHKHHVQMTESVPGKHYTDRQRLRSGRSTAKR

SEQ ID NO: 136492 - protein, 193 aa, Triticum aestivum
  unsure (1)..(193): unsure at all Xaa locations
  Clone ID: PAT_TA_30910.pep
ILQXVDISKEAPPAPTPKSGHGGMFNMGSFFRRNSKKSRDLDPIIPTSPGPQSAPELDPNLPRTPRQGSPDLDPRLPRTPRPNLKELGEKRTSIKIVVSDDASKGGDGKLXQDMANGGAQEPGRSLTHTERSXKRRDDKTPDVPEQADAYGRELVVNEGPVTIEGKPMDVHPTMEDGNVQDVAVEAENTTRAS

SEQ ID NO: 136493 - protein, 192 aa, Triticum aestivum
  Clone ID: PAT_TA_30911.pep
RAEFGTRLSDPYVRGRIGLFKFQTQIQRKTLSPKWFEEFKIPITSWEASNELVMEVRDKDHMFDDSLGECTVDVNELRGGQRHDKWISLKNVKKGRIHLAITIEDVSEETEATTSLEESPAKTDVKLPLPTSADSKSDAAKLLEERKVIMDEVEHIDFDGQEQPGGVYVHRPGTGVPQTWECGKGRARNPDT

SEQ ID NO: 136494 - protein, 157 aa, Triticum aestivum
  unsure (1)..(157): unsure at all Xaa locations
  Clone ID: PAT_TA_30912.pep
GWGGLGXLAEPKXSIYVLDNCPHDWLFLQCKAVVHHGGAGTTAAGLKAACPTTIVPFFGDQPFWGERVHARGVGPSPIPVDQFTLQKLVDAIKFMLDPEVKEKAVELAKAMESEDGVTGAVRAFLKHLPCKTDENSPPPTHGFLEFLGPVSKCLGCS

SEQ ID NO: 136495 - protein, 326 aa, Triticum aestivum
  unsure (1)..(326): unsure at all Xaa locations
  Clone ID: PAT_TA_30913.pep
TDEDAGQDLLRASVLALFVSDCFGGCDRSASLRRTRGAIVSLRKEQPFICTCAAGSMCDSNEASKQASTPPGHFNFTGLCDKSIHIIKERNNSGIVPIGALQFGVCXHRAVLMKYLCXRADPPVPXELVXRGHLDYAPXAWNVVPVRQGNILVRMIVDACYPTNIKEETDPEYFCRYVPLSRLHVALDDEGYTPRSSFPSVSLCKEIEATASSAVYHCKIGSVDAAAKIRYLDTRRASNDEVKKFEYKLLGEVRMMNALRKHRSIVDIYGHQLSSKWVQDDSDKEYRIMQSVILMEYVKGGSLKGYLTKLLKEGKKHVPVDLAFYI

SEQ ID NO: 136496 - protein, 142 aa, Triticum aestivum
  Clone ID: PAT_TA_30914.pep
DTSFSSVINNTCTPISTRLFGRCANPSAPGDRAYISIGRPMLTVTAVRRGILVTRTPEEQRGSPKTVDVAPSPHVRAPLTTHGPHHLGPARMKEGRHLGPARMKERRHLGPARMKEGRRAPGLTWWACRRRRGEASAESWSC

SEQ ID NO: 136497 - protein, 67 aa, Triticum aestivum
  unsure (1)..(67): unsure at all Xaa locations
  Clone ID: PAT_TA_30915.pep
TLFADREAAEACFGQCYDGCKTKXSLPRPLRAGAGMPTTLGPVVADLPSSEPDPDDAVRASSEAPEH

SEQ ID NO: 136498 - protein, 110 aa, Triticum aestivum
  unsure (1)..(110): unsure at all Xaa locations
  Clone ID: PAT_TA_30916.pep
MGFAVTRTSRSLVAPSSPTPAGETLRLSSLDRVPGLRHLVLSLHAFDGATRVDAAVGEGEAAASPARAVREALGKALVDYYPFAGRFLEXGGGGRQVRVACTGXGVWFVE

SEQ ID NO: 136499 - protein, 144 aa, Triticum aestivum
  Clone ID: PAT_TA_30917.pep
MLAGAAEGFYGNCFYPVTVTCSSAEVATGEVVDVVRAVRDAKARLAGDVARWAVGGFAQDPYELRFTYDSLFVSDWTRLGFLEADYGWGAPTHVVPFSYHPFMAVAVIGAPPAPKIGARVMTMCVEEAHLPEFRDQMNAFAAGK

SEQ ID NO: 136500 - protein, 199 aa, Triticum aestivum
  Clone ID: PAT_TA_30918.pep
MEASSSRSRSGGLPSKRRSGGCGRGSGYGLTGQPLNDDTLRSIFSRLDDHFDLAHCSAVCKSWNTIISTGHLMRGLYYKRNPQARGSSSTISMRSYFEALAMNEHASTLARGSAEVHQWIGHDVRATLCRMKSGSVLTGMGDKVLRLWSAESCKYMNEYNVPNSKMLVDFDFDENKIVGLTSSQVCIWKRSRNWAQKKS

SEQ ID NO: 136501 - protein, 268 aa, Triticum aestivum
  Clone ID: PAT_TA_30919.pep
MCNNSGGRGGAMAARKGPWTENEDAQLVWFVRLLGERRWDFLAQVSGLRRTGKSCRLRWVNYLHPGLKRGRITADEERLILSLHAEWGSRWSRIARKLPGRTDNEIKNYWRTHMRKKAQEEKMLAKNKASSSPSSSSADSTSLTTTTCSASPTATSSSAATTEEAPQESTTSMDDEAEEEAATSASEEKKAEVVQYCSPVDMDQLWNDIAASERYPEMMMSWGVAGHVVMPAPAVEPSSPVWEFCEDYSLWRIDDQEYYNKIDQHALN

SEQ ID NO: 136502 - protein, 273 aa, Triticum aestivum
  Clone ID: PAT_TA_30920.pep
LYFEKSAMIITFVLFGKYLEVLAKGKTSDAIKKLVELVPATAILLLKDKEGKYVGEREIDALLVQPGDVLKVLPGSKVPSDPVVVWGTSHINESMITGESAPMPKEVSSVVIGGTINLQGILHIQATKVGSGTVLSQIISLVETAQMSKAPIQKFADYVASIFVPIVISLSILTFSVWFLCGSLGAYPHSWFDGTSNCFVFSLMFSISVVVIACPCALGLATPTAVMVATGIGANHGVPVKGGDALERAQNVNYVIFDKTGTLTQGKAVVTTA

SEQ ID NO: 136503 - protein, 108 aa, Triticum aestivum
  Clone ID: PAT_TA_30921.pep
MSPIMAARGQGLGQGQGHQVQQDFDFFLVVDFEATCEKDARIYPQEIIEFPAVLVDGATGLIASAFRSYVRPRHRPVLTQFCRDLTGIRQEDVDGGVDLGEALWLHDA

SEQ ID NO: 136504 - protein, 222 aa, Triticum aestivum
  unsure (1)..(222): unsure at all Xaa locations
  Clone ID: PAT_TA_30922.pep
MAAIMAARGQGQVQDFDFFVVVDFEATCVKDARIFPQEIIEFPAVLVDGATGRIESAFRRYVRPKHHPVLTQFCRELTGIRQEDVDGGVDLGEALWMHDSWLKAATAGGGSLAVVIWGDWDCRTMLESECRFKGIEKPSYFDRWINLRVPFQAAXRRRRAGHPPEAVRAAGLDWEGRLHCGLDDARNTARLFVELMRRGVKMTITGSLAPPAAIQQKEQAPQ

SEQ ID NO: 136505 - protein, 134 aa, Triticum aestivum
  Clone ID: PAT_TA_30923.pep
MAGRGKAIGSGAAKKAISRSSKAGLQFPVGRIARFLKAGKYAERVGAGAPVYLAAVLEYLAAEVLELAGNAARDNKKTRIVPRHIQLAVRNDEELSRLLGMVTIASGGVMPNIHNLLLPKKAGGSKAVAADDDS

SEQ ID NO: 136506 - protein, 303 aa, Triticum aestivum
  Clone ID: PAT_TA_30924.pep
MAAIMAARGQGQVQDFDFFVVVDFEATCVKDARIFPQEIIEFPAVLVDGATGRIESAFRRYVRPKHHPVLTQFCRELTGIRQEDVDGGVDLGEALCMHDSWLKAATAGGGSLAVVTWGDWDCRTLGGGGRVTLQEAVRAAGLDWEGRLHCGLDDARNTARLLVELMRRGVKMTITGSLAPPLPIQQAAPAASHKLLRWLICAGAAADDPAEATVAAASHKPLRWLIGAGAAADPAEAAAAAATHDKPLRRLLATSPLPYSARGTTPLPHFLPAPRFPFHNRGSPPSTVAMAGRAKSIGAGPSM

SEQ ID NO: 136507 - protein, 316 aa, Triticum aestivum
  Clone ID: PAT_TA_30925.pep
MDCAAAAAAAIYRLPEECVAHAIAMTTPGDALSSSAVSPAFRAAADSHAVWDRFLPPDHAAVLARADDAGDHLGRSKKELFTRLCSRPVLLDGATMSFGLDRRSGAKCWMLSARALSIVWVDDPSCWICPIPSCISRFPEVAELVDVCWLEITGKLQLSLLTPRTTYAAYLVYAIADDSYGLECNIGILPPKATVTVVVSGNSTKPTSTATSTSTENTICLQHMQGEEETAMHRRRQEYVRPRKNYGWKLVREADMDIRCPRRRGDDGWTEVELGEFAVAGEEDGVVEVSLKEVECRRWKRGLIVQGIEIRPKHTN

SEQ ID NO: 136508 - protein, 294 aa, Triticum aestivum
  Clone ID: PAT_TA_30926.pep
PTRPEKMVESGMCAKQEEADKFQQVKPRVREMVKARLDTKPKVTEQRDDSAHDFQGGVSIDDKTALKGKFVLDAPLEDRICDLYDLYVEGMDEDKGPQSRKLYVELADLWPQGYMDKVEIRNAISRSKERRNLLYRQRKVRNEERMKRRRIAAAAKSRDGNPMVAQYATAQQVMQPPVKDASPSMTSTHTLYPVVNYGHSQVCRNADRVGEVTVGAASDGNRSSSTDIKRRKLGSDAAVDLQLQANPLKAPPRYVSEKQKPAKRVDDAKVGSSSSLPQTVLAIAGYDPQRPGYS

SEQ ID NO: 136509 - protein, 267 aa, Triticum aestivum
  unsure (1)..(267): unsure at all Xaa locations
  Clone ID: PAT_TA_30927.pep
PGRVALVGXGPGDPELLTLKAVRAIEAADLVLYDRLVSNEVLDLVADGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLHVAENAADPDTTLVVYMGLSTLPSLAPKLMKHGLPPDTPAVAVERGTTPQQRMVFAMLKDLVNEVHSADLVSPTLIIIGXKVVALSPLWVESSEHDALNNENSSQPSTTVSPV

SEQ ID NO: 136510 - protein, 216 aa, Triticum aestivum
  unsure (1)..(216): unsure at all Xaa locations
  Clone ID: PAT_TA_30928.pep
VTWGLSLLYALEHKGDRALTSTQGELAHALRFLASVVSQSFIAFGDILELHKKFLELSGGINRIFELEETLRAAQKDALVPSSAISAASDEIIEFHEVDIVTPSQKLLARKLSCSVVQGKSLLLTGPNGTGKSSVFRVLTXLWPAFSGGVTKPSEWDVVVFLTPSIHQAWGTLPGSDHNTLCQRGKGPEGTGSCPVFRLPTGSWPPPAGAVSTTLK

SEQ ID NO: 136511 - protein, 192 aa, Triticum aestivum
  unsure (1)..(192): unsure at all Xaa locations
  Clone ID: PAT_TA_30929.pep
PRRRCRDVFWLVVFLLHLLVFGGALALAGLNRFRVADRFNIDRYANHTAAPPSAAVAPPGSDVGVSKEKALPPELTETYWKYYGAAGAVGMLLAWSWLAAAAGKKDGGRVLMRAAVHSLTAYLAVISVLCFWGNHSFWGVALAVGAALHFLYVMSVIDRFPFTMLVLQKAXKMVWELPDVMRVAYAFVLVML

SEQ ID NO: 136512 - protein, 84 aa, Triticum aestivum
  Clone ID: PAT_TA_30930.pep
IRFNQEWRDRQEGQVRSVNPVVVVAVGFAQASKSVRSMPLLISCNSDERATPRFRMGIKNPNLPTSRPPMYHIFAHLVQQETFP

SEQ ID NO: 136513 - protein, 300 aa, Triticum aestivum
  unsure (1)..(300): unsure at all Xaa locations
  Clone ID: PAT_TA_30931.pep
RALGRAHRGPPHWXRFDHAGRAVALRGHSASLVVLGTFLLWFGWYGFNPGSFLTILKSYGPPGSIHGQWSAVGRAAVTTTLAGSTAALTTLFGKRLQTGHWNVLDVCNGLLGGFAAITAGCSVVDPWAAIICGFVSAWVLIGLNKLAARFKFDDPLEAAQLHGGCGAWGVIFTXALFARSEYVEQIYGAPGRPYGLFMGGGGRLLGAHVVLILVIAAWVSCTMGPLFLALNKLGLLRISAEDEMAGMDQTRHGGFAYAYTDEDSSSRPGRGAGGSVGGFMLKSAQTSQVAADATSPSSSV

SEQ ID NO: 136514 - protein, 158 aa, Triticum aestivum
  Clone ID: PAT_TA_30932.pep
RPRHRQRLLRRDTRGSGRCRPRGAGPGPSAPPAAPRGRGAGRGRAQARRHLRRRPCSDGRAGAVRGLPSDYGRAGVRAVPARSKRIGALTVPYTGSGGRSLTVIPARLPPSRVKDTGKPCRLITGLCAGVLCSSVSSRILLRKSPHGSRLVGCSRCGE

SEQ ID NO: 136515 - protein, 278 aa, Triticum aestivum
  unsure (1)..(278): unsure at all Xaa locations
  Clone ID: PAT_TA_30933.pep
KXTDVEESLKVSLEGTRMAYDIAAMALQKVGVWRDKGKSKVTELEERVEELTREKDHIGVLLRSAPQANTTEVLKVAEDGLREAGIEIGLNGHRDHRPGSTEKDEVYTLAGALENSMKESQIKIIELQHLVEAQRAESSLLRTRMEGQEKEIGQLRKQIKHLEEKEKMANESVEDLMVDITAAEEEIQRWGTAAEEEADAGRSIEQEFQTQISSLHKELEEARETMVELENKLKFKEETAAAAMAARDAAEKSLKLADTRSARLRERLEELNRQAEES

SEQ ID NO: 136516 - protein, 143 aa, Triticum aestivum
  Clone ID: PAT_TA_30934.pep
VNVTSAWGLLRYFSGDELRRELDDVANLTTQRLDEMSDLFLEDLGKGNGALERRGWPADPVYAAYMASKALVCAYTRVIAREEGAALRVNCVHPGYVLTGMNDYTGVLTAAEGAAAAVAVALAEKGGVTGAYFDRTELGASFV

SEQ ID NO: 136517 - protein, 133 aa, Triticum aestivum
  Clone ID: PAT_TA_30935.pep
YHGMEQEIGVCLHNQHQQDYLQNPTTGGACCEQRVVAWSGCSPTTSCFCWSTVVQWRSVSDVAQSRAPTPLPPMDRHSCCLGLISCCMYFKELSSCFCWRQCNMMWWSGLFWCRSGNYFLQLEPTSYIYFLNL

SEQ ID NO: 136518 - protein, 260 aa, Triticum aestivum
  Clone ID: PAT_TA_30936.pep
APPKEYPFQRALKMAENASDPCGGRYIYVHELPPRFNEDMLRECHSLSVWTNMCKFTGNDGLGPPLSNEDGVFSNTGWYATNQFAVDVIFGNRMKQYECLTKDSSIAAAVFVPFYAGFDVARYLWGYNISMRDAAPHDLVDWLRKRPEWNVMGGRDHFLVGGRIAWDFRRLTDEESDWGNKLLFMPAAKNMSMLVVESSPWNANDFAVPYPTYFHPAKDEDVFLWQDRMRSLERPWLFSFAGAPRPGDPMSIRGQLIDQC

SEQ ID NO: 136519 - protein, 330 aa, Triticum aestivum
  unsure (1)..(330): unsure at all Xaa locations
  Clone ID: PAT_TA_30937.pep
MTPVDSPSPRSEGVTSPEVTMNSAGLREITEPHYVLATGCNLTTAQNAEVDALVKKVRPVIPFYITAMNXQVICKDYAAKYLPHEEQFITLCHPHKSNIWVDNLKVITDGSCMLSVGWSCFVLHNELRESDICLFEVSKNDGEVTMVVHSLEGGHHLQGKEPESQNKCSYPVKVEVTDEEESDKEHAESSYYYSRYAYDLTGEEQEEIFRSALIQQGNPVYVAVLQENHVSSRNNLLTFPREFAAKHLAERSHDILLLRPNRREKWCVRYYYHSMMRIQGFSYRSWTKFVSDNGLQEGHVCVFELMKGVCEATMMVHVFRKFNGRFVLLD

SEQ ID NO: 136520 - protein, 276 aa, Triticum aestivum
  unsure (1)..(276): unsure at all Xaa locations
  Clone ID: PAT_TA_30938.pep
PTDTPPPTPDPATAPPPPXPPAGPPSPPGSPCTIAHRRSTTPPLCPDPRDHPPPPXAPASHWPLAVAPPSDASTRCPAPTPXPPARHPPLPPXASTRHPPRPPRPRXPPAADRLAPARHPLSLPPGPQTHLLQPSLALGPDEPPAATHPRSTSPRPVNCSCRSTATPATGQSPLAPLYCLLHRAKDLPLTSDGSGVRVQSRSPPQSPSHWPTCSWGGLDLQLEEVSTCRWRPSRIFSGKATLCRERCLQPYLLVGICKLSSFCSCSTTAKLRKSRG

SEQ ID NO: 136521 - protein, 114 aa, Triticum aestivum
  Clone ID: PAT_TA_30939.pep
ESMATYMGSQLVMSHGKGRLLSSRSSSSSVGRITVTPLAAQVTRVTRAVQHPPPGPVSDGPRPDGSGSILQVDRAKKTDKVHTGCGDPPCGKRPPRPKRMARQGQEKEEAQSPF

SEQ ID NO: 136522 - protein, 147 aa, Triticum aestivum
  Clone ID: PAT_TA_30940.pep
SRPRVRRPRTSRVVGSVAALLLLLAVVVPFTQTQTQSARDKAAMAEDAGPLVGGIKDSPMGQENDLDVIALARFAVSEHNNKANALLEFENVVKLKKQIVAGTMHFITIRVTEGGAKKLYEAKVWEKPWENFKKLEEFKPVEDAAIA

SEQ ID NO: 136523 - protein, 170 aa, Triticum aestivum
  unsure (1)..(170): unsure at all Xaa locations
  Clone ID: PAT_TA_30941.pep
LRPDRIPPPLLCRCNYRGRARLEDRWLALLSLLPVVVPLFLPAIAVPSTPTQPQSARAKAAXGEDAGPLVGGIXSDSPMGQENALDVIALARSAGSKHNNKANARLEFENVVKVKNQTVAGTMHYITIRVTEGGTKKHYEAKEWEXKPWKNFKKLEEVKVGGTTFQAHNS

SEQ ID NO: 136524 - protein, 238 aa, Triticum aestivum
  unsure (1)..(238): unsure at all Xaa locations
  Clone ID: PAT_TA_30942.pep
MVTVQDEMRKGPWTEQEDLQLVCTVRLFGDHRWDFVAKVSGLNRTGKSCRLRWVNYLHPGLKHGRMSPQEEHLIIELHARWGNRWSRIARRLPGRTDNEIKNYWRTHMRKKAQERKIDMSPSSSXSSFTYQSCLLETAPIIRMDGGSTHNGTTCFSSVLKSNQSVMDGYSMDQIWKEIEAPAMLPIDDKACSNLPCPLLPSPMGDRYCPPEVVWKMDNGDLKMLAPQFGYGNGERSCY

SEQ ID NO: 136525 - protein, 284 aa, Triticum aestivum
  Clone ID: PAT_TA_30943.pep
EIRGVRSKIGNNECLLCCVDFFFHIVETLVRFFNKYAYVQIAVNGQSFNRSARDAWELFQSTGIEALIAYDCSGAVLLMSTILGGLITGTCTGVWTYFTQRDKAIMVGSTSMLIGMILVGLAVVVVESAVTSIYICYAEDPLLIQRWDPEFFEQMSEALHQRLQYRSSRARQILNGRLDHLPDTSSILISCQIRHFCQTIERAAAISRTSCFGSSCHENIENEVPQQSSRPSKAIFPSRQSYVHSFLLLCVGYVHNYVNLQHFRGKQKKNFKSVSGLGVYLTFF

SEQ ID NO: 136526 - protein, 146 aa, Triticum aestivum
  unsure (1)..(146): unsure at all Xaa locations
  Clone ID: PAT_TA_30944.pep
MSRTGPIAQDWEPVVVRKKLPNAAAKKDEXAVNAARRAGVDIDIAKKHNAGTNKAAHSTTSLNTKRLDDDTENLAHERVPXEPEXRALMQARTDKKLTQAQLAQLINXEKPQVIXQEYESGKAIPNQQXIIGKLERALGTKLRGKK

SEQ ID NO: 136527 - protein, 68 aa, Triticum aestivum
  Clone ID: PAT_TA_30945.pep
KVYNMPYGSDHTTHDIQVQMIPATKKLHQHSILSVNDGVNNDMDEVGVGEQGSTSRQFHPRSGEAFSS

SEQ ID NO: 136528 - protein, 177 aa, Triticum aestivum
  Clone ID: PAT_TA_30946.pep
MARAPLPGPALPLLAVILLLVGRRGAAGGGGGGGRGSSVYPAPVVYPHHSRQISWYPRAFLYPHFLTDDEANHLVSLARAELKRSAVADDTSGKSKLSEVRTSSGTFIGKGQDPIVAGIEDKIAAWTFLPKENGEDMQVLRYKRGEKYEPHHDFFTDSVNTIRGGHRVATVLLYLTD

SEQ ID NO: 136529 - protein, 158 aa, Triticum aestivum
  Clone ID: PAT_TA_30947.pep
QDRDAFIEDPDGYKFEILERPGTPEPLCQVMLRVGDLDRAISFYEKACGMKLLRKRDNPEYKYTVAMMGYGPEDQNAVLELTYNYGVTEYDKGNAYAQIAIGTDDVYKTAEVVKLSGGQVIREAGPLPGLGTKITAILDPDGWKSVFVDNIDFAKELE

SEQ ID NO: 136530 - protein, 348 aa, Triticum aestivum
  Clone ID: PAT_TA_30948.pep
MRALPMAVSRGAVACATPAAAAAAVPRRSMLLSTAAAGAALQSDPIRLMSTPKLKLRASAGAAQAAATSFSSNDEAFTWAKKDNRRLLHVVYRVGDIDKTIKFYTECLGMKLLRKRDIPEEKYTNAFLGYGPEETNFAIELTYNYGVDSYDVGAGFGHFGIATDDVAKTVELIRAKGGKVTREPGPVKGGKTVIAFIEDPDGYKFEILERPGTPEPLCQVMLRVGDLDRAISFYEKACGMKLLRKRDNPEYKYTMAMMGYGPEDQNAVLELTYNYGVTEYDKGNAYAQIAIGTDDVYKTAEVVKLSGGKVVREAGPLPGLGTKITAILDPDGWKSVFVDNIDFAKELE

SEQ ID NO: 136531 - protein, 307 aa, Triticum aestivum
  unsure (1)..(307): unsure at all Xaa locations
  Clone ID: PAT_TA_30949.pep
XAPPLAGRRVYASAQHGPASRXRGPEPPTGWLSRIVXTSSAVAMXNQRWXRHCETSVSFALRPSPHPASAYAXHLCGRIRHRLGFTRRVGIRIRIRVHRRILLRAAFQEDGRGERELWRHGGVLIVVVPAEFVLHFAHVIEWKHVLRRRSARTVGQCRPRWLGGLGEPRLGRAALRSRARIHRPVHGAGQIGRADERLCVRRVVVQRIIARLQQRPVVCIFGRKLGGRRSHGLGSGSGSRLQGSRTQPLHAPPTAARGIHASRNTAACNEQQCCDERHEQRPPRGSGRHRDPLTPHAAHTHTGTPVS

SEQ ID NO: 136532 - protein, 150 aa, Triticum aestivum
  Clone ID: PAT_TA_30950.pep
VVFKSSRCPTPPIPHELVPSPPPRCSIPTPSPRTSASSSSWAPGRSRRRPGSTGARSSCRSWQGTAPRHPASPPSPPRRPASPPVTPHRPAPRRHYPLPVAPGNFPQSEHISTRGFLFVCDLVRCEHLKHCPANEGWNSTNQEHHYSVMW

SEQ ID NO: 136533 - protein, 350 aa, Triticum aestivum
  Clone ID: PAT_TA_30951.pep
MASPSAAVAPCRFLSPLATTSRTLLSSILPTPATTRRRPLLSSTTAICAAAMAASGKAGPASCKVVDSHLHVWASPLQAAENYPFFPGQEPTLRGDVDFLLECMDEAGVDGALIVQPINHMFDHSLVTSVLKKYPSKFIGCCLANPADDGSGIKQLEHLIVQEKYRAVRFNPNLWPSGQKMTNEVGRSLFAKAGELGAPVGIMVMKGISSYIQEIEELCTDYPATTVIFDHMAFCKPPTNDDEEKAFSSFLNLSRFPQVYVKYSALFRITREAYPYEDTSQLLSRVISSYGANRIMWGSDFPYVVPECGYKGAKEAISHVAGKAAVSSSDLEWILGKTVSQLFQGAWVTP

SEQ ID NO: 136534 - protein, 447 aa, Triticum aestivum
  unsure (1)..(447): unsure at all Xaa locations
  Clone ID: PAT_TA_30952.pep
PPPAAPPPAPALLLRPRPSAGPSARVPPRAAGFRAPAVAAPAAPPPLPAAGERGVYNFAAGPATLPLSVLQRAQAELVDYRGSGMSIMEMSHRGKEFDAAIKKAEADLRALLAVPDTHEVLFLQGGHTTQFAAAPLNLCASPADPADFVVSGSWSDKAFKEAKKYSAASVAWSGKAAKYTSLPADFGAMSQNPEARFLHICSNETIHGVEFKDKLDSKNDAGLLVADMSSPCFSMSVCGLVFEDLLAHGGLAEVQKRNPHTVVRMDVIGSAQRLTPLMPGGKTGADAHARALHAGHGGRLGGAVHRRGGQGGHAAAQGAQVGRRRARPPIDNSHARARDWVSPAAQSXVGRSMNVPFTLAKGADSXNQFIAEAAKDGMLHLKGHRSVGGVRASIYNAMPLSGVEKXLVAFIKDFQSRSPFSGLRRNALSICIPLTWEKGCCLSYIIT

SEQ ID NO: 136535 - protein, 69 aa, Triticum aestivum
  unsure (1)..(69): unsure at all Xaa locations
  Clone ID: PAT_TA_30953.pep
RGHQGEKWSATKWIRVASFDKVYHTPGNCTDNSNSCSQWAALGECTKNPAWXVGTVALPGHCRRSWGGC

SEQ ID NO: 136536 - protein, 108 aa, Triticum aestivum
  Clone ID: PAT_TA_30954.pep
GRRTEGFSGSDVAVCVKDVLFEPVRKTQDAMYFFKTDGDMWMPCGSKQPGAVQTTMQELASKGLASQILPPPISKNDFEKVLARQRPTVGKKDLEVHEKFTKEFGEEG

SEQ ID NO: 136537 - protein, 388 aa, Triticum aestivum
  unsure (1)..(388): unsure at all Xaa locations
  Clone ID: PAT_TA_30955.pep
LXEQAIEYVKQAVQEDNAGNYVKAFPLYMNALEYFKTHLKYEKNPKIKEATXAGGDDSDQSKLRAGLNSAIITEKPNIKWNDVAGLESAKQALQEAVILPVKFPQFFTGKRRPWRAFLLYGPPGTGKSYLAKAVATEADSTFFSISSSDLVSKWMGESEKLVANLFQMARENAPSIIFIDEIDSLCGTRGEGNESEASRRIKTELLVQMQGVGHNDDKVLVLAATNTPYALDQAVRRRFDKRIYIPLPDAKARQHMFKVHLGDTPHSLSESDFEVLGRRTEGFSGSDVAVCVKDVLFEPVRKTQDAMYFFKIDGDMWMPCGPKQARRCARPRCSRDRPSAGIASQSITSSPWKKVMGIEWQAAVRTFSNRTRSSPQKCTMLIALNGCA

SEQ ID NO: 136538 - protein, 110 aa, Triticum aestivum
  Clone ID: PAT_TA_30956.pep
ASLMALRWLIGATAFAGDSAAAAAAGSHKPLRWLLRDVLVLLRGGDQRWRGAGASQPLLWGRQLDAGHGIASCGPGPNERTSHGMRLRFRIQCSSAVGVARASHQYQSLR

SEQ ID NO: 136539 - protein, 103 aa, Triticum aestivum
  Clone ID: PAT_TA_30957.pep
GLDRGCRPGQAHHGQYTYRYANIQHPPTRHRSHDTSINPTGTQHTTHRHTPRNSPYKLTHRDPAPPSTGGRHKTATDFWQLRYNITTTCFFFFGVQYSTNGVG

SEQ ID NO: 136540 - protein, 221 aa, Triticum aestivum
  Clone ID: PAT_TA_30958.pep
MELEKTGEKRERVLAAEAAELRRAKAALEEENRELARRLQDAEQVSTAVSLVHEDDMVDEASYLREANDRLTRQIEQLHSDHCAHVEELVYLKWVNACLRHDLRGGDHHPSSAEQDQDGAGSAMPSAMDLSKSMSYRSSEKAKELMLQYGSLGLDGYDPALFSPLNESTYGDGESHQRRVGDHDEPGRSPVVPSPAAAAPEHRAGHGKLKFLRNIKKLLAS

SEQ ID NO: 136541 - protein, 140 aa, Triticum aestivum
  unsure (1)..(140): unsure at all Xaa locations
  Clone ID: PAT_TA_30959.pep
IGTKAXALGIDVAFDTASGDFTKYNAGLSHTNQDLTASLNLNNKXNTLAASYYHQVQRTTAVGAEIAHSFSSNENTITVGTQHELDPLTTVKGRYNNFGIANALIQHAWRPKSLITLSTEVDTKAIEKSPKFGLALSLKP

SEQ ID NO: 136542 - protein, 178 aa, Triticum aestivum
  unsure (1)..(178): unsure at all Xaa locations
  Clone ID: PAT_TA_30960.pep
QPPPPRKAELQYLHPHXGTTAVLGLNPNPLVNFSGVIGTKXLLKGINVTFDTASGDFSQXNAGLSHTNQDLTASLNLNNKANTLAASYYHQVQRTTAVGXAEIAHSFSSNENTITVXGTQHELGPLTTVKGRYNNFGIANALIQHAWRPKSLITLSTEVDTKAIEKSPKFGLALSLKP

SEQ ID NO: 136543 - protein, 274 aa, Triticum aestivum
  unsure (1)..(274): unsure at all Xaa locations
  Clone ID: PAT_TA_30961.pep
SSRRFLLAPSPTSTRAPSPTHASSLTAAVFPPPPPGASFPAAVALPPPHPHHRRHPRSPAPPSPRQPPXSLQPPQPHPASSTLAVVPPPQPPXAPPPKAPLSSSPDARDPPGAARASSLLRFPAAGDHPPRSPDTSEHPPRPGPQSKPRTPVSPPSIRPSVCSWPGASVLLSGCCRGRFQMLIFSVLPKELGEQMHSPNDIQENIFKRRNKIWLAMLDPTKRSSSSRYWCRLGCVVMRGEACAPLPLASSSSVDGYFLLIASTEKNELRVASAS

SEQ ID NO: 136544 - protein, 197 aa, Triticum aestivum
  Clone ID: PAT_TA_30962.pep
MANSGALILLISLVLLAGAAYIRREPGHADGSFADTHLHFFMHDAYDGPRPTAALIVTGREPLPLPSDDGATGGQATSSSPRRFGDIAVMNNALTEGPERGSVRVGTAQGFTVRVAEHGAVNDLSLHLVLEAGEYGGSSLAVKGRVDTGAAVRESIIVGGTGRFRFATGYALSRSYDYDVANGGVVEIDVYMQLRLV

SEQ ID NO: 136545 - protein, 361 aa, Triticum aestivum
  unsure (1)..(361): unsure at all Xaa locations
  Clone ID: PAT_TA_30963.pep
MARRHHLLVLLPLLALAVSFVAAAPEGHGDAAAAFIDGAPHRYLRDQQDDQATSMSLDEVSAAVSVLLGFAPPAMLPAPSSAKLNKLLLPKPFDRPRAVFLMQIDGSHDSVDSFISDAGSIYKTKIEGAQNAATGLTDKDELIVIRSHESSGSDVLDNELTDLATWLEGSYQKADGKLNIPLXGNSLTLLLNKEVDVEFASSLISLXQNHQRGIQVHEDFSGGIVSPAELLVCRFTGIKALEDEYGSAEIVKQGAEVVRTALTKAFDQLQGAYNGKIVGLVISTEEASTSLASIIDGPSSLHISRRLAEASKTNATASIAAIYLVRLSLAWITGIILLVSTLIGICLLMNMPLTRDTLLYS

SEQ ID NO: 136546 - protein, 93 aa, Triticum aestivum
  Clone ID: PAT_TA_30964.pep
WESFWAGNIQAWRLLHSLASIIDAPPSLHISRRLAEASKTNATASIAAIYLVRLSLAWITGIIFLVSTLIGICLLMNMPLTRDTLLYSNVKMD

SEQ ID NO: 136547 - protein, 209 aa, Triticum aestivum
  unsure (1)..(209): unsure at all Xaa locations
  Clone ID: PAT_TA_30965.pep
MWQTEDLILVAVSLSVSVLACTVAGDGGGRPLVTAVTRDAATSLYTIPVKSGSPLVVDLSGPIVWSTCDDAASHDTLECNSIDCMRAHRFHPPNCQHTGYGMPDPGNPYRCKCTTHPHNPVSGDTASGDMTRVALSANATDGRNPLGPVSFTAVASCAPDSLLAGLPAGAVGVAGLAHSGLSFPAQVARTQGVXNSFALCLPSGPGNGV

SEQ ID NO: 136548 - protein, 240 aa, Triticum aestivum
  Clone ID: PAT_TA_30966.pep
VWVQRGLRRHIHNLRVSTVGVGAMGYIGNKGSISVSMSIYQTPFCFVCCHLTSGEKDGNLTKRNADVEEILRRTIFNPVHRVSMPKGIHDHEKIIWFGDLNYRINLSYERTHELISRQEWDLLFDNDQLKWELMTGGAFYGWIKGVMSFPPTYKYEFNSDKYAGDEPISARRRPAWCERILSYGKGIRLDSYRRVELNLSDHRPVSAVYMAEVEVLCHRKFQKAVTFTNVEVEDHLLLER

SEQ ID NO: 136549 - protein, 160 aa, Triticum aestivum
  Clone ID: PAT_TA_30967.pep
SAYVQYTWHLPKNYTSYSVFIPEGGVRDGNVSVEEILRSIHPDVVKQMREEVINLIPKVIYADPRSKLETLKDAFDVSVSAIINKVTQLRRDIISGSEDKDFIEENSWKYELLEGQRTVGPHEWDPFFSKPKPKDKGADSGNSSAEAAKNSWKIKRGDQN

SEQ ID NO: 136550 - protein, 209 aa, Triticum aestivum
  Clone ID: PAT_TA_30968.pep
GAPLLGRTGERVKLISTSEQGGSTTANLKGFDCPSSEHKHDKVQQLTWLIVLEIATGALLLVFLITGAITASRSCNLKPSIRISSWSRSKSWSDEITVLIDSDMLKSLPKLSRQELEVACEDFSNIIGSTPETVVYKGTMKDGPEVSVISLCAFEGHWTSQHELFYQSKVIDLARLNHENIAKFLGYCRESDPFSRMLVFEYASNGTLY

SEQ ID NO: 136551 - protein, 159 aa, Triticum aestivum
  Clone ID: PAT_TA_30969.pep
FHVGNSDEFPQSISALLSSLQLFALLCDDILIEGFRLQFLEAITEKAMSRTDIGALQAIHRVAGHVARGGSSGMMYAVRAHLVGLLHRRCTTCTACLRGFEFHSLPPDPPKERRSSRGRPVPSDRCTPGLPHPSFFSYLSSSLDPPLSLFSTRKIKAPP

SEQ ID NO: 136552 - protein, 128 aa, Triticum aestivum
  Clone ID: PAT_TA_30970.pep
GFNPPPGTCRAPPPRRGHTRAPPPRGRAPRAAGASTVQAPPGRGHARTSPPGASTARAPPAAVSSSSAAGTTSSAHHRGLHRASSSPPTRRPPRELIPAPPRRPPRELLPPRSPVTLAGQPPHRSSSP

SEQ ID NO: 136553 - protein, 152 aa, Triticum aestivum
  Clone ID: PAT_TA_30971.pep
FTPGARAWCWSRRRAAPRSRPRHWLRSHSSTAPGAGHNGEDHANRGRPDAGRVGVGEQARSASAHGGTLTGSRTSLRRKEYLRAARRWGIHRTSSSRPRPRKNSSAGGVHRASSSRRGLDLLPRAPDPSRAQPPHPARELLPAPTRRPPRAV

SEQ ID NO: 136554 - protein, 172 aa, Triticum aestivum
  unsure (1)..(172): unsure at all Xaa locations
  Clone ID: PAT_TA_30972.pep
HEGDEGRRDVAGDGRGRRRGGGGGGGGGAGGAEEADGREGAGAGAGGGAVTLEELRKKMADRGGGRDREPSGRGRSPLGGPGGEVGELSEIFQWKGEVPKGLPGWQKXCGVDLGKAALRKIDLNARKYPAGPGCRPSKKGVHCSDDTGDSRDDHGDVVAVVRADEIKEEHAS

SEQ ID NO: 136555 - protein, 275 aa, Triticum aestivum
  unsure (1)..(275): unsure at all Xaa locations
  Clone ID: PAT_TA_30973.pep
MAPGLYTDIGKKTRDLLYRDYCTHQKFTLTTCTPEGVAITAAGTRKNESIFGELQTQLKNKNLTVDIKANSESDLLLVYSXSKELSVGVDVSFDTATSNFTKYNAALSLTYPDLIASLHLNNHGDTLTXLSGVFGSKELSVGVDVSFDTATSNFTKYNAALSLTYPDLIASLHLNNHGDTLTASYYHLVKSHSSTAVGAELSHNFPRNESTLIFGSQHSLDPHTSVKARFNNYGMASALVQHEWRAKSLVTISGEVDTKAIEKSTKVGLSLVLKP

SEQ ID NO: 136556 - protein, 202 aa, Triticum aestivum
  Clone ID: PAT_TA_30974.pep
CHGAAGARTDGLTVQIAAHRRTTTSTATGLPAGNNLVQEVRNLEISFPAQGLGRIRPEAVAIILQLQVRHRPSSSITLPLLPPRPRRRVHRESPQLFPLFPPLIRTRSRVLPSLPTPWSLPPRHGQSSRSGPSFDAAGPRTLDLAPPNLVGLPHASLTLLRLDPSVGSRLSPFSGVGGRRWPAAPGEVGRVGAWQEAAGGAR

SEQ ID NO: 136557 - protein, 177 aa, Triticum aestivum
  unsure (1)..(177): unsure at all Xaa locations
  Clone ID: PAT_TA_30975.pep
ANSARGKEGFTTSPXRGEMLAWGKNGTRSQTRYNNVGGTNGRLGKGGRFAKLVDHLRATDENKEFNLYLVLLPLDGQTMPNLEKPYLSCRPRVSIRHLLQFIALQLSRQVEELEMYIRVDLHNRSVAVKDSGSAETKLSLFDGLERLREDKLLLDLHPSFASGNGDLELIYALKRQG

SEQ ID NO: 136558 - protein, 111 aa, Triticum aestivum
  Clone ID: PAT_TA_30976.pep
TRPAPGAAPTYGSAQVPPSYASGPVPSSSYGATTARPHGSAQGLPSYGQTQAPSYAHTQMPPSYGLAQASSHFAPTQGGSPYGLSAQPQGYGSAQAAPNTSGAYQAPHGRR

SEQ ID NO: 136559 - protein, 254 aa, Triticum aestivum
  Clone ID: PAT_TA_30977.pep
MKKNYDSMVTELEKLRAELTNTTNIDRSGTLYNPNFAQKDGGTSSHHSAYDGGYGVAQARTPPGMPDPLSGSPAGTAPRSGYDPSRGNSYETSRLARVHDASRGATGYDSLKVAGYDTSRMPALGAQAAAPTAHGSSAGYYGSSQVTPPSHARAPGAPTYGSAQVPPSYASGLVQTSSYGATTAQGLPSYGQIQAPSYAHTQMPPSYGLAQASSHFAPTQGGSPYGLSAQPQGYGSAQAAPNIGGAYQAPHGRR

SEQ ID NO: 136560 - protein, 376 aa, Triticum aestivum
  unsure (1)..(376): unsure at all Xaa locations
  Clone ID: PAT_TA_30978.pep
HHXQLPANRXYRMVYAAHAVVPGTPANVTNQCLPNSLSPXKVRGKIVVCLRGSGLRVGKGLEVKRAGGGAIVLGNPPMYGSEVPVDAHVLPGTAVSMAGVNTILKYINSSANPTAYLDRSRTVVXDVKPSPVMAQFSSRGPNALEPSILKPDVTAPGRQGRAAWRGGARRRRPDGDDGEEREEKNNIISGTSMSCPHVSATAVLLXKSAHPDWSAAAIRSAXMTTATANNAEGGXPIMNADGTVAGAMGYGSGHIRPRHALDPGLVYDASFQDYLLYACASGGAQLDRSFPCPASPPRPYELNYPSVAIHGLNGSTTVHRTVTNVGEHGAHYRVAVVEPMGFSVKVSPTSLAFARTGEKKSFTIKIEATGEQKSDV

SEQ ID NO: 136561 - protein, 232 aa, Triticum aestivum
  Clone ID: PAT_TA_30979.pep
SARGNRERDGVAIFGGGPLFAANGRSITEMLGGDTPLRKHGESPGYYVSASRGVFVDGVKVPVDTYAPLTIGFSTTTPYALVRRDVYRPLIDAFDQAMERDGAITAGARVPSPAGSPFELCYNSSRLSLTRFGYFVPTVGFGLEGGSGWAVQGINSMALVIGRPTACFGFVEMKEGDNAGYGGGAAPAVVLGGLQMEENLVVFNEEKQTMAFTGQINGRGLFCSNFNFTVPA

SEQ ID NO: 136562 - protein, 327 aa, Triticum aestivum
  Clone ID: PAT_TA_30980.pep
MAGTGSTWLLLEQKGAGPGARSSHAITLVGGTAYSFGGEFTPRLPVDNTMYAFDLKAQSWSALDAAGEVPPPRVGVTMASVGATVFVFGGRDKDHTELNELYSFDTATSTWTLLSSGDDGPPHRSYHSMVADGEGSRVYVFGGCGNAGRLNDLWAYDVAAGRWEELPSPGAACPPRGGPGLAFAGGKVWVVYGFSGDAELDDVHSYDPATGKWAVVDTTGDKPTPRSVLCAAGVGKHVVVFGGEVDPSDLGHLGAGKFSAEAFVLDTDTGAWVRLDDAGSGHHPGPRGWCAFSAGALDGRRGMLVYGGNSPTNDRLGDMFLFTPLLA

SEQ ID NO: 136563 - protein, 192 aa, Triticum aestivum
  Clone ID: PAT_TA_30981.pep
MNLTDWLLCRCRNNKPKKKAEKRPRLPRVSFLTKSEVDHLEDGYRWRKYGQKAVKNSPYPRSYYRCTTPKCGVKKRVERSYQDPSTVITTYEGQHTHHSPASLRGSAAHLFMPPGLHGLPPPHLIPPGVFHPELMSMMRMPYPSPNMHLLSVPPPPHHHPTSHPMAGTLQQYHFTDYALLQDLSTSTMPNNP

SEQ ID NO: 136564 - protein, 165 aa, Triticum aestivum
  Clone ID: PAT_TA_30982.pep
MPPKIDPSQKVEIFVRCVGGEASGVSSLAPKVGPLGLSPKKISDDIAKATGDWKGLKITCKLTVQNRQAAVEVVPSAAALVIRALKEPARDRKKEKNVKHNGNLTLDEVIKVARAMRHRSMAKTFSGTVKEILGTCVSVGCSVDGQSPRPAQAKIDAGEIELPDA

SEQ ID NO: 136565 - protein, 289 aa, Triticum aestivum
  unsure (1)..(289): unsure at all Xaa locations
  Clone ID: PAT_TA_30983.pep
MGRKRRARVSSDSDGDDVEMNGDEPAPAAAESKSLYEILGVASTASQQEIKKAYHKLALRLHPDKNPGDEEANEKFQQLQKVISILGDQEKRALYDETGITDDDALVGEAADNLQAYFRTVYRKVTEADIEEFEAKYRGSDSEKKDLKELYTKFKGNMNRLFCSMICSDAKLDSHRFKDIIDQAIAEGEVKSTKVYAKWAKKISEIEPPXTNPLERRVKKKKSQESDLILAISQRREQRKERFDSVLSSIMSKCDDNKAGSSEPTEEEFERARQRLEKKRTKGRKWYES

SEQ ID NO: 136566 - protein, 271 aa, Triticum aestivum
  Clone ID: PAT_TA_30984.pep
ADKARNIARARAAIESAAADGAKLVLLPEIWNGPYSNDSFPEYAEDIEAGGDAAPSFSMMSDVARSLQITLVGGSISERSGNSLYNTCCVFGSDGKLKGKHRKVHLFDIDIPGKITFQESKTLTAGQDLTVVDTDVGRIGIGICYDIRFQELAMLYAARGAHLLCYPGAFNMTTGPLHWELLQRARAADNQLFVATCAPARDTSSSYVAWGHSTLVGPFGEVIATTEHDESTIIAEIDYSLIEQRRQFLPLRHQRRGDLYQLVDVQGSGSK

SEQ ID NO: 136567 - protein, 122 aa, Triticum aestivum
  unsure (1)..(122): unsure at all Xaa locations
  Clone ID: PAT_TA_30985.pep
EGKFFWLIAQKLGKLLDLVRQGEMANLLVPQPRSRRGIGISCFGRWCLWLGSLRRSITVGCAGCQRLGQGRHWRARGGGRASHQGPRPRTRRRGGAGRCGRRRRLRLGLLXRGIAIGGVGYW

SEQ ID NO: 136568 - protein, 70 aa, Triticum aestivum
  Clone ID: PAT_TA_30986.pep
MGRSRGVPNSGDDDTNHRSKRRRVASTGDASDSLSAACGGAGDGKKALYHCNYCNKDLFGKIRFKCSKCP

SEQ ID NO: 136569 - protein, 350 aa, Triticum aestivum
  unsure (1)..(350): unsure at all Xaa locations
  Clone ID: PAT_TA_30987.pep
HEITNLPRKWNVCVIGTHDLYEHPHINDEAGTRAEKDGKFGFNLLVGGFISPKRWGEALPLDAWVPGDDIIPVCKAVLEAFRDLGTRGNRQKTRMMWLIDELGMEAFRSEIEKRMPNGVLERAAAEDLIDKKWERRDYLGVHPQKQEGLSFVGLHVPVGRLQAADMFELARLADEYGSGELRLTVEQNIVLPNVKNEKVEALLAEPLLQKFSAHPSLLMKGLVACTGNQFCGQAIIETKARALQVTRDVEARVSVPRAVRMHWTGCPNSCAQVQVADIGFMGCLTKNSSGKIVEAADIFVGGLRRSADLAXLTGVYKKAVPCEDXVPLVADLLGGAVRGPWPREREEDEE

SEQ ID NO: 136570 - protein, 105 aa, Triticum aestivum
  Clone ID: PAT_TA_30988.pep
TKQACASRDSYKKYKKAGAEVIGISGDDAASHKAFAKKYRLPFTLLSDEGNKVRKEWGVPSDLFGTLPGRQTYVLDKKGVVQYIYNNQFQPEKHIGETLKIIQNL

SEQ ID NO: 136571 - protein, 143 aa, Triticum aestivum
  Clone ID: PAT_TA_30989.pep
MTIPSQEITEAATPRRQQPIDEEAVANGDGRTCELPTWALIGGITVGVALALALSVDAGPAMALGPEGPLLEEFWDNMRRYGLYALTVSTGFAWALVQPIYELLRNPITAVLIIVVMAGGAVLTVQVINAMAGNSDFVYMYEQ

SEQ ID NO: 136572 - protein, 104 aa, Triticum aestivum
  Clone ID: PAT_TA_30990.pep
DRGTSSGERRPVATVFGVHARLEKKDGNLVVTDMDSTNGTYVNERKLVPGFPVAVQPGSLLIFGDIHLAMFRVRKTIVDVAAEATKDDQQEAETVLASAVQETS

SEQ ID NO: 136573 - protein, 216 aa, Triticum aestivum
  Clone ID: PAT_TA_30991.pep
MAFAASTACCKPSVLLAPRASSLSSSQARLCRPSTSAAFHGLRAPASAFALTPAPRRRAASTGIVCGKVSKGSVPPNFTLKDQDGKTVSLSKFKGKPVVLYFYPADETPGCTKQACAFRDSYEKYKKAGAEVIGISGDDAASHKAFAKKYRLPFTLLSDEGNKVRKEWGVPSDLFGTLPGRQTYVLDKKGVVQYIYNNQFQPEKHIGETLKIIQNL

SEQ ID NO: 136574 - protein, 224 aa, Triticum aestivum
  Clone ID: PAT_TA_30992.pep
MEAAAAAASSSVLLSFSSPGRSTAATFLRLSTASPRITCSATQQLPLAAPWLLTSDKSSSRRRSILSLRCSSASTGSPSAVVSSERWILEPAGDGDWKHIGYRVARPGAMEIASEAITVGRVPENADVVIPVATVSGVHARLEKKDGNLVVTDMDSTNGTYVNERKLVPGFPVAVQPGSLLIFGDIHLAMFRVRKEIVDVPAKATKDDQQESETVLASAVQETS

SEQ ID NO: 136575 - protein, 88 aa, Triticum aestivum
  Clone ID: PAT_TA_30993.pep
GREGNGFTQLLMEYRLMSKLGSKHRRERLKTLAATSDHPHTTLEHKTHSARTDSRTLVFFNFITTPGAKTLHTLRSAVHLMRSEHADA

SEQ ID NO: 136576 - protein, 158 aa, Triticum aestivum
  Clone ID: PAT_TA_30994.pep
MSLIRRSNVFDPFSLDFFDPFDGFPFGSGSSNSSGSLIPRTSSDTAAFAGARIDWKETPEAHVFKADVPGLKKEEVKVEVEDGNILQISGERNKEQEEKTDTWHRVERSSGKFLRRFRLPENAKAEQVKASMENGVLTVTVPKEEAKKPEVKSIQISG

SEQ ID NO: 136577 - protein, 162 aa, Triticum aestivum
  unsure (1)..(162): unsure at all Xaa locations
  Clone ID: PAT_TA_30995.pep
MSLIPRGNAFDPFSLXDLWDPFDGFPFGSGGSSSGGSLFPSFPRISSETAAFAGARIDWKETPEAHVFKADVPGLKKEEVKVEVEDGNVLQISGERNKEQEEKTDTWHRVERSSGKFLRKFRLPEDAKADQIKAAMENGVLTVTVPKAEAKKPEVKSIQISG

SEQ ID NO: 136578 - protein, 216 aa, Triticum aestivum
  Clone ID: PAT_TA_30996.pep
ARRSSMDAFHLLRLGVLREPEPAAGNLPTCVRPPSRLSRCQSFSARRLPLLPRFAPLILEDLAAPSPRHTPPLRPSLPAPATSRPCTCCAFWASSLPSSASCSCPGPSAPPVSAASACFRGRGVPPAQPVGRSAEGDAACAMGPKKSQGEGGRHGARGRISEIVGRKGGDGSVRGGMDGGVGVVLEAGRVGNWFHGSSGGGVLGGCCRGDLLVGDV

SEQ ID NO: 136579 - protein, 186 aa, Triticum aestivum
  Clone ID: PAT_TA_30997.pep
MGSPSRVLPIILVLHFILSMASPSLSCVIPCESEINLRLYLHQIAAGSGTNQVAIVASSQPAGFGTTAVNDWTVIDGPNPGTATIVARTKGMHVQADVGGPGWFNYFSMVFEDARRRGSSFEVMGMNRAQEGEMAIIGGTGEFAMARGTIKYRALANPPPGQSIKELNIHAFYVKPAGTIAGPTIQ

SEQ ID NO: 136580 - protein, 323 aa, Triticum aestivum
  Clone ID: PAT_TA_30998.pep
MEGPFPLLVHDLGNRTDDCQTRFSISNQAVSTAAIHELKDYRCFESPQGWVLALEPASLHTFLWRPQDGQRISLPSPKQEFPRRCKCLLSDKPSSTSSCTVLVLDLDQPNLLVCRIGGSQWDSYNYELTMFLADDKPREIHMAKLKGIAAVGGKVYYTFTGHALGVVEFSPELSLTEFEVDMVELPDTMPFTSTYLVESCGDLFMVVVVFLGHNVHKIDKVDVYKMDFSRPEWCKVDRIGDRVFLLGGDSIGASNFGASCSASEHGLSSNCIYFLNNIAAEENYLHIFNLEKGTEEVQRPFRHKNGCLLPPPRPPMWLLPTDD

SEQ ID NO: 136581 - protein, 140 aa, Triticum aestivum
  Clone ID: PAT_TA_30999.pep
MDTQGKDQRENTRSTGQPEAARIRLLRFDDNGWYISEHRAPHNHSLSSTCGEKMHWLSHRLIDRYTKDLVRQLRENNVSLGKVFSIVGSFFGSVDNVPFTKRSLKTLCCKLNKEQSDSDARKKSRMDILAEMKVNDSEFN

SEQ ID NO: 136582 - protein, 134 aa, Triticum aestivum
  unsure (1)..(134): unsure at all Xaa locations
  Clone ID: PAT_TA_31000.pep
GAVSEYLVRSWTIXRTALIICTHGVRRRAPRPQALGAHAPHPVGDGLPGHSAGHRSAGEDPARSAEAGWRRIGQPAPELRAGTAGGGRPRDRGAGKIGDGEVERRPAATPGTDNASQGSHFFGLTLPSWTVGLG

SEQ ID NO: 136583 - protein, 242 aa, Triticum aestivum
  Clone ID: PAT_TA_31001.pep
RHEATLVRDDPLPVGPEGAEPQPHRQATLGEMTLEEFLVKAGVVREIPTAPAVPPPPMHPRPVPVVPKGPSFYGNFPSANDAGAAALGFPPVAMGDLALANGLMPRAVGMGGAPLVVQTAVNPVDSGSKGSEDLSSPSEPMPYSFEGIVRGRRTGGGVEKVVERRQRRMIKNRESAARSRARKQAYTMELEAEVQKGGDPDGEPGRAEKEILEMQKREAPEMKDQFGRKKRQCLRRTLTGPW

SEQ ID NO: 136584 - protein, 178 aa, Triticum aestivum
  unsure (1)..(178): unsure at all Xaa locations
  Clone ID: PAT_TA_31002.pep
ASASGASFLPRHSSRPAAEAPTAHPPSKETHAQARNDCLPRALAVVTMDAPSATAKRKRSSPAAAAPAPVSVDDVSDAEVEEFYAILRRMRDASRRLVSRRGRRGHGPRXPAPRAPAWCPSFSWEDFAPPAPTPPPAPSQQEQLLPADERVAENASPPRRPVPRGLDLNAEPEPEVQA

SEQ ID NO: 136585 - protein, 118 aa, Triticum aestivum
  Clone ID: PAT_TA_31003.pep
EPYVGSIDAGGNDVYGRCFPCRRCRRGAPTPTVFVCGLRVKTQDRACRIGWRCCVLGNTTSLEGSSWRPKRRLLLLCVVVGGAFGGGACSGPRVVCSSSVVSLRLSYVWSPACYYACS

SEQ ID NO: 136586 - protein, 274 aa, Triticum aestivum
  Clone ID: PAT_TA_31004.pep
QIAKQHHEKLNTGDNRAAEGTGVQLKPGNASLLGWAMSSITQKGKPSDHGPVSTANASNSQVSAPPSTTSDTHSAPAAYAPAATSNSFDQTAPASASSSMDGWGELENGNQEENGSDNEGWDDVDPFEEKSPPSLLSNIQAAQKRPVVQPKQPIPSSSRSNQPAAPKAEEDALWGPTAVPAPKIAPKSAGIKPSVSHNDDDDLWGSIAAPQPKSSGKALKPAAANNDDLWGAIAAPPPATKARPLASSGRGRGAKPAQPKLGAQRIGRTSSTGM

SEQ ID NO: 136587 - protein, 491 aa, Triticum aestivum
  Clone ID: PAT_TA_31005.pep
MAVASSSTESHVLPHIAIFPFMAKGHTIPLIQLVHHLRRRGLATVTFFTTHGNAAFVREGLSGADDTAIIELAFPADVSGVPPGVESAEAVTSMASFLAFAHGVLLLQPQLEASLAAMEPPASLLVADAFLYWTNASAATLGVPKVSFFGISAFAQVMRELRITHDPCPALQHADFDGDGNPATFTVPEFPHIKLTFEDLMAPFGDPSSVAPMMELDSKLGKAIVESHGLIVNTFQGLEKPYMEFWNKHYRPTAWAIGPLCLSQTASSSSGDAGRPSWMEWLDEKAAAGRAVLYVALGTLAAIPEVQLKEVADGLERAEVDFIWAVRPDNIDLGAGFEERTKDRGLVVREWVDQLGILQHESVRGFLSHCGWNSVLESVTAAVPLAVWPMHADQPFNAAFVVDELKIAVRVHTSDRTMRGLVTSQEISEVVRKLMLGEVGTEAAKNVAELSMVAMESVLERGSSWRAVEEMIGELCAPNMHANVEPSKEES

SEQ ID NO: 136588 - protein, 195 aa, Triticum aestivum
  Clone ID: PAT_TA_31006.pep
GWLPYLGGGDDGRDDRIEDLVEEMEASRFWPVERREAVARDLLRGLDDCGGRFCCRDELETHEELADHVAARCRFRPVRCRNQAQGCRAEVSACRADAHDEACAFKLLPCEQRCGLAVARRQMDRHCVTVCPMKLANCPFYQLGCESAFPACNLGSHCAEFLRPHLRLLLSPSKIGADRLDPEERLLRLEKVSIS

SEQ ID NO: 136589 - protein, 211 aa, Triticum aestivum
  Clone ID: PAT_TA_31007.pep
MNKIKVHPNVAAASPAVSAAEGEKGEAVSLTVWRRSLLFNGKGFTVFDTNGNLVFRVETYSRGSPREVVLMDAHGLALLTVRRKKLSLAEEWLVYDGDGDEPAPRRFTARRNRSLLRTKSLARLSPPRSLDGTGDAPGCRYDVEGSYAGRSLDMFACTSWASGGNQRRRVATVCRKEAAVGLDVFRLIVEPDFEPALAMAMVILLDQMNAS

SEQ ID NO: 136590 - protein, 103 aa, Triticum aestivum
  Clone ID: PAT_TA_31008.pep
SPLITMYKRKIRKAFQTAVQFSCPRGMAVTVTQTSSSLDKLHGWEVCRSKLPLSCIREVSSAAVIHTSTSKTPSKFTLSLLYSNGPNKTARVILPRKMVLLSA

SEQ ID NO: 136591 - protein, 118 aa, Triticum aestivum
  Clone ID: PAT_TA_31009.pep
SSHSHYFTRTGQTKQPVLFRHVKWCYCQHENIYSYTYCICPSQSTTDRGPDQSFKSTNRNLGRDHASPPHAPSPPERYLQPTPACPPKAALRHRPKVHARPNLENHVWRKTSRTLTTT

SEQ ID NO: 136592 - protein, 722 aa, Triticum aestivum
  unsure (1)..(722): unsure at all Xaa locations
  Clone ID: PAT_TA_31010.pep
MATTPALHDALLDFTSRENWDKFFALRGDGDSFEWYAEWPQIKAPLLSLLLGEEGTEILVPGCGSSSLSEQLYDLGFRRITNVDCSRFFVADWLRRHARLRPQMRWPVIDMTNLQFPDGSFDFILDKGGLDALMEPEVGTKLGMKYLDEAKRVLKSGGKFACFTLAESHVLDLLLSEFRFGWDMTIQAIASEPSSKSAFQTFMVVMVKGKMGVVRTIKSLVXLSSEYCNMQQANAVIHALLNENXIRHSQNSSKDIQXNAQYLQHGAIGDLMRILTVDVDSSDLGARGSSPPAYLARLCVPXVRNEAPVYLGGASSAPKARAQQSLWASAGGQSLVGLSAQAAPLIMVCLDRRHASADIDVVKKDLSPLVMDLEPEYPEETDPMPFMMASDGVKQRDILQEVTSEITGPMVVEDVLYENVDGDQSCMSEKMFRRLIFKRSSGLVQSEALLIRESPSDETDSKTKNSSASSKKKSQKKGLTGSKDSLRVDHSYLGSSYHSSIICGLSLVASALSAAASSGERVSTTIVGLGAGSLPMFLRGCLPHLNIEVVELDPMMEEVATKYFGFSMDEQLKVHLGDGIKFIEENAHSEPNGKDSDAVRILIVDVDSSDLSSGLSCPPANFVEDAFLMSAKKFLSAGGLLIINLVARSSAVREMVISRLKAVFENLYSLQLEEDVNEVLFASPSKRYLEIDHLDEAATKLKAMLKFPVDVESDMKNLQRLQ

SEQ ID NO: 136593 - protein, 220 aa, Triticum aestivum
  unsure (1)..(220): unsure at all Xaa locations
  Clone ID: PAT_TA_31011.pep
MKYGDDGSTSLALVPVPMPEEPTAVAPGDSGAFSAPAVKPAAGGVLAVPPVGMKKRGRPKGSTNKVKKQDKVMSALAFIGTAGAGFTPHVIAVQAGEDVAAKILSFAQHGVRAVVVLSANGAISNVTLRQSATSGGTVTYEGRFEILSLSGSFTVQEXGGHRSRTGGLSVSLASPDGRVXGGGIAGLLIACTPIQVVVGYLQHRGREEEGTEAPSCCCCT

SEQ ID NO: 136594 - protein, 289 aa, Triticum aestivum
  Clone ID: PAT_TA_31012.pep
VFITGGSSGIGLALATAAAREGARVSILARNAARLDDARAAIRLATGQDVGVHQADVRDAAAVARALDEAGPVDVLVCNHGVFVPQELEKQDMEEVKWMVDINLMGTFHLIKAALPAMKARTRETSLPASIAIMSSQAGQVGVYGYTAYSASKFALTGLAESLQHEVVSDDIHVSLIFPPDTETPGLVEEKKKRPELTTIIADSSGGMKADDVAMKALNGIKSGRFIVPCNFEGAMLAIATSGLTPQSSPLIAFVEVIGAGLMRFVALCFQWNWFSTIENWYAKNKKHG

SEQ ID NO: 136595 - protein, 179 aa, Triticum aestivum
  Clone ID: PAT_TA_31013.pep
MAGRRAPHVMSLHDSGPPLLGRAPQHPQPGDDRDEPPHGALLHHPRGGPAQHPAVAALEDRIVARDRDIQEFLVDNQRFAATHVALQQQLISAQHELRAVFIAGTRARMEREADVCDIADQAARIEAEARSVAGARVEIEQVHADVRVLAGARNELMDRLKSLREQLGRAQSQFRPVGE

SEQ ID NO: 136596 - protein, 199 aa, Triticum aestivum
  Clone ID: PAT_TA_31014.pep
MLCICWNGSVLCCKMLRDCSSYARKGMAMEMSRDHRPTYEAERQRVTECGGYIEDGYLNGVLSVTRALGDWDMKMPQGSQSPLIAEPEFQQTVLTEDDEFLIIGCDGIWDVMTSQQAVTLVRKGLRRHDDPERCARELAMEAKRLQTFDNLTVIVICFASELGGCLRSSEEASSRRIRSCKSLSAEALCNLRRLLESDQ

SEQ ID NO: 136597 - protein, 172 aa, Triticum aestivum
  Clone ID: PAT_TA_31015.pep
MGFPSVCYCVILPQPLILVLQLLDFLRHAVLLCLSSLGLAAPPAADDHPAYAPPPDLWAVAESAAPSSSLSLATGPAPAPAAIKARLPAVRYADLRSRRCAAGAAAASTCCAVCLGALEARHRVRELGNCAHAFHKACIDKWVDKGQATCPLCRALLLPTDADAGKLPTFSF

SEQ ID NO: 136598 - protein, 277 aa, Triticum aestivum
  Clone ID: PAT_TA_31016.pep
MKTDWDESVIQSPWHGSNSPCGVNASPPPPGPYLPPPRASYNASPTSSSFPSGASSPFLPHSNNMVNGVDATPILPWLQTFSNSTASSKRAHLRLLLIHGGSISAPVTPPLSSPTARTPRMKTDWDESVIQPPWHGSNSPCVVNSTPPSPGRQMVPDPAWLAGIQISSTSPSSPTFSLMSSNPFSVFKEAIPGGGSSRMCTPGQSGTCSPVIPGMARHPDVHMMDVVSDEFAFGSSTNGGAQQATAGLVRAWEGERIHEDSGSDELELTLGSSRTRS

SEQ ID NO: 136599 - protein, 167 aa, Triticum aestivum
  Clone ID: PAT_TA_31017.pep
IQKGGKKKKKFPKKKKKKKPLSISGDRIRRPSQLRPPDPLPRPVASPTTTDSWSDDLVFNREPARQVGGDDVAFPGRREAPVLLRPCCPSAGVAMSGSRSAAPTTRPFARLPPDPATPSIAAARSLPLSLSRGPGCIPLMASHAPCRGFSFSSSYVKIISYCFLEVK

SEQ ID NO: 136600 - protein, 178 aa, Triticum aestivum
  Clone ID: PAT_TA_31018.pep
DRLQWLDATNALMVATLFPKTDNCSIGLLDFRDKSVAWSWSDAGTAASLEEKRVLHAIAMEDERSVCVINQYDDLGFLDLRSNPGAVRWSSRSKLMNRKAPGEESCYPKLATHGGQLFSSMNDSISVFSGPEHVLTSTLRRSYGGAICDFSIGGDRLFALHNEENVFDVWETPPPPII

SEQ ID NO: 136601 - protein, 58 aa, Triticum aestivum
  Clone ID: PAT_TA_31019.pep
MKPSLDGHNPSWFMSLCMETEELGPLFQRRFDGHAHPYIMAWPPSLIDNQVHPQLEGA

SEQ ID NO: 136602 - protein, 70 aa, Triticum aestivum
  Clone ID: PAT_TA_31020.pep
TPNLYAQNVLYDHDDKSAPHIMFFACEDIPPGQELVYHYNYAIDQVHDENGNIKKKKCLCGSVECDGWLY

SEQ ID NO: 136603 - protein, 82 aa, Triticum aestivum
  Clone ID: PAT_TA_31021.pep
QVAVVRPVTTASNSNNGDSLLPSSAGQVISEGISKGDTRETGTRNTCIYRFHSASAPTPTCSSCRCRIGAASNLLAQFLRSQ

SEQ ID NO: 136604 - protein, 74 aa, Triticum aestivum
  Clone ID: PAT_TA_31022.pep
TWLVIFFVFLPCICDTSLNMFISLSRHSCLTCQFTKGSLVHIAPACAGSGERSDHLTCQFTKMKEIQMTCEPPC

SEQ ID NO: 136605 - protein, 119 aa, Triticum aestivum
  Clone ID: PAT_TA_31023.pep
ADKLYDQPLLGFVRAKNEPTENQEAQPAQKTREEPLDLQNKCSLENKKEDESGDSESCFRSDEDGSWHESTKMGPEERKAARKENKKKVKEEKRETRKTKIPKADKKKRKKMAKAKCKR

SEQ ID NO: 136606 - protein, 87 aa, Triticum aestivum
  Clone ID: PAT_TA_31024.pep
RGYRGGIRFHVLHIVPLLRGGGEIKRGDELELHGLVRVVAAVAEPRVHQPLHHAVLQVRLGPGEEAHVGAATGSAEMSPGGRREGEH

SEQ ID NO: 136607 - protein, 90 aa, Triticum aestivum
  unsure (1)..(90): unsure at all Xaa locations
  Clone ID: PAT_TA_31025.pep
TRGFSXLKPGGPGSGARGPGRAPGRPGTPGLWXYFLGPVLGTLSGAWTYTYIRFEDPPKDGPQKLSSFKLRRLQSQSVAADDDELDHIPV

SEQ ID NO: 136608 - protein, 279 aa, Triticum aestivum
  unsure (1)..(279): unsure at all Xaa locations
  Clone ID: PAT_TA_31026.pep
GARRRHLWRGVQGARPPHRQEGRREAGPWQRGRGARPAGHPGDHPHFPLPLWVVLIVTSLTWIGWFPFILFDTDWMGREIYRGSPEIVADTQKYHDGVRMGSFGLMLNSVVLGITSIGMEKLCRKWGAGLVWGVSNIIMALCFVAMLIITYVAQNLDYGPSGAPPTGIVAASLIVFTILGAPLSVTYSIPYAMAASRVENLGLGQGLAMGILNLSIVIPQIIGSLGSGPRDQLFGGGNAPSXFWVAAAGSVEGGRGATMAPPPARFWRRRETTQRRRFS

SEQ ID NO: 136609 - protein, 357 aa, Triticum aestivum
  Clone ID: PAT_TA_31027.pep
MDSFFQRAFGDPMCSEDSNVVQQGIDKCPFLRNINEPTSFSLTSINFPAPATGAKGPIFEDGPNFDTAFRVFHGRDGVVPLSEGAFAHIEKPLPKPTPEFNPLAAKAATISLSGFGGFFSFGDFSNKRNKQNSNKKNPNNLPQNKGQSNNNHEAMSNDWLENGQCPLAKSYRAIGGVVPLVAKLLTPPAGMKLTCPPAIVAARAAISRTAFAKGLRPQPLPTKVVVIALLGMAANVPLGIWREHTTKFSVQWFAAVHAAVPFIGMLRKSILMPKSAMALTIAASILGQTIGSRAERIRLKRAKLAAEGHGHEHATRIEAPVNLKTGSSGAVQLWDPLGLRVKGAVSPALVPTVGAMY

SEQ ID NO: 136610 - protein, 137 aa, Triticum aestivum
  unsure (1)..(137): unsure at all Xaa locations
  Clone ID: PAT_TA_31028.pep
MVSLAEWXTPCLRNGQLDQIVDQRIAGTIRPGSLKKLADTAEKCLAEYGVERPTMGDVLWCLEFALQLQVGSSDSSDVDTMLPPAPPVPVKTPEVQRRLSAATVATDAAAMTTNLGDLDGMSLSGVFSNMIKSDEVR

SEQ ID NO: 136611 - protein, 220 aa, Triticum aestivum
  Clone ID: PAT_TA_31029.pep
VRGADFFLTRLPADDDTFPGWAIEGCCDGKVLLQNFSLEQLAVYNPLTRALDLIPVPPDKIFDDARGDAKYLGCYILSSEEGSEPLRLVYTCHDKSRARAAVFSSESREWQIFPWSEAVTPLPEDEHWLKVGTMVNGFVYWIHTNEAYILVLNTSTLHFSQMDLPPTLVAREFTFWVGESKDGKPCIVCPVYFELFVWVWRAEYDGMGEMDARQEVSVGV

SEQ ID NO: 136612 - protein, 55 aa, Triticum aestivum
  Clone ID: PAT_TA_31030.pep
VEDVLLLVVFLLLIMIIHHSACAHIIYSVYNVTYVRACMAGACHSANKCINKMEV

SEQ ID NO: 136613 - protein, 38 aa, Triticum aestivum
  Clone ID: PAT_TA_31031.pep
QFCSYIAETCLGLAAAKIQSFVVFPSCHKMLHPLFLNV

SEQ ID NO: 136614 - protein, 193 aa, Triticum aestivum
  Clone ID: PAT_TA_31032.pep
MAVNDTKLADAENPGVMCRGGGIDSDSDVDFAGRANWLRAAVLGANDGLVSTASLMLGVGAVKHEVRAMVISGFAGLLAGACSMAIGEFVSVCSQRDVEIAQLDRDGKRGGDEERALPSPVQAAAASALAFSVGALLPLLAAGFIVGYKLRVAVVVAVATLALAAFGVDGAVLGRAPVVRSSAGSTRADWPTW

SEQ ID NO: 136615 - protein, 310 aa, Triticum aestivum
  unsure (1)..(310): unsure at all Xaa locations
  Clone ID: PAT_TA_31033.pep
MAHATVHGAPMTRPCPRPSAPLIVFLVLLASCYLALTRLPSAAPLAALIAPSAGHGSGHGAVDSCAGFYRGAGAAGRRAVTASVEEFGAVGDGVTSNTAAFRRAVAALEERGAGGGARLEVPAGRWLTGSFNLTSRFTLFLHHGAVILGSQDPEEWPLIAPLPSYGRGRERLGPRHISLIHGQDLNDVVITGXNGTINGQGKMXWELWWNRTLNHTRXISSELMNSNQRPDLHVTLRNSPFWTVHPVXXXNXVIKVWXITIPLECPNTGXIDPNPIQNLYLGRYIESXXXWLLQNGWVGRKPKITPRVQQ

SEQ ID NO: 136616 - protein, 92 aa, Triticum aestivum
  Clone ID: PAT_TA_31034.pep
IPCRQSQRSKQMQLLETRPTKKFALLILPEAAFISTIKPYQFAKDERSLLLFDEQYLQRRTRDAEGSSAGTNTKFAWSRRGRGMNEERRAKP

SEQ ID NO: 136617 - protein, 244 aa, Triticum aestivum
  Clone ID: PAT_TA_31035.pep
GARYCSGCRFARASAFPGVRHYVPRNLNHHRRSCATVELHDGVPPGEYRDLPDPLELPGGVSLRRADLPPSFRRCGEPVYAHLLEEGRRYRRADGFLVNTFYEVEPATVEEFKLATERGAFPPVFPVGPFVRPGTISDEAAGASACLDWLDLQPTGSVVYVSFGSGGSLTVQQTAELAAGLEASGHQFLWVVRMPNLDGGNDGRDREDDNANPLAWLPEGFLERTAVKGLAVVVWTPQVRVLCH

SEQ ID NO: 136618 - protein, 189 aa, Triticum aestivum
  Clone ID: PAT_TA_31036.pep
MAPRFLACFGRGGATASAPEPVEDLAPGPVLVELFSSQGCAASPEADALVARLAQESSETGGGERAMVVLGFHVDYWDYRGWKDPFASSAWTVRQKAYVEALRLDTLFTPQVVVQGRADCVGTEQDKLAQAVRDAPRYPSPAMKVKFQRPNPSTLQASFTGALHSRVDGGGSVLVALYESGVVTDWRRG

SEQ ID NO: 136619 - protein, 139 aa, Triticum aestivum
  Clone ID: PAT_TA_31037.pep
CVRGPGHDGRRAHPRLEHLFPPLHQRQGGGGHRGACLPAQGRHGQVPPRGPSPHRRRPTLASTYLRPAGANRLHGGWGAVVFSGPMSIGDLPTLGLTSHFLRSTYDLGENATVVPVCLPKDAMDKFRLEVEGLTGGAQL

SEQ ID NO: 136620 - protein, 360 aa, Triticum aestivum
  Clone ID: PAT_TA_31038.pep
MKARQLVNVVMRRYGMGSSLYAVSRIKPEEQLFYPSTKEAQASSTGEMETISISRMPAPSLRLELSVSKEDKRLDFLPFYERGSGGHSKILCVDAEGRTVLYDTDAGLLHSMPCLGTPKGPNPVSFSILDREPRDPGRADALYVMGRCCDYFDFEALMYCDPSSGRKGWRWHQLPPPPVPRAAASAVGCHALIHDEGDPILVVSSAKTSGVGTHCFNTSTNRWFKAGRWTLPLVGRAERVSELDNLWFGIGGGWPYDLCAMDLYSLRAAGAEAPGLAYSWGDLSLPDDWVMMDCSMVYLGGGKFCVAKIFEFCVGDDRLGMGAVISGLEVVRRGEPSKLVMVKHKSKFYKFTRDEIECIL

SEQ ID NO: 136621 - protein, 157 aa, Triticum aestivum
  Clone ID: PAT_TA_31039.pep
DVLRVGRAVLPIANSLISMSRVIFSGDPSMTLKVFPILLFGAKYGHLFTVWRLLATGFFGCFTLPKLYSCYSSHIHEKVEGLNARILNAWKSCPRKKLVAAAAVTTFWNLVSVKTRVMAAFVSAVALRYHYQYGRSSRNSEGVIRRQEQQQAMVLED

SEQ ID NO: 136622 - protein, 410 aa, Triticum aestivum
  unsure (1)..(410): unsure at all Xaa locations
  Clone ID: PAT_TA_31040.pep
ICQNLILLSPCLHMLPNQRTGRCTAVAGKTTRAKAGADCWVPGIGRNTEAYVLKDQETRYRQRYLDLMVNHQVRHIFRTRSRVISFIRRFLDERNFLEVETPMMSLIPXGASAKPFVTHHNELNMDLYMRIAPELHLKQLVVGGLDRVYEIGKQFRNEGFDLTHSPEFTGCEFYMAYADYNDLMELTETILSGMVMELTGSTKIKYHANGADNPPIEIDFTPPYRRIDMMQALKSIAGLDIPSDLSSDEANKYLAATCEKYGIRCSPPQTTARLLDKITGHFLEATCVNPTFIINHPEIMSPLAKWHRTQSGLTERFELFINKHEVCNAYTELNDPLVQRQRFEEQLRSRQSGDDEXMALDEAFGTALEYGLPPTGGWGMGIDQIAMLLTDSQNIKEVLLFPTMKPQLPG

SEQ ID NO: 136623 - protein, 191 aa, Triticum aestivum
  unsure (1)..(191): unsure at all Xaa locations
  Clone ID: PAT_TA_31041.pep
ERRTTQRHCCVVSRGLTDRGCRGGENIFSALVFEFPLLRLSSFKLGGEPSASLNGSILLSSSAICACRFDVSAGSILLSSTAICACGLTMSAGSILLSSTVTCSCGLNVSPGSVLSSTAICACGFNASAGSILVSSTAICACGFNTSAGSILLSSTVICACGFSVSAGSILLXLPLRFVXCXLVTEXPAAR

SEQ ID NO: 136624 - protein, 72 aa, Triticum aestivum
  unsure (1)..(72): unsure at all Xaa locations
  Clone ID: PAT_TA_31042.pep
MRQGLGPIEVTFENFPYYLSENTKDVLLSCSFLHLEKKGFIEQFSEVSSIXPANLSSGPSSKLFFVIAYCLR

SEQ ID NO: 136625 - protein, 174 aa, Triticum aestivum
  Clone ID: PAT_TA_31043.pep
AKMSCTPRAHASRLQAAACRAATLAAMSCTMSQNELHATRRAARHALTQAEVAACRAATLAAMSCMVSQNELHATLPGVFILGSSRSSCVGAAIGLHQRECRTARHAPRRLHPRDFAVVVRRCSHRAAPTRVSYCTPSRGGGGWGAPLMSGSDAGRAWGGAAIFGKNSWCRGRR

SEQ ID NO: 136626 - protein, 146 aa, Triticum aestivum
  Clone ID: PAT_TA_31044.pep
YIERHVNMGSVDSMIIKQLDFIRSGMVGYHSSVTAAMIPRYTAGSTTAAAAAGVRATSTLTGALGCLAPTGTSTNIPVALSVTYIERHVNMVSVDSMLIKQLDFYYSQWHGWVSFLSHGGDDPAVHGRLNDGRRRSKIYQHLRRRH

SEQ ID NO: 136627 - protein, 184 aa, Triticum aestivum
  Clone ID: PAT_TA_31045.pep
QKDLNSNDIRNRISRVIKMLAIKRIKEHVTTVKVPCHLNQTMTWLHPLICKKAFARRWLESHVLDLSPIAPPIAISAHPLQVLVLSTIALPSASSPHQMFRRFLPAATSGSPPPDVLVAAQAQQRAPCYFSRGGESPPRRKGRCMAGGWLEESRLGPGRRRKEASVQHQGRAGHRRPDRAPPPA

SEQ ID NO: 136628 - protein, 242 aa, Triticum aestivum
  unsure (1)..(242): unsure at all Xaa locations
  Clone ID: PAT_TA_31046.pep
VHPVYCXNVVIKDLTILAPLNAPNTDGIDPDSSSEVCIEDCYIESGDDLVAVKSGWDQYGISVGKPSSNIIIQRVSGTTPTCSGVGFGSEMSGGISNVLVRDLHIWNSASAVRLKTDVGRGGYITNITIANVTMEKAKVPIRFTRGSDDHSDDKYDRTALPMISDIHIVDIVGVDVQRAPMLEAVHGAVYEGICFRNVSLTAIRRQIRWQCESVYGEAHEVFPAPCEELRNNGSSSSWCGLP

SEQ ID NO: 136629 - protein, 201 aa, Triticum aestivum
  unsure (1)..(201): unsure at all Xaa locations
  Clone ID: PAT_TA_31047.pep
PRGRRAKHPRSLSHLRSSSSHGPQGRQEAGRREQGREGGGEDPGRQEAQGRETGQQQPWPPKQTSSRPPRARSRKAAEKTPAGKKPNTEKRFPAGKQAHPEGAGGEGKTRGRKKGGKAKKGVETYKIYIFKVLKQVHPDIGISSKAMSIMNSFINDIFEELXAGESAKLARYNKKPTVTSREIRSSVRLVLPGEPAKHCVS

SEQ ID NO: 136630 - protein, 171 aa, Triticum aestivum
  Clone ID: PAT_TA_31048.pep
RFKCFPPIRDAANKENLWEALLDGHIDMLSSDHSPSTPDLKLEGEGESERARGGISSLQFVLPVTWSHGKKYGITLNQLASWWSEKPAELAGQKNKGSILPGYHADIVVWKPEVQFHLDDTHAVYHKHRNISAYIGKELSGKVLSTFVRGNLVFAEGKHAGAACGATILAK

SEQ ID NO: 136631 - protein, 369 aa, Triticum aestivum
  Clone ID: PAT_TA_31049.pep
MAMMVDPPNGMGNHGKHYYTMWQTMFEIDTKYVPIKPIGRGAYGIVCSSINQETNEKVAIKKINNVFDNRVDALRTLRELKLLRHLRHENVIALKDIMMPIHRRSFKDVYLVSELMDTDLHQIVKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSETDLAFIDNPKARNYIKSLPYTPGMPLSIMYPHAHPLAIDLLQKMLVFDPSKRISVTQALEHPYMSPLYDPSANPPAQVPIDLDIDENIGTDMIREMLWQEMLQYHPEAARMVNM

SEQ ID NO: 136632 - protein, 300 aa, Triticum aestivum
  Clone ID: PAT_TA_31050.pep
EAITVSKCSPVMVRPSTEPVLGKTAATQVVQLSSWDRGYVGFLAAVLLVFDGPVHQPVEAIREGLSRALPHYHTLAGRLPPPHDDDDSVLHVACTGEGVPFVAASAGCALQDHGLLDAPFSTSLLDRLAVAYPAAEGCRRTDPLLLMQVTEFACGGFTVGVTWNHTLADGAGMAQFLQAVRELARAEADVVLVPSVAPVRDGRAVSLPLLSPHVVAGKQWLMLDRGGTGLVYLDITVPVKLINRIKSEYKAAHADDGGYCTTFEAAVAVLWRCRTRAIIGDDPDYDMSTPAPLAFFVNVR

SEQ ID NO: 136633 - protein, 112 aa, Triticum aestivum
  Clone ID: PAT_TA_31051.pep
HDAGRRWQGSGRRGSGGRRGEGDEVGIQRGCAKAGGGDAPWPWGHNQTNKRPGRAVVLERSELPVVEERKGRVEPDPAEQGRAPTPGNCVGGGGRGGAARRAAREVTGGCSH

SEQ ID NO: 136634 - protein, 99 aa, Triticum aestivum
  unsure (1)..(99): unsure at all Xaa locations
  Clone ID: PAT_TA_31052.pep
RYEIIKGICEGLQYIHRDXTFHLDLKPANILLDENMVPKITDFGLSRCFEEKQSQASYHFKTIRIYESWYQALIDEHRLQTYLLLVLGGPAARRLQISS

SEQ ID NO: 136635 - protein, 250 aa, Triticum aestivum
  Clone ID: PAT_TA_31053.pep
WHTGVVVHGKEYFFGGGVQQDRPGRTPYGTPARVEHFGVTHVGKEDFEDFLHEISPRYTPETYNLLSNNCNHFSNEVVKFLVGSTVPSYILDQPKEAMKSPIGALIMPMIQGLETTMKAGAAPQQPPQFVPAPAAGAQMQSRSVTADEPGADKTADHDSGIIPAPKEAGQVQPSASSTQDEIATDETVSNDGGIIPPVVVLPTPKGVGQTQPSTNNDQIESRSVTANETGADEMVNSDGGIIPPPAKPAA

SEQ ID NO: 136636 - protein, 212 aa, Triticum aestivum
  unsure (1)..(212): unsure at all Xaa locations
  Clone ID: PAT_TA_31054.pep
QTHELPYHRQHPRGEDDANLVTYCTCLCEGWRLHPWTRGTAAEEDQRELWPASRHRGGGMQAQTRHRGRCPGDVRGVGPGHRLRGGEIRYGASLVAPAVGPRAAAAAAITSRTRIAWFLRGGASGVDLYQPGCGDRSHFSFDRRANRPLDRSRATFSWRANNPASFSRRRRAKNPASFLFLLRSSSEFQHRNCSVYLFRLCNHLVSLFFAXX

SEQ ID NO: 136637 - protein, 92 aa, Triticum aestivum
  Clone ID: PAT_TA_31055.pep
SARAKRPTLLQELSRHQECAICHLDLETGDEEIVRLPCFHAHAFHTPCIKQWFYQQSKCPICRREVPDYFGFRFCDEIYTRSRRTNLYKFFR

SEQ ID NO: 136638 - protein, 163 aa, Triticum aestivum
  unsure (1)..(163): unsure at all Xaa locations
  Clone ID: PAT_TA_31056.pep
GRGGRRSRGGVDAQARPACRSGRAASPDPAEPSRALPRGSSRPQDPACLRAPAATPGRQPAPARGRRSSRCRCPPAXPVGAPPEEDHRPRRRRAGAGRPQPRQEDPRPQHVGLGGRRPRPRPQLGQGLRRAGGGRPPEPHRVGIDLTVNKPREPRSKPPNCRS

SEQ ID NO: 136639 - protein, 231 aa, Triticum aestivum
  Clone ID: PAT_TA_31057.pep
MSSPAAAVKVIGALDSPFSHRAEIALRLKGIPYELIPEDLRNKSELLLANNPVHKKVPVLLHGDRAVCESLLIVEYVDEAFPGPPLLPADPYERAMARFWASFIDGKCSKAYWLALWAEGEAQEGFMKETKENFALLEAQLEGRRFFGGDAIGLVDIAACGLAHWLGVFEEVAEVRLATEDEFPRLCRWAKEYVSDEKVRACLPDRPQLLARFAANKGMFMAIAKSMLPPK

SEQ ID NO: 136640 - protein, 80 aa, Triticum aestivum
  Clone ID: PAT_TA_31058.pep
KQKGLFLIYSSPNLFDDYTSTDTTGRRNAIQVQMPRHTRSARTRHNYSILLGGRARTHMNQTGSDPILSRRSRWPSPRAS

SEQ ID NO: 136641 - protein, 357 aa, Triticum aestivum
  Clone ID: PAT_TA_31059.pep
WLASNNVTGKIVLCYAPRLAPSVLPRVELSLTINRTVGAGAKGLIFAQYTTNLLPICKGGMPCIVVDYEIAQRIESYLAITESPIVKVSPAMTVVGDGVLSPRVASFSSRGPSPLFPGILKPDITAPGVGILAAMRGFYVLMDGTSMACPHVSAVTALLKSVHPDWSPAMIKSAIVTTASATDQFGEPIEAESVPRKVADPFDFGSGHMDPDRAANPGLVYDVDAREYKKFFNCTLGSFHGCESYQLNLNLPSIAIPDLKDHVTVQRTVTNVGAVGTTYHAVLEAPAGVIMSVEPSVITFAKGGSTSMTFRVSFATKRRVQGGFTFGSLTWSDGNTHSVRIPVAVRTVIQDFVADIS

SEQ ID NO: 136642 - protein, 123 aa, Triticum aestivum
  unsure (1)..(123): unsure at all Xaa locations
  Clone ID: PAT_TA_31060.pep
RQVPRFPEFSDPVLACNFAGRPTVFSDLVCLRFPWRRWTRTSTRGCGAPTSRTPSSSLAPECAPSPSTKSAAPCQYRKILIHSSRACPGRPNQTGKTRPRXIXXARNEXKLCLNVXXKWALEX

SEQ ID NO: 136643 - protein, 350 aa, Triticum aestivum
  unsure (1)..(350): unsure at all Xaa locations
  Clone ID: PAT_TA_31061.pep
KSTGEGAPSLVRTTVQELAAAVEEPPREYVVHERDADELLAADEMPDPIPLIDLGRLMAADEAHKLRDAVETWGLFLVTKHGIQESLTNDMMDASMDVFMKPSEGKLKCSNLKDGGKHLELEGYGXDKVGTTEYQGHSGNERWHLRVEPEAAYPKDFSKWHPNRARIKNAFHECASLANTIKEPVSIRDLVLLAISKRLDLDPDDLQEPSVNQXPAFLRATNPPCVLRPERVPRVARHSDPRLFPTLTAVPGVLRLLGEGXNVPAQPYALVINLAEXWQIMCNGFXRNPLDRVVXTKAAKARISLALFYACGWRKRCWYPAPRFGLVDEEAPGGYGKFKAKEFWLSFDGT

SEQ ID NO: 136644 - protein, 263 aa, Triticum aestivum
  unsure (1)..(263): unsure at all Xaa locations
  Clone ID: PAT_TA_31062.pep
MGRSPCCEKAHTNKGAWTKEEDDRLTAYIKAHGEGCWRSLPKAAGLLRCGKSCRLRWINYLRPDLKRGNFSDEEDELIIKLHSLLGNKWSLIAGRLPGRTDNEIKNYWNTHIRRKLTSRGIDPVTHRAINSDHAASNITISFEAAQRDDKGAVFRRDAEPTKVAAAAAAITHVDHHHRSNPHHQMEWGQGKPLKCPDLNLDLCISPPSHEDPMVDTKPVVKREGVVALCFSCSMVLPXKREMQCSSFNGLQMQQLDFRSIEMK

SEQ ID NO: 136645 - protein, 366 aa, Triticum aestivum
  Clone ID: PAT_TA_31063.pep
PPPTCDLAHGRWVFDNESLPLYREKECNFLTKQLTCLANGRNDDLWQYWQWQPNNCSLPTFDARRFMERMRGKRLMFVGDSLNRNQFYSLVCMVQSILSKGRKKVVKRGSNTIFHAKEYRATLEFYWAPFLVESNSDDPNIHSIEHRIIRPERIEGHAQYWRGVDYLIFDTYIWWMNTADIKVRRPDSRSWSEHDEVPRIEAYGRVLKTWSDWLNENIDPARTSVFFMTISPIHISPDKWGNPHGIKCAKETLPVLNYTEPLDLNHDMRLYDMVASTARSMKKVPVTLIDITRMSDYRKDAHTSVYSVRRGYLLTPKQKNDPEKFADCIHWCLPGVPDVWNTVLYTRIFSKSPPSSPPALALPPPQ

SEQ ID NO: 136646 - protein, 264 aa, Triticum aestivum
  Clone ID: PAT_TA_31064.pep
MERQPRPQLAVAEEAIALYDTYWFHRLVLNAYSPPAPQPPPPAPEREQPEQAPAEESKSELRRAPSGLQRHRRTRSDEAKAAAFHGQLEPLKIPNGHRARLETILSGKDGLAAPEPLPERRRPEARRPGGRRRRSRRGRSLSELEFEEVKGLQDLGFTFSETDVDAELASIVPGLRRLRAEEEARRAKAAEAAACAEEEACRNRAAAEASDAAPRRPYLSEAWEDEETEVRRVLSNFRIPAAADGADLKENLRLWAHTVASAVR

SEQ ID NO: 136647 - protein, 214 aa, Triticum aestivum
  Clone ID: PAT_TA_31065.pep
MPTPYSAAALQQHQRLVSSSGGLAATGAHRCGEHDGTVPPEVARHHEHAAPGGRCCCSAVVQRVAAPAADVWAVVRRFDQPQAYKSFVRSCALLDGDGGVGTLREVRVVSGLPAASSRERLEILDDERHVLSFSVVGGEHRLRNYRSVTTVHPAPGGSASATLVVESYVVDVPPGNTPEDTRVFVDTIVKCNLQSLARTAEKLAGRGAAYGALP

SEQ ID NO: 136648 - protein, 124 aa, Triticum aestivum
  Clone ID: PAT_TA_31066.pep
MVNSDGGIIPPPAKPAAPAAATQTETSLNSIELQTVDEGTRMVTPPAVQPAAPAATVAKVTLPAAAASDPLGGAKSRAQEEIKQEFAAIMATGTVQAGDAAALAMRRVMERHELRRTAVPTQRG

SEQ ID NO: 136649 - protein, 121 aa, Triticum aestivum
  Clone ID: PAT_TA_31067.pep
TQQEQTTKKLPVNNSQGDSLAIYISYGRSSPPIGLYVKYRRRATAAAVRLCICHHAPLCSSALQAPPCPTLVCAPAIQQDAALLPPPVPKPDSMTIDLLFFLHGAVYGNPSGSSAPCCPVA

SEQ ID NO: 136650 - protein, 238 aa, Triticum aestivum
  unsure (1)..(238): unsure at all Xaa locations
  Clone ID: PAT_TA_31068.pep
SAPVFCVITEFLPGGSLRAYLRKLEGKQLPLEKIISVALDIARGLEYVHSQGVIHRDVKPENILFDAECCAKVVDFGVAFEDVYCNTMEDDPGTYRWMAPEMCKRKPYGPKVDVYSFGLVLWELXVGSIPYEEMTPLQAAYAVVNKNLRPVVPSSCPTPLQQLMEQCWSAQPEKRPEFTQIVKTLENLKATLDRDGTIEKTSCQEAAQEQNKNRLANWILKLSYSPPDFSGPPPPKLL

SEQ ID NO: 136651 - protein, 149 aa, Triticum aestivum
  Clone ID: PAT_TA_31069.pep
RRLRDERRVLPVSTGETNGPPHLRWPSWSVEVGRASGTRWLGRLYPPFGSCNVREARFGRRRPRRHGIRSSQALPRHGSVLSHYAFGRVEVVLSGSSHVDLDGCCTGESLRPWLRLPLTAVMAEPEKINLSELSSPDAPRFDGCCSYFR

SEQ ID NO: 136652 - protein, 177 aa, Triticum aestivum
  unsure (1)..(177): unsure at all Xaa locations
  Clone ID: PAT_TA_31070.pep
APQPLPFLSSRRILLTRPRWQPLAGTSVAGLASCSPESCTSDVKIPRPVLPFLGRISPVRHHPDAWCCLFAGRGTPAGLAAVAGASQRRPAVPAARQDEADQTGRRAPSRNRAVQLAASAVPIRGVLPACAQRELTDLVAARGVGGADPACNRRSSRSRRCKSDVAGGKRCRXGRSG

SEQ ID NO: 136653 - protein, 174 aa, Triticum aestivum
  unsure (1)..(174): unsure at all Xaa locations
  Clone ID: PAT_TA_31071.pep
MLVYQDKLSGDELLSDSFPYRELENGVLWEVDGHWVVQGAVDVDIGANPSAEGGGDDEGVDDQAVKVXVDIVDTFRLQXEQPAFDKKXFISHMKRYIKNSLPXXKGMTRFFKKNVDPPQIPLNNSXTXFFVAXHHDDXLVFXYYKXDXINFXYXAKCNPRSKIYGAYICRPRPM

SEQ ID NO: 136654 - protein, 379 aa, Triticum aestivum
  unsure (1)..(379): unsure at all Xaa locations
  Clone ID: PAT_TA_31072.pep
SAHASGEVRLPFEENGSSKIGVSFDKPIPGGIDLGGNCEVDHGFFCSVDSLVLDGPGWEDRAKHPFDVIFEFVSEESAHGPLILFLKDVEKVCGNTYSYHGLKSKLEIFPAGVFVIGSQTQADSRKDKLNGSPFLSKFPYGQAAILDLAFQDSFALLGNSDNTAATGXLGTPKVETEFQYMINSCFDFESSKWKQLLDRDIEILKVKANISKVQSFLTRNGLECADVQTTVCVKDRTLTNECGDKIVGYALSHQVMNSTVPTPGKDVLLALSGESLXHGVDLSERMQNDHKKKSTKKSLKDVATENEFEKRLLSDVIPPDEIGVSFDDIGALENVKETLKELVMLPLQRPXLFSKGQLMKPCXGILLFCPPGTGKTMLA

SEQ ID NO: 136655 - protein, 473 aa, Triticum aestivum
  unsure (1)..(473): unsure at all Xaa locations
  Clone ID: PAT_TA_31073.pep
RRTWLVNHPPTEPLGTLRFPIQVTGPPPQGDSVLALWTHPVHRALEMLLMVDYIALVHSFLTRNGLEXADVETTVCVKDRTLTNECVDKIVGYALSHQVMNSTVPTPGKDVLLALSGESLQHGVDLSERMQNDHKKKSTKKSLKDVATENEFEKRLLGDVIPPDEIGVSFDDIGALENVKETLKELVMLPLQRPELFSKGQLMKPCKGILLFGPPGTGKTMLAKAVATEAGANFINISMSSIGSKWFGEPTRPVKAVFSLASKIAPSVIFVDEVDGMLGRRENPGEHEAMRKMKNEFMVNWDGLRTKDKERVLVLAATNRPFDLDEAVIRRLPRRLMVNLPDATNRKKIISVILAKEDLAEDVDLEAVASLTEGYSGSDLKNLCITAAHSPIREILEKEKKERSLAEAENKPLPPKYSSSDVRPLNMSDLKQAHEQVCASISSDSTNMNELVQWNELYGEGGSRKKTPLSYFM

SEQ ID NO: 136656 - protein, 229 aa, Triticum aestivum
  unsure (1)..(229): unsure at all Xaa locations
  Clone ID: PAT_TA_31074.pep
MRRSAAVLRVAVVGLLVLGLALPPLAAALRPLRERVASAGAAASSGSWADEHAFYKRDDNDMSPYSWNITGTYKGSWSFAGATNGSSRFLEFMTSKGDSVLELLSTPTKISGVHYVQGTITFHDVIDKSHDRGAAQIRLEGVYIWPFRQLRMVANSGADGEPLQEEDYFLSNPYHLLRIFSSQVFQDSSXEKNXKKNSLTHDMEKHCNIKIAAKVVRVSSNQNEGEHEK

SEQ ID NO: 136657 - protein, 106 aa, Triticum aestivum
  Clone ID: PAT_TA_31075.pep
MKHHREWSVSWIMMMVMCLPSPGGGACGEVSDDVSCARCPKMESVVRGRAAAGREAELRMGARLLRPHLHDCSVNTCAGSMGVDGVDTSGRAPTSNKLGGPKAQLR

SEQ ID NO: 136658 - protein, 242 aa, Triticum aestivum
  Clone ID: PAT_TA_31076.pep
MKYSKEAKPERAGGGGGGARAVPVALMLLLLCGFSFYLGGMYSTGRTFTFSSTTTSIIPIVSTAKQEGSAIALAIARNGNGDDEVEFSECPADYQDYTPCTDPKRWRRYGNYRLSFMERHCPPPPERAVCLVPPPRGYKPPIRWPKSKDQCWYRIVPYDWINSQKSNQHWLRKDGDRFTFPGGGTMFPNGVGAYVDLMADLIPGMKDGSVRTALDTGCGVASWGGDLLARNILTVSLAPRDN

SEQ ID NO: 136659 - protein, 198 aa, Triticum aestivum
  Clone ID: PAT_TA_31077.pep
MERRGGAAAPSLELPGFRFHPTEEELLEFYLKHHVTRNSKQQHLRAAPFDIIPTVHLYRHDPWDLPGLAAIASEREWYFFVPRDGARKHASGVAGGGRPSRTTERGFWKATGSDRAVRCAAEPKRLVGLKKTLLYYHGRAPRGTKTDGVITAPRPPPRRGARAAGLPSVARRSVCRTSMRSPPRLPQKLNHHQEAVPV

SEQ ID NO: 136660 - protein, 174 aa, Triticum aestivum
  unsure (1)..(174): unsure at all Xaa locations
  Clone ID: PAT_TA_31078.pep
MATLGSPPWSLLCVFGALLTALWCAGRALAGAWLGPRRVARALRSQGVRGTRYRFPSGDMKEYVRLLAAACSQPMPLSSHAVAARAVPFDHAIIKQHGKVALTWFGPEPRVVVSDPQLFREILSNKQGRFGKQRXILRIERSLQRRLTHAQWVPTGAHNTLISHAMRFTASRGQ

SEQ ID NO: 136661 - protein, 206 aa, Triticum aestivum
  Clone ID: PAT_TA_31079.pep
MSDCSTGTDSPRADSVDEQPPADAESPGVGQSKRDHPSPSSPLPPPKRSRRSVEKRVVSVPIAECGERAKTNGEGPPPPDSWAWRKYGQKPIKGSPYPRGYYRCSSSKGCPARKQVERSRADPTVLLVTYSYDHNHPWPAPKTGCHPTKSSPRLVEPKPEPGTPVECQPEHGPEAPEHGPEAPEQEQEEEHEQKPVIGLGDPAAIT

SEQ ID NO: 136662 - protein, 142 aa, Triticum aestivum
  Clone ID: PAT_TA_31080.pep
MWKHHRVLGSVAALLLLLALVLPSIQTQKQSAREKAAMAAEPARRLAGGIVDSLGRENDPYIVDLARFAVSEHNKEGNTQLELEKVVKVKEQAVAGRLYYITIQVDEGGAKKLYEAKVLEQLWLDVKKLVEFKPAEGASPNV

SEQ ID NO: 136663 - protein, 129 aa, Triticum aestivum
  Clone ID: PAT_TA_31081.pep
VTQSSCGSFAPPSSSGITPQRATGSIAPPTATHLVPTSSTSHGVRRVVGATATPATIAASTTVAATDQQGSDTNCSRRLTSQRHFFFYLELPHTTLLLSLSIKRIKRTHTEEHTHTTHRGDTSFAFYSR

SEQ ID NO: 136664 - protein, 157 aa, Triticum aestivum
  Clone ID: PAT_TA_31082.pep
VTMDHLVIDDASARQSPCRLAVDDALAAPSTTTSCHMQQPSLDVDGGADRHAVNILRHRTATGHQRHHATDSLHLAPPSSTSHGVGRAAVVASDRQGSDANCWRRLLAAPLLLLPRVASHNSLLPLTQFSCVFSQELSHEHTHTRTHGPRRSTKALP

SEQ ID NO: 136665 - protein, 154 aa, Triticum aestivum
  Clone ID: PAT_TA_31083.pep
CSPSRLQPLIRLAASHAAPSASRRARRLTRHPGISPPWRAHLKPSSDEHHTRLDYMQNSNMLIQISRLALTFTLLILISQSSYGSPAATCRRRRSATAGHSPTDAIAAPVTMDHLIMDDVLATRSPHIIVARRHRHASHHSDQHHRRRHGSTRL

SEQ ID NO: 136666 - protein, 178 aa, Triticum aestivum
  Clone ID: PAT_TA_31084.pep
HRRGAPNGACEGHVQPPTARMPPTHWQRHATKASTPPRRPQSTWSTLTASLLPSPCGAAQTPHFMARTPPRPGPTRRPSLDTAPYPDHNLLSPLLALSRHRLLTTTWHHNGTSRPNRPPTTRPTPPCRRRPPSRWPPSPHGRATPPCRPSLSRSVAASPPPISAAPSPSRSLSQLAHP

SEQ ID NO: 136667 - protein, 217 aa, Triticum aestivum
  Clone ID: PAT_TA_31085.pep
EMRYLLAIWKASRPLNSGEGWEIMRRELSVLYSRFYGILLGGILLMYELHNFLRPLLFLMYSFWIPQIVTNVIRDTRKPLHPQYILGMTATRVAIPLYIFGCPSNFMRIEPDKKWCIAVTTFMGIQAAVLLLQHYLGSRCFIPRQILPEKYCYHRKVEDSTNQPIDCVICMTAIDLSQRTSEYMVAPCEHIFHSGCLQRWMDIKMECPTCRRSLPPA

SEQ ID NO: 136668 - protein, 102 aa, Triticum aestivum
  Clone ID: PAT_TA_31086.pep
NHYFKNLLAKKGLLSSDQGLVSSPDGAAATRALVQAYSYNSQRFLCDFGDAMVRMGNIAPLTGSAGQIRKKCSAVNGAGAPPGTPRAGEESCRALHVYHGRG

SEQ ID NO: 136669 - protein, 228 aa, Triticum aestivum
  unsure (1)..(228): unsure at all Xaa locations
  Clone ID: PAT_TA_31087.pep
ECPAHDRHRRAAEDGLNRVERQRALRRHREGVRCRAKHQSSARRRAYVTQALWYIGLVATHVGTKYKLALXEGPLCEGDQVTXGWHTNQTSSMLRRFPIGFSGFAFNSTMLWDPKRXKSPTVGSIILHSGGRGGLQASRFIERLVKDXSQMEGLADKCTRIMVWTFDLEAPQLNXPTGWLLEKKLDPRSLCSGSVCSCAHTSVSDAFLNLAAPRITRKPALCRRPDSK

SEQ ID NO: 136670 - protein, 197 aa, Triticum aestivum
  unsure (1)..(197): unsure at all Xaa locations
  Clone ID: PAT_TA_31088.pep
APTSLTFPLTREIIGVVIXQDIFGAATETTXTAVEWAMSELLNNSEAMVKAQQEVREVLGQGRHVIKSTDLSELRYMXMVIKEVLRLHPPAPLLVPERGERTVXIMGYNMPKGTNIFVNIFVISRDPKYWDNPEEYKPESFENSNVEYYGTHFEFEKKKKKKKKKKKKKKKKKKKKKKKKREKKKKKNKKKKRPLKR

SEQ ID NO: 136671 - protein, 298 aa, Triticum aestivum
  Clone ID: PAT_TA_31089.pep
MTATAPPTSIGRHTARSSYAQPPASAAIAATPPARQARPRHQAHDTNCWNRSPLSLSARGRRRHKTQEISGEKVGDSPDSQDAGNTPLACAAAALERAGRPAARSHAAPLVLAPPTVPAAVGHAARSRSARHPPGVPPSPPRLAPAPPGGRLARPPAAGTAPTHRPPPARTPQPPRHRPSVPRPPPPPLARAPRPPTPAHALTPTAPPDPQAQHARPGRQALPPPARAASAPAPQAPHTRPNKGGRRSQELEATLRRTGARTPPRAHERPNFSMAPTPRRAHAAALPLRMFSNDTTLV

SEQ ID NO: 136672 - protein, 160 aa, Triticum aestivum
  Clone ID: PAT_TA_31090.pep
MAEASFFDRMVSQLRSTSKYYTGYPKDLGPSRIIRFTSERQFVQLLHEGRPVVVAFTIKCTYTQHLDKVLEEAAATFYPHIKFVRVECPKYPGFCLTRQKTEYPFLEVFYNPEQAANPGKIVDPSITKYSAKVLPFNYDQSVYGFREYFKKYGFKYSEAN

SEQ ID NO: 136673 - protein, 200 aa, Triticum aestivum
  Clone ID: PAT_TA_31091.pep
DIKNRFILPPHLVLENFAALDLGKMDKTDDSGLASYVASQVDQSLCWEDVKWLQTITSLPILVKGVMTAEDTRIAIEYGAAGIIVSNHGARQLDYVPATISCLEEVVREAKGRLPVFLDGGVRRGTDVFKALALGAAGVFIGRPVLYSLAVDGEAGVRKVLQMLRDELELAMALSGCPSLRDITRAHVVTDGDRIRRARL

SEQ ID NO: 136674 - protein, 215 aa, Triticum aestivum
  unsure (1)..(215): unsure at all Xaa locations
  Clone ID: PAT_TA_31092.pep
AMMDGHVXNDDLLGVMMESNIEESQEAGSSKPTMTTDDIVGELKLFYFAGMETTAVLLTWAMVLLSMHPEWQDRAREEVLRVFGQNQPDSEGINRLKVVTMILHEVLRLYPPILLLSREAYKETELGGVTYPAGVTFALPIVCIHHDPGGWGGEVDGFQPAGYAGGPAGAFNITQMCWEKGSGDWSGRGQQMASPAHPKKSPAFFPVWLGAAGVC

SEQ ID NO: 136675 - protein, 77 aa, Triticum aestivum
  Clone ID: PAT_TA_31093.pep
ASLAPSLIAPPLLILAKHDLEPVKVIEDLPLGMKGSRNLIIPNRTGSTLMDARCGTYGTLTLLATCQAAYPPFSGCF

SEQ ID NO: 136676 - protein, 119 aa, Triticum aestivum
  Clone ID: PAT_TA_31094.pep
RELIYFHLTAKSVGSLSIDINECNLPAEDTECYGECTNTQGSFNCHCPQGTIGNHTIPNDCIELSKPSKHRNTGGHRIILLTRKVFHPSYVNMPTLITLCIYVSGLSMGIGFGSGAGAI

SEQ ID NO: 136677 - protein, 371 aa, Triticum aestivum
  unsure (1)..(371): unsure at all Xaa locations
  Clone ID: PAT_TA_31095.pep
MWGERAHHKHGHHHDNVGSRDRQPKFIADNYSSVDEVVAALREAGLESSNLILGIDFTKSNEWSGRHSFGRKSLHAISGTPNPYEQAISIIGRTLSPFDDDNLIPCFGFGDASTHDHSVFSFYQENRPCRGFEEVLDRYRQIVPHLNLSGPTSFAPLIYAAMSVVESSNCQYHVLVIIADGQVTTSIPSSCXKVATIADYRRQCCLMLAKSILWGWGHNXSNDCIPDRAFDNFQFVNFTGIMSSSKDMSKKEAAFALAALMEIPTQYKATQGLRPPERHAQNANPPRILPPPSKVLERDNIVAASHTPAATSQSTDVGYTVSDEKVCPICLTNPKDMAFQCGHLTCKECGPTLSTCPLCRAPITVRVRLFS

SEQ ID NO: 136678 - protein, 142 aa, Triticum aestivum
  Clone ID: PAT_TA_31096.pep
EEGLKLQNYKKIYNLRQTNMPCSAETLSALIVMPKSKGAHNVVVFHQTGQNEVARLQGTHGNSIMRITCVQTSVISSPITIELILDSSLNLSNKQACHSRPVVPPEQQHQRWRGTRTSPRPRSGAPASSPVHTEQVWRQRLV

SEQ ID NO: 136679 - protein, 86 aa, Triticum aestivum
  Clone ID: PAT_TA_31097.pep
TPVHLTESPLAILHILQVLHFYVHKFTIYIPPTSHIYMMMLYLQIAMYTASEFVEFFRSHALPCHAGCSSDSGGRSLLSGWCSRFP

SEQ ID NO: 136680 - protein, 287 aa, Triticum aestivum
  Clone ID: PAT_TA_31098.pep
HFLPQPRILMAMAPMLARRHRFLSAAPRDGLLPSFFSDVSEKTQVPVKSTIITGICAASLAFFMDVSQLAGMVSVGTLLAFTIVAVSILILRYVPPDEVPLPSSLQTSFRLSQECDEEKVGSPLGDGNHEQGTSEIKDVIVVESINDPLIEKQLYANKLDELNRRKTAARSIASVCVGVLILTASASVTFLPFLVMCLFCVFGGLLLLAGLGMLSWIDQVDGRHSFGYSLIFIGGGMWMRAVVWLVMEAFLYIFYGRTHSSLTDVVYVSLAQANEIYGSSSSSAFVA

SEQ ID NO: 136681 - protein, 86 aa, Triticum aestivum
  Clone ID: PAT_TA_31099.pep
RIAAAGAVLVERKFIRRCGTVGHVEDVVVDAAARGRGLGEGVVRRLVEHARARGCYKVILNCTPELRGFYAKCGFVEKNVQMGLYF

SEQ ID NO: 136682 - protein, 221 aa, Triticum aestivum
  Clone ID: PAT_TA_31100.pep
EFGTRKADTWVLFAGADMVGKRRMAEALSVAIFGAGPVTVRLGCATTGDVDGGEESVVSCRGRTALDRVAETVRANPFRVVVLDDLDHADDVVHGAIVHAIESGRLTDSHGRDVALGSAIFIVMSSWSSSASGQPTDSAWNLELRVRRRTTLKRRPEQELDGYRRVKPRKPLPLDLNLSMCDDHIDDGDEDSGGEGSRNSSSDLTVEHEQEYAQPSSDVTR

SEQ ID NO: 136683 - protein, 148 aa, Triticum aestivum
  Clone ID: PAT_TA_31101.pep
PTRPHYFSYLKAKEELGYVPVTSPQEGLAATISYWQERKRRELDGPTIFTWVAVIAGMLAVFSAAFLPPVGPLKWVLAINLFVFRSMLVIRIVFVAAVAAHASEAVYAWFLAKKVDPRNATGWFWQTFALGFLSLRFLLKRARAGTGP

SEQ ID NO: 136684 - protein, 135 aa, Triticum aestivum
  Clone ID: PAT_TA_31102.pep
RASYTCPPPPPPPRPPLRPPPGPRPPPPSSPTPPFPQRVNRLPPPPRRLPQPLTPPTPTLPRCINLLPLTPSRQHHALFANPSKLTSVPCLGGERHRPRLQRLAGLLFSAPSPAFRPLSCLLFHLLIFGPSHVLT

SEQ ID NO: 136685 - protein, 76 aa, Triticum aestivum
  Clone ID: PAT_TA_31103.pep
MALTNLILTVVGVGAAVMLLRKDVKQSSAVFRRNIRHIKTWLEEESAATTSAERSVPKELEAQAAKKDSTPKVDKD

SEQ ID NO: 136686 - protein, 196 aa, Triticum aestivum
  Clone ID: PAT_TA_31104.pep
MADIRCDQAKMTPSPSPLRIFGYDVPGGATDATVVLTPPPTPPADPRRFGCQYCSREFANSQALGGHQNAHKKERQQLKRARLHVDARMSYFAPPPGHLIAVGHAGSSAYTRDAFHRWVYLAHQSAAGLPFHALPAGGGCQAEPRLLEDPRDCGSAAISTSSGARACTPADDSTEEASAMGVGLDLDLRLAPATSS

SEQ ID NO: 136687 - protein, 122 aa, Triticum aestivum
  Clone ID: PAT_TA_31105.pep
HASERLRRSNLSSIASSINQISSGSYPSSTGRSVPVVNEDGNIISDIRHGKAVDLASGSEASSSKSKCTLCLSTRQNPTGTTCGHVFCWNCIMEWCNEKPECPLCRTPITHSSLICIYHSDF

SEQ ID NO: 136688 - protein, 279 aa, Triticum aestivum
  unsure (1)..(279): unsure at all Xaa locations
  Clone ID: PAT_TA_31106.pep
EDKAARGGAAATAPTDLLVCFPGRQHLALMPKSMCSPSRATLDKAVAARRRQLQLPAAPATRYGGGGRGSTSSPLFRGSKAKETVGDDEPQSPKVTCAGQIKVGRPKKPRPMVEKHVKGDGGSGGRWVTVAEEIERLQERRKKASWLETVGIRRDALPFLGGALWSLRHKVRCFGSSLPAAVDSSTDDDNDVEERERKCATASVFSKWLMVLERSHEPHEQDXHDDELDQEDGRPSNEAGDDCSKAPSVPPPSNALLLMRCRSAPAKGLTRKGAEAAGE

SEQ ID NO: 136689 - protein, 175 aa, Triticum aestivum
  Clone ID: PAT_TA_31107.pep
GAGGRLATGAERRRSGGGSTSPWVEMCAQVRCQNLERAETMRHCRADASQRVGDGGEIRHFEDELRTMEQPGELFDDVVAEILFRLPAHAVLRCPAVCRRCRRLADDPSLLAARARHLPLEVLAYTTTTVQESGSTLYVALAGPCLGEPSPRPVPEDDSLLAALIRKGLQFLIWC

SEQ ID NO: 136690 - protein, 258 aa, Triticum aestivum
  Clone ID: PAT_TA_31108.pep
PRVREVESILQGLINKRMQAMEEGKKSENDLLGLLLESNMKDVDENGQPRQGMAMEDVIQECKQFYLAGMETTSVLLTWTMIVLSMHPEWQDLAREEVLGLFRKNKPEYEGLSRLKTVTMILHEVLRLYPSATTFSRKTYKDMDIGGVRYPSGMFVEVPVLFINHDPDIWGSDVNEFKPERFAQGISKASKHPGAFLSFGWGPRVCIGQNFAMLEAKMALSMILQHFKFELPPSYTHAPHTVMTLQPMHGAQIKLRAI

SEQ ID NO: 136691 - protein, 166 aa, Triticum aestivum
  Clone ID: PAT_TA_31109.pep
MGGGNKQCGNDTNSRGLGGYYPSAYSSPPIAYPAYPPPQAGHGCPPAYYPPQPQGYGHGYPSAGAYGCPPSSYPHHQGGYHGHGGSLLVAGGAAAAAAYGAHHLSHGHHGHGGYYHRPAGYHHHYGGKFKKHGRYGYGYGGKFKHGKRMRLFGGKHGLFGGKHKWK

SEQ ID NO: 136692 - protein, 533 aa, Triticum aestivum
  Clone ID: PAT_TA_31110.pep
MHDLTSQFQLDDDSTGATAGSCSSPSFFSSSTVSLSSPPFSSVLIAASFTSVPFFPSDSPSSSLKVAADVSSCSGSRETLSASCGTTSTSSTVTTSSSVVVASLVCSVLSLDSTAASLTTVGFGSSGSFLRSSLFKEGVGCSAASGTSTSGTGLVGNAALSSTLVAGADALVAVSTSLAVVGTGASTVTASSCFSRVTTGAASTVVALPSALATRASTKATGTLCSSLATGASTKAAVSLSCCLVTGAAGKEATSTSSATGAATRAAVSVSCSLATGADGKVATLTSSATGASTKAAVSLSCSLATGAAGKVATSTSSATGAAAMVIPSISPANGADEMDTSSSSLAAGAATKEALPSSPATGAARKVAPASSLALAAGAGTNVSIWSFSIAGASAEMILSSSLVTTPTEASAMATLPSSSTLISSMSFSLDDAASSSFASADHPSSSSPRRRSLPASTVGAIDTSTGWPFLISSTTMMVSLVDATPSSRSGTTSLWPTPSCLIGPAASSVAVPFPLASGTATAPFLPSCLLS

SEQ ID NO: 136693 - protein, 115 aa, Triticum aestivum
  Clone ID: PAT_TA_31111.pep
MSRSNRKSSSKGLDLKLNLSLPARGDSSNRVMADEESSPSSCLSSENEHGLQWSNSPEATSMVLAACPRCFIYVMLPQDDPRCPQCKSPVLLDFLQDSGNNNNNTNSNSRKSRRG

SEQ ID NO: 136694 - protein, 236 aa, Triticum aestivum
  Clone ID: PAT_TA_31112.pep
MEMSGVSAVDSPGSGSASSALGAPRPSRYESQKRRDWQTFGQYLRNHRPPLELARCSGAHVLEFLRYLDQFGKTKVHTAGCPFFGHPSPPAPCPCPLKQAWGSLDALVGRLRAAFEEHGGRPEANPFGARAVRLYLRDVRDGQAKARGIAYEKKRRKRHPQTSSKQKQQAAAASAAASPAPVDRPDMRHGMLEQTHYLFPMHAHLFQGHFLAPAPDGDPVGALDGVVPAGDDIVMV

SEQ ID NO: 136695 - protein, 113 aa, Triticum aestivum
  Clone ID: PAT_TA_31113.pep
AFSCRAGCPFDRDEGQAHVPFLQIIAPDLVNCTLCLTKMTGYGMKKYGSYSTQGSVRLYLQKTKTKKERIFPSLVRGRTICRISFDNSGIVRTTGAAFVVQPMKLRSPFSFTV

SEQ ID NO: 136696 - protein, 201 aa, Triticum aestivum
  Clone ID: PAT_TA_31114.pep
MSAATMAADPQCPRLLHLGQRGSRPAARCRRTGYMRGLLLCPALPPCIPCASGGQALLPLRPSGSRSSSFTPPHLPRLDFFHCMKCNCCLGMRLSEHKCREKGLETNCPICCDFLFTSSAAVRALPCGHFMHSVCFQAYTCSHYTCPICCKSLGDMAVYFGMLDAFLAAEELPKEYHDRCQIMSEALECGSCVEAFTYFHG

SEQ ID NO: 136697 - protein, 393 aa, Triticum aestivum
  Clone ID: PAT_TA_31115.pep
SARGESSKLAAEAVSNLRTITAFSSQDRILGLFNQAQNGPRKESIRQSWIAGLGLGTSMSLMTCTWALDFWFGGRLIAQHHITAKALFQTFMILVSTGRVIADAGSMTTDLAKGADAIASVFAVLYRVTEIDPDNPEGYKPEKLKGEVDIRGVDFAYPSRPDVIIFKGFSLSIQSGKSTALVGQSGSGKSTIIGLIERFYDPVRGMVKIDGRDIKTYNLRALRQHIGLVSQEPTLFAGTIRENIVYGTETASEAEIENAARSANAHDFISNLKDGYDTWCGERGVQLSGGQKQRIAIARAILKNPAILLLDEATSALDSQSEKVVQEALERVMVGRTSVVVAHRLSTIQNCDLITVLDKGIVVEKGTHSSLMSKGPSGTYYSLVSLQQGGNQN

SEQ ID NO: 136698 - protein, 87 aa, Triticum aestivum
  Clone ID: PAT_TA_31116.pep
RYPFLGETLQETYDKIVNDPADIPSNVSPQLVDLLERLLCKDPGDRITLEAAAAHPWVAGDEGPVPEYMCRCGFGRRKRNGSQEAVQ

SEQ ID NO: 136699 - protein, 238 aa, Triticum aestivum
  Clone ID: PAT_TA_31117.pep
MATYRPDSNTLLADDSILEYVLETTVYPREHERLRELRLITQQHAKSFMGSSPDQMQFFSVLLKMIGASNTIEVGVFTGYSLLTTALALPAGGKVVAIDASREYYELGRPVIEKAGVAHKVDFREGDGVAELDKILSEDGGARAGTFDFAYADADKLQYAGYHERLLRLVGVGGAIAYDNTLWGGSVAMPRDKPGSSEYDRRVRDSFLEFNAAVAADDRVEACIVPIADGVTLCRRVK

SEQ ID NO: 136700 - protein, 171 aa, Triticum aestivum
  unsure (1)..(171): unsure at all Xaa locations
  Clone ID: PAT_TA_31118.pep
MLRFCCDDLLRFASVNLDHLTETFNMSFYMTYLARWPDYFHTAVNPGDRVMGYIMGKVEGQGESWHGHVTAVSVASEFRRQKLAKTLMHLLEEXSDKMDKAYFVDLFVRASNMPAIRMYEKLGYVVYRRVLRYYSGEEDGLDMRKALSQDVDKKSIIPLKRPITPDELEYD

SEQ ID NO: 136701 - protein, 167 aa, Triticum aestivum
  Clone ID: PAT_TA_31119.pep
NKMSMLNLVASLVKTGVHGRIFAADTGRPIPGSLMVKGIDSKINASGTFGDYHRIIAPGQSYEVVASMEGFKPKRTRVMLGREAMNLDFILDPDGALKGTKPLRNDCGCSCNDDGASNKPFLLREAYLWLYLLALFSLLALYLLFRRRMASRLAAHRHPPPKRTVAV

SEQ ID NO: 136702 - protein, 154 aa, Triticum aestivum
  Clone ID: PAT_TA_31120.pep
MESTLITRLYPLLPAPPKARPLSSSPLAGARRIASISFSSVSMCGVLRPSGGVTSSVTAAAAALGEAAEPGSEAILLSVQGMMCDGCAASVKRILESQPEVTSATVDYKEARAVVWTTPEVKVAEDWQKQCGEKLASHLGTCGFESRPQGIDCL

SEQ ID NO: 136703 - protein, 331 aa, Triticum aestivum
  Clone ID: PAT_TA_31121.pep
MARQEAAGAATGVDFHLPDEILAVIPTDPYEQLDVARKITSMAIASRVSRLEADVARLRRDLADRDRGDADLRARLADSDARLLAALDENAKLVKERDTLALTAKKLSRNLAKLEAFKKQLMKSLSEDNLLQLSETGEDRDVDAENSGTARSPSWKDEVSSSHTSSNTSSRSTITESAQGYQFSITPYVAPQITPGSTPIISSSGGSPLAYSTGPSTPKFYSGPTSPTRSRSEDQSAFSSWNGSSHQYSAPVSPQRRSFTGRPRIDGKEFFRQARTRLSYEQFGAFLANIKEFNAQKQSREDTLSKAEEIFGTEHKDLYISFQNMLNRNQS

SEQ ID NO: 136704 - protein, 215 aa, Triticum aestivum
  Clone ID: PAT_TA_31122.pep
ISPVVADASSQTPPSKEHEHQGSSTSARPGERARGRARRNRGARQDAAPRTRWHRHRNDRTTGEPTPTAAHVGPPYPAAAAQPPASTISPAGTPRPDPGRRSLLQKRTRALKESIRIESTEQAAVKAIRRSDSVKPNWMEKLVSPEVSSVSLLVTISHGGGKARGISHTLGAISGPLQGLIVVVVFLLFRAPASSVRLPLMIVCGEQRCQTKRTL

SEQ ID NO: 136705 - protein, 387 aa, Triticum aestivum
  Clone ID: PAT_TA_31123.pep
APSWAGFLADQSSRDASRLLYLDSLAVAGRAYAPIASGRQLLQTPTYVVRARLGTPPQQLLLAVDTSNDAAWIPCSGCAGCPTTTPFKPAASKSYRAVPCGSPACSRAPNPSCSLNSKSCGFSLTYADSSLEAALSEDSLAVANDVVKSYTFGCLQKATGTAAPPQGLLGLGRGPLSFLSQTKDMYEGTFSYCLPSFKSLNFSGTLRLGRKGQPLRIKTTPLLVNPHRSSLYYVGMTGIRVGKKVVPIPPSALAFDPATGAGTVLDSGTMFTRLVAPAYVAVRDEVRHRIRGAPLSSLGGFDTCYNTTVKWPPVTFMFTGMQVTLPADNLVIHSTYGTTSCLAMAAAPDGVNTVLNVIASMQQQNHRILFDVPNGRVGFAREQCTAA

SEQ ID NO: 136706 - protein, 45 aa, Triticum aestivum
  Clone ID: PAT_TA_31124.pep
MEEKRDELVFMRTAPDFLKLSIDIAKETWVVGGVDPLAKSRSWKR

SEQ ID NO: 136707 - protein, 137 aa, Triticum aestivum
  Clone ID: PAT_TA_31125.pep
MADAKTAPAVTLRTRKFMTNRLLSRKQFVLEVIHPGRANVSKSDLKERLAKIYEVKDSNCIFVFKFRTHFGGGKSTGFGLIYDNLEAAKKFEPKYRLIRNGLATKVEKSRKQIKERKNRTKKIRGVKKTKAGDAKKK

SEQ ID NO: 136708 - protein, 90 aa, Triticum aestivum
  unsure (1)..(90): unsure at all Xaa locations
  Clone ID: PAT_TA_31126.pep
NSSKSQSKQTGGHERISTKDNLIKRNWTXSTRCSFCDRDETIKHLFFDCPMARVLWRSVQIAFNITPSNLVRSFFGTWLVGIEAETARQI

SEQ ID NO: 136709 - protein, 75 aa, Triticum aestivum
  Clone ID: PAT_TA_31127.pep
EYVLCCGQFGTAEMIWLLTPIFFGKQPIHFLQVLFRATALIRMWSLLTPAEARARLVTGSVRWEMVARDIFNWFG

SEQ ID NO: 136710 - protein, 177 aa, Triticum aestivum
  Clone ID: PAT_TA_31128.pep
RTRGPPIRRTSGVLSNPNITNLVKIAANNKKLTDANTSWTALPPSLAKLGKELLKYRDAAQMAAVEAMQEASAAESLLRCLSTYAEVSSTAEEQNPQLAVEQFLALHSAMSRATVVADSLAKAAAATSTTTSPDRSTVSEAASIDEESLAVAAERRRRAVSWVGAGLATDLWLTAAR

SEQ ID NO: 136711 - protein, 488 aa, Triticum aestivum
  unsure (1)..(488): unsure at all Xaa locations
  Clone ID: PAT_TA_31129.pep
MPPPWQPSTYAAGTIVAASPCRSSSPAGFHASPYSDPLSSVSDEEKTIGDTSSAAPPISLDDEFPKATAMGPYASAGWSDLPIDLLIRILHLLELPEALAFHAVCPSWRSASVAAGGVPPRRTPWLVSLAEEPLPAGDQQRPVRRGLWDPTATSELRNLAGALRALLVSFPWGQAVACCGASHGWLIMANELSDLVLYNPFTTASLSLPPITGFASCIEGVYGDEGNVVGDRYSCYESDSVYDVRSLGGFFYDKVVLSGSPSAGPAIALSMHMDGKRLSFARVGDSSWRHGXSASGRNGDSFADCIYHRGRFYAVTMEGILKSWDFSGSDKPRKKTVIAEDDNDMFDDPVITRYLLSTPWGNLLQVRVFLDTHQGNNVRIEIDRLDLKSQTRVALSSGKALRGHAAFVGQNSPGILSTKEFPKLRPDCIYFTTPRLRERHAFEHRRNQWSGVKVYDLKRQTLEDAFPSGGGLYGTICPLEVWFTPSLI

SEQ ID NO: 136712 - protein, 110 aa, Triticum aestivum
  Clone ID: PAT_TA_31130.pep
LNQPNEDHRAYVDFILLHNFRSTGSNRREHQVSIPKWSPPPAESVKVNVDAAIFAQTKRMGIGVVIRNHLGLVLAASRGFIHHVDNPELGEAIAMRHALFFAEDSSFLKI

SEQ ID NO: 136713 - protein, 189 aa, Triticum aestivum
  Clone ID: PAT_TA_31131.pep
MEVAICGPYIVVKSHEFMPKWTPAMLAPLKSWITCGPNVQIFRDTVILVLIAYVILVDISLSFVWLAIFPVIALVFIRALHLKFNRRTGGSSRKVNQGSSLVVVETKMTTMEVGIIVVMTLGALLGMDQLPDHAAARFTISQFLLFLSCTVAALTRMVMKLPAGASPGIALATEMLHKTLLLLLLATAH

SEQ ID NO: 136714 - protein, 321 aa, Triticum aestivum
  unsure (1)..(321): unsure at all Xaa locations
  Clone ID: PAT_TA_31132.pep
MSQKKSRGGAAAREDADELSRSPLQAVLLADSFTLKFRPITLERPKVLLPLVNVPMIDYTLSWLETSGVEEVFVFCCAHAQQVKEHLEEAGWTGKPAAREMAVMAVESHDAISAGDALRVMYGRGLINGDFVLISGDTISNMSLKEVLQEHKDRRKNDPLAVMTMIIKHSKPSILMPLARSPTAVTVMALASETKELLYYEDRADSSHLCVTIDKDILANNPTLQLHNNMEDCYIDICSPDVLSLFTDNFDYQHLRRHXKGLLVDDIMGYKIYTHEIHSSYAARIDNFRSYDAVSKDIIQRWTYPMVPDVLSFGNCHEMKL

SEQ ID NO: 136715 - protein, 432 aa, Triticum aestivum
  Clone ID: PAT_TA_31133.pep
MQDSQSAFKKEDPLGMDAMSSEEFASQSKLLQEFTNVPSIESAWLFKTNNEDRSTAMFSISQPDLLANKKRKYILHSHIVTHGTMPLECHWSPFPIEMTGVSAVVPSPSGSKLLVVRNGEKGSRTTLQIVNQSHVEKEIHVDQSIHGPLYTDEWFHGISWNHEETFIAYIAEQSPQPKPTFDNAGYRKGGSSEEELYSWRGQGDWEEDWGETYSRKGRPSLFVLDIASGEVRAARDVTKSMSVGQVVWAPPSSSGHQKLLVFVGWLEHNGFQSTARKLGIKYCSNRPCSLYAIHSPFEEEPNADNASNSGSESVPASVATNLTPSISSALFPRFSKDGKLLVFLSSKCAVDSGAHNATDSLHRINWPSDWKADEQLSVADVVPVVMCPQDGCFPGLYCSAMLSDPWLSDHCTMVLTSAWRSTEVILSIDVLS

SEQ ID NO: 136716 - protein, 250 aa, Triticum aestivum
  unsure (1)..(250): unsure at all Xaa locations
  Clone ID: PAT_TA_31134.pep
MTTDVGSEVVSGISEGSGEYFVRVGVGSPPMEQYLVVDSGSDVIWVQCRPCAECYQQADPLFDPAASASFAVVPCGSGVCRTLPGGSSGCADSGACRYQVSYGDGSFTQGVLAMETLTFGDSTPVQGVAIGCGHRNRGLFVGAAGLLGLGWGPMSLVGQLGGAAGGAFSYCLASRGADAGAGSLVFGRDDAMPVGAVWVPLLRNAXEPSFYYVGLTGLGVGGERLPLQDGLFDLIEDGGGGVVLDTRTAV

SEQ ID NO: 136717 - protein, 400 aa, Triticum aestivum
  unsure (1)..(400): unsure at all Xaa locations
  Clone ID: PAT_TA_31135.pep
MPHLAHTLGALPYLPPPSPRTSEEPNPMAGGGGKVACAAWIRRREDKATRVFAVHGRPSPPALEVLGFDSGSCSLSEEPLARIVLGEDPGDAPLAVAVHPTGDELVCATAKGCRLFKLIFEEFTVRFIESKAPAIXSVGLQKCLAYSTDRAEFAIGGEDGLLSRVHRPSMKVLAXVEPNAHNSFRDXWDISLDSEFLVSSSTDGTAXRIWKINEGVPLVNLTRSSDEKIECCRFSRDGMKPFLFCTVAKGSKAVTVVWNISDWSRIGYKRLLGKPASTLSVSLDGKFLALGNQDGDFCVVDVKEMEISHWSKKVHLGSPICGIEFCPTERVVISTSPQWGAELTRLNVPADWKEWQIWLILLALFLASAVLFYVFYQNSGSFWSGTPRRDVIDLPSHAEF

SEQ ID NO: 136718 - protein, 243 aa, Triticum aestivum
  Clone ID: PAT_TA_31136.pep
MSSMLPSDPASSWLRICFGVHLASVSFIISFGSIGFLTCLCAYIFGLLLFRPCGRGPLLSLILHRLHGLADKIGPTMAVLRLDVQRNIERLQELYLQDPSKYSILTAMVEKEADDGTVRKADSCARAILWLTRSMDFTVALLQRLEEEEKEEGSDQQSLAQLVEAAYMVSLKPWHGWISSAACKIALKLIPERAIFVGWLMGENQSYSLLKVEIEKLVQLLQPFLDDIHAMLAKFKLDRLKST

SEQ ID NO: 136719 - protein, 115 aa, Triticum aestivum
  unsure (1)..(115): unsure at all Xaa locations
  Clone ID: PAT_TA_31137.pep
CKIAIFFSMFALCSDVPLTCGFTKKLCRACRGLTKHSRHVTLGWTAIILYLAKILTEYHTFQCMSKQPPLPELENLPSSWALISPQFQRKLLTKYSIXXISKFGEXPKMHXIIAL

SEQ ID NO: 136720 - protein, 92 aa, Triticum aestivum
  Clone ID: PAT_TA_31138.pep
GRRSTSTSSPTSTRPPPCSARRRRRQTGGRGDLGCAHFVVALRRFRWAGPGWGKKCVSLFHKEKCVGHLVRFFIIFAFLFLKFTGKKWRKWW

SEQ ID NO: 136721 - protein, 281 aa, Triticum aestivum
  Clone ID: PAT_TA_31139.pep
GLPQQAPQGSVRAAIGCRLVDPRGILKPSNEISISKVFSRPQECSTKAAVVGRRALAASAFLRGDSFTMECTIEVLKELPDTVTDPVEEVPVPCSNLGRHLALLLQSEAGADVTFLVSGESFAAHKSILAARSPVFMAQFFGDMKEKCSQSVVIEDMEAAVFKALLHYIYTDTVSEFDEKGEEVTMLAQHLLAAADRYGLDRLKLICEGKLSDGINVDTAATSLALAEQHNCPRLKAKCVQFIIRNREVLDAVLATEGYKYLAASCPSVLADLLKSSLRVG

SEQ ID NO: 136722 - protein, 320 aa, Triticum aestivum
  Clone ID: PAT_TA_31140.pep
MIERMVQLNKTWDKLNEDYLERFGCPDTPVSNRSFVEKPFGYAASDDSLLTSSVVSLALYDGDKMLFACSGVALGRKGRAYPVVSRFVTSKRLVTEFEKNRNRADNLRINVRLHDKESFDGFLGLYDSHIAIVTSFWFANVPPVDLHSHIGWQNDLVAYGRAFSSGILMATSNAPTQLLGADHLIKHDLIPFPCPVTEAGLGGPVINEAGDVVGLSIKVDVDEETTYFLHRVALLARLEYLEKLMPNSTNFREYTLPDGVNSIVPSGFMAHVNYLKSCGYPQPPPLVLEVNGRLLNTFEEDFGQLYGYEDCDSNFYDRSS

SEQ ID NO: 136723 - protein, 180 aa, Triticum aestivum
  Clone ID: PAT_TA_31141.pep
PPRPHMTPPPPQPPVPPRFRRHHKLAGSLPDRPAQPPPQPPPLPPFVPTTSSAALRRADHLCCDPLPQSPQQPPAPLHSNTTCPPLRPELHLVLTQPAAQPSSAPPSSHPAMRKLSSSASSAWKSRPSGMATSYLATACEQGATSQLRWASPSAAVNAPAPLLGRSPVCLAVAVRRYRAR

SEQ ID NO: 136724 - protein, 93 aa, Triticum aestivum
  Clone ID: PAT_TA_31142.pep
PLPACHSVPSPPPTSFLSSPPPPAASPPPPSQVSPVLGQRISPSPTSKKQTQGAPTWTFPACHSVPSPPPTSLSSSPPTLAAPPPPRPKGAAM

SEQ ID NO: 136725 - protein, 134 aa, Triticum aestivum
  Clone ID: PAT_TA_31143.pep
MTLNQRPRDALEPTIPYIPSERWCLLIILCLIRHQEWRDQRDLRGDRMTLDEFDGGSWLAIVYLDGAGVEAELDAQRRLEDGRQQDRMSGTCGRLESMRLTPSARIELEPRSHPRTRSNMIQQQSLSLDREVRD

SEQ ID NO: 136726 - protein, 225 aa, Triticum aestivum
  Clone ID: PAT_TA_31144.pep
MQSLLRNVCRAGNRGAAARLLEFAAPVATQPGATPPSSAIKYLRPCGFTPPTGNWFISRDGVPASSGFCAKVLMTRSLSTVGTVEVASDEDDSSSPAVEHPPRIKFKRPDKTARHIMNILNKEAVEKVRSEREIPDVQPGCIIQMRLQVPENKRRESTLKGIVIARRNAGINTTFRLRRLVAGVGVESVFPLYSPNIKEMKILDRKKVRRAKLYYLRDRMNALKK

SEQ ID NO: 136727 - protein, 458 aa, Triticum aestivum
  Clone ID: PAT_TA_31145.pep
VKAQLKRLFDIDPSEALLTSAKTGQGLSQVLPAVIERIPCPPGNCDSPVRMLLLDSYYDEYKGVICHVAIVDGAMRKGDKISSAATGRTYEVFDVGIMHPELTPTGVLYTGQVGYVITGMRSTKEARIGDTLHQAKIIVEPFPGFKPVRHMVFSGVYPADGSDFEALSHAIENSTCNDILVSVTKETSTALGMGFRCGFLELLHMDVFHQRLEQEYGAQVISTIPTVPYIFEYGDESKVQIENPAALSFNAGKRITACWEPTVIATIIIPSEYVGPVIMLCSERRGEQQEYTFIDANRALLKYRLPLREIIVDFYNELKSITSGYATFDWAAPASQKSDLVKMDILLNGQPVDAMATIIHNQKAQKVGRELVDKLKKFIERQMFEITIQAAIGSKVIARETLSAMRKNVLAKCYGGDITRKKKLLEKQMRREERMKRVGSVDIPQEAFHELLKVSSSK

SEQ ID NO: 136728 - protein, 184 aa, Triticum aestivum
  unsure (1)..(184): unsure at all Xaa locations
  Clone ID: PAT_TA_31146.pep
IAIAPLHWMLLKASSSGPLSCSRLPPSQLRVSLYADHAALFVAPTARDIEVTRQIPCAFGDASGLRANLAKSGIYPIGCLNISRPIILQQFPIXCVQFRCKYLGLPLHFKKITIADLQPILDKIASKLQVWRGKLMSSDARLRLLNSVLSAIPTYLISLTKGRCRGCTASTLFPSYASSPSYGP

SEQ ID NO: 136729 - protein, 162 aa, Triticum aestivum
  Clone ID: PAT_TA_31147.pep
WHGIAEYAYTLKVDEKSDVYSFGVVLLELITGHRPVGPHLGEDGSLDLVQWVRARVDAVGHGGGVEAVLDPRLGGDVPAWEAAQALFVGMLCVQEQSVERPTMREVVHMLQQAKLPPPSLVLDPRGRAMPMPPAAAAARVHVVHDDEEAAAGGGSDSECEGR

SEQ ID NO: 136730 - protein, 162 aa, Triticum aestivum
  Clone ID: PAT_TA_31148.pep
MQIFVKTLTGKTITLEVESSDTIDNVKAKIQDEEGIPPDQQRLIFAGKQLEDGRTLADYNIQKESTLHLVLRLRGGAKKRKKKTYSTPKKVKHEREKTPLAVLGYYRVDDATGKVERLRKECPNPDCGGGTFMAAHADRHSRAQCGLTYAYAEAQSPEIDSD

SEQ ID NO: 136731 - protein, 265 aa, Triticum aestivum
  unsure (1)..(265): unsure at all Xaa locations
  Clone ID: PAT_TA_31149.pep
MDLLLPLLSPSSLPSLASPCDRYAHRSSAAYYPCAASLAAAACGGGPPALSGNGGCRAAGAAALVGRRVGLRAPAPGRRTAHEIRGSPGISSVDTDRTRTKANGTDLVIREAAAAAQGPRARAAGLAKHGPVYEEHKRVQCEYKGKSLXLRVEQRSRAPNELAVTILYQGGQTDIVAVDVAQVGSSSSWRSLTRDHGPTWSTSLAPPGPLQLRAVVTGGYDGKWVWADREVLPRQWRAGEVYDTGVQITDIAQEACFPCDTQEWS

SEQ ID NO: 136732 - protein, 195 aa, Triticum aestivum
  unsure (1)..(195): unsure at all Xaa locations
  Clone ID: PAT_TA_31150.pep
MPPHYRRILFSDDCDPWYGCPTPPAPPFFTPSPSPSPSSPPPIISPPPPPSPSFSFYFPSPPDLAPSPSPVHDGGGGWSDQGGGTYGYGAVDDRRRRFVTYVLCAAAALAFLSLILLGASIAVRRRQLRRRREALLAQPPAAATNVGNDDPEGGGSGGVVHHVWYXPTVGLDEAAIDSIAVTRYRAGSGLLGAAD

SEQ ID NO: 136733 - protein, 134 aa, Triticum aestivum
  Clone ID: PAT_TA_31151.pep
LCSSSHAVESAVGEAVTASSHARGHPCGCALRVASDLATAEGAVGHRALCEQHLQGCPARAGRCGCVQRLRQSVAADARSRAGEPCLTSPPCFSTGLNHAPRSRRAEGCRPLRYERPWRVEMGRALPQAGHRWL

SEQ ID NO: 136734 - protein, 161 aa, Triticum aestivum
  Clone ID: PAT_TA_31152.pep
ARARAGPLGPTLPQKHPSDNMVSSRVLLLVVAILLCMASVQASGQSLTPPAEGAPAPAPSACGGDHCTLSDIVKLEVCLDLQLGRMSPGAKDRCCRRIRAMPNAAGCLRVAFIRADLRFHANIDNRVNAVLTACGTATVLDRACLVPLFGRRHLGLAGDPQ

SEQ ID NO: 136735 - protein, 125 aa, Triticum aestivum
  Clone ID: PAT_TA_31153.pep
MVSSPVLLLATILLAVASVRASGQGLPPPPATAPAPSACGGDHCPLSDVVKLDVCVDLQLGRMGLANKERCCRQIRGMPNAADCLSVTLSRAHVRVRANIADEVNAVLTACGVARVFDLACIIIF

SEQ ID NO: 136736 - protein, 151 aa, Triticum aestivum
  Clone ID: PAT_TA_31154.pep
RPGRAIDIDSSTEAASRTIATTNPETMVSSRILLLATILLAVASVRASGQDLPPPPATAPAPSACGGDHCSLDDVVKLDVCVDLQLGRMGLANKDRCCRQIRGMPNAADCLSVAFSRADLRIRFNIGNHVNAVLTACGVAHVLDHVCVAIH

SEQ ID NO: 136737 - protein, 106 aa, Triticum aestivum
  unsure (1)..(106): unsure at all Xaa locations
  Clone ID: PAT_TA_31155.pep
KLKKTTLKRLDAELVPIPFGEFKPSNHLDNERYRQGGHQSPPGKFQAKAKSRIPYTNKQWGRQRQPSGNSLPTIPPRKILHMVHCQLQEXPTQSDKVPEELSPCXK

SEQ ID NO: 136738 - protein, 77 aa, Triticum aestivum
  unsure (1)..(77): unsure at all Xaa locations
  Clone ID: PAT_TA_31156.pep
LYHIFLAYASHHNFKLYQMEXEEYTFSGPLSELVYVKQPPGFEKPRYIXQLHEALYGLKQASGAWYDHLKTYLNEKG

SEQ ID NO: 136739 - protein, 118 aa, Triticum aestivum
  Clone ID: PAT_TA_31157.pep
PTRPALSRHSCIKTPENSAEKRNVVWEPSKDLKHLNLRVLLIQGCEDEDKVTNYARLVMERAVGLKRILLCDQLPCEDCNAINPEPSLRRSQVDEASRHRIKERLTRGSSSSVDIIIC

SEQ ID NO: 136740 - protein, 50 aa, Triticum aestivum
  Clone ID: PAT_TA_31158.pep
HVKPLNDLHFGTEEVVGNSSRLFPTTQTKLVPSTSRLWEEHKSYRIHTSD

SEQ ID NO: 136741 - protein, 268 aa, Triticum aestivum
  Clone ID: PAT_TA_31159.pep
PRVRRRFPLPSGHVAVRRHHRRLWIEHADTVSGVAASTDGRLLSSVSWDKTLKVWAIPSLRCLQSLPAHDDAVNAVAVAPDGTVYTGSADRRVRVWAPRPASDKTTKRQSKKPVYYLAATLSRHTAAVNAVAVGCGGQVLYSGGNDRCVVVWEREDSASHMVAIGALRGHRKAVLSIASTGGGLVVSGSADHTVRAWRRETDGRGHTCVAVIDGHGSAVRSVAVALVPGKKQLQGGEDGDDGGEEWRVCSASFDGEVRVWSLRVTTGL

SEQ ID NO: 136742 - protein, 137 aa, Triticum aestivum
  Clone ID: PAT_TA_31160.pep
RDNAAASAAAAEAEASTGKYAHSNSFSGNLRFPRQKRCAASCPSSMRSSPNHSGMLSFGGAGGVGFPDVPAAAAAAMTSSIGMRPVSLSAASSSSMEELQSAIEGAIAHCKNTMGGVVSLCPRKVPASAAAGEITAF

SEQ ID NO: 136743 - protein, 63 aa, Triticum aestivum
  Clone ID: PAT_TA_31161.pep
PRVRPRVRHRVSNRGSDFAVSLHLYTPPNVAKKGCHIFDENTGRRSHVPGCHYYSAYGRLLKE

SEQ ID NO: 136744 - protein, 289 aa, Triticum aestivum
  Clone ID: PAT_TA_31162.pep
VRDHVMINNRAVRVHKFHAKGASGLSNVLQNQQILNYGQHSRFQGDFLPSQGLESKERFCSFQQATDASVDMSRFLQGQTSNDVSHQIVTQQITPYDPSQGTFLPRPRITQLRIPNIERTDFGPDAETSAIAHYNIQAGQVVMQFGQHGQNHSHFSEQSYSSFPVGSLTSMDTAMDSMQPHSQLTSNRESFSKQPDLLCNGQTLHQSNQVFAGLQPSRTNSFDSVENDQLIQRFIFQFFSSEGAATPLSPRKWVKIKAALKLASVGRLSRASRRGLHSPPGRARLVPTT

SEQ ID NO: 136745 - protein, 121 aa, Triticum aestivum
  unsure (1)..(121): unsure at all Xaa locations
  Clone ID: PAT_TA_31163.pep
MKGGEAPAATVVVGEEHCETEDRELTVRKTTLFSPGDGLEAYDHRTGALAFRLETYGRGGACGGGAAAGDLALLGAAGDPVLTVRRRRPSLHHRWDGFLGDGGGAKPLFSARRSSILGAXA

SEQ ID NO: 136746 - protein, 161 aa, Triticum aestivum
  Clone ID: PAT_TA_31164.pep
PAGSGTYFSALALNNTLVWDTRLVPLSHTRDALRSKVGRFFRPLHCLSHGKQMPTAEYTSQLPGHVDEGDQGVNATQWLHNQPVLVTASGDGSVGMWDVTLGKPCVRHIVTHNRCANAVAVAPNDEYISTGGSDQKVVLYHNRNGCAHLNWRLTYPLPGTD

SEQ ID NO: 136747 - protein, 197 aa, Triticum aestivum
  unsure (1)..(197): unsure at all Xaa locations
  Clone ID: PAT_TA_31165.pep
KTITSQVDKFSLQENKKVQTQLVKRNENLKRAERARIIANKXPGLVELLIAKTPFWEHGSKKIFYYDELPLLEMLKQYMLTLKEKEEERCRQRENTMVQTQLVKRNENSFISRPNTGCSRPSSRGFNTSHRSTSFSSHRVSSVDQQPISDNSAEKDMHIRKVRDRSMQSKVGNNRSCTVHDEDKTSGVSTKQGLSSI

SEQ ID NO: 136748 - protein, 168 aa, Triticum aestivum
  Clone ID: PAT_TA_31166.pep
NCPLCRSDVIDPAATTAGAGIESDSNPSADPDVNANAAAEQAAAGSDSTLEHEDDEEDQEAPRVEEEQHEQQQPNSPEPEPLPQLPGPLPRNVRRAASMNAAMVSTAADVAALDRLPDAAPEGEERNGREKHQSGATGHPSTERPAPGGLPRSFFARHCRARSSVLPL

SEQ ID NO: 136749 - protein, 156 aa, Triticum aestivum
  Clone ID: PAT_TA_31167.pep
DVKTEKNDTEAADAELVSISFGELNLQPLDNEDTDKEDIKSPLKSSSEGQVRESLTNKQMEPSSSSPSEDPLQLYPPGRILHMVALPAAEESNTSEQGSQEEVVTLYETPRHLYSKIRLGRSMVGEHYMPKYIRTMELLIEKLAKEDMDSDQLDLL

SEQ ID NO: 136750 - protein, 297 aa, Triticum aestivum
  unsure (1)..(297): unsure at all Xaa locations
  Clone ID: PAT_TA_31168.pep
TTGDLFRSPSVVAVDLRQEMVDYITQRSETFIADTLIESEVEQNADNQMPDDPYEVISIFMDDFSRTKRNIIGHVSGWLLSDSREDKIDDFVQEMDMTRFWPLERREGIAEVLLKNVDIKTKXHCPEKYENEERLADHKAQCSFRPVTCPNEGCRAKVSVRCMQDHDATCLFKILQCEQNCEKRLLRRDMDRHCVTVCPMRPMKCPFGCDDSFSEHDLEEHCSESLQQHLLKVLQVIHKNNFTADELKETALRLEKSEDRGKLAKARDARSLATIVKDLEAKQFQCSGVVSHINLGG

SEQ ID NO: 136751 - protein, 133 aa, Triticum aestivum
  unsure (1)..(133): unsure at all Xaa locations
  Clone ID: PAT_TA_31169.pep
MLDSHYGKHRGFXKLRGKRLXVAQKEVXDLKEMRMPLEGQESAHAVTEPNSRSRIPDQPGWTSGMGEERINYHSREFIRPDDRDTRRGYSDYRSVGQRNGYDPRGRFAGRGGRGRDRFDYQYGGXKQHARGDR

SEQ ID NO: 136752 - protein, 307 aa, Triticum aestivum
  Clone ID: PAT_TA_31170.pep
LLTRFACGSLAVGFAANHAVADGHATSDFLVAWGRAARGLDISGPSPTPPPHSHPDLFPPRDPPVVNFEHRGGDREYYLPSPTDVVGHHGDAADNIVIHKAHFSKDFIAGLRVKASEGRGRPFSRFETILAHLWRTMTRARDLSPEETTKIRLSVDGRHRLGQPAEYFGNMVLWAFPRSTVGDLLNRPLKHAAQVIHDEVAKVDGAYFQSFVDFASSGAAEKEGLARSAVCKDAQCPDVEVDSWLTFPFYELDFGTGSPSYFMPAYFPTEGMLFLVPSNFGDGSVDAFVPLFQENLQAFKECCYSME

SEQ ID NO: 136753 - protein, 148 aa, Triticum aestivum
  Clone ID: PAT_TA_31171.pep
GGGGGGDAGVEEEEEDSAAEEADGDGSEEEMQVDDGNAANASDDLGCEMETHNEPKKSQADAWELSNKLNENAQHIHMILSGEADEDGGHHNAPAYAISPDAMETTRQKADELIKSLGGLVSYLNQFTDLIKENGIEDAVGVNWLKAL

SEQ ID NO: 136754 - protein, 149 aa, Triticum aestivum
  Clone ID: PAT_TA_31172.pep
NQRCMYVCPLVADQHFVPSIEYHHSSMLKYWHHCDLLCSRLHACRLARGIKGRGFASSVEPEESGTDEDSASAEKLVVVTTLLWWLRLVRFGIAEDARGAEASLSRGERSKGDGGADDTRNEGRHCDNQNYFGLIEIVVALFVWLNPEL

SEQ ID NO: 136755 - protein, 149 aa, Triticum aestivum; identical to SEQ ID NO: 136754
  Clone ID: PAT_TA_31173.pep

SEQ ID NO: 136756 - protein, 194 aa, Triticum aestivum
  Clone ID: PAT_TA_31174.pep
MGMGMENKSVAIIGAGVSGLAACKHLLERGCRPVVFEADTVVGGVWAHTPDCTRLQTERTMYQYTDFPWPDSVTEEFPNNRQVAAYLNAYARRFGVLECIRFGHRVAGMEYVGVAEEEVAAWDEWAGCADAFGSGNGKWRLTVADAQGQVQVHTADFVILCIGRFSNVPNIPKLPPGKGPEAFDGKVIHSMDYS

SEQ ID NO: 136757 - protein, 91 aa, Triticum aestivum
  Clone ID: PAT_TA_31175.pep
PRVRPRVRPRVREAARDFVRNGGLIVDPEAKVASVSKILRWYNTDFGKNETEVLKHAANYLEPAASEQFLELLANTQLKVSYQPYDWSLNI

SEQ ID NO: 136758 - protein, 227 aa, Triticum aestivum
  unsure (1)..(227): unsure at all Xaa locations
  Clone ID: PAT_TA_31176.pep
PNRNILFCRXGKTAKELSXEDPFLHLTGPSRAIVADEPVFFQIELKLKYGAQFKDTALFTAYQRYRPMKKYDIMLINSRCCTAEISLERFAPSIQATIVGVRVVEGESFNYGCKVSCFFFRVEAMLGSAVEVVLLDCSGERMHAGLDGYLSLSRNVMSVGLQGTLRVVIGAYSKSKPSISRINHVDFPVQQCQTTMLKCHVGGSKVEIVVAWSRLVMDNHNLVLDGY

SEQ ID NO: 136759 - protein, 149 aa, Triticum aestivum
  Clone ID: PAT_TA_31177.pep
SAAVAAPGVSFAPPLLAFVTAHVGAPRVFVPAPGRNMKVCVAMGVVQIVAWAIWAGVTHHPSRLKLWVVVFGGALAMLLEVFDFLWVVVFAGALAMLLEVFDFPPYKGYADAHSLWHASTVPLTYLWWSFIKDDAEFRSVLPTLVKKAR

SEQ ID NO: 136760 - protein, 81 aa, Triticum aestivum
  Clone ID: PAT_TA_31178.pep
VKRPLLLFTAPPKWLSRAEEMGIFASTAWGCSGGHLVVSTKASCPHLSLECGGTRASPLQGAKERGLSSRLRLSDILSAPS

SEQ ID NO: 136761 - protein, 115 aa, Triticum aestivum
  Clone ID: PAT_TA_31179.pep
CIQRAAEYNKYIFREVSSGSGTPLMPKRKFETYIFTLFNEDLKPGPVAERNFGMFQPDFTPMYDIGIMKDPVKTTPAPASVVPATSPKVAATPILATADALDAAVPAKANGSNNA

SEQ ID NO: 136762 - protein, 80 aa, Triticum aestivum
  Clone ID: PAT_TA_31180.pep
PRTRGAVMFGKWEFDPMALPEPPCPVHLWQGDEDGLVPVALQRHVAGRLGWVNYHELPGTGHFLSAVPGLGDTVLRTLFG

SEQ ID NO: 136763 - protein, 123 aa, Triticum aestivum
  Clone ID: PAT_TA_31181.pep
MSSSVEKGNGSLDPGERSGPMSQRNACGIRYTTKPREAMGLEDPPKKRQPAAAAAPAAAAVACSEAGGESADPEQQQQPPQQQPKKKTTTTKRGREVELRVVGFGKEVVLKQRRRMRRRPRLG

SEQ ID NO: 136764 - protein, 190 aa, Triticum aestivum
  Clone ID: PAT_TA_31182.pep
KGPSDYAMLKIHTLPATGGDTLWASGYEVYDRLSDPMKKFLEGLTATHDATFFHDEARRLGNPIRKGIRGSPLNQGEQLTSVHPLIRTNPVTGWKSVFVNKGFTKRINGLSKDESDTLLAYLFNLVTQNHDAQVRYRWSKNDCAIWDNRSTFHCATYDYEAARAGDRVCSLGEAPYLDTNSKSRREALGI

SEQ ID NO: 136765 - protein, 356 aa, Triticum aestivum
  Clone ID: PAT_TA_31183.pep
MENGHAGRHRVAVIGSGNWGSVASRLLASNTAKLPSFHDEVRMWVFEETLPTGEKLSESINQAHENCKYLPGIKLGANVIADPDLESAVKDADMLVFVTPHQFVEGICKKLVGKLRPGVEAISLIKGMEVKMEGPCMISKLITDTLGINCCVLMGANIANEIAVEKFSEATIGYREDKEAANRWAKLFTTPYFLVAIVEDIEGVELCGTLKNVVAIAAALASGLDMGNNTKAAIMRIGLREMRAFSKLLFPSVRDNTFFESCGVADLITTCLGGRNRRVAEAFARNGGKRSFDELEAEMLHGQKLQGVSTAREVYEVLTYHGWQELFPLLSTVHEICIGQLPPTSIVEYRLAEGQS

SEQ ID NO: 136766 - protein, 180 aa, Triticum aestivum
  Clone ID: PAT_TA_31184.pep
IRHEFGYAAFGNDAPGNLLTGFGFYEPYWLIDFANACIILHLLGGYQVYSQPIYQFADRHFAERYPGSGFVNDFHTVKVPLLPAYRVNLLRVCFRTAYVASTTAVAIFFPYFNEILALLGALNFWPLAIYFPVEMYFIQRKVPRWSPRWLVLQGFSTVCLLVSAFALVGSIQGVIPQKLG

SEQ ID NO: 136767 - protein, 162 aa, Triticum aestivum
  unsure (1)..(162): unsure at all Xaa locations
  Clone ID: PAT_TA_31185.pep
MMAAATAPATATKLAADEYTAELAGVAVGAPVGVAETADGVIAEGASVGASVGGAGGEAIGDGDAAVGGVATGAGAVAGDLAGGAGSGAILGAGMGPXAAAATARTAMTAATTAKRAIWLLLVAENFTEIERGDGTMGIANAWALVWRVGGWEVCRRRPARR

SEQ ID NO: 136768 - protein, 406 aa, Triticum aestivum
  unsure (1)..(406): unsure at all Xaa locations
  Clone ID: PAT_TA_31186.pep
KEFERSFQMRFPACSIAAKRHIDSSTTILDVQGVGLKNFSKDARELIMRLQKIDNDNYPETLCCLYIINAGQGFKMLWGTIKSFLDPQTXSKIHVLGSKYQNKLLEIIDESELPDFLGGKCRCEESGGCSKSDKGPWKDPNIIERVLNGEANYGQRILAISSTDGNTVSYTKLHSSAKKTSDASAESTSDVEDITSPDAPLDVIVNPDLTLHEPKSSGHASTSGTAPVVEESVPTVVDKLVDDVCNSPRATSVASTSGSFSLRNIRMALGMLRTQIVTCLTVLIMSLFMVIRSAQSRISERFSRQSIACDHNCGEFPQNLEFKVPYVLRQLRELEEKVVVLETKPSQMPVEKEEVLNTAVCRVDALEAELISTKKVLYETLIRQDELLAYIEKQDKNKFRKKRFCF

SEQ ID NO: 136769 - protein, 185 aa, Triticum aestivum
  unsure (1)..(185): unsure at all Xaa locations
  Clone ID: PAT_TA_31187.pep
DPRAARAEFGTRFLGINSLIDVAGGHGGAARAIAMSFPXRMKCTVLXDLPHVVAGAPQXCPCVIYFLGDMFKXIPPAXDALFLKCIFHDWCDEDXCVKLLKNCKEAIPPRDAXGGKVIIVDMVVGSGPDDIVTRETQVFYDLFIMGAEGIEREEFEWKKIFMEAGFSNYKILSVLGVRSVIELYP

SEQ ID NO: 136770 - protein, 86 aa, Triticum aestivum
  Clone ID: PAT_TA_31188.pep
ELTWAVWERVPNEWGIEKFRKWHEILRADPNLNEFDARNLAIDRVYELALQCLAPKKRNRPSMRRCAEILWSIRKDYRELAQPTSS

SEQ ID NO: 136771 - protein, 156 aa, Triticum aestivum
  Clone ID: PAT_TA_31189.pep
RPRTRGRCDLRGLVQDLKRVARAGMGLEYEDPHTVIEESPSLRRAPVARRVEEMFAQIKAKLPGAPLFLLCLLPERKNCEVYGPWKKKCLADFGIVTQCLAPQRVNDQYLSNLLLKINAKLGGLNTLLQIEAARAIPIVGKVPTIILGMDVLHGQP

SEQ ID NO: 136772 - protein, 243 aa, Triticum aestivum
  unsure (1)..(243): unsure at all Xaa locations
  Clone ID: PAT_TA_31190.pep
LSGLPVYRTTDSVEPPKQEMLPSCVKPRGTEDASLLRECLIDFYTSSGKRKPDQVIIFRDGVSESQFTQVINIELEQIIEACKCLDDKWEPKFTVMVAQKNHHTRFFQTNFRDNMFQGLAMGQQVCHPKNFDFYMCAHAGMIGTSRXRHYLHDKMGFSGDEXQEFVPQHSLSYVYQRSTTAISVAAPIAYAHLAAAQVGTFMKFEDMSDTSSSQGGGHTSAGSAPVPELPRLHEKVRSSMFFC

SEQ ID NO: 136773 - protein, 369 aa, Triticum aestivum
  Clone ID: PAT_TA_31191.pep
MLGSPRKQHGGGGGGIHSASFLLGALLPTLLLFFLASDRVGERLTSISTYTLGNNNNGSSSAHREQMTHDANLTDTDTTEERVFPGLAELLPRVATDDGTVIITSVNEAWSRPGSLLDLFRAGFNNGEGIAHLLNHTLIVAVDPGALAHCEAVHPHCYLLEVTSANVSSANRFMTRSYLELVWAKLELQQRVLQLGYSYLFTDVDIMWLRNPFRYISLYADMAVSTDRFNGDAEALTNAPNTGFYYVKSTNRTVSMLRRWRAARSRFPPTHDQAVFDEIKGELAGGELHIRLVFLETALFDGFCQLHDEMDRVCTMHANCCIGLENKVHDLTNMAADWKNYTSLAPAERRGSGRRWTAPDQCEESMRQR

SEQ ID NO: 136774 - protein, 122 aa, Triticum aestivum
  Clone ID: PAT_TA_31192.pep
MGGTRSPLGAGLHDSDLWLQKSPFQQLPLDTESLFLSHNFPETPAHSELGFGSPNKVAHAHPFGPPGPGHPWPKEELVLNGPQGASQIHSPTGAHAGLFPTNPDMQSVWSFDQKRDSMEPTK

SEQ ID NO: 136775 - protein, 118 aa, Triticum aestivum
  unsure (1)..(118): unsure at all Xaa locations
  Clone ID: PAT_TA_31193.pep
EQLSXLMGWHIHLILQNKTTIEYHEGVRAMWLAEKGGDLYHHPYDLGVYENLISVLGRSIFCWLCPLSVNTGNGILFRALDEALPAGSAQYQSIQAMAYGSVHRMIFYQLRLHVIYKR

SEQ ID NO: 136776 - protein, 89 aa, Triticum aestivum
  Clone ID: PAT_TA_31194.pep
QKQMHQMACCLMVSEKCCKRVMKANKGECFEGAKQEGCFVTGKEPCRDLSIHRTATAPGLVAVNTRRCDVSCHHAPPWPTVARTARRSP

SEQ ID NO: 136777 - protein, 168 aa, Triticum aestivum
  Clone ID: PAT_TA_31195.pep
TLSSAAFQLLGMADLGLLPRVFALRAPIFNTPWVSIVVTSLITLGMSFFSFNNIVAAANFLYSLGMLLEFATFVWLRIKRPEMSRPYRVPLRLPGIVVLCLVPSGFLVFVMAIAGWKVYAISAMFTAAGLGVYYLMKFCKVRGFLKFGTVDGEGLMYECHQGRENVSV

SEQ ID NO: 136778 - protein, 139 aa, Triticum aestivum
  Clone ID: PAT_TA_31196.pep
MAIAGSGRGKAKPAASAKSVSRSSKAGLQFPVGRVARYLKVGKYAQRVGAGAPVYLAAVLEYLAAETLELAGNAARDNKKNRIVPRHIQLAVRNDEELSRLLGSVTIAAGGVLPSIHTTLLRKKAGKGKGDIGSASQEF

SEQ ID NO: 136779 - protein, 198 aa, Triticum aestivum
  unsure (1)..(198): unsure at all Xaa locations
  Clone ID: PAT_TA_31197.pep
MELQEDKRAADEESQPHFLIVTYPAQGHITPARHLARRLVRAAAGAGGARVTICTPVSAFRKMFADATSAVGGDEIREEGGVAYAAYSDGYDGGFDRTAGDYAHYMSQVRLEGARTLSGLLRRLGDRGHPVTCAVYTLLMPWVAGVARAYGVAVVAVFWIQPVTALAXYYHYFRGSRASVMVGAASRDPNAEVCIPGP

SEQ ID NO: 136780 - protein, 97 aa, Triticum aestivum
  Clone ID: PAT_TA_31198.pep
MYFQVNYTERKLNDYIDPDYDTLKVRLANSDLQANCRIMLGTDKRAIVTINRSEFRCLAKIHGDISAFRFKVTTKQRRVLMVHFCRGDYSQPDMYRL

SEQ ID NO: 136781 - protein, 220 aa, Triticum aestivum
  unsure (1)..(220): unsure at all Xaa locations
  Clone ID: PAT_TA_31199.pep
MASSSSFLLVALIALASWQAMASDPSPLQDFCVADNSSHVFVNGFVCKDPKEVTAEDFFLAAKLDMPRDTKMSKVGSIVTLLNVMRIPGLNTLGISLARIDYAPLGENPPHTHPRASEILTVLEGTLYVGFVTSNPDNKLFWKVLNKGDVFVFPQGLIHFQFNPNPYKPAVAIAGLSSQNPGAITIANAVFGSKPPISDDVLRKAFQIGSXAQDWLGAQF

SEQ ID NO: 136782 - protein, 277 aa, Triticum aestivum
  unsure (1)..(277): unsure at all Xaa locations
  Clone ID: PAT_TA_31200.pep
MVLLDKTGSPAPSMGTGTPTNIGGSIPGLIGCYNLIARRDKVKANCVVDNYFVVLCSVDINWTSPTSSLKQELPSLGHDLAMMWDKQDLTDVSFDVGGESFSAHRLVLATRSPVFRAELYGVMAESKMASITIHDMEASTFRSMLHYIYHSSLPDAGKIDISSPMAQYQHLLVAADRYGVEGLKKICEDKLXAMVSRRTLVSMLELAEAHVCPKLKARCFDFLTDGDNLKMVATSSEYLHLMQNFPTLLVEARNRFKIEHGKPTIVEPGSHKKARVN

SEQ ID NO: 136783 - protein, 243 aa, Triticum aestivum
  Clone ID: PAT_TA_31201.pep
DIGFAAPIICRTTVQGRHLISDDNGYVCSALSIDPWSRCCPQTGERFSCQGCNLDSQCCNSYEYCVSCCLNPSMTKEADVLKLKVAKPVTAGTYANIFDFCMGRCRHSSASVVHENAYLSDFHHCFLVQQNSSGSTESNFGSRLDGINVILGRQGESCSSACRAKGQSCVPSRLSELNKCQILQKYMRCKNGCFPSLGPDQPAEVVDEAPKNLNPGACLYMQMDDRLTCDGSHQHTRRLCPCA

SEQ ID NO: 136784 - protein, 118 aa, Triticum aestivum
  Clone ID: PAT_TA_31202.pep
GTAEERGQPSLAYRKGICLFHLYVVDKMSDGRIASSSVFAWSIILPIRTQRTSSYIPISLMHIDVLLAQHFGCLVMLSLVYSLFFVVQMYRLVNLLCCVKLTLPTLEKYSGVSYFVGV

SEQ ID NO: 136785 - protein, 147 aa, Triticum aestivum
  unsure (1)..(147): unsure at all Xaa locations
  Clone ID: PAT_TA_31203.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVXIPNINSVXLLPKKSAAAEKEAXAQEEGRHQVPKKKAAAAKE

SEQ ID NO: 136786 - protein, 103 aa, Triticum aestivum
  Clone ID: PAT_TA_31204.pep
SNRVHFVPTHPGVLDALICRTFTESTFSIIQNMTSCSSATMSSDLSLASSYKINLFHLASSSSSRSLLTNLALPILPRGPRRRGRLAESLGLLVAAMFLAWSA

SEQ ID NO: 136787 - protein, 114 aa, Triticum aestivum
  Clone ID: PAT_TA_31205.pep
ELELLFLVCVNSSDCCTPNSISTFRFDKYHALILAFFDKFMFMTSPVYSYCHSLCFSDLPAPWRHGTPHCFVGLNVGYLSDHQQTHKDSRCCLCSGRYHLVVCCYFQFALNKGM

SEQ ID NO: 136788 - protein, 455 aa, Triticum aestivum
  unsure (1)..(455): unsure at all Xaa locations
  Clone ID: PAT_TA_31206.pep
PRCRSYPSCKAPPWYTYAVCACVAALFGRSAERKLPPSAGSPDAAPEMAXPSLQAPCRAPPAPLGPPSFRVGVRFPRLPTPPLRLPAPPLPPSTPPPIPPNSAPTSATSANATATHTLTTTTHLPPSPAPATEHRQVHHGPVFVGRHAIRVRKWPHPNPGELLKAHSILAAVQEAQRRSRNRMADPLRPVIAVTPTTTSALQAPSLTSLAHTLRLVDAPLRWIVVEPGHRTDAVAAVLARSGLDFLHLVASDGPSTARLRMHALREVRKEKMDGVXWVFADENGILRTELFDEAQKVKSVGAVPVGILGEDEGTKESFLQAPACDEAGKLVGYHVSEETLLPAARSDMLLSTRLEWAGFVVSARVLWEGAAERPEWVRDLDAVDGGAHLASPLALVTDAGQVEPLARCAQAALAWSLRSDALHEVKFPHEWKFDAPLVSAASRQQSSVVNTEDGH

SEQ ID NO: 136789 - protein, 114 aa, Triticum aestivum
  Clone ID: PAT_TA_31207.pep
HASAHASGAASRHAGESWADDGEWEGASSTSEDDHHHRHHHHDASEEHLSEVTIRITKRQLHELMGRKTPGGRGSSTRQLLADIMDSGEVHHHDVHREEHWKPALRSIPEAVES

SEQ ID NO: 136790 - protein, 107 aa, Triticum aestivum
  Clone ID: PAT_TA_31208.pep
MGNCAASRHAGESWADDGEWEEASSTSEDDRHRRHDGSEEHLSEVTIRITKRQLHELMERKTPGGRGSSTRQLLADIMDSGEVHHHDVHREEHWRPALQSIPEAVES

SEQ ID NO: 136791 - protein, 236 aa, Triticum aestivum
  unsure (1)..(236): unsure at all Xaa locations
  Clone ID: PAT_TA_31209.pep
MYSGSALRVVESCLVTPSDETPREGLWLSALDLVLANRGHTPLVHVYSASDVAAADGFFNVAKLKKSMAKALVPFYPLAGRLGADRDGRIEIDCNGEGALFVVARSDRTVEDFSGPTPSSELTKLFCPRVQPSSIMLAAQVTFLKCGGVVLGTAVHHAAVDGSSAFHFIGTWARYCRXARAPVIELPCHDRALLRARSPPAIHPETVSMFCSKPTHARARVVRPRDQVITMVLHLR

SEQ ID NO: 136792 - protein, 47 aa, Triticum aestivum
  Clone ID: PAT_TA_31210.pep
QLYNNKTAIGQHAVNCPQKKREKQRSCSRLNYTRDTNVQFFSLLMKV

SEQ ID NO: 136793 - protein, 57 aa, Triticum aestivum
  Clone ID: PAT_TA_31211.pep
LQHVARNYVQCYIAAPERGFSSMCHGVQTMSGIWLCSALVQGRKYVKIPLEIFKISK

SEQ ID NO: 136794 - protein, 129 aa, Triticum aestivum
  Clone ID: PAT_TA_31212.pep
LLQCMIQQLSFYHKRMAFMHHQVWADLLAELLEHLREYQSGYPSHVASFPKLHSSLVGSSSQLPILLDAFLYISSNAMSCASSLTGNSSLCLAFACFASLSFYSILSSRTRISTDEEELPDLQVPLLST

SEQ ID NO: 136795 - protein, 104 aa, Triticum aestivum
  unsure (1)..(104): unsure at all Xaa locations
  Clone ID: PAT_TA_31213.pep
CQGFDRVVPSVDRCGYPYCAPVLGPGTNAWLLSGAGRGCPXAARAEDGVLETGELRRCVEIATSEAVTSRAASWKEEARVAVADGGGSDRSLMEFVRRIARGST

SEQ ID NO: 136796 - protein, 68 aa, Triticum aestivum
  Clone ID: PAT_TA_31214.pep
MLKAYKNLSSKTRLGVGVAVIAWGAAGLMLTDPLEKSLGLTPTEEDKAELDKYTPKIVTVVKDEKDGK

SEQ ID NO: 136797 - protein, 116 aa, Triticum aestivum
  unsure (1)..(116): unsure at all Xaa locations
  Clone ID: PAT_TA_31215.pep
AQLNEEWCSLALKRLKEASPLALKVSLRSIREGRYQTLDECLVREYRMSINGISKPFYHXFCEGVRARLVDKDLAPKWDPPALEFVSEDMVDSYFAPLGEFEPELKLPTEQREAFI

SEQ ID NO: 136798 - protein, 244 aa, Triticum aestivum
  Clone ID: PAT_TA_31216.pep
LDVFAVGPVVGSSAEARIHLFNHAGADKTRYMEWLGAQPERSVVYVSFGSIWTYSKQQMEEIADGLRRCGRPYLLVVRKDGRQEDVSRCLEDVVQERKGMVVEWCDQPEVLSHPSVGCFVTHCGWNSTLEAMALGVAVVAAPSMFDQPTNAMLIEEEWAAGVRGERNGEGIFSGPELARCVELVMGDGARAVEVRKKVESRKGMARDAMAPGGPAERNLRSFVMEVQSSDEARRKDTNTISPPP

SEQ ID NO: 136799 - protein, 128 aa, Triticum aestivum
  Clone ID: PAT_TA_31217.pep
MQSCEQQGVNGNARSSAPNPLPNDRSTEPAEENPVTQSHTTEDSSNHVDNTGADTSEDQRTDTPEVNALFEDDHYGVDDLERLMSEIGNMRSNLRLVPDFQRREMAAKIAMKMATMFGDSDDEGFHAV

SEQ ID NO: 136800 - protein, 109 aa, Triticum aestivum
  unsure (1)..(109): unsure at all Xaa locations
  Clone ID: PAT_TA_31218.pep
XFXCXNIWQNYAHCIDFRTXQHCCYYVGIIVXCGSMXILLXLLGMXTIXIFAXRKLHARXRRANASVRGLGVMEPGVGQRPARANGRRNHVSPVEKEIMHLGKAFGTKC

SEQ ID NO: 136801 - protein, 306 aa, Triticum aestivum
  Clone ID: PAT_TA_31219.pep
HPPRFDGIKFLELMRGKTLAFVGDSVARNHMESLLCILWQVETPVDRGGRRMNRWIFRSTKTTIVRIWSAWLVHNSIEAVGFAPKGLDKVFLDVADEKFMQFIASFDVLVLSSGHWFAKRSAYIQNGNVVGGQLWWPQQAGKMQINNVDAFGVSVETCLTAVATHPNFTGIAVLRTYSPDHYEGGAWNTGGSCTGKVKPLDVVVRNGYTDAMYEKQVAGFRKAVQNSGKHGSKLKLMDITEPFALRADGHPGPYRSPDPNKKTQRGPDGKPPPQDCLHWCMPGPIDTWNEMLFETIRSELEGDSSS

SEQ ID NO: 136802 - protein, 181 aa, Triticum aestivum
  unsure (1)..(181): unsure at all Xaa locations
  Clone ID: PAT_TA_31220.pep
MEATLSPKPHFVVIPWPTTSHIIPIVDIGCLLALHGAAVTILTTPASAQLVQSRVDRVGAQGDSAGIEVAVIPYPSVEAGLPXXCERLDHVPSPDLVPSFFDATTRFGDAVARHCRLMASPRRPSCVIAGMCNTWASGIARELGVPCYIFQGFSAFALLCCEYLHTHKPHXXGRVASTSAS

SEQ ID NO: 136803 - protein, 309 aa, Triticum aestivum
  Clone ID: PAT_TA_31221.pep
RTRGRTRGRAPPLPLLSSLPLPRRSGALAVRMASSDAQLGATVEVPGAAGPVRVVAAAGLPEVDFRKALDSALFRRWLENLQAERGLLAHGKLSLRQILIQGVDMFGQRVGFLKFKADIVDEETQSKIPGIVFARGPAVAVLVLLESKGQIYAVLTEQARVPIGKFILELPAGMLDDENGDFVGTAVREVEEETGIKLNLGDMVDLTALLDPATTGCRMLPSPGGCDEEIGLFLYRGHVDEETIRALQGKETGLRDHGELIKLRVVPYDQLWRSTSDAKALSAIALYEMAKKEGVLPPSPPSSGSSLNL

SEQ ID NO: 136804 - protein, 304 aa, Triticum aestivum
  unsure (1)..(304): unsure at all Xaa locations
  Clone ID: PAT_TA_31222.pep
AVGSSLAGARCLAAFQPGGDKGFNPVHWWSNDTIGVESTRLQAPTTSFRSTDLAWPASVTATYPGHQEVMEYIRSYVCEFDLLKCIKFSSQVLGVEYLGATEEEIMEWEHWSGNGTAFGAGKDGRWSITVKDLKIGDVEVFQVDFLILCIGRHSGTPNIPEFPPNKGPELFKGKILHSIDYSYMDNVADFVIGKSVTIIGSGNPAFDTAAVLAGGSGAHHPCSIIXDRGSRWWVNPASRALPVVTSRXYPFSQLLVHKPGEGFLHYLLACALSPLRWAITKVIETYFKQRIPLEKHGMVPRPPR

SEQ ID NO: 136805 - protein, 213 aa, Triticum aestivum
  Clone ID: PAT_TA_31223.pep
LLGKLRHESVVDVVACYHSKEEKLAVYEHVPGRSLFELLHENRGEGRMPLPWPARLSIAKGMARGLAYLHQSMPFFHRPPHGNLKSSNVIILATPSGKHQHPHVVPKLTDYGFHPLLPHHAHRLAAAKCPEYARGKRPSSRADVFCFGLVLLEVVTGKLPVDEADGDMAEWARLALSHEWATGILDVEIDGKLERSGDMLRLTEDALMSTGGE

SEQ ID NO: 136806 - protein, 100 aa, Triticum aestivum
  Clone ID: PAT_TA_31224.pep
MAGVRRAAALLLLLALACTPALAARDVASSAAQAKTKHPSGPAAGKKPAKPYMPPATKLAGSGGAGGGGGMPAIPGIGTIPGFNVPGMGGGWGGGYGGPD

SEQ ID NO: 136807 - protein, 203 aa, Triticum aestivum
  Clone ID: PAT_TA_31225.pep
VWGVELAPSCPRTALGLLCRRLPPAAANLSEAIDGADGFQNTHQSQHCESAKFSIEQVVFILEKIHIMWESVLPRSIYRRSMSHVLGPVFSRITKDMLLIDDMAAELNFRRFTSSKGVLRLDRREPSLGCRVLLLITRCPHYGPLSPSDSVDTFTDCISAAIGSGELANCGFTSSEMRNFIKAIFADSPLRKECLGWIVATPA

SEQ ID NO: 136808 - protein, 89 aa, Triticum aestivum
  Clone ID: PAT_TA_31226.pep
MTMTPRGGRGASSSSSSSRRRRRRSAGSCRSRALTAGGTSSSPSRPAAPWTATTGSPRRPAPPPRRRGPRSTNWPKTARASWPPPLRVR

SEQ ID NO: 136809 - protein, 291 aa, Triticum aestivum
  unsure (1)..(291): unsure at all Xaa locations
  Clone ID: PAT_TA_31227.pep
MPPPSMVLQLPRLGRFAGVTAAPAFQDGARNLNSHGCHSSRRSSSSSSRSSSWFSSNAENPGPDTRDDNRTSSRRWWSDDQFDVEEEEEEEFGSEGSFGSAREMFDEPWFTKVFRVYGYVLPVLLASMLVTTRPQAFLMAMAIPLAQSVLSFAISKIGSFGRRRRDEEEYDDDGTXQQQEESADSDPTVESGDINGTTGTAARSESGSIGFGGWDELEEGDDRRSSSRSRARASPADTATAGGAVGTSRPPATRRRRSRGAAAARYRQAPLPMRLLIALFPFLGSWFRILL

SEQ ID NO: 136810 - protein, 150 aa, Triticum aestivum
  unsure (1)..(150): unsure at all Xaa locations
  Clone ID: PAT_TA_31228.pep
MAAATAPATATKLTEDVXTAELAGVPLGAAAGAPSGVPETADGGIAEGASVGASVGGAGGEASGDGDAAVGGVATGAGAVAGDLAGGAGRGAILGAAPGACAAAVTARRATMAATTAKRAMRLAQAVIGGRPWLRSAEQEGVASRSSDAW

SEQ ID NO: 136811 - protein, 217 aa, Triticum aestivum
  Clone ID: PAT_TA_31229.pep
SVVAAEVPDYSYSFAMSSCLIALLPEGFYDRVDEGSIILKKSKKFSFCGNGIIMEDGNECIKSDIVILATGFRGDQKLRDIFTANWCRNIVVGSSDTSVPLYRECIHPRIPQLAIVGYSESLTNIYASERMANWVIHFLAGGFQLPSVRCMEENVTEWAKYKDLYNGKYFRRSCISTVNIWFNDLLCQDIGCNPRRKKGFLAEWFQPYGPADYAGIC

SEQ ID NO: 136812 - protein, 165 aa, Triticum aestivum
  Clone ID: PAT_TA_31230.pep
LGKKGKASWVAYLDVYCLNADGSLFDAALISVVAAFTHLEIPLVSVGDDGRVFTVGGNEGKSKYELVNREKRKLTLGDIPFPLTCALHKDSILADPTAEEESIIETSVTVVLDSSGRLVSIQKPGGGVTSMATIKACIGLAKERGQKLKEILTDSVEAMEVDQAE

SEQ ID NO: 136813 - protein, 190 aa, Triticum aestivum
  Clone ID: PAT_TA_31231.pep
MATPDLLFNLRNLFYLGAYQSAINNSDVPGLDADAAAERDVIVFRSYIALGSYQLVISEIDSSAATSLQAVKLLALYLTGDKEGAISSLKEWLSDSAIGSNPVLRLIAGIIFMHEQDYNEALKHTHTGGTLDLHALNVQIFLKMHRSDYADKQLKIMQQTDEDHTLTQLANAWLDIAVGGSKIREAYLIF

SEQ ID NO: 136814 - protein, 70 aa, Triticum aestivum
  Clone ID: PAT_TA_31232.pep
LILSKEGAISSLKEWLIDLAIGSNPVLRLIAGIIFIQEQDYTRCCQAHTHNGGTLDISSSSDIGRGCTKL

SEQ ID NO: 136815 - protein, 342 aa, Triticum aestivum
  unsure (1)..(342): unsure at all Xaa locations
  Clone ID: PAT_TA_31233.pep
LILSKEGARTRGPSNSFFFLEISHSPPRVAVEPTPPPRRRQRPPPPKSAAPSPGNLRNLFYLAPYHSAINKSDVPCVATGPAAASATTRSWTSMALXARRLVIXEIDSSGGDVAAWPTTLLALXLTGDKAKGVISKPEXMVEVIQISSGKQNRVAAIMIAXGIHIFMHEQESTMRLLXHTHTGGTLDLHALNVQIFLKMHRSDYADKQLKIMQQTDEDHTLTQLANAWLDIAVGGSKIREAYLIFQDFAEKYPMTGMVLNGKAVCCMHMGSFEEAETLLLEALNKDAKDPETLANLIVCNLHLGKPSSRYFSQLKLSHPDHVLVKTTTSAEGNFERALQAVA

SEQ ID NO: 136816 - protein, 169 aa, Triticum aestivum
  Clone ID: PAT_TA_31234.pep
GTRKRSARLLVQKADRLALPVECRDNGYRLSYAWADDAEVRATLGIREGSVGAWSRCVTLTHFRHDVASTVPYHANLTRRGYRALVYNGDHDLDMTFVGTQAWIRTLGYPAVAPWRPWYANRQVAGFTTEYAHNLTFATVKGGGHTAPEYRPKECLAMLDRWTSADGRL

SEQ ID NO: 136817 - protein, 91 aa, Triticum aestivum
  Clone ID: PAT_TA_31235.pep
MGASPSTLERPTPVRHRAEAHLPRRWPPVPSAPVRPPPRSGAACPPLPCDLPAGAAPPAPGRPPPARSPQAPSPRPPPSPTPVPKLCLQEK

SEQ ID NO: 136818 - protein, 67 aa, Triticum aestivum
  Clone ID: PAT_TA_31236.pep
GIIKVRKLDKYLSQVRIFFFQKEDKNKRLTTVVPATRSARAIDGGCRGFVTADVLEKGLSRGAIATG

SEQ ID NO: 136819 - protein, 72 aa, Triticum aestivum
  Clone ID: PAT_TA_31237.pep
IGQSATEPATVNVPRAAHWIVPHRSSSCMCCRCCHHHEQADLRHEKNNDHLEDAIFRHCLRTQNNREYVIMQ

SEQ ID NO: 136820 - protein, 119 aa, Triticum aestivum
  Clone ID: PAT_TA_31238.pep
QFDHLNMKLSQFLSVAAVCGFAAASPIPDNAIAERENLYPRPYTLKMGGDAFKKRENLYGRPYTLKMKDDALEKRENLYTRPYTLRMEGDAFKKRDPQNTYGKAYTLKMKDDGFEKRDE

SEQ ID NO: 136821 - protein, 193 aa, Triticum aestivum
  Clone ID: PAT_TA_31239.pep
MATIRSSKPRHRSEASAPATSVAVAAARAQDAPKPPLRRSAAFQPRRSHSHPQPHAHGHQRCDSEHVSRSGRQPRCGEVAGGTAAGCAAVCCCFPCVMVEVVVLATVRAPAALCRRAVRARRRRRSASAGQPVDMYELLVDDGTVAGPGDAAVVWPAGQPPEEEAGETEKEVWSRFYGAGFWRSPSSLGDENR

SEQ ID NO: 136822 - protein, 165 aa, Triticum aestivum
  Clone ID: PAT_TA_31240.pep
LNRRDRRASRPCRPRRPPAPRTGRASGAAVASGLRSLVSAGSSGLDRWSVVELGATRPPKVSTTSFPEGEPYFGLENFGSTCYCNSVLQALYYCIPFREQLLEYYTNYRNPGDAEENLLTCLADLFAQISLSKKKTGVISPKRFVHRVRKQNESFCSSMHQVTCR

SEQ ID NO: 136823 - protein, 215 aa, Triticum aestivum
  Clone ID: PAT_TA_31241.pep
LCRLITIERERKIIHSSTTMAISLLPYTASALLAIVIAVAITVAPAVVRSDQEPGPSIEAINATCATATYKFECTQPLLSSRRGRPHSPRPSRNPPSASPTASTTSPYYPSTSRRSRRRSKPPTTRASLSNLTKRENVTEMVARTTSTGFFEQFDTKKKCHGDCCSDNFSGEECNAKSQIGGVFDALRVTDDLLMRRAYFRKQQLDNKTTSPNSN

SEQ ID NO: 136824 - protein, 95 aa, Triticum aestivum
  Clone ID: PAT_TA_31242.pep
NRSNANRVGLRASGGGPMTRGERGRRGADILGFDVRRATRPIPAPPFSTSPPSPPDLAPTCAIRRRWRIELRCSGTDGVNVKYGSECRIDYSDGT

SEQ ID NO: 136825 - protein, 289 aa, Triticum aestivum
  Clone ID: PAT_TA_31243.pep
MAAAPDSLASSMAGLGVSKQFTLSSSDSSSSVGDDAPLPFPEALARADFLAEDFQPAAYLSALPHRHQTLEDLRSDLRDRSAAISSELLELVNSNYTAFLSLGSELRGGDDKVENAKVSLLGFRRAVEEVKTKVTERREETNTLNGELRGVRSAIEKGRKMIELSERLASLEERLSLDSLPADEDWDEDSEDEGEDDNYGSSTAKLLTSAQECSRITKLLESMDPDTPYVIKMEERLTRCRNTLLLDLGNALKEAKKAGVKGQDRVLKCLAIYRVLDAQSEAVKALRGG

SEQ ID NO: 136826 - protein, 179 aa, Triticum aestivum
  Clone ID: PAT_TA_31244.pep
TNAWADAWEFILESTTVAGVEPVIDRPLLYIQGTRLKCGGFIFGQRFCHCVVDAPAGMQFEKAVCELACGAAAPSITPSWGREMFMARQPPQPSYPHLEYSEPAGGAVDRMLTTPPGDVARVPFFFGPREIAGLRQRAPPHMSRSSRFELVAACIWLGRTAALGYGADEEVRLSFIVNA

SEQ ID NO: 136827 - protein, 105 aa, Triticum aestivum
  Clone ID: PAT_TA_31245.pep
GPLWFQWRMAFLVLMESTSSANGTSRSSLTVHLVTLKTHLCSSETSGVVSGAPTCGRVGDDKDASKEGKPGLFLLFVSVSLATYAWCLDGQNSPNKSAHASADAW

SEQ ID NO: 136828 - protein, 207 aa, Triticum aestivum
  unsure (1)..(207): unsure at all Xaa locations
  Clone ID: PAT_TA_31246.pep
SAAPSAATARRGLRRFPPPLLLLLRALFLVAAAAAGKGKKRGGGGLRFRREGGTFKVLQVADMHYADGRSTACEDMLPEQVAGCSDLNTTAFLYRVIRAEDPDLVVFTGDNIYGADATDAGKAMDAAIATDLAMDALWAAGNDNHDLEGTLSRXGLMRHLVGMKTSLSRFNPAGVAVDGTRILVGAQVGCRPTYLMTVNKLQYTVSN

SEQ ID NO: 136829 - protein, 193 aa, Triticum aestivum
  Clone ID: PAT_TA_31247.pep
MKTKASTFFKQMLSTIVAVVKAKSTAVRAKTSTLKTRLLVLGVLRNRKLLVSAINHKIHAIMGQDDHARKEEAAQEDDGGKKAIVLYTSPSYVTERDVEAAAEEEEEESDDEYLTHSLFREEDDDDDELVNAPGSVIDVVRDAKEKEAEGAEFRLEDEIDHVADVFIRRIHKQLKLQKLESFKRFCEMMERSA

SEQ ID NO: 136830 - protein, 207 aa, Triticum aestivum
  unsure (1)..(207): unsure at all Xaa locations
  Clone ID: PAT_TA_31248.pep
SLRVRPRVRHPISNHGARVRHDGPPAPRPPPGHGAHLAVSPSPSAPACSVRFAARTRGPRARRLPPSAPAAAPAATATPGEHGISLTEKALKHLEASGXKKNEDLCLRIGVKQGXCSGMSYTMEFESRGSANPDESVIEYEAFTMVCDPKRLLFMFGMELDYSDALIXGVGFNFQNPNATXTCGCGQVVSGPSKEMQEQSNCLQQMN

SEQ ID NO: 136831 - protein, 216 aa, Triticum aestivum
  Clone ID: PAT_TA_31249.pep
PPLTWIWQEREKWLDHRPGPAATPPRCQPRRASKPTSSIAPSREGGRHPTPSRRAGLPGQSPSNPLQPQHRREGSRRAARSRSPHPRPPDPRARSRRSAATRHAVPARSRRGAPRPHPKSPERGRPTPRPAHPGRAPRALAAQPRARPHTPVRAPARVPRRAESPHERTARAAPARAGGGKGPAAAEPRGLRPATSAGGGKGRRGRRGLCRRRLGF

SEQ ID NO: 136832 - protein, 533 aa, Triticum aestivum
  Clone ID: PAT_TA_31250.pep
MGRVKRFYQDFIHIKLHSFCRISGYVVDSIAFVYRFVALHVHPFWIQLSYFLAIAILGSVLLMSLKPSNPDFSPPYIDMLFLSTSALTVSGLSTITMEDLSSSQIVVLTLLMLIGGEIFVSLLGLMLRVNHQDMQDLPSVKISSVPVELEELDLPNSMALCDESQLEEAAHAIPPKKCTELKRSRSVKCLGYVVFGYFAMIHVLGFLLVFLYITHVPTASAPLNKKGINIVLFSLSVTVASCANAGLVPTNENMVIFSKNSGLLLLLSGQMLAGNTLFPLFLRLLVWFLGRLTKVKELRLMINNPEEVHFANLLPRLPTVFLSSTVVGLVAAGVTMFCAVDWNSSVFDGLSSYQKTVNAFFMVVNARHSGENSIDCSLMSPAIIVLFIVMMYLPSSATFAPPSGDTKTTNENTKGKVKRGSLVQNLAFSPLGCNIIFVMVACITERRRLRNDPLNFSTLNMIFEVISAYGNAGLSTGYSCSRLHQLHPEIICQDKPYSFSGWWSDGGKFVLILVMLYGRLKAFTLATGKSWKV

SEQ ID NO: 136833 - protein, 482 aa, Triticum aestivum
  Clone ID: PAT_TA_31251.pep
MADEEHAQTSRKRVADKQINKDNPELDDDSPEQEGGTFKKASEEVMATRKIVKVRRQQPSSAPSSNPFSAIKFTTSDSSVQASIPVSKPPPSDVTTSNVRSSTEKADEVSNGSGKDDVKTADSNEVAEIQKDESGLNESNAENKSNAPMEAHSSLTETDKKAGSTEGGTGEDKVLVGEPKVDSSKTSGIEGKTEDEAAKVNEGGDEDKSSMDGAEKKDESESGTKDEVNEGGDEDKSSKDGAEKKDESESGTKDVSPTPLFSFMNVSSGHNAFTGLAGTGFSASSFSFGSASKESTNAPLFGLKNDSASFPSFNIGGTNNNGSSVPSLVAAAEAPKKFIMPEGPVETGEENEMAVFTADSAMYEYLDGGWKERGKGELKLNIPVSGGERSRLVMRAKGNYRLVLNASLYDDMSLKDMEKKGVTFACINSTGDSPGRLTTFALKFKDTGVRDDFKAAVEAHKAKKASDAMPKTPESSPKVSDD

SEQ ID NO: 136834 - protein, 91 aa, Triticum aestivum
  Clone ID: PAT_TA_31252.pep
MELEMVSQHGALLKVGLFVLVQALVYLILAQSSSVFSTTKTLCLPPARSLSARRMVALLSDLPLPLGGEPSPRAAFVEPPSPVPLAHQKKD

SEQ ID NO: 136835 - protein, 256 aa, Triticum aestivum
  Clone ID: PAT_TA_31253.pep
MSQFKMVQEALELSKSQVDDLEQKLASQDADISKLTEELSLHCSSEESLKEKSLKLETELATVNEELQAKLLSLQEMEIKLEEHVKEKETSEATLEKQQSQILNLQSGLDELKDEHETLKGTLVDAESKLSERDSMLRQAEEEHAKAQLLLSEALSHKEELEVNLKSINEQHGESKAVAEDANGKILELEAQIQALHAAEEALKSHLEEASMNVKVAEKKCSDLEQRLSESESKLATSSEQVKLLEEQVQQEASSA

SEQ ID NO: 136836 - protein, 207 aa, Triticum aestivum
  Clone ID: PAT_TA_31254.pep
MAPRLRTPRQQNYSFNGRVLLMAAFLLFGLTIFFTLIRFLLYVLVARSGGRRRRGSFTAGILRSINSFGGTSGRRGLDASALSALPVTTYRKEGAATAGADCAVCLSELADGEKVRELPNCGHSFHVECVDAWLRSRTTCPLCRAEAELPKGNDKAEVAAQSSSSSSSSSAREPPQQALFGAGGTLIVTVQGGFPDTQRGVRGSTSG

SEQ ID NO: 136837 - protein, 298 aa, Triticum aestivum
  Clone ID: PAT_TA_31255.pep
KAETRDWLNSVVSDLENQIDNFEAELEGLSFKKGKQRPPRLVHLEKSITRHKAHIKKLESILRLLDNDELSPEQVNDVKDFLEDYVERNQEDFDEFSDVEDLYSTLPMEKVEALEDMVSLAPSILIKGVAAVSTTAVLSTKSPTATSPTQATVSTISQGTSQDQAEETTTLESNPESVPQTPPPKGGNLGPSVPVVPTAISTSAAAVSVSADTITSPGPVRPVIPATAPTIFAPSAAVRNAPESMPAVASTSCKLIYAVRMMKGRLRHCKRPPITELGRGYRLLLLPQAIQKVIRNPQ

SEQ ID NO: 136838 - protein, 236 aa, Triticum aestivum
  Clone ID: PAT_TA_31256.pep
MVTVSIATKPDPGPKVRLHVTSEVRGGDLARAVSQAGGRGLDLPAAHHIGMMATVMNAIFLQATMESIGIPTRVQTAFRISEVAEPYIRRRAIRHLEKGRVVIFAAGTGNPFFTTDTAAALRCAEINAEVVLKATNVDGVYNANPKHNPNARILETVSYNQVISRDLSVMDMTAVTLCQENNIPVVVFNLQNTGNIAKAIVGEKVGTFIGSTRNLEYRESTEGSLDQEDKILVSEW

SEQ ID NO: 136839 - protein, 159 aa, Triticum aestivum
  Clone ID: PAT_TA_31257.pep
TDAGAQREQQSAQRKARRCWSPELHRRFVAALQRLGGPQVATPKQIREMMKVDGLTNDEVKSHLQKYRLHTRRASDGDQQQSASAGQWPRPEQYTTSQHSSSQSGSPQGPLQLTVSSRGMSVTVGDSCDGGEENEEEDGKSASYSWGMQQKGTKASSSS

SEQ ID NO: 136840 - protein, 350 aa, Triticum aestivum
  Clone ID: PAT_TA_31258.pep
VRIADYFDVIAGTSTGGLVTAMLTAPDAKGRPLFAAKDINNFYLEHCPKIFPAGYGGPLGLLRSMRGPKYDGQYLHSVVKELLGETRVGEALQNIVIPTFDIKLLQPTIFSRYDARNDVSKNALLSDVCISTSAAPTYLPGHHFETKDKDGRPRAFNLIDGGVAANNPTMLAMTDVSKQILLGNQDFFPIKPADYGKFMVLSLGTGSAKVEEKFDAAACSKWGILGWLYNKGATPLIDSFSQASADLVDIQASVLFQALRCEKRYLRIQDDELKRDTSFVDVSAPEILNRLVEVGKALLKRSVCRVNVETGKTVPDHNRGTNEEELISFARMLSQERKARLQKKGVTVPQ

SEQ ID NO: 136841 - protein, 63 aa, Triticum aestivum
  Clone ID: PAT_TA_31259.pep
FSFLFAGVNILVVFFRKKEKTAWVVMNCIGASQCMSVWSSEIRNKFLLIKFLRSKCASSWEHF

SEQ ID NO: 136842 - protein, 190 aa, Triticum aestivum
  unsure (1)..(190): unsure at all Xaa locations
  Clone ID: PAT_TA_31260.pep
EVGGVEGTLLAXKSVLNMYFLDSGDYSTVPSIPGYGWITASQEAWFRKTSSSLQKNYTKEEPRQKEPAPALAYFHIPLPEFTRVTASNFTGVKQEEGISSPSINSGLLITMVQAGSGKAAFLGHDHLSXNDFCGKVFRMCYARSVRLPCHMGRPGWSTRSKGWCLCNLRKTENREWWRRNASLSRHGHEA

SEQ ID NO: 136843 - protein, 134 aa, Triticum aestivum
  unsure (1)..(134): unsure at all Xaa locations
  Clone ID: PAT_TA_31261.pep
GLPKVLWGLRTTPNRSTERTPFFLVYGAEXALPSDLLHNAPRVELYSEDESEQARQDAIDLLXEEREMAMVRSTIYQQALHRFHARNVKSRAFQEGDLVLRVDXQKPHKLSPTWEGPFIVTRVLLHLYNVDRQD

SEQ ID NO: 136844 - protein, 358 aa, Triticum aestivum
  unsure (1)..(358): unsure at all Xaa locations
  Clone ID: PAT_TA_31262.pep
VRKLLDEDGTLVSARDYDSRTPLHVAALHGWQDVAECLLAKGADVNALDRWQNTPLADAEGAKRHAMIELLKKHGGLTFGKTGSHFEAKSIPPPLTNKADWEINPLELDFTKAVMIGKGSFGEILKANWRGTPIAVKRILPSLSDDRLVIQDFKHEVNLLIKLRHPNIVQFLGAVTETKPLMLVTEFLRGGDLHQYLKEKGSLSPLTAVNFALDIARGMAYLHNEPNVIIHRDLKPRNILLVNTAANHLKVGDFGLSKIIKXKHANDVXYKMTGETGSYRYMAPEVFKHRKYDKKVDILPFAMLLXRDLEWDHFSKLVTECGSLXTADGQRPTFRSKGHTAXLKELTEVCWAADINLR

SEQ ID NO: 136845 - protein, 165 aa, Triticum aestivum
  Clone ID: PAT_TA_31263.pep
STLSTTTPSRRDKCPRKKHPLERRRAFPPFSSRRCRRPSAGEARAGSSEGGGGASPWVPSVLLLPSSLGVAAAWRRAPDLRGLAAGSSRGPWRAAGCGQCRHGGPNTWWGGRGWPGLAARSKRHARQRGWLVVPRWLRSAGALCCFGGGAGGRRCGRWLLALSDL

SEQ ID NO: 136846 - protein, 118 aa, Triticum aestivum
  Clone ID: PAT_TA_31264.pep
MEPTKNGKGRENTEEHKNETEEKLVVDIVDNDYIDAVEETNSISTDTLVSESDSESDDSESDAPQRAPSNRTRGGGRGGNRTRGGGGGRGGNRTRGGGGRGANRIRGGRRGGTGRTSG

SEQ ID NO: 136847 - protein, 97 aa, Triticum aestivum
  Clone ID: PAT_TA_31265.pep
ACTTSLLHLSSSIQRNIDQSLAHASAEKIVRCPYQFGRLLSPLRKNRALALHDSNLSTVLRVESDIMSVMIHGVINLPSFCVDVQSSVICLAFFSRL

SEQ ID NO: 136848 - protein, 60 aa, Triticum aestivum
  Clone ID: PAT_TA_31266.pep
DNSIHYIILAQCTYIGETNLQGHGSFHTQKNLQGHVPTQPYPTRHQYNNYKHAKLSISDH

SEQ ID NO: 136849 - protein, 186 aa, Triticum aestivum
  Clone ID: PAT_TA_31267.pep
VEYGQPQPLQYVVNAAFLASLFSDYLEAADTPGWYCGPHFYSIEVLRSFARTQMEYILGKNPLKMSYVVGYGKHYPKRVHHRGASIPKKKGVHPGCKGGWTWRDTKKPNPHIIVGAMVAGPDRHDGFKDIRKNRNYTEPTLAGNAGLVAALVALSGEGHGVDKNTMFSAVPPMFPSPPPPPAPWKP

SEQ ID NO: 136850 - protein, 256 aa, Triticum aestivum
  Clone ID: PAT_TA_31268.pep
EANTSPDSSKRQRTVSQVNGLTTDQDNQESVDPAPRVRPRVRGRVGEEMKLDASVQMDASFSGHSGFLEPDDVSTECIKIFTTPSYQFNRRTLIKHKDSPLHLCCAGLKVQFGVGTKFLDTAGRPKLNMVVHIPENLSKVLEFCDNQAQRFFQESGTTSEWRTLIKKYGYVNRPTVRLNIPTTPSSGASPYSTDIYQKEPSGNIQKLAFSKVDAAELDSLFVRGNRLDAFFSLEIYDYQQNAGIRLVAKRLVVHSK

SEQ ID NO: 136851 - protein, 149 aa, Triticum aestivum
  Clone ID: PAT_TA_31269.pep
KKELPFSSNGSKKWLLHYISRPFCWFRLHLASLANIFCIYLWMASILCSMDHDLERLAVETVGRCTSHCRPHRRHKETPASLPATRTSLAQPVSKVVAASTRPTPTAWLMLQCKTVEPAGGVTRSRTSCSTVQLLVLWPVAQGAECRPQ

SEQ ID NO: 136852 - protein, 181 aa, Triticum aestivum
  Clone ID: PAT_TA_31270.pep
MADKGLEDVPETQIETNYDETVDSFDDMNLKSELLRGIYAYGFERPSAIQQRAIMPVIKGHDVIAQAQSGTGKTATFSISVLQKIDTNVKACQALILAPTRELAQQIQKVVVAIGDFMNIECHACIGGTRVRDDMKALADGPQVDVGDPRSWPGTESSRRVLQNAPPRKTAPGGGAGAGEE

SEQ ID NO: 136853 - protein, 316 aa, Triticum aestivum
  unsure (1)..(316): unsure at all Xaa locations
  Clone ID: PAT_TA_31271.pep
HASAHASAHASAHASAYPVACFNFTCDTVTGENRAPMVAGFSSRGPNPIVPEILKPDVIAPGVNILAAWSGAAPPSDSDMDPRRVEYNIISGTSMACPHVGGVAALIKKRQGDWTPAMIRSALMTTAGPLDKNGRDIVDGGSAVGAAATPMEAGAGLVLPRLTMDPGLVYDSGTHDXRLPSATLNYTGEQMRRFVPGLSKCARTIPGGVANLNYPSFVVVFEGRTRARTLTRTVTKVSAQPKRYNVTVPAPDGVKVTVTPASLEFKRVNEKRSYPVRFTSKAGAKASPPGTWEFGPIAWENRKPRVRSPVPFNWDD

SEQ ID NO: 136854 - protein, 387 aa, Triticum aestivum
  Clone ID: PAT_TA_31272.pep
NTATSCGEYDLTPDKVMGKVVVCSREAGASAGLEVERAGGAGIVSVQSTERFWDTVMAEPFPLPGLLLSSAGGKKLADYMSSVAYPVASFNFTCDTVTGENRAPMVAGFSSRGPNPIVPEILKPDVIAPGVNILAAWSGAASPSDTEMDPRRVGYNILSGTSMACPHVAGVAALIKKRHGDWTPAMIRSALMTTAGPLDKDGRDIVDSGSAIGAAVMGATPLAAGAGFVLPRLAMDPGLVYDAGTQDYVDFLCTLNYTVEQMQQFVPELSKCERTIPGGVANLNHPSFVVVFDGRTRVRTLTRTVTLVSARPERYNVTVAAPDGVKVTVTPATLEFRWPKEKRSYSVQFSSEAGAKARPAGTWEFGHIAWENRKHRVRSPVAFKWDN

SEQ ID NO: 136855 - protein, 143 aa, Triticum aestivum
  Clone ID: PAT_TA_31273.pep
RPIHYSGRAIESKHGSDHGANAHTDYGMLTLLSTDGTPGLQICRDKDGRPQLWEDVHHIDGALVVNIGDLLERWTNNVYRSTLHRVLMVGKERYSVAFFVWPSPDMVVTCIESCCSEANPPRYPPIRSDEYLEQRLTSTYKYK

SEQ ID NO: 136856 - protein, 310 aa, Triticum aestivum
  Clone ID: PAT_TA_31274.pep
MGHASAALPVIDLASPDIGAATKSIRQALVDYGFFYVINHGIDDALMKSVYAESASFFQQPMEEKMALHKNSSHRGYIPPDFEGFEADAGGKGDLLECFHIGSGVDGDSKNPVNQWPPAERFPYWKETMKSYYQCAMGTSKRILSLIALSLDLDAEFFKPDGSETILRPIHYSGRAIESKHGSDHGANAHTDYGMLTLLSTDGTPGLQICRDKDGRPQLWEDVHHIDGALVVNIGDLLERWTNNVYRSTLHRVLMVGKERYSVAFFVWPSPDMMVTCIECCCSEANPPRYPPIRSDEYLEQRLTSTYKYK

SEQ ID NO: 136857 - protein, 133 aa, Triticum aestivum
  unsure (1)..(133): unsure at all Xaa locations
  Clone ID: PAT_TA_31275.pep
ALAENGSEVNKNDGYQDQQIERVRMCRAVFERAFDYFRTNAAELKEERAMLLEEWLKXELSFGDLGDVTLVQKKAPRKVKRKRPLPTDDGSNIAYEEYIDYIFPDEVTLAPNLKILEAAYKWKKQKANDTEDD

SEQ ID NO: 136858 - protein, 334 aa, Triticum aestivum
  Clone ID: PAT_TA_31276.pep
MYVCLMQTLIFSSIRTTLFASFFEREMMKKVNLKVWGWISINALFGIVLAMGLHYYGLRATNAAYTVNFLNVIPVVTFIIAIILRVERLKIGTCPGKMKVIGAAICVGGTMVISMYKGKLLHLWPTHLLKPQLQSVGAASSVPDHHNMLIGTLFLAGSCLSYAFWFIIQVRVSKEFPSKYFSTMLACVSGTVQAVVIGVMLDRRPMAWALNWNLQLLTVVYSGVFNTGITFCLISWAVSRRGPIYPSMFNSLSLIITTVLDSVLLGTDVSVGSLLGALLIIIGLYAFLWGKGKETQEQRKQSREAANGNGSAAGNGLDSVQVGKHEVRIRVEVS

SEQ ID NO: 136859 - protein, 181 aa, Triticum aestivum
  Clone ID: PAT_TA_31277.pep
FQGITVSKDDGVREGITVESLGKIRPAFAKDGSIHAGNASQISDGAAAVLLMKRSTAEKLGQKIIGKYVCASIVGVKPLLMGQGPWKAIPKALDLAGISKDDVDIWEINEAFASQCLWCANELGIPQEKINPKGGAIAFGHPLGCTGARQVSTLLYELKRTGQKVGATSMCVGTGMGMAAI

SEQ ID NO: 136860 - protein, 139 aa, Triticum aestivum
  Clone ID: PAT_TA_31278.pep
MAPKAEKKPVAEKAEKTTAAKKTKAEKRPPASKEGGADKKGKKKSKKSVETYKIYIFKVLKQVHPDIGISSKAMSIMNSFINDIFEKLAGESAKLARYSKKPTITSREVQTSVRLVLPGELAKHAVSEGTKAVTKFTSA

SEQ ID NO: 136861 - protein, 70 aa, Triticum aestivum
  Clone ID: PAT_TA_31279.pep
SLPLLRDYMMVVQASQHLQISPSKKHTKGSSWIGCIIPETCWSLLRSPSQGPIQKQKQQSYAPPCQVFHL

SEQ ID NO: 136862 - protein, 222 aa, Triticum aestivum
  Clone ID: PAT_TA_31280.pep
DEMLSRGCTEQIYDIFQLLPQSTQVVLLSATMPQDVLEVTTKFMRDPVRILVKKDELTLEGIKQFYIAVEKEEWKLDTLSDLYETVTITQAVIFCNTRRKVDWLTDKLTARDFTVSAMHGDMDQAQRDLIMKEFRSGSSRVLIATDLLARGIDVQQVSLVINYDLPANRENYIHRIGRGGRFGRKGVAINFVTADDVRMLREIESFYSTQVDEMPMNVADLI

SEQ ID NO: 136863 - protein, 186 aa, Triticum aestivum
  unsure (1)..(186): unsure at all Xaa locations
  Clone ID: PAT_TA_31281.pep
VSSIWVVVASTTVAVAGSFVFGISVGYSSPSQKGIMRDLHLSLAEYSVFGSILTIGAMLGAIVSGTIADRVGRRCAMAISDVFCILGYLLIAFSKNSVWLDLGRLSIGCGIGLLSYVVPVYISEITPKNLRGRFAAVNQFMICCGASLAYALGTCIXLRTLAIVGVTPCLLQLAGLLVIPESPRGL

SEQ ID NO: 136864 - protein, 511 aa, Triticum aestivum
  unsure (1)..(511): unsure at all Xaa locations
  Clone ID: PAT_TA_31282.pep
MKPEVTAHLPKSESTKPITMTTQACKRRRSVYISSGSEDSGTDSEVEGSKRSQKSGTTSISSSEHRPSSNNKAGSMNASKTRVCRNILGKLMDHPGGWLFHKPVDPDLFGIPDYFDVIRNPMDLGTVKKKLTNKNYSSTDEFAADVRLTFSNAMTYNPPGNQVHTVAEQLNIMFNSEWTSYERKWSDRNLKPVQLPMKVIKARVAVNSKPVVSGGLVACSNSSAKKTLTNAISSKVKIKFCVRGSGQTLSKETPLQAAGSKEGPLHHSIPCTKESANTTKVQSSEHRVHYLQAEPLSPAQALRAXVLKSCRAGTLVRHRPQPAAGDRASISPPYARCHNASVSAGHXVWKERMEGQVQAAEAAAQLQXDEELRKKREREREAGRLALHMMKKTVDIDNSDFLKDLENISKKWELNPPAKLIVDFVDGMELPPGLGSPLERLGLFMKRDIEEEVEDEMEDSVSAPSVDVDSVSPPSVDADSISPPSVDVNSILPPAVDMDIDGEEGEIGCCG

SEQ ID NO: 136865 - protein, 201 aa, Triticum aestivum
  Clone ID: PAT_TA_31283.pep
LYSIDSPLKRRTSEKPAVLFDDNRFRGMLSMEVVRAATKDFGSENVIGIGGSGAIVFQGVLPSGSRVAVKRFQAMWPCSKAFLSELRAMLDCPHHPNLAPLLGWCSSEHDQVLVYEFMPNGNLDSALHTKGGAILPWEARFGAVLGVASALTFLHDECEHRILHRDVKSSNVLLDADFNARLGDFGLARVVSHGGVPLATQ

SEQ ID NO: 136866 - protein, 131 aa, Triticum aestivum
  Clone ID: PAT_TA_31284.pep
RPSVPHASDQNGLPLPRNNGVWEPGADIWVGARPPTDLDAFGRSDSEGTDSKMQIMDAFLWGRCLTEDEIAALYTIMSPAEYGFFDLAAEDAWHGSYSARVDDWESEEANYELLHRAPDVSYHLNTLVLDR

SEQ ID NO: 136867 - protein, 630 aa, Triticum aestivum
  unsure (1)..(630): unsure at all Xaa locations
  Clone ID: PAT_TA_31285.pep
ARRAEQTSIPGAVCVLDDEPRSTGRHCGEIDLCLCQSQRVSFSIAVMVQPVSGPLCLFRTEFEKKVCWEILVAGSQQGMEAGHVGLTLLTNGERMTTVAKEWNIGASSIADGRWHIVTVTIDADLGEATSFIDGVYDGYQNGLPLPRNNGVWEPGADIWVGARPPTDLDAFGRSDSEGTDSKMQIMDAFLWGRCLTEDEIAALYTTMSPAEYGFFDLAAEDAWHGSYSARVDDWESEEANYELYDQEDVEWDGQYSSGRKRPVRDAVAIDIDSFARRPRKPRFETREEVNQRMLSVERAVREALSAKGERAFTDQEFPPDDRSLYVDPGNPPLKLQVVSEWTRPSDIAKEISISSQPCLFSGSVNSSDVCQGRLGDCWFLSAVAVLTEMSRISEVIITPAYNEEGIYTIRFCIQGEWVAVVVDDWIPCESPGKPAFATSRXKQNELWVSILEKAYAKLHGSYEALEGGLVQDALVDLTGGAGEEIDMRSPQAQIDLASGRLWSQLLHFNQEGFLLGAGSPSGSDAHISSSGIVQGHAYSILQIREVDGHKLVQIRNPWANEVEWNGPWSDSSQEWTERIKHKLKHVPQSKNGVFWMSWQDFQIHFRSIYVCRVYPPEMRYSVHGQWRGYS

SEQ ID NO: 136868 - protein, 396 aa, Triticum aestivum
  Clone ID: PAT_TA_31286.pep
MKSALLTAAALLGSAQAGVHKMKLNKVPLADQLAMNSVEDHLQSLGQKYMGAARPKNAADYAFATNVPSVEGGHPVPVSNFMNAQYFSEITIGTPPQSFKVVLDTGSSNLWVPSQECGSIACYLHSKYDSSASSTYKKNGSEFEIHYGSGSLSGFVSNDVVSIGDLKIKDQDFAEATKEPGLAFAFGRFDGILGLGYDRIAVNGMVPPFYQMVNQKLLDEPVFAFYLDGQEGQSEATFGGVDKSKYTGDLEYIPLRRKAYWEVDLDAIAFGDEVAEQENTGAILDTGTSLNVLPSALAELLNKEIGATKGYNGQYTIECDKVSSLPDITFTLAGSNYSLPSTDYILEVQGSCISTFQGMDFPEPVGPLVILGDAFLRRYYSVYDLGKNAVGLARAK

SEQ ID NO: 136869 - protein, 256 aa, Triticum aestivum
  Clone ID: PAT_TA_31287.pep
LPSLTNLSTGGAGDLSRSSNAPVASGSPSNSVSKSTGGSPPASGSAKGGQPVVQLSSPQQHAAKNSPSTSGSKSASTNPYSSMPMPSILGQQPNMAHSGGKQQSHGPSLKQQQPFPQGHGHGHFFISNAFAPQGPPQHVNAGAGAGLYQKRSADKTQQQQQQQQQNAVSGSSAMLSLGSMSMSTSAIPADAGKAHSAAGSNMKANLHPAPGGFMHLATAGQSASGSPHSHLSAAQLTFSMPMPVKPTSDQKPAAGK

SEQ ID NO: 136870 - protein, 72 aa, Triticum aestivum
  Clone ID: PAT_TA_31288.pep
VISFCSLSLQASCSDHFDQSLPVIILTIFFSVVLCRMKMYEMKKSGRYGIGFIEPNTVNEFTWNIQHHVKEV

SEQ ID NO: 136871 - protein, 177 aa, Triticum aestivum
  unsure (1)..(177): unsure at all Xaa locations
  Clone ID: PAT_TA_31289.pep
AAAVRTSFPGPVPGTRRLLHLTPSVASLLRPVPGGAPAAPAPAPFHRFRPPRPNAAGKPAFFLPSRTGMFVLNAFIVVWVFARRIXVGFGLGGWASMVNFIRQINTFGLFAKCYQCPKPGAAMRRSWPLLLAPLAPSPSPGTVTLPCHWPVGSKQGAREASPPAPGGRHGGSITVAC

SEQ ID NO: 136872 - protein, 154 aa, Triticum aestivum
  unsure (1)..(154): unsure at all Xaa locations
  Clone ID: PAT_TA_31290.pep
VPPSSPAHLLGSDALPXHVLAYTRLTEXKDTTSSSRIFINIPFXELSEHLGIRLLNERLNDPNMQGSFESVFPRDHPKNTRFSINFFTSIGLGGITESLREYLKNMPRMIMQQQKPPSPSESESSGESSDSGSSSESESSSDESEKKRRKRRKK

SEQ ID NO: 136873 - protein, 168 aa, Triticum aestivum
  Clone ID: PAT_TA_31291.pep
VPPGVRERTDEECERVAASGGYIEDGYLNGVLSVTRALGDWDMKMPDCSTSPLIAEPEFQQATLSEDDEFLIMGCDGIWDVMTSQHAVSVVRHGLRQHDDPERCARELVMEAKRLETADNLTVIVVCFGSELGSPPPPPAVAAARPRSCKGLSAEALCNLRSWLEADR

SEQ ID NO: 136874 - protein, 225 aa, Triticum aestivum
  unsure (1)..(225): unsure at all Xaa locations
  Clone ID: PAT_TA_31292.pep
MSSSDPIDHMSVSERLQRLATPSAPAEDDVDVDADGDGATFRDIHPSPAPAPLRQPSWDVASQRSLXSYSDEQFMSSMGREFTAMVDAGGAPADPCPGRDSGAGNNDLQLARIGEHEPVPETETNPLAIVADTGRALPPAPTSSAAPAPAAVVVEVRQVXKKEEAEXXVAAWQAEEVAKINNKFKREEVGDQRGGRTNXXTTGTTYLXKXXKETWRXERAKGDER

SEQ ID NO: 136875 - protein, 360 aa, Triticum aestivum
  Clone ID: PAT_TA_31293.pep
MAASPPAAPLVTVTAAGHPAYCGQHTRPPGAAPVKPSPWARESPPLSLAGGAPLRDFVDPFDRLTDENRLPHLLLYGPPGTGKTSTILAVARKIYGPQYGNMILELNASDERGIGVVRQQIQDFASAHSLSFGAKPAVKLVLLDEADAMTKDAQFALRRVIEKYTRSTRFALICNHVNKIIPALQSRCTRFRFAPLDGSHVTERLRHIIKSEGLDVDEGGLTALVRLSNGDMRKSLNILQSTHMASQQITEEAVYLCTGNPMPKDIEQIAFWLLNEPFSTSFKHIADMKMRKGLALIDIIREVTMFVFKIKMPSNVRVKLINDLADIEYRLTFACNDKLQLGALISTFTTARTAMVAAAD

SEQ ID NO: 136876 - protein, 253 aa, Triticum aestivum
  unsure (1)..(253): unsure at all Xaa locations
  Clone ID: PAT_TA_31294.pep
GSKAMVADEKLPASGDANNSQQQLHDTDTKSRVXDMWKKMNGGLPAKMPKPPTRPLKTVAKEKKTKATNNWMTILGLPPKKASANDQVPPNEQQQTQHKTSEDTKKLAANALAAVRDAATAASGRGKVEITEVRDFAGKDIEIKKLVDADSKEAVEKASAAGASPSAVDNILEQIRKKQKLSVLDKTKKDWGEYKAEKGVEEELGAYKKSSNQYLDRQSFLKRADYREYELERDARLSLMAKRKSESMQDDDV

SEQ ID NO: 136877 - protein, 104 aa, Triticum aestivum
  unsure (1)..(104): unsure at all Xaa locations
  Clone ID: PAT_TA_31295.pep
PPTGSRCSLCARSRTRSWRRRRTTARVPSEPRTQNPGAAQAPRCHHHPRMSSRACAPAIRWRPGAPVTXRYSTTCLLFPLASLHALPNAAAPGQPGLGHRQRRR

SEQ ID NO: 136878 - protein, 65 aa, Triticum aestivum
  Clone ID: PAT_TA_31296.pep
PSRYLCSWWIISYSCLHPMFINFNACTWLLSLSSWSLPSLLLALTCTKREYYLCIQFLKPQSYSI

SEQ ID NO: 136879 - protein, 83 aa, Triticum aestivum
  Clone ID: PAT_TA_31297.pep
GNASGSGNGSGGGQSGGVAQGPSMGVGSGSGIGGGQTGSTGSYGQGYATGTGAGTGGGGGGSNNGGFGNGGGSGSGSGSAGYP

SEQ ID NO: 136880 - protein, 89 aa, Triticum aestivum
  unsure (1)..(89): unsure at all Xaa locations
  Clone ID: PAT_TA_31298.pep
TDCSPRCCPENEICAAPIGMSAHRAALLGFVLPLSKCLVXRIPRLIGSSREKEYPSLTVRAYNGLSWDTPAGYYLSKAVPTVMWQMGIC

SEQ ID NO: 136881 - protein, 89 aa, Triticum aestivum
  Clone ID: PAT_TA_31299.pep
TPKLFHMSPPYLPIYGIYLPFQVNLYVPNSKPLNKHSVLYAQIAHVSTRAVRIFHVRRVILKRSGLRSSLRNGSSPGCPVPCFMQIKSK

SEQ ID NO: 136882 - protein, 91 aa, Triticum aestivum
  Clone ID: PAT_TA_31300.pep
PYNHTEEEYAHGAHCNRSSCGFIFTAKFQFLYTPIFMFLFGLKTRYSCPANRDWTRRFGASSCRHDGVGGAGSNSTHVLPRVRGRVGGRVR

SEQ ID NO: 136883 - protein, 60 aa, Triticum aestivum
  Clone ID: PAT_TA_31301.pep
CMKLCLLPEYRTRLIEYQQTRKWSDCIGTTDGIHSCILCNIGISSLFCVCRLVPARAAAR

SEQ ID NO: 136884 - protein, 74 aa, Triticum aestivum
  Clone ID: PAT_TA_31302.pep
FFFSQTTHVYIRERYIVGYIATSHNYLIKALHHPKYTQGPITDPNKRGLPQMLHRSPIVPIGLHYLINLEMEIT

SEQ ID NO: 136885 - protein, 76 aa, Triticum aestivum
  Clone ID: PAT_TA_31303.pep
STKKPNKKIRVSSSHPNQSEPCIIFSVFALLNLRLHRRVQLLVLASSLLEFRVLFTSCHAVAAPSSSALAIYDQRS

SEQ ID NO: 136886 - protein, 180 aa, Triticum aestivum
  Clone ID: PAT_TA_31304.pep
LHLLMRQVPWNVYAFLDFAKFIGCLVRLQDHQHQVPLQNTKFHYDCRVHLPSPEDPCTTSAKFDYRTVTPSSSTKNVYNYPCQDREYLYRRRVRLLPTTTHERLLPLPSRERLPPLWPVNNYFPYDSCTTTSLDELDPPRNACFEASVSFRSCEDSFDYVCLSSSWTHSSSYRDFSCRCR

SEQ ID NO: 136887 - protein, 72 aa, Triticum aestivum
  Clone ID: PAT_TA_31305.pep
TRPQIEWSKIQTPTDEVVVPYDTLAPPPEDLDAMKALLDKLVVLKLFGRGREGPTAVSITQIPNPIDACLPH

SEQ ID NO: 136888 - protein, 91 aa, Triticum aestivum
  Clone ID: PAT_TA_31306.pep
CCLLHFAMPCFIKPDMHHTRLCIVPCCCVGCLLCCVLLFRCLLLRVGSDNVEVVRIHSSTSVCLLHGLVLLPCGISGKMIIPSKSLLSLLC

SEQ ID NO: 136889 - protein, 117 aa, Triticum aestivum
  Clone ID: PAT_TA_31307.pep
RSGALPGLQEQGLALTRVPKIKYLIIIGGAKFRSPAIADKAYANMIKIPSLHFLGSTSICSSQTCSLQLPWLVGCWLAYLPSCFLGGVCGWLSPYHIYFPAGMYTSCAVMFQCLLCD

SEQ ID NO: 136890 - protein, 50 aa, Triticum aestivum
  Clone ID: PAT_TA_31308.pep
INNADTHSTRRIYNRIAITHLLHRMSQKRTYCNKYGLRPSYNGNNGRLGR

SEQ ID NO: 136891 - protein, 116 aa, Triticum aestivum
  Clone ID: PAT_TA_31309.pep
DPARKKNESMKKKNGRSRTDPHKRDVTGTNRGQLERWARPRTCGRSMGRWGERLNWNRSTRQGRCTLLSPDDECQRQVLASLRARGWEVDDAEPAPDLDRRDAGQGGCSRTWRRGG

SEQ ID NO: 136892 - protein, 123 aa, Triticum aestivum
  Clone ID: PAT_TA_31310.pep
LFALNKTPPARPNLGFTICLPKPFSLGFCRLKGDLYFTPRASARRECWSNLSTAGGHQGQLCAGLPEVWTIRCALRTRYVQLLSGFVGTAGGFAGLVLPLSKCLVNRDSESDRVFLGEGLFLR

SEQ ID NO: 136893 - protein, 143 aa, Triticum aestivum
  Clone ID: PAT_TA_31311.pep
FLENWTRLVMLDQMAPLVDESWRSKFERVRDDGFSRLRGLWVLHEIIMPIVTKLLTALCVPYVLARGIFPVLGYPLIVNSAVYRFAWLGCLIFSALFFCGKRFHVWFTNLHNSIRDDRYLIGRRLHNFGEDSHSPEPSESGAT

SEQ ID NO: 136894 - protein, 53 aa, Triticum aestivum
  Clone ID: PAT_TA_31312.pep
GTGGGQTGSTGSYGQGYATGTGAGTGGGGGSSNNGGFGHGGGSGSGSGSAGYP

SEQ ID NO: 136895 - protein, 63 aa, Triticum aestivum
  Clone ID: PAT_TA_31313.pep
IPDRPNWAPLLIIRKRNIVTARILVELPLEFGSITCTGILNTYKVLRVVESLILVSVLNRFLS

SEQ ID NO: 136896 - protein, 154 aa, Triticum aestivum
  unsure (1)..(154): unsure at all Xaa locations
  Clone ID: PAT_TA_31314.pep
EYNASYAYHSLYAYFDRDNVALKGFAKFFRESSDEEREHAEMLMEYQNRRGGRVRLQSIVTPLTEFDHSEKGDALYAMELALALEKLVNEKLHNLHSVATRCNDPQLSDFVESQFLQEQVXPVKKISEYVTQLRRIGKGHGVWHFDRMLLEEEA

SEQ ID NO: 136897 - protein, 110 aa, Triticum aestivum
  Clone ID: PAT_TA_31315.pep
MFAAAGGPKSKEAPRIFPLVDENSIKSKESLWALYECWCKYWGVSRDREEMVRRFKSFEATAQWVYKMNNSGCSQVSQLGPHADFSESEFAEVVFPPLPDDDDEDIKEMV

SEQ ID NO: 136898 - protein, 89 aa, Triticum aestivum
  Clone ID: PAT_TA_31316.pep
ANVEAFVLRASDLEQVTGQFARFLRNPRVQGAIRYESPYWRTIAAARIQVAWRYRKRRLKRAERSRPSEEPDRILGTCSQYAFQPGQRG

SEQ ID NO: 136899 - protein, 165 aa, Triticum aestivum
  Clone ID: PAT_TA_31317.pep
MAFIVSKLARAALASRPVGDIAGGISPCLSRLYLAACTSRRMFAASGGPMSKDAPRIFPLVDENSIKSKESLWALYECWCKYWGVSRDREEMVRRFKSFEATAQWVYKMNNSECSQVSQLGPHADMSEREFAQLFPPLPEDDDEDIEVLVPGEDLGQELEEPLNN

SEQ ID NO: 136900 - protein, 76 aa, Triticum aestivum
  Clone ID: PAT_TA_31318.pep
PRHSLSEALAPYEWVDRTNLHPLHLLVYHCKSSHDLVNYARAHSSLWLHTEVYSMNNLMIPLSLGGGPKENRQSLE

SEQ ID NO: 136901 - protein, 92 aa, Triticum aestivum
  Clone ID: PAT_TA_31319.pep
VSVTHVTHHLFTIPQCIPLRPNMVKCHVIDVHMTPLRESQHTYYQNIEHISSSHDYLQHDFPRDLKNKNNYSQVINMIKIKGVLNSIMDLNI

SEQ ID NO: 136902 - protein, 134 aa, Triticum aestivum
  Clone ID: PAT_TA_31320.pep
LGHNESALFRRAQLKALVSIHSKEAGKGGELTHDETTIISGALDLTEKTAQEAMTPIESTFSLDVDSKLDWEAIGKILARGHSRVPVYSGKLLRLEFMKSVQSGMLNDNNIARCMHVQAWLQITFFSQICEKSL

SEQ ID NO: 136903 - protein, 77 aa, Triticum aestivum
  Clone ID: PAT_TA_31321.pep
ALLPSGRAIPPRELHSRRGKSSSSSSPTTLPSWGGLYSSTSSQHQLLSNPSSSLAFNLCIKTIDWCPWVTSSVDYIL

SEQ ID NO: 136904 - protein, 76 aa, Triticum aestivum
  Clone ID: PAT_TA_31322.pep
YSCFIPLLSMCYIASIFHVLTRFRAATFMLQTFQTTSKVLLGRGSILSDAVGVDGPIYLPSLPLLSLLDGLKPYLL

SEQ ID NO: 136905 - protein, 77 aa, Triticum aestivum
  Clone ID: PAT_TA_31323.pep
TSKLFHMSPPYLPICGIYLPSQLNLYVPNSKPSNEMLFCILEQLMFQLGLFVSSMLGGLFPREWTPLLIHENMAGNG

SEQ ID NO: 136906 - protein, 112 aa, Triticum aestivum
  Clone ID: PAT_TA_31324.pep
DFTVFRTLDRVCSSYLQSTKKPQKKIRVSSSYPNQSEPLHNLFRVFALLNLRLHRRVKLLVLESSLLEFRVLVISCHAAAAPSASPCHLPPLLIRHRLESVTIYQQRCHIAP

SEQ ID NO: 136907 - protein, 71 aa, Triticum aestivum
  Clone ID: PAT_TA_31325.pep
DQQLDRRCNRKFNKAKTLKRLCKGSDWFGYDELTLNFFCGFFVDCRYEEQTRSKLRKTVKSHRATWKSDTA

SEQ ID NO: 136908 - protein, 70 aa, Triticum aestivum
  Clone ID: PAT_TA_31326.pep
SFALLNLRLHHHVELLVLASSPLEFRVLFIGCHAAAAPSSSSLPYTTTPAYTSPLPYTTTNPSPHIPSPY

SEQ ID NO: 136909 - protein, 99 aa, Triticum aestivum
  unsure (1)..(99): unsure at all Xaa locations
  Clone ID: PAT_TA_31327.pep
KKIRRKVLGRSXTVSRRNLGRSTFALRRSHSAGETSFRRGKSKPSSSATILSSQGPIFINIFTRTISSQTLAHLLYSIFVPKPQIVTYWLLVVLITSCS

SEQ ID NO: 136910 - protein, 71 aa, Triticum aestivum
  Clone ID: PAT_TA_31328.pep
YEVETLILGRRKYEATYIQSANWLFVFLTPALSFHIWQASMGFCTLLPNPGEPQTSRGYRFPSYSIVLISK

SEQ ID NO: 136911 - protein, 75 aa, Triticum aestivum
  Clone ID: PAT_TA_31329.pep
HQELWDQCCRERRKEVTFHFGQHGKYSHDAYHSLFAYFDRDNVALKGFAKFFKESSDEERGHAEKLMEYLGRDHA

SEQ ID NO: 136912 - protein, 98 aa, Triticum aestivum
  unsure (1)..(98): unsure at all Xaa locations
  Clone ID: PAT_TA_31330.pep
LTFRLPENSALCGFPLXDCPNTCLLXDEKTVEGEDQWLYYCVTAGVVFGFWLWFGLLFSVETWRCALLFSVDGMQSKIMQKVSHIDQFISKSSSDQYM

SEQ ID NO: 136913 - protein, 75 aa, Triticum aestivum
  Clone ID: PAT_TA_31331.pep
LFLKDCVSVIRFSNIMQCENQAEAIESCGEKCANLYRVYKLIMVSRVPGYGQLEYLVPGLSFESHHVTLINFVGF

SEQ ID NO: 136914 - protein, 81 aa, Triticum aestivum
  Clone ID: PAT_TA_31332.pep
LQVKIGGRSLLEHLLFTCWDIIILPCYLNAPIYLVKGGRLGLSPSVLFHSCRPSFRHIGIMFPDFASLTRFGIWEPLDNSR

SEQ ID NO: 136915 - protein, 121 aa, Triticum aestivum
  Clone ID: PAT_TA_31333.pep
SFRVLSSVHRLSCRRCHISPPHHHHRCCHIPRPHQLHRCCDIPPPHIHRQSQSIYATTYPPPSHQSEFTCNIYPPPVRVPSDSSPPPVLLQVQYFVTLFWISRSLHTPSPDRERLQNFCVT

SEQ ID NO: 136916 - protein, 124 aa, Triticum aestivum
  unsure (1)..(124): unsure at all Xaa locations
  Clone ID: PAT_TA_31334.pep
HXGFLRVSANAAADETLASRCCRRRRARVLDTPFPATAIPAICPSPKSPQIFLVPFPGISMRLARRPPSMCLDSKSPQIYSALPTIVSLMRSRRRKRRRRRRRRRWCWRRRKREGSSRAVSITA

SEQ ID NO: 136917 - protein, 59 aa, Triticum aestivum
  Clone ID: PAT_TA_31335.pep
KTVSRSSVSQTPCSVRNPTEEIESCGEKCSNLYRVYKLIMVSRVPGYGHLEYLVLELLF

SEQ ID NO: 136918 - protein, 117 aa, Triticum aestivum
  Clone ID: PAT_TA_31336.pep
SAKQIQSSLAKLSHTQRAAERAKKDALRSAARVAGHLVEAVDGGVQELFVNEKRIELEARALLGTIARYRKQSDQWLAATNAVNSVLKEIGDFENWMKIMDFDCKSINAAIRNIHRS

SEQ ID NO: 136919 - protein, 95 aa, Triticum aestivum
  Clone ID: PAT_TA_31337.pep
CLFLEGEYKLYHSVSEPHIMSVARKISPSLGCYVDNESIRLKILFISISKPSCGTSTNPFFPLRRAYLFTFMLSHHPLIEKHQLESTTIICILYC

SEQ ID NO: 136920 - protein, 154 aa, Triticum aestivum
  Clone ID: PAT_TA_31338.pep
MESLASQAKPAAVLWLAGFLQAARLHRVVSFCVSSRALSIRIAQCFLLNGFIFLGSLLTLKSVVIPTLLWILPEQCDQSWGQHLCDHTTAVALYSFLRSGLVEIFYVFWFYPLYIFSFIISTLWYGDIAKHALAVAKSKKLDASQASDSDPHST

SEQ ID NO: 136921 - protein, 148 aa, Triticum aestivum
  Clone ID: PAT_TA_31339.pep
SLRPPSDRPGVWSCFCGSACRSPPARAMPPHAPSFEKSCSGDRQRQESGGQLLRGPGQRSASFHGRGAEQRHQLPKQRPKTQPDLLAGVRGRSFRAADGGEPLAELAVRRTPSKVLVNVTVQRSLWPLNVMASAEWSVADLVAAAVGI

SEQ ID NO: 136922 - protein, 62 aa, Triticum aestivum
  Clone ID: PAT_TA_31340.pep
RRTPNATKVPDRPQLGSTTDQLERSNTKDKIFIKLLLSLVVSSARTHRHLQAEIPQGRRMSP

SEQ ID NO: 136923 - protein, 162 aa, Triticum aestivum
  Clone ID: PAT_TA_31341.pep
LLYTQGKYICVDGDGSVPAESAKADGLDAVARIGVAADHRGIVCDHRVFRIVQHWLHAGEPDPFYDPLNDYVVIPTIFEVEKHHEKRGDVTSVREDWEIISHTDGDEAKRLAELPAMVGAMSASCEGKDGLMDEAQATVVVHPESGGRQHVEVRAVGVSHGG

SEQ ID NO: 136924 - protein, 96 aa, Triticum aestivum
  Clone ID: PAT_TA_31342.pep
IEFVLHTYSPRKKPKKLGLVHPIRTNLSLCIIFCVFALFNLRLHRRVQLLVLASSPLEFRVLFTGCHVAAAIYHHCIIIIAAAIYHHHTNFIVAAI

SEQ ID NO: 136925 - protein, 195 aa, Triticum aestivum
  Clone ID: PAT_TA_31343.pep
RPPPLARCCAPPGATTAISGQIRSRRRGSGRILFRGRRGGDPGDAGGGLAAGLELQVHGVGVRRRFRARWRAPAECLHGYGGVATRRRREAMEMSSFCPSCSNGEANAEVCVCEDLVFLASGGPMVGEDQVMAFFGDFMGVSALISTLSSTTSTTTTPGTLGMIVICAMGAEWKGLPFKFSRGCTFYRSEPDPHR

SEQ ID NO: 136926 - protein, 108 aa, Triticum aestivum
  Clone ID: PAT_TA_31344.pep
DNPKCYIPDRPNWAPLLIIRKRHIVTTTFLVELPLEIDAVICTGIVGTCNSTARRRRRRHRSSSARRNWEEKPAALQLQFPGGPLVGLVRSAASTSTSHASRWRAPGR

SEQ ID NO: 136927 - protein, 173 aa, Triticum aestivum
  unsure (1)..(173): unsure at all Xaa locations
  Clone ID: PAT_TA_31345.pep
MAPPSPSPPPPRVCVTGGGGFIASWLVKLLLSRGYAVHATLRDPSDPKNAHLMQLDGAAESLSLFKADVLDRAALAAAVAGXCQGVFHVASPVPAEKIVDPESEVMVPAVKGTLNILEVCSSLKVQKVVVVSSTAAVHYDPNWPQGKPQDESCWSDRKVCQDYEIWYSLAKTV

SEQ ID NO: 136928 - protein, 113 aa, Triticum aestivum
  Clone ID: PAT_TA_31346.pep
SARGFCYMKAFTLEKIISKLTGRDSAFTRRNLGRTNLGLLRSCSAGKTSLREGEIITIVITNDPLIGRGSISINIFTSTISSQNPSSSLVSNLVSKPQIGTCGLLVVLITPYS

SEQ ID NO: 136929 - protein, 77 aa, Triticum aestivum
  Clone ID: PAT_TA_31347.pep
RFELSWHIQVKTKSSKSVYLLKSHSYIYLAFSSVYIYTLSVPKYLSFGDFKWTTCTDVYRHILECRFTHFASYVVTY

SEQ ID NO: 136930 - protein, 74 aa, Triticum aestivum
  Clone ID: PAT_TA_31348.pep
LNYRLHHRVELLVLVSSSFRVSSFFHISHATAASLSLPLSTTHPSISTTCYPPFIVIIIVEIVHIFTCSNLHLI

SEQ ID NO: 136931 - protein, 108 aa, Triticum aestivum
  Clone ID: PAT_TA_31349.pep
RWSVDGSSSTVCAYITTEATTSISVIPIKSEWCAQRRVDSWAPRSKQPQSFGLWNSHSLIRFHLGFMCRTQSHNLNKLLPYSGMSPPCRRYNQLSVLPSEINDTIFLL

SEQ ID NO: 136932 - protein, 66 aa, Triticum aestivum
  Clone ID: PAT_TA_31350.pep
PRRSTINLTTKVYSCKQSKNKQEYDKSNLNIVNMYEVLIKVGIRKRSWSGRWTQTKYTKLQWLTFN

SEQ ID NO: 136933 - protein, 95 aa, Triticum aestivum
  Clone ID: PAT_TA_31351.pep
CLLVEGEYKLYHSVWEPPIMCVAWKISPSLGCYVDNESIPLKILFTSVSKPSSGTSTNPCFPLRRAYLFTFMLSHHHLIKKHQLESTAVICIHYC

SEQ ID NO: 136934 - protein, 164 aa, Triticum aestivum
  Clone ID: PAT_TA_31352.pep
MVQLPAMGKRQHPEPAEPPMAPPAAAVKMEADELRDFDHGPLGKRARPGQPSPPPLTPPHQDMYHNVLDEPSPLGLRLKKSPSLLDLIQMRLSQANSDAGQSTTDNAEPSKKKDLKSGTSSASERLKASNFPASVLKIGTWKYTSKYEGDLVAKCYFAKHKLVW

SEQ ID NO: 136935 - protein, 225 aa, Triticum aestivum
  unsure (1)..(225): unsure at all Xaa locations
  Clone ID: PAT_TA_31353.pep
MAAAAPCAARRSFRESLKVLEADIQHANNLDYDGACLQMRMSYXCPAANIFLFLLQRTDCSIAGAPGLLRIPIYKVYVDGTTTICPPTKGNPAPRNSFYAVTFPSLVQLEHGISDTDDPRQRVVCSERYRRRDGEGEDSKRPVSKIEEECGIRMELNSRAVLHPRHVHRANACYIPSRWRHASSNRVRRQAIASNSESSVIQPRPTLVLLLLLLRHCCALMDYRS

SEQ ID NO: 136936 - protein, 119 aa, Triticum aestivum
  Clone ID: PAT_TA_31354.pep
EHGLVAVVLTIILRLADRVPLLPRRPLRPRHRLRGAGTRCCAVFFLVFDSGHHSCSIALTVVSVHFTSSRTPHRVREPGDEFVNEDPVEYVHEEQGFDTTENIAHEMIITPDITSIFAC

SEQ ID NO: 136937 - protein, 121 aa, Triticum aestivum
  Clone ID: PAT_TA_31355.pep
GLCYAPASQKEREWRKTHDDLKKDKTCQFKVAQQPYAGAGGRVEYRVALDIPTATYYVRAYALDASGTQVAYGQTAPAAAFNVVSITGVTTSIKVAAGVFSTFSVVSLAFFFFIEKRKKNN

SEQ ID NO: 136938 - protein, 155 aa, Triticum aestivum
  unsure (1)..(155): unsure at all Xaa locations
  Clone ID: PAT_TA_31356.pep
RWRCWWWSSPPAAARRRGAVAYLSKLPVTLDVTASPSPGQVLHAGEDVITVTWALNASQPAGKDADYKNVKVSLCYAPVSQKEREWRKTHDDLKKDKTCQFKVTQQAYPGTGKVEYRVALDIPNRTXYVRAYALDASRTKSPNGKPRLLPLSSSA

SEQ ID NO: 136939 - protein, 274 aa, Triticum aestivum
  Clone ID: PAT_TA_31357.pep
YYSAPDAQNSRERTRPPPPPVPIQMMLRVSASPAAAVANQLSGGAAAPAPARVTAQRSGVSLSAAAAGKGKEVLSGVVFQPFEEIKGELALVPQSPDRSLARHKFVDDCEAAINEQINVEYNASYAYHSLFAYFDRDNVALKGFAKFFKESSDEEREHAEKLMEYQNKRGGRVRLQSIVAPLTEFDHPEKGDALYAMELTLALEKLVNEKLHSLHGVATRCNDPQLIDFIESEFLEEQVEAINKVSKYVAQLRRVGNKGHGVWHFDQMLLQEGA

SEQ ID NO: 136940 - protein, 46 aa, Triticum aestivum
  Clone ID: PAT_TA_31358.pep
GYIRVEKDSGAEGGLCGIAMEASYPVKADSKPKPKPRRALGAWESQ

SEQ ID NO: 136941 - protein, 233 aa, Triticum aestivum
  Clone ID: PAT_TA_31359.pep
SGQQLLLSRGYAVHATLRDPSDPKNAHLMQLDGAAESLRLFKADVLDSAALAAAVEGCEGVFHVASPVPADKIVDPESEVMVPAVKGTLNILEVCSSLKVHKVVVVSSTAAVHYDPNWPQGKPKDESCWSDRKVCKDNEIWYSLAKTVAEETVWEYAEKNRLNAVTVCPCIVLGPQLQSVVNTTSELLLYVITGGPNALNEMLWHIVDVRDVAEALLLVTRTRSSGRISAHIH

SEQ ID NO: 136942 - protein, 135 aa, Triticum aestivum
  Clone ID: PAT_TA_31360.pep
ELLEPISSRGGPPGGHNPLGRARQPKRALVGCSPLGPPLVPIFWYISHFYLEKIRRRLSGRSAAVSRRNLGRSTFALRRSDSAGGTFLPKGEIIVIVITNNSPILGRAISINIFTSTVSSQTLVHLLYSILLPEL

SEQ ID NO: 136943 - protein, 75 aa, Triticum aestivum
  unsure (1)..(75): unsure at all Xaa locations
  Clone ID: PAT_TA_31361.pep
TXVDLTPXCGXFPHLXXVRXRXXXVIXAHXVLPAXTPLIRGPDIXVPNHRTFQVHAYXGKFLNLEGGSNSSQGPH

SEQ ID NO: 136944 - protein, 58 aa, Triticum aestivum
  Clone ID: PAT_TA_31362.pep
PPKRYPSSHRKTGHLCLYQIAITTCIFGWWKSFMVIVFCEKPIFPTTKEYNLFNYKVG

SEQ ID NO: 136945 - protein, 136 aa, Triticum aestivum
  Clone ID: PAT_TA_31363.pep
DEMVLVKMLMEIALPKMGELLLMMMTMISTSGREVPRQNRSARGQKCSYPSSASRRRLSAPKVFPLFFLGKNELYTRRWAPEVGRGGYYPPWRTWATWRAQVGCAHLTPLWYLLAPIILIYSIKNLCKVSTCLELC

SEQ ID NO: 136946 - protein, 70 aa, Triticum aestivum
  Clone ID: PAT_TA_31364.pep
PGRLPPKRNPPSHRKTGHLCLYQVVSERYQFSGCSVRISSFPRLDLFSYLLSKKKPQKRVRSIHPWSKPV

SEQ ID NO: 136947 - protein, 122 aa, Triticum aestivum
  unsure (1)..(122): unsure at all Xaa locations
  Clone ID: PAT_TA_31365.pep
YKVYVDGTTXHLSTHEMKASIKEFCLRYLNRRPAETEAVMFPSLVQLEHGVSDTDDPRRRVVCSERYRRKDGEGEDSKRPVTEIEEACASSATVNACYIPSWWRHHLIEHEDKLLPVILSHL

SEQ ID NO: 136948 - protein, 191 aa, Triticum aestivum
  unsure (1)..(191): unsure at all Xaa locations
  Clone ID: PAT_TA_31366.pep
MALLVVVLAGGCCASAGAVAYLSKLPVILDVTASPSPGQVLHAGEDVITVTWALNASQPAGKDAXYKNVKVSLCYAPXSQKEREWRKTHDDLKKDKTCQFKVXSRPTPGTGKVEYRVALDIPTATYYVRAYALDASGTQVAYGQTAPAAAFNIVSITGVTTSIKVAAGVFSAFSVASLAFFFFIEKRKKNN

SEQ ID NO: 136949 - protein, 95 aa, Triticum aestivum
  Clone ID: PAT_TA_31367.pep
CLLVEGEYKLYHSVWEPPIMCVAWKISPSLGCFVDNESMPLKILFISISKSSSGTSTNPFFPLRRAYLFTFMLSHHPLIKKHQLESTAVICIHYF

SEQ ID NO: 136950 - protein, 127 aa, Triticum aestivum
  Clone ID: PAT_TA_31368.pep
AKEIVQGTHTLSRRQGAPPYRARPLSPAPWWASGVHLLLYHHFYSGKNCGQAYGTKFRLHEVEPWRNQFRALAELFYRGHFPPGGGNHHQRHYQRSSHREGVNFHQHFHQTSFPFKILVHLLYPILY

SEQ ID NO: 136951 - protein, 155 aa, Triticum aestivum
  Clone ID: PAT_TA_31369.pep
EAPTVRAANGTCNAARVAKSSPVVVRIDGHQDVPANSEEALAKAVANQPVSVAIDASGKAFMFYSEGVFTGDCGTDLDHGVAAVGYGVAEDGKAYWTVKNSWGPSWGEKGYIRVEKDSGAEGGLCGIAMEASYAVKTDSKPKPTPRRALGAWESQ

SEQ ID NO: 136952 - protein, 166 aa, Triticum aestivum
  Clone ID: PAT_TA_31370.pep
GTRQTTQGRLEPCPEQPSRREPTPPLSSARAVVAQIRRRPAGSAPSPPRRPSLQPPSLPFKSHAVVAVPCCCRCFPCRTNEHDAPALTPGPPLLRPSGSPPSREAQRPKLASSASAFRPNLRFRSGVVRIRSTTSVCLLHGLVLLPCGISVAGADDTSAGDATELK

SEQ ID NO: 136953 - protein, 93 aa, Triticum aestivum
  Clone ID: PAT_TA_31371.pep
IQVANYVVEKLVLEKPLDGSPDSTFAMGLTSGTSALDSSSRLGLKPWQKLKPSVEILCNNQVLSPEMSLATVRTYIWKKPEDLILNYRVVQSR

SEQ ID NO: 136954 - protein, 127 aa, Triticum aestivum
  Clone ID: PAT_TA_31372.pep
AIFEMLGISKLCLRFRCSLHRFQRNHLTFPVARLDFQVEAGFILSLSNLAYASHIASRIAYHVCIMLFELCTWLIVFLLHVCLVWVEPGDEFANEEPVEFALEDPVNSDNFAGKMIIPSKSLLSLLC

SEQ ID NO: 136955 - protein, 123 aa, Triticum aestivum
  Clone ID: PAT_TA_31373.pep
STKKPKKIRVSSSHPNQSEPCIIFSVFALLNLRLHRRVQLLVLASSLLEFRVLFTGCHVAAAIYHHRIIIVAVVIYHHHIFTANPNPYTPPHIRRHHANPSSPATYIRHLSVFHQIYLRHQSE

SEQ ID NO: 136956 - protein, 60 aa, Triticum aestivum
  Clone ID: PAT_TA_31374.pep
VVTPPPHHHHRPCHLPPPLRIRIHIPPPIRVHIPPPIHIHILPPPLPYTITIYLPPIRVP

SEQ ID NO: 136957 - protein, 168 aa, Triticum aestivum
  unsure (1)..(168): unsure at all Xaa locations
  Clone ID: PAT_TA_31375.pep
LYAQIDAVYAAMKAMGHTDIGVRVSETGWPSKGDEDEVGATXQNAAAYNGNLMQRIAMGQGTPLKPSVPIDVSVFASSNQNMKPGPASRKKXYGLFYPNGSPVYAINAGTAGSGSSSGDGGGSSVGRFDPYSSQSMFSAASRLVAVRRRLSSLTLLLVLPVLSALLAC

SEQ ID NO: 136958 - protein, 120 aa, Triticum aestivum
  Clone ID: PAT_TA_31376.pep
INEIFSSILSAVACEVPSAVQSKPNHLSSPAFRCSDEPSLFSGQAPKLSWRSSAPTALAHRWISPLSLSGSMSANAPAARPDKRRSYRAPLDDDFGKPALASSAYFWPTDMPSGSWFFGK

SEQ ID NO: 136959 - protein, 141 aa, Triticum aestivum
  Clone ID: PAT_TA_31377.pep
AGRVGLSIPPSSSSCRHKVSHSTPYPSPTPCPSSTLARSSSSSSSSSSGSDARVPDFVPVSVPDRFLWVAGLDRLPRCRPRLCLLPLPPLRHERRLLCFPVVDLVRLQQHPHVAGTGYAMIMTQERCLFALRSSSAPSIRG

SEQ ID NO: 136960 - protein, 73 aa, Triticum aestivum
  Clone ID: PAT_TA_31378.pep
TLRPATRHDDATANSTKQNPKKIMQGSDWFGYDELTLIFFCGFFVDYRYEEQTRSKLRKTVKSHRATWKSDTT

SEQ ID NO: 136961 - protein, 178 aa, Triticum aestivum
  unsure (1)..(178): unsure at all Xaa locations
  Clone ID: PAT_TA_31379.pep
MGGGHDMHGGHNGGVKGFVSGLVNGGKGHGYGSSYGQGHGYGGGHVQGYQQGYGGHGQSYEHGYGGHAQHGHGGYEHWYGGGHAQHGHGHEHGYGGHXQQHGYGGGHAQLGYPPAAGAYPPHGGYQAHGYAPAAYPSHGGHQGHMGSYHTGHGGGHHHGGKYHGGKYNGGKHGSKWIR

SEQ ID NO: 136962 - protein, 86 aa, Triticum aestivum
  Clone ID: PAT_TA_31380.pep
YHHTTSNEDTFTIASVYFSIIIIVRIHLPQLAYVLVPSYNSEDTFTTPLRLVKSDEYYHHGNLFLTAITCCCVAPPRPLRGPSVVR

SEQ ID NO: 136963 - protein, 107 aa, Triticum aestivum
  Clone ID: PAT_TA_31381.pep
IKLFQQGPNIGFTICLITNKTCRGTRRHPRSFNQPPGQCSSWVLGQTGRCPAPPGQPGSQPTRRLAHTVYPENEIRVSPIRLGRCIWRSCWFCFTIAKMSCAPGFRV

SEQ ID NO: 136964 - protein, 75 aa, Triticum aestivum
  unsure (1)..(75): unsure at all Xaa locations
  Clone ID: PAT_TA_31382.pep
DLIKLWVWKVDEVVPITCYYQTFGSYFYVCLLCHAMLVDVDWVSEIHDRCEIVKVMVYLRWQLKHTSXWIEAPVF

SEQ ID NO: 136965 - protein, 88 aa, Triticum aestivum
  Clone ID: PAT_TA_31383.pep
AMAFIVSKLARAALASRPVGDIAGGISPCLSRLYLAASTSRRMFAAAGNPYVEKAFSKFGSESRLPKFSKEFSYLDLNFISEIPALCL

SEQ ID NO: 136966 - protein, 337 aa, Triticum aestivum
  Clone ID: PAT_TA_31384.pep
MAPPRRVCVTGGGGFIASWLVKLLLSRGYAVHATLRDPCDPKNVHLKQMGEVRENLHLFKADVLDYDALTRAFEGCEGVFHLATPVPEDKIVDPESEVLAPAVKGTSNVLKACSAMKVQKVIVLSSNAAVDFNPNWPQDKLKDESCWSDKDFCQENQDWYSVAKIVAEQASLEYSEKHGLNVVTLCPPLVFGPLLQPTVNTSSKFLIYVINGGPDVMSNKLWHIVDVRDVADALLAVYEKAESSGRYICAPNSVCTKDLVDLLRKMYPQYSYVNNIVDVDRKAGLSSQKLKGLGWRPRKLEETLSDSVGCYEKAGLLQGSAGRNCRLPHLFRLAGDQ

SEQ ID NO: 136967 - protein, 88 aa, Triticum aestivum
  Clone ID: PAT_TA_31385.pep
NSVLYAQIAHVSNRAIRIFHVMRVILKRSGLRSSLTRKWLVTGMPNPMLYANQTKIIANKTPPGTVVSWRHSLFRASHGLMLVGGGGV

SEQ ID NO: 136968 - protein, 96 aa, Triticum aestivum
  Clone ID: PAT_TA_31386.pep
ITLHHPKHSWPDYGAKIEENPTCDNGPNHPQLGTTTDHQERKHSITEILVEPHLSSRGAGTNRLYDRIPRSLASFTTLTGKPGLPTNRLRIPFAAG

SEQ ID NO: 136969 - protein, 83 aa, Triticum aestivum
  Clone ID: PAT_TA_31387.pep
EKVLVVSVTCSKQRDAMTKVCRALEELRLRVITANITSVSGCLMHTLFVEVDEMDRFQMKETVEAALSQLDSMGSPPLSSMSY

SEQ ID NO: 136970 - protein, 143 aa, Triticum aestivum
  Clone ID: PAT_TA_31388.pep
MGRAPCCDKASVKKGPWSPEEDATLKSYIEQNGTGGNWIALPQKIGLRRCGKSCRLRWLNYLRPNIRHGGFSDEEDRIILSLYISICSRYWYSWSHLSCQLYDQLSCRISCKLVGRHMGVVQSITCYLLPPFLNTCLSRDFKK

SEQ ID NO: 136971 - protein, 286 aa, Triticum aestivum
  Clone ID: PAT_TA_31389.pep
SGLGLLLFALLIGNMQNFLQALGSRKLEMQLIRRDVEQWMSHRRLPEDLRRRVRHAERFTWAATQGVNEEELLSNLPEDIQRDIRRHFFRFLNRVRLFTLMDWPILDAICDKLRQNLYISGSDILYQGGPVDKMIFIVRGKLESISADGSRAPLQDGDVCGEELLTWYLEHSSTNKDGGKSRFHGMRLVAIRTVRCLTNVEAFVLRASDLEQVTGQFARFLRNPRVQGAIRYESPYWRTIAAARIQVAWRYRKRRLKRAERSRPSEEPDRIPGTCSQYAFQPGQRG

SEQ ID NO: 136972 - protein, 269 aa, Triticum aestivum
  unsure (1)..(269): unsure at all Xaa locations
  Clone ID: PAT_TA_31390.pep
MGLLSNRVERSEVRPGDHIYTWRAVYAYSHHGIYVGGSKVVHFTRKKEVESSDSSNFISGLISQASSECPTFPDCGFQLADSGVVLTCLDCFLGNGSLYCFEYGVPPAIFXLAKFRGGTCTIAQSDPSEVVVRRAMHLLQNGFGNYDIFEKNCEDFALYCKTGLVPVDEAGIGVSGQASSAIGVPLAALLSTPFKIFAAGPLGMATVTAGMYCAGRYITDIGVRKDVAKVEVENLSSHLGFRRVEDTESVNRSSDKVKKLLPLKRKRER

SEQ ID NO: 136973 - protein, 136 aa, Triticum aestivum
  Clone ID: PAT_TA_31391.pep
MEGAKAAAGPAAGGQLESALLHIMQQHHHQSLRQRQQTERAKKDALRSAARVAGHLVEAVDGGVQELFVNEKRIELEARALLGTIARYRKQSDQWLAASNAVNSVLKEIGDFENWMKIMDFDCKSINAAIRNIHRS

SEQ ID NO: 136974 - protein, 111 aa, Triticum aestivum
  Clone ID: PAT_TA_31392.pep
TSSPRQAQAKSWLLLDRPLLLRFGQFVHSRFRGWMHLLFDSSDKRKGIRNNRSCQSAGHGLFHYSFMDVASSWLLLILLSLCVLAMHVYVLKMCVSSCGGKSSWVKKKKKN

SEQ ID NO: 136975 - protein, 104 aa, Triticum aestivum
  unsure (1)..(104): unsure at all Xaa locations
  Clone ID: PAT_TA_31393.pep
MAGRHTIVLVQPSPNKASRTFMDFSSLNQALDGICARYEKKIMDINPMARNFTYDITDLYNFIDGLADISAXLVYDHQLQAFLPYDRQWIKQKMFQHLKNQARQ

SEQ ID NO: 136976 - protein, 127 aa, Triticum aestivum
  Clone ID: PAT_TA_31394.pep
VAVTHTYTYRCIIYTSIKNDASGFLSNYGYGPSNSLYRVMRLILYFLELLSIHLSSPVSVAFLLHLHHLIKSISLTNDKSASPLPFFSVFGVPNTLMCRLRARLPGGGAETLAANMDEKENHGAQEE

SEQ ID NO: 136977 - protein, 199 aa, Triticum aestivum
  unsure (1)..(199): unsure at all Xaa locations
  Clone ID: PAT_TA_31395.pep
MARSELVMALLVAVLAAGCCASAGAVAYLSKLPVTLDVTASPSPGQVLHAGEDVIXVTWALNASRPAGDDAAYKSVKVSLCYAPASQKEREWRKTHDDLKKDKTCQFKVAQQPYAGAGGSVEYRVALDIPTAAYYVRAYALDASGTQVAYGQTAPRRRLQRRQHHGRHXSIKVAAGVFSTFSVVSLAFFFFIEKRKKNN

SEQ ID NO: 136978 - protein, 64 aa, Triticum aestivum
  Clone ID: PAT_TA_31396.pep
EPVWLVGKSGSGIGGGQTGSTGSYGQGYATGTGAGTGGGGGGSNNGGFGNGGGSGSGSGSAGYP

SEQ ID NO: 136979 - protein, 218 aa, Triticum aestivum
  Clone ID: PAT_TA_31397.pep
HQDRIDIIWKGQELIFQRTIRLLTGIDLSGNLLSQCIPDELTNLYGLRFLNLSRNHLSCGIPGDVGSLKNLEFLDLSCNELSGHIPQSISFLSTLSIFNISNNHLSGRIPGGSQMQTLTEPSFYRNNSGLCGFPLADCPTTSPASDEKTGEGEDQWLYYCVTAGVVFGFWLWFGLLFSVETWRCALLFSVDGMQSKIMKKVSHIDQFISKSSNDQYTM

SEQ ID NO: 136980 - protein, 500 aa, Triticum aestivum
  Clone ID: PAT_TA_31398.pep
MEVASLYRRVLPSPPAVEFASAEGKRLFAEALQGGTMEGFFNLISYFQTQSEPAFCGLASLSVVLNALAIDPGRPWKGPWRWFDESMLDCCEPLHKVKAEGITFGKVVCLAHCAGARVQSFRADQTTIHDFRAHLTRCASSQDCHLISSYHRSPFKQTGTGHFSPIGGYHAEKDMALILDVARFKYPPHWVPLTLLWDAMNTTDEATGLLRGFMLVSRRSSAPSLLYTVSCGHGSWKSMAKYCVEDVPNLLKDESLDNVTTLLSRLVESLPANAGDLIKCVIEVRRKEEGESSLSKEEKERLFLKEKVLQQIRDTDLFRVVHELQYPKGLCGSCSSSSDEDSLAEIAATVCCQGAAFLSGNLVSRDGFCCRETCIKCIEANGDGLKTVISGTVVSKGNEQAVDLLLPTSSSKTSLCNSNLKSKIVKYPSSTDVLTVLLLVLQPNTWLGIKDENVKAEFQSLVSTDNLPDLLKQEILHLRRQLHYLAGCKGQEACQEPPSP

SEQ ID NO: 136981 - protein, 176 aa, Triticum aestivum
  Clone ID: PAT_TA_31399.pep
MGGGHDMHGGHNGGVKGFVNGGKGHGYGSSYGQGHGYGGGHVQGYQQGYGGHGQSYEHGYGGHAQHGHGAYEHGYGGGHAQHGHGHGHGYGGHVQQHGYGGGHAQLGYPPAAGAYPPHGGYQAHGYAPAAYPSHGAHHGHMGSYHTGHGGGHHHGGKYHGGKHGGKYHGGKHGSRW

SEQ ID NO: 136982 - protein, 108 aa, Triticum aestivum
  Clone ID: PAT_TA_31400.pep
CGVPSMCNSLHIELHLICSVVCCILPFHASFKPDMHHTCLCIMSCFCDGCLLCFLLLSGLLLSLASVSFQSFEDPFNYVRLSSSWTRSSSLRDIRQDDHTLEITSIFA

SEQ ID NO: 136983 - protein, 74 aa, Triticum aestivum
  Clone ID: PAT_TA_31401.pep
CTIVTLMYHLLVVRNLQHETLHPETGQFIECTGKFTPLEKMMNKGYHYMHIWLVEKLYGYNVFAKSQFFPTTKE

SEQ ID NO: 136984 - protein, 101 aa, Triticum aestivum
  Clone ID: PAT_TA_31402.pep
LVYTLCRGLRTFPHKTRSPPLGFSHYMMFEKRMAETKSFKALAPYDRVDSTNLHPLHMLVYHCKSSHDLVNYARACSSLWLHMEVSSMNNLTIPLSLGGGP

SEQ ID NO: 136985 - protein, 123 aa, Triticum aestivum
  Clone ID: PAT_TA_31403.pep
NSPRDVVCWRHSLFRAGHGLMLVGGWGSINLYHSVWELPIMHFVWKIQPSHSCCVDSESMPLKMLFYLYFKIELWHLYKSLLPSTKGLSIYFYVESSPFLLKAPAGENTVILIHYFWFILGMT

SEQ ID NO: 136986 - protein, 90 aa, Triticum aestivum
  Clone ID: PAT_TA_31404.pep
NSKQFTCLNHFKPMHCCGVIICMMSRGFSAKHVSLEIRQIRSRGKKPHRAESRWPMSAQGEGAGYEAHQASWTGSVGRLDAGWQMLVPNS

SEQ ID NO: 136987 - protein, 134 aa, Triticum aestivum
  Clone ID: PAT_TA_31405.pep
TGYGQVQMKRRQPQMLDPRSPRLDSTTDHLETIHSNDQGPHQIPTSDQLRHLRWYPRHLHLQGSQSSRRLDPRKRSQQVPRACTHLPALLTLGQEDDDGDEPAATRTSLRRRGRALNLAGLLSAKQGRKRTTGK

SEQ ID NO: 136988 - protein, 87 aa, Triticum aestivum
  Clone ID: PAT_TA_31406.pep
LHGSCGTELDHGVAVVGYGVAEDGKAYWTVKNSWGPSWGEQGYIRVEKDSGAAGGLCGIAMEASYPVKTDSKPKPTPRRALGAWESQ

SEQ ID NO: 136989 - protein, 102 aa, Triticum aestivum
  Clone ID: PAT_TA_31407.pep
CCFMCRKEKFSECPGNPRRHFLELIRIFGERIKARGPTLSTRVGGAPSAWARPPISWAPWDLHRLQLQLHIFTSEEKKIREKVSSRFTTRSRRQALISLEGG

SEQ ID NO: 136990 - protein, 85 aa, Triticum aestivum
  Clone ID: PAT_TA_31408.pep
APLNFSVVCALCHAMPHYTGHASYLIVHHDMIMLVCLPCCLLHSGLLLSLASVSFRSCEDSFDYVRLSSSWTRSSSLRDFSCRCR

SEQ ID NO: 136991 - protein, 114 aa, Triticum aestivum
  unsure (1)..(114): unsure at all Xaa locations
  Clone ID: PAT_TA_31409.pep
WCRIRHENAKSEGELLSELVSVLKMSEARYTVLYASQPYGLLENPSNLPLARYLAEKTNTTTKSGLGKCDGECLVKSSFLEGTFVGXVLLIILISGLCCMMGIDTPSRFEAPQD

SEQ ID NO: 136992 - protein, 154 aa, Triticum aestivum
  Clone ID: PAT_TA_31410.pep
MGGGHDMHGGHNGGVKGFVSGLVNGGKGHGYGSSYGQGHGYGGGHVQGYGGHGQSYEHGYGGHAQHGHGGYEHGYGGGHAQHGHGHEHGYGGHVQQHGYGAHGYAPAAYPSHGEHHGHMGSYHTGHGSGHHHGGKYHGGKHGGKYHGGKHGSRW

SEQ ID NO: 136993 - protein, 176 aa, Triticum aestivum
  unsure (1)..(176): unsure at all Xaa locations
  Clone ID: PAT_TA_31411.pep
MGGGHDMHGSPNGGVKGFVSSLVGGGKGHGYGSSYGQGHGYGGGHVQGYQQGYGGHGQSYEHGYGGHAQHGHGGYEHGYGGGHVQQGHGHGYGGHGQQHGYGGGHAQLGYPPAAGAYPPHXGYQAHGYAPAAYPSHGAHQGHMGSYHTGHGGGHHHGGKYHGGKYNGGKHGSKWIR

SEQ ID NO: 136994 - protein, 254 aa, Triticum aestivum
  Clone ID: PAT_TA_31412.pep
MFLRIASSPAAVAAASQLSAPGPAHGSARLPPLAKGSSTATACRAAGKGNKEEVLLSGVMFQPFEELKGELSLVPQAEGQSLARQKFVDECEAAINEQINVEYNASYAYHSLYAYFDRDNVALKGFAKFKESSDEEREHAEMLMEYQNRRGGRVRLQSTVTPLTEFDHSEKGDALYAMELALALEKLVNEKLHNLHSVATRCNDPQLSDFVESQFLQEQVDAVKKISEYVTQLRRIGKGHGVWHFDRMLLEEEA

SEQ ID NO: 136995 - protein, 322 aa, Triticum aestivum
  Clone ID: PAT_TA_31413.pep
LTQPIAMATSQSTAPSFFNFLKEGLLLPTRNRKLFIAVGAIIVASTTLLLLGSDLAVQPLADEIQLDVKALNGTDPGSLEYAKLVQEIQDDTKELLLVSAGYLLFAVVVSSAVRILLLFATVLTYSGEQRATFSELLGKAKAQLKAPLLTLAFVYILEIVYVVFLALMGALLVVLMAKQYFVLLILASLLVLSAAISFVYFSFVCSFSVVVAVAEPGCHGAAALGRACRLAKGKKWQVVLYVAVTCALASVLSPVHTLARTCAGNSVAVGLLLGFVYAVLMALVQLFAVCAMTAFYYERGENIDSQLGDTAYTKLSTEEANA

SEQ ID NO: 136996 - protein, 85 aa, Triticum aestivum
  Clone ID: PAT_TA_31414.pep
AWLRHLHGILGTCKLVDDDDALGGAWWNSCAWLLLMVASSQVDGDARAGRSRGEVRTQRWLGIEPPARSVDGHDDESKGGGGGFC

SEQ ID NO: 136997 - protein, 79 aa, Triticum aestivum
  Clone ID: PAT_TA_31415.pep
DLRSRPPPSTMPKQIHEIKDFLLTARRKDARSVRIKRTKDAVKFKVRCSRYLYTLCVHDTDKANKLKQSLPPGLNVQEV

SEQ ID NO: 136998 - protein, 236 aa, Triticum aestivum
  unsure (1)..(236): unsure at all Xaa locations
  Clone ID: PAT_TA_31416.pep
MDPDMGENFAYYWETQRYLESEELVDSIFVGATEDAISYYDSSSPDGSHSSSTPMGAAMPGAGMGMSGTGANKNILMERXDRRRKLNEKLYTLRSVVPNITKMDKASIIKDAIEYIQQLHAEERQMEAEVSALESATGAEDDYDGGLSVDQVSSAQRKKVKRALSVSSMNDALLAAAAAVASPPVEVLELRVSEVSEKVLVVSVTCNRQRDALTKVCPALEELXRLRVITANITFV

SEQ ID NO: 136999 - protein, 221 aa, Triticum aestivum
  Clone ID: PAT_TA_31417.pep
FCLCTLPCHVSLNRTCIILGCASCHVYVMVVYHVVCFFSVVLLLDSSCDVGIVRIRSTTLVRLLHGFGLLPSRILGKMTVTLGYHFYLCLLVAPFYRYAALPITCFTKPPSLPCQPLTFSPFLANHCLAMLPLCSAPLIALLVAGEVEDCSMLDRIMLGYHNISYLINASIYLVKGGRLGLMPGVLFHSCHPNFRHTGVMFLDFAFLTRLGDLWDPLDSSL

SEQ ID NO: 137000 - protein, 79 aa, Triticum aestivum; identical to SEQ ID NO: 136997
  Clone ID: PAT_TA_31418.pep

SEQ ID NO: 137001 - protein, 126 aa, Triticum aestivum
  Clone ID: PAT_TA_31419.pep
CYKTRRLGASRAEFGTRSKAFPSLTYIAVNKEGESISNIPANAVNAVTWGVFPGKEIIQPTVVDSASFMVWKDEAFEIWSRGWACLFPEGDSSRELLEQIQKSYYLVSLVDNDYISGDLFAAFKEI

SEQ ID NO: 137002 - protein, 86 aa, Triticum aestivum
  Clone ID: PAT_TA_31420.pep
SFPPAKYAYSIAVAFHYSLCVTLPSIFHVLTRFQAATFMLQTFQTMSKVPLGRGSILSDAVGVDGLTYVASLPLLSLLDGLKPYLL

SEQ ID NO: 137003 - protein, 141 aa, Triticum aestivum
  Clone ID: PAT_TA_31421.pep
DTPLQIVHVRDVADALLLIYEKPESSGRYICAPNYISTKALLELLKKTYPDYNYVKCKADAHQNSPVTPISSAKLSNLGWNPRALGGDAPGTASNTTERWELCRMSKGQTYRLPGYFPPLSSCRRVIGRVAVLSAFYSLRF

SEQ ID NO: 137004 - protein, 203 aa, Triticum aestivum
  Clone ID: PAT_TA_31422.pep
MPPHAPSFEKSCSGDRQRQEAGGQLLRGPGQRWSSFHGRGAEQRHQLPKQRPKTQPDLLAGVRGRSFRAADGGEPLAELAVRRTPGKVLVNVTVQRSLWPLHVMASADWSVADLVAAAVGIYVKEGRRPLLPATDPSTFGLHYSQFSLESLDPREKVMELGSRSFFLCPRSSSAAVQTSSSSCSSAGASGVRKLIKLCELLQW

SEQ ID NO: 137005 - protein, 147 aa, Triticum aestivum
  Clone ID: PAT_TA_31423.pep
PTRPPWMVREGMNLTKEQRGESSNTSKGDEKSEVKDEKKQDSKEDEKSLQDEYLKAYYEALKKRQEEEDAKRMQQEGQAFSSEIHSERQVGMKAKREDENGEDEGVEWEEEQPAGNTSEEPYKFVDLNAEAPESGDDEEDEIDWEEG

SEQ ID NO: 137006 - protein, 305 aa, Triticum aestivum
  unsure (1)..(305): unsure at all Xaa locations
  Clone ID: PAT_TA_31424.pep
GIRTRRQSNRTEKSSSQRRIRGKKEDMDPDMGENFAYYWETQRYLESEELVDSIFVGATEDAISYYDSSSPDGSHSSSTPMGSALPGAGMGMDGTGANKNILMERDRXRRKLNEKLYTLRSVVPNITKMDKASIIKDAIEYIQQLQAEERQMEAEVSALESATGAEDDYDGGLSVDQVSSAQRKKVKRALSVSSMNDALLAAAAAVASPPVEVLELRVSEVSEKVLVVSVTCSKQRDAMTKVCRALEELRLRVITANITSVSGCLMHTLFVEVDEMDRFQMKEAVEAALSQLDSTGSPPLSSMSY

SEQ ID NO: 137007 - protein, 78 aa, Triticum aestivum
  Clone ID: PAT_TA_31425.pep
AFAIFFSLFALLNYRLHRRVELLVLVSSSFRVSSSVHISHVAAASLSLPLSTTHPSISTTCYPSFIVIIIVQIVHIFA

SEQ ID NO: 137008 - protein, 99 aa, Triticum aestivum
  Clone ID: PAT_TA_31426.pep
LGVEKTILKMLSGSYMNDCLFNLEPILLVFSLELNACRFQLSPMHVHSYYYTDRSVVQVKGNNDDIGWTYWDEKSWYELDLSCFCKYDEFIVPDSAYYE

SEQ ID NO: 137009 - protein, 92 aa, Triticum aestivum
  unsure (1)..(92): unsure at all Xaa locations
  Clone ID: PAT_TA_31427.pep
MAAAAKASWMAAMSVGAVEALKDQAGLCRWNYALRSVHGAAQGQGQHARXGVISQGTKRLPASAAAVAERRRAEKAEEGMRTVMYLSCWGPN

SEQ ID NO: 137010 - protein, 359 aa, Triticum aestivum
  Clone ID: PAT_TA_31428.pep
MSSAGRARAASLAAVAVRMVVGAAARPAPSAALMMAAVRGEDTEFGTALWWAYAAFSALLVLLAGIMSGLTLGLMSLGPVDLEILMRSGTDAEKAQAAAILPVVKKQHQLLVTLLLCNACAMEALPIFLDRIFNPVLAIILSVTFVLAFGEVIPQAICTRYGLAVGASFVWLVRIVMVIAYPIAYPIGKLLDFALGHESALFRRAQLKALVSIHSKAAGKGGELTHDETTIISGALDLTEKTAEEAMTPIESTFSLDVDSKLDWETIGTILARGHSRVPVYSGNPRNVIGLLLVKSLLTVRAEIETPVSAVSIRRIPRVPSDMPLYDILNEFQKGGSHMAAVVKAKPKNAPPHDKTEPG

SEQ ID NO: 137011 - protein, 108 aa, Triticum aestivum
  unsure (1)..(108): unsure at all Xaa locations
  Clone ID: PAT_TA_31429.pep
GYPPLPDPDPLPPPPPNPPLLLPPSPPPVPAPPVLPVRPPPMPEPEPTPILGPXATPPPWPPPLPLPPPLAFPPEVSSLAACPAPAPLPPPFPPSPPPPPLPPPPASE

SEQ ID NO: 137012 - protein, 92 aa, Triticum aestivum
  Clone ID: PAT_TA_31430.pep
TPKLLHMSPPYLSIYGIYLPFQVNLYVPNSKPSNKHSVLYARIAHVSTRIVCIFHARWVILKRSGLRSSLTRKWLVTGMPSPMLYANQIKIT

SEQ ID NO: 137013 - protein, 102 aa, Triticum aestivum
  Clone ID: PAT_TA_31431.pep
TPKLFHMSPLYLPIYGIYMLFQVNLYVPNSKPSNKYPVLYARIAHVSTRAVCIFHVRRVILKRSGLRSSFTRKMAGHRDAQSHALCKLNQNNCKQNSPWDSC

SEQ ID NO: 137014 - protein, 111 aa, Triticum aestivum
  unsure (1)..(111): unsure at all Xaa locations
  Clone ID: PAT_TA_31432.pep
MSMMKTSLTIIPMCPRERFPLYKSLSXLSFATKKIGPPCCTLFTFVTCYPLRITLSQNYMLPIISVLAENTLLKTACHFLLLLVGFDTLTYRKDYYSSLYCGASRPFLARC

SEQ ID NO: 137015 - protein, 236 aa, Triticum aestivum
  unsure (1)..(236): unsure at all Xaa locations
  Clone ID: PAT_TA_31433.pep
PRPLRPTASSPSPWSPSVPPPPSXPLPATSPYQATPASLRPPAGQPRRRSFPAPLPSSSSQPYLVFPYPTPLGPASPPDLLPLRQVSPPCPVSPRPRPRRTSSTAAFFSSARTPPRRRTLSSPGSPRPAILSMPASSSRVVVFSASSRAAVPSPLHRAQLPALEPACFHDPRSPPEEESTHERLVRVPDPVNRPSLPKPSRFFASSPVARSSVSFRSCEDSFDFIHLSSSWTRSSS

SEQ ID NO: 137016 - protein, 244 aa, Triticum aestivum
  Clone ID: PAT_TA_31434.pep
ALAARASGPPYLRITGIDDSDSAYARGGGLDIVGRRLCNIAQSCCLPFEFNAVNAASHEVTLEHLDIRMGEAIAVNFAYQLHHTPDESVCIENHRDRILRMVKSLSPRVVTLVEQEANTNTAPFFSRYMETLDYYTAMFEAIDVACPRDDKVRMSTEQHCVARDIVNLIACEGAERVERHEPFGKWRSRFAMAGFRPYPLSALVNNTIRTLLNDYNSYYKLEEKDGVIYLGWKNRKLVVSSAWR

SEQ ID NO: 137017 - protein, 185 aa, Triticum aestivum
  Clone ID: PAT_TA_31435.pep
GTRVVEMPITSITLPRELVEEGGMVLAVVLKADPDPVPALAVATVLVRVARRQPLAAVGTPNADGQGGGGGAGGGANGSSGSGAGSGAGKGEAESGIAIAPSVAPSAGGVSYSDAGGAGTGGGGGDGGSGGGNGAGGGQAASDDTTGGNANGSGSGNGGGQGGGVAQGPSMGVGSGSGHWGRTDW

SEQ ID NO: 137018 - protein, 222 aa, Triticum aestivum
  unsure (1)..(222): unsure at all Xaa locations
  Clone ID: PAT_TA_31436.pep
GRRHSTKSSSSGSPPLQISSTTFPSSILLPNQPATPVDPPTTAPAASSPPPSGQPPPHHXDRSPVLPTTSPSRARPPGRHLAGPLARPMLKLLCPGVPRTSSRRRPSSMASSSSRPSLPRLAPDLLPPPPLPFKSRAPASSRCGWSSEPSAQSPQARTAPSPAPVDRSPPASRGPAPPPSPRSGPWPMFRLHYDCEDSFDYVGSSTSWTRSSFLRDLSCRCR

SEQ ID NO: 137019 - protein, 115 aa, Triticum aestivum
  Clone ID: PAT_TA_31437.pep
TPKLFHMSPLYLPICGIYLPFQVNLYVPNSKPSNEILFCMLEQLMFQLGLSISSMLGGLFSRGVDSAPHSRERAGNRDAQSHDPKRSKQIKIIKENSPCDPLNVGHTRCFEQAMD

SEQ ID NO: 137020 - protein, 254 aa, Triticum aestivum
  unsure (1)..(254): unsure at all Xaa locations
  Clone ID: PAT_TA_31438.pep
LVPRLTGPIPVAFGNMASMRHPEIVSSQASALDGSNYQDRIDIIWKGQELIFQRTIRLLTGXIDLSGNMLSRCIPEELTRLEGLRFLNLSRNHLSCGIPKDIGSLRNLESLDLSCNELYGNIPQSISILSGLSTFNISNNHLSGKIPTGSQMQTLTDPSIYRNNSGLCGFPLEDCPNTSLASDEKTGEGEDQWLYYCVTAGVVFGFWLWFGLLFSVETWRCALLFSVDGMQSKIMQKVSHIDQFISKSSNDQYM

SEQ ID NO: 137021 - protein, 133 aa, Triticum aestivum
  Clone ID: PAT_TA_31439.pep
ATAPAVAPSAGGVSYSDAGGAGTGGGGGDGGSGGGNGAGGGQAASDDTTGGNASGSGSGNGGGQGGGVAQGPNMGVGSGSGIGGGQTGSTGSYGQGYATGTGAGTGGGGGGSNNGGFGNGGGSGSGSGSAGYP

SEQ ID NO: 137022 - protein, 95 aa, Triticum aestivum
  unsure (1)..(95): unsure at all Xaa locations
  Clone ID: PAT_TA_31440.pep
FLXVAIDKFTKWPKVXAVRKXDTQSAIKFLKXQCVILGVPARIITDNGTQFRSRAFMQYVHALGCKISFASMAHPRSNGQPKSTNADVATRPQKV

SEQ ID NO: 137023 - protein, 80 aa, Triticum aestivum
  Clone ID: PAT_TA_31441.pep
DLEMCSFSSLSMACNPRLCRRCHILTSLFQKVVMINILCNCFFFCYKSKNVCMYVCYATPSVPKYLSFTDYNIRMYVDIF

SEQ ID NO: 137024 - protein, 289 aa, Triticum aestivum
  unsure (1)..(289): unsure at all Xaa locations
  Clone ID: PAT_TA_31442.pep
GYPALPDPDPLPPPLPKPPLLLPPPPPPVPAPVPVAXALPXEPVLPVCPPPMPEPEPTPMLGPXATPPPWPPPLPLPLPLALPPVVSSLAACPPPAPLPPPTPPSPPPPPVPAPPASEXLTPPAEGATAGAVAIPLSASPLPAPLPAPDPLDPSAPPPAPPPPPXPSALAYPLPLGADAEPLEPTPLPPPEPEPDPDPPWEPPPAPFPPPPPAPLAKLYLFLASPPFSPYPKPPPPTAPWPHPLPPPPDELPPPPPPPPPPPALEELASILEALVTQCSRGQQNQELQA

SEQ ID NO: 137025 - protein, 116 aa, Triticum aestivum
  Clone ID: PAT_TA_31443.pep
AQAVANQPVSVAVEASGKAFMFYSEGVFTGSCGTELDHGVAVVGYGVAEDGKAYWTVKNSWGPSWGEQGYIRVEKDSGVAGGLCGIAMEASYPVKTDSKPKPTPTPRRALGARESQ

SEQ ID NO: 137026 - protein, 124 aa, Triticum aestivum
  Clone ID: PAT_TA_31444.pep
ERAGNRDAQSHDPKISKQINIIKQNSSRDVVSWRHSLFRASHGLMLVGGWGSINLYHSVWEPPVMHVVWKIQPYHSCCVDSKSIPLKMLFHLYFKIELWPLYKSLLPSVKGLSIYFYVESSPSY

SEQ ID NO: 137027 - protein, 246 aa, Triticum aestivum
  Clone ID: PAT_TA_31445.pep
MGSLAGGVGARRPRFLCLHGFRTSGEIMRKQVVGKWPAEVTARLDLVFADAPFPAEGKSDVHGIFDPPYYEWFQFDKGFTEYRNFDKCLAYIEELMIKEGPFDGLMGFSQGSILSGALPGLQEQGLALTRVPKIKYLIIIGGAKFRSPAIADKAYANMIKIPSLHFLGDNDFLKPHGEQLIESFVDPFIIRHPKGHTVPRLVDETSLEVMSRFLDKMEKEISELPSVKAEAEAEAAADVDEKEVCI

SEQ ID NO: 137028 - protein, 336 aa, Triticum aestivum
  unsure (1)..(336): unsure at all Xaa locations
  Clone ID: PAT_TA_31446.pep
MAPPRRVCVTGGGGFIASWLVKLLLSRGYAVHATLRDPCDPKNVHLKQMDEARENLHLLKADVLDYDALTRAFEGCEGVFHLATPVPEDKIADPESEVLAPAVKGTSNVLKACSAMKVQKVIVLSSNAAVDFNPNWPQDRLKDESSWSDKDFCQENEDWYSVAKIVAEQASLEYSEKHGLNVVTLCPPLVFGPLLQPTVNTSSKFLIYVINGGPDVMSNKLWHIVDVRDVADALLLVYEKAESSGRYICAPNSVCTKDLVDLLRKMYPQYSYVNNXTRTVKRPLSSQKLKDLGWKPRKLEETLSDSVGCYEKAGLLQGSAARHCRLPHLFRLAGDQ

SEQ ID NO: 137029 - protein, 305 aa, Triticum aestivum
  unsure (1)..(305): unsure at all Xaa locations
  Clone ID: PAT_TA_31447.pep
HARNGDGQDDDDAPPRRRGSPRGLLRRVGSQHSECRPRWTRALLPPLIHALRPLLGSGKHAGVACDSWVLGVEAHNVRGWKTVPASCEGYVGHYMLGSHYRRDSKVVVDQAIAYVDSLKLAGNGKEAWVFDIDETTLSNLPYYAEHGFGATPFNATSFDAYVREGSAPSLPETKRLYNKLLSVGVKPVFLTGRTEDKRAITVTNLRRQGISGWMNLLLKQPGFKGSAVTYKSGERQKLRDAGYVIIGNIGDQWSDILGXAPEGAXRTFKLPDPDVLHRLGHSGLGMPPLSSRISWTLLVICMFSQ

SEQ ID NO: 137030 - protein, 281 aa, Triticum aestivum
  unsure (1)..(281): unsure at all Xaa locations
  Clone ID: PAT_TA_31448.pep
MAMVRMPILVAVALVAAVASCSAREPNICTPMAEVAATAVDDAVAPLIHALRPLLGSGGQLGSHGGVPCDSWRLGVEAYNVRDWTTVPANCEGYVGHYMLGSHYRRDSKVVIDQAIAYLDSLKLAGNGKEVWVFDIDETMLSNLPYYATHGFGARPYNATSYNAYVLEGSAPALPETKRLYYKLLAVGIKPVFLTGRTEHRRXAITVANLCRQGISGWMNLLLKQPWFKGSTVTYKSGERQKLQDAGYVVVGNIGDQWSDILGAPEGARTFKLPDPMYYIG

SEQ ID NO: 137031 - protein, 304 aa, Triticum aestivum
  unsure (1)..(304): unsure at all Xaa locations
  Clone ID: PAT_TA_31449.pep
RTGLAEVRRSRRLTVSFICTVANYEYGFYWHFYQDGKIEAEVKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKKDRPLEETDIVLWYVFGLTXHIPRLEDWPVMPXVERIGFMLXMPHGFFNCSPAVDVPPGTSDAADVKEAESPKAIQNGSLVSKL

SEQ ID NO: 137032 - protein, 268 aa, Triticum aestivum
  Clone ID: PAT_TA_31450.pep
MGLLSNRVERSEVRPGDHIYTWRAVYAYSHHGIYVGGSKVVHFTRKKEVESSDSSNSISGLISRASSECPTFPDCGFQLADSGVVLTCLDCFLGNGSLYCFEYGVPPAIFLAKFRGGTCTIAQSDPSEVVVRRAMHLLQNGFGNYDIFEKNCEDFALYCKTGLVPVDEPGIGVSGQASSAIGVPLAALLSTPFKIFAAGPLGMATVTAGMYCAGRYITDIGVRKDVAKVEVENLSSHLGFRRVEDAESVNKSSDKVKKLLPLKRKRER

SEQ ID NO: 137033 - protein, 64 aa, Triticum aestivum
  Clone ID: PAT_TA_31451.pep
GHSHLRLIESASYLVCLGKREKKKIKKKKERKKEKKKRKRGRRKRKKKREKKREKKKKKKKKKI

SEQ ID NO: 137034 - protein, 81 aa, Triticum aestivum
  Clone ID: PAT_TA_31452.pep
RLLRRNVMHVCSRIVKVVSTKSIFIISSKDRDTLASIKWYQFSGCSVRISSFPRLDLFSYLLSKKNPEKRVRSIHPLSKPV

SEQ ID NO: 137035 - protein, 218 aa, Triticum aestivum
  Clone ID: PAT_TA_31453.pep
RHPAQCGRWEARMGQFLGKKAYDKAAIKCNGREAVTNFEPSTYDAELLNEVAAEGADVDLNLSISQPTSQSPKRDKSSLGLQLHHGSYDGSELKRPKVDAPPEMVAIPHRYPLLTEHPPIWHGQSYPLFLNNEEAARDHSRRPEVATGAVPTWAWRVSHPPPTQPMPLFSSSSSAAASSGFSKTAAAAAPGAPSASFRFDPMAPSSSSSNQHHHHHPR

SEQ ID NO: 137036 - protein, 311 aa, Triticum aestivum
  unsure (1)..(311): unsure at all Xaa locations
  Clone ID: PAT_TA_31454.pep
LLIFNAGMIVIPIXLGRLVFEAVPRLPITHGIKCNDLFSFSIGCYIIWSAAAGTRYAVDYIRSRRLGFLVQQICKWCSIVLKSSALLSIWIFVIPVLIGLLFELLVIVPMRVPIDESPVFLLYQDWALGLIFLKIWTRLVMLDQMAPLVDESWRMKFERVREDGFSRLKGLWVLHEIITPIITKLLTALCVPYVLARGVFPVLGYPLIVNSAVYRFAWLGCLIFSTLFFCGKRFHVWFTNLHNSIRDDRYLIGRRLHNFGEDSRRSNEPDETPGSLEDDLALIPLDHQDNDDVGLRFRGNNRHEDAGLVVG

SEQ ID NO: 137037 - protein, 116 aa, Triticum aestivum
  Clone ID: PAT_TA_31455.pep
TPKLFHMSPLYLPICGIYLPFQVNLYVPNSKPSNKHSVLHARIAHVSIRVVYIFHSRWVILTMSGLRSSLMRKWPVTGMPNPMLKSNQNNCKQNSPRIVVSWTTPVVSNKPWIDVC

SEQ ID NO: 137038 - protein, 105 aa, Triticum aestivum
  Clone ID: PAT_TA_31456.pep
MYPQEHFAYHKTPFWPVLCLKRIGLPCCTFVTITITCSLQIILSQNYLLSIVSVLAENTLLKTAHHFLLLLVGFDTLTYRKDYDRSPILVGYQFTIDSDGRDANE

SEQ ID NO: 137039 - protein, 91 aa, Triticum aestivum
  Clone ID: PAT_TA_31457.pep
NSAAHEAEPWRNQSRAPAELFCWGNFPPGGGNHHHRHHHRILSSGEGSISINIFTSTISSQTLVHLLYPIFVSKPQIGTCGLLVVLITPCS

SEQ ID NO: 137040 - protein, 152 aa, Triticum aestivum
  Clone ID: PAT_TA_31458.pep
ALMVNEGYSFSREDPISFGIPVTRHFENGKTSPAKPPDVPTIPDRSCTHLVLRATPDEHYVQLKPDLKFPRGGAASGSSSDQHLDKHWPGGAKIKMTLERATPKGKVGGGEANGKTKVGPCWRSFIQSELSGGSHKSPDRVRNAKSGNITPV

SEQ ID NO: 137041 - protein, 532 aa, Triticum aestivum
  Clone ID: PAT_TA_31459.pep
MAAVAGAGRARGASLAAAVRAVAATARPASSAAAAAGVSVAAVVLKGNDTPFGSVGWWAYAGISCFLVLFAGIMSGLTLGLMSLGLVELEILQRSGTDSEKAQAATILPVVQKQHQLLVTLLLCNAVAMEALPIFLDRIFHPVVAVVLSVTFVLAFGEVIPQAICTRYGLAVGANFVWLVRILMIMCYPIAYPIGKLLDCALGHNESALFRRAQLKALVSIHSKEAGKGGELTHDETTIISGALDLTEKTAQEAMTPIESTFSLDVDSKLDWEAIGKILARGHSRVPVYSGNPRNVIGLLLVKSLLTVRAETETPVSAVSIRRIPRVPADMPLYDILNEFQKGSSHMAAVVKARPKNPPADTTEPNMEAAGATQLTAPLLSNAEERAESVVVDIEAPHSRQTNGNKHHSVQQNDKPSNGVGRSSEDIEEGEVIGIITLEDVFEELLQEEIVDETDEYVDVHKRIRVAAAAAASSVARAPSVRRLTAQKASGTQSRQGQAGQPAGILKKPATEGDSNPSKQVNLVEPLLENRR

SEQ ID NO: 137042 - protein, 304 aa, Triticum aestivum
  Clone ID: PAT_TA_31460.pep
HEGDRATEQRRAEASDESEGRRKKEDMDPDMGENFAYYWETQRYLESEELVDSIFVGATEDAISYYDSSSPDGSHSSSTPMGAAMPGAGMGMGGTGANKNILMERDRRRKLNEKLYTLRSVVPNITKMDKASIIKDAIEYIQQLQAEERQMEAEVSALESATGAEDDCDGGLSVDQVSSAQRKKVKRALSVSSMNDALLAAAATVASPPVEVLELRVSEVSEKVLVVSVTCSKQRDAMTKVCRALEELRLRVITANITSVSGCLMHTLFVEVDEMDRFEMKETVEAALSQLDSTGSPPLSSMSY

SEQ ID NO: 137043 - protein, 115 aa, Triticum aestivum
  Clone ID: PAT_TA_31461.pep
LPITFTKHDHLIQQFISYHVLTISHHNMPCKNKLDVLYFVVASFTWLLRASSKNRSYLRKNHNNDYQVCYFNLLQGPVIVKFDSTKVGETDTRQPPLCKTSCMSVGGTGLMCVDM

SEQ ID NO: 137044 - protein, 244 aa, Triticum aestivum
  Clone ID: PAT_TA_31462.pep
MGSLAGGVGARRPRFLCLHGFRTSGEIMRKQVVGKWPAEVTARLDLVFADAPFPAEGKSDVDGIFDPPYYEWFQFDKGFTEYRNFDKCLAYIEELMIKEGPFDGLMGFSQGSILSGALPGLQEQGLALTRVPKIKYLIIIGGAKFRSPAIADKAYANMIKIPSLHFLGDNDFLKPHGEQLIESFVDPFIIRHPKGHTVPRLVDETSLEVMSRFLDKMEKEMSELPSVKAEAEAAADVDEKEVCI

SEQ ID NO: 137045 - protein, 189 aa, Triticum aestivum
  Clone ID: PAT_TA_31463.pep
LDLPKDSGSNKRLRSEPCGRPTSKACREKVRRDKLNDRFLELGTTLDPGKPVKADKAAILSDATRMVTQLRAEAQQLKDTNGSLEDKIKELKAEKDELRDEKQKLKLEKETLEHQMKLLTATPAYMPHPTMMPSPFAQAPMAPFHAQGQALGQKLMMPFVGYPGYPMWQLMPPSEVDTSKDSEACPPVA

SEQ ID NO: 137046 - protein, 574 aa, Triticum aestivum
  unsure (1)..(574): unsure at all Xaa locations
  Clone ID: PAT_TA_31464.pep
IRNGRPAPPPQVRDDVHIPKLKLNIPPFEGRYVPDIYLTWELETEQRFTCLQYPEERRVAAAVCAFTSFACVWWSEHCRLYPIPTTWAALKTAMRTRWVPPYYQRELLQKLQRLRQGKNSVEEYYQELQTGMIRCGIVEENEAMLARFLGGLNREIQTILDYKEYTNITRLFHLACKAEREVQDRQALARTNFSAGRPSSWTPRASSTXTHSATPATPSAATSNRDTIKQAQSPLSAKITPSGPAKSCSSSMASTGQTHDIICRCCKGGAHYARECQSKSVMIIIEDGGYESASDYDEESLALITHEEHGGDDSDPETQYMAAEDADRYECLVAQRVLSVQVTQAEQNQRHNLFHTKGVVKERSVHVIIDGGSYNNLASMEMVEKLSLTTRPHPHPYYIQWFNNSGKVKVTRTVRVHFSIFTYADYVDCDVVPMQACSLLLGRPWPFDKNSVHHGKNNHYTLVHKDKNITLLPMTPDSILKXDINRANKAKQETNKSENQIVAIEFEQQMKPNNKPSSVASGNIYVLFLLLYVMHVCLVTLGKCTFCTDRASFLGICCYSTGNLKLDKAKIEAI

SEQ ID NO: 137047 - protein, 297 aa, Triticum aestivum
  unsure (1)..(297): unsure at all Xaa locations
  Clone ID: PAT_TA_31465.pep
GQTEVVNXTLSTMLRAVLKNNKKMWEECSPHIGFAYNRSLHSITKMCPFEIVYGFLLRAPIDLLPLPSSEKVIFDAKERAELILKMHELTKENIERMNAKYKLARDKGRKHVVFAPGDLVWLHLRKDRFPNLRKSKLMSRVDGPFMVLEKINDNAYKLELPADFGVSPTFNIAGLKPYLGEEDELPSRTTSFQEGEDDEDFNTIVTPTTPAAIHIGPITRARARQLNYQVLSFLGNDSNVHENMMLPKLDTFVLLTNEGPSLEKDEHWSKNKHGVDGMHKGNKNGVTSDDFRTLKPP

SEQ ID NO: 137048 - protein, 363 aa, Triticum aestivum
  unsure (1)..(363): unsure at all Xaa locations
  Clone ID: PAT_TA_31466.pep
CSFFLSFSPLAVVASSSSSHPNPNLLSPPRTEGRGRAGRRGANGGQGRTAGSFVGGLSFHTDERKLEDAFRRFGKVVDTQIMLERHTNRHRGFGFVTFSDPRXAVETAINDMHNKELDGRTISVNRAEPEVAXDDTRYSSGGGGGDRGDYRGGKGDGPPPGNCFECGRAGHWARDCPNPGGGRSGRFPSKFSGGGGRGDRFSGSDRFGDRYVDDRYDGGRYGGYREPIDSRDRYDGGRDRYASDRYPSGGDRFGADRYGAAPDRYAPSGGGGGYGRERERSYERDGLRGGGGAYDRSGPRGGASYDRDGPRGGIGGGYDRDGPRGGGADYGSGGPARYEGGGYRERPAPYDRPRGGGRFDDRY

SEQ ID NO: 137049 - protein, 459 aa, Triticum aestivum
  unsure (1)..(459): unsure at all Xaa locations
  Clone ID: PAT_TA_31467.pep
RLVRLTARAFYDDISIKGDTQAKTSRGDNRGMAVVVLDGLTRRQWVREEDLAKSLKLHSKQLRRVLRFFEEEKLVTRDHRKESAKGAKIYSAAAAAAGDGQPTKEGEEKVKLHTHSYCCLDYAQICDVVRYRIHRMKKXTLKDELDSRNTVQHYICPNCKKRYSAFDALQLISYTDEYFHCENCNGELLAESDKLSSEEMGDGDDNARKRRREKLNDMQQRIDEQLKPLQAQLKRVKDLPAPEFGSLQSWERLNLGAFAHGDSAAAEAARNAQGQYNGTPMPYLGDTKVDVELAGSGVKAEGDESGRDGSALKVLPPWMVREGMNLTKEQRGESSNTSKGDEKSEVKDEKKQDSKEDEKSLQDEYLKAYYEALKKRQEEEDAKRMQQEGQAFSSEIHSERQVGMKAKREDENGEDEGVEWEEEQPAGNTSEEPYKFVDLNAEAPESGDDEEDEIDWEEG

SEQ ID NO: 137050 - protein, 282 aa, Triticum aestivum
  unsure (1)..(282): unsure at all Xaa locations
  Clone ID: PAT_TA_31468.pep
EGIFSESLELVRSTNRKGLPYRLGINRFXDMSWEEFQATRLGAAQTCSATLAGNHLMRDAAALPETKDWREDGIVSPVKDQSHCGSCWTFSTTGXHLEAAYTQATGKPVSLSEQQLVDCEKXFNNFGCSGGLPSQAFEYIKYNGGLDTEEAYPYTGVNGICHYKPENVGVKVLDSVNITLGAEDELKDAVGLVRPVSVAFEVITGFRLYKSGVYTSDHCGTTPMDVNHAVLAVGYGVEDGVPYWAXSKNSWGADWGDDGYFKMEMGKNMCGVATCASYPIVA

SEQ ID NO: 137051 - protein, 113 aa, Triticum aestivum
  Clone ID: PAT_TA_31469.pep
DCLRIMPCHASLNRTCIILGCASCYVDVVVVYYVVCFFPVFLLRVGSDNVVFVRNRSTTSVCLLHGLVLLPCGISGKMTIPSKSLLSLLASCSLFCYAYAAIPTTCLSCLPYC

SEQ ID NO: 137052 - protein, 645 aa, Triticum aestivum
  unsure (1)..(645): unsure at all Xaa locations
  Clone ID: PAT_TA_31470.pep
VRWNCLADGACTKTLRQHSDYVICLAAAEKNSNIVASGGLGGEVFIWDLDAAIAPIAKSVDAKEDEVPNGNSGPALSTLCNVNSSGNIVSTNGKSHGYCPIAAKGHKDSVYALDMNDTGTLLVSGGTEKVVRVWDPRTGSKNMKLRGHTDNIRALLIDSTGRYCLSGSSDSMIRLWDLGQQRCVHSYAVHTXSVWALASTPSFGHVYSGGRDQSVYLTDLSTRESVLLCTNEHPILQLSLQDDTIWVATTDSSVYGWPAEGQTPQKVFQKGGSFLAGNLSFSRARASLEGSAPVPVYKEPSFTIPGVPAIVQHEIMNNRRHVLTKDTVGSVKLWEITRGAVIEDFGKVSFDDKKKELFEMVSIPAWFTXDARLGCLSVHLDTPQCFSAEIYAVDLNVTGAQEDLKINLAHETLRGLLVHWSKRRPKPGPHSLSNGDSSIGKDVSLKILPHSRSDVDDGSENHANNVLPSFEFSTVSPPSIITESSSGGPWRKRITDLDGTEDDLPWWCVDCAENGRFPKENTKCGFYLHPAEGSPAPNITQGKLSAPRILRVLKVANYVVEKLVLEKPLDGSPDSTFAMGLTSGTSALDSSSRPGLKPWQKLKPSVEILCNNQVLSPEMSLATVRTYIWKKPEDLILNYRVVQSR

SEQ ID NO: 137053 - protein, 390 aa, Triticum aestivum
  Clone ID: PAT_TA_31471.pep
MSVPQHWAELGFFRPAAPPPDMRILQMQQQQLQVHAQPPPPPAAQPPVAKKSRRGPRSRSSQYRGVTFYRRTGRWESHIWDCGKQVYLGGFDTAHAAARAYDRAAIKFRGVDADINFNLSDYEDDMKQMKGLSKEEFVHVLRRQSTGFSRGSSKYRGVTLHKCGRWEARMGQFLGKKYIYLGLFDNEVEAARAYDKAAIKCNGREAVTNFEPSTYDAELLNEVAAEGADVDLNLSISQPTSQSPKRDKSSLGLQLHHGSYEGSELKRPKVDAPPEMVAIPHRYPLLTEHPPIWHGQSYPLFLNNEDAARDHSRRPEVATGGVPTWAWSVSHPPPTQPMPLFSSSSSAAASSGFSKTAAAAAPGAPSASFRFDPMAPSSSSSNQHHHHHPR

SEQ ID NO: 137054 - protein, 113 aa, Triticum aestivum
  Clone ID: PAT_TA_31472.pep
LAYNRHFTQYINKTYIIQRYPHRSDYGTKIKEDNPTARSLIDPNWAPLLINMKRNNTTNKIFIELPLELGCVIFTGIPGTCKLVLGVSVSHGDSAISHPARSRLFKLMGKVKA

SEQ ID NO: 137055 - protein, 218 aa, Triticum aestivum
  Clone ID: PAT_TA_31473.pep
FQILTRLSTFVIFAMFNDEDMTTLDMTKNIAYMHICQVISSANYSIIYLCYPEQKYFTHFCVLSNCRCMRHLYNPHMKIREKEMFTCCSKSSLTSLLGQEKIESKSLTFWIQIRTAQTYLTQNANNFFIRTPNWVILFLLETRFRALSNTIGFTFKFVRSIELWSKQSDVAPESESNYKSKGVASPPLGPMCLVRPRVGFRLPWDVLPPPWPPPLAPI

SEQ ID NO: 137056 - protein, 153 aa, Triticum aestivum
  Clone ID: PAT_TA_31474.pep
RFVYASLLRLLVLKFVLSMSASKDVLALASLEVDLSSIEPGSTVTVKWRGKPVFIRRRTDDDIKLANSVDVASLRHPEQDAERVKNPEWLVVIGVCTHLGCIPLPNSGDFGGWFCPCHGSHYDISGRIRKGPAPYNLEVPTYSFLEDNKMLIG

SEQ ID NO: 137057 - protein, 328 aa, Triticum aestivum
  Clone ID: PAT_TA_31475.pep
MASPDISFDIRPEFNSFDHLRSTGYISTDRPWLKLYGIRVPPVSPFNSLSSTPDLALIHQCLPDELLIEIFGRMSPYTLGRAACVCRKWKYTTRNPTFWRNACLKTWQRNGIEANFRMVQSLYDSSWRKMWVQRPRIRIDGLYVSRNTYIHTGITEWQFKKTVNVVCYYRYLRFFPTGKFLYKISPQKVKDVVKCMHLRASKGDSVFKGDYILSGDGQIEMALLYPGHRYTLVRMRLRVRGTTIGANNRLDVLKILTTGVNGTELGNWKGNILELVEDWEENETHDPDVPAVSHSRGLTPFVFVPFEESDTSSAKPANGRKMDYFVPG

SEQ ID NO: 137058 - protein, 396 aa, Triticum aestivum
  Clone ID: PAT_TA_31476.pep
MKVIEKIQEAAANGRTVFSFEYFPPKTEEGVENLFERMDRMVAHGPNFCDITWGAGGSTADVTLDIANRMQNMVCVETMMHLTCTNMPVEKIDNALDTIKSNGIQNVLALRGDPPHGQDKFVQVAGGFSCALDLVEHIKAKYGDYFGITVAGYPEAHPEVILGEEGATEEAYSKDLAYLKRKVDAGADVIVTQLFYDTDIFLKFVNDCRQIGITCPIVPGIMPINNYKGFVRMTGFCKTKIPAEITAAIGFIKREVNMVGFCTVDFAKGSPDAILLDKACLVLWDEAPMVRCHCFEALDRIFRDILAVYDSSRSLFPLRGKVVVVSGDFKQVLPVMQEGAKTGIIGASLVMSPLWRHIKLYVMSARIEKTIGLIAFGRGGRKNRNNDAYVDSKYSY

SEQ ID NO: 137059 - protein, 165 aa, Triticum aestivum
  Clone ID: PAT_TA_31477.pep
AMAFIVSKLARAALASRPVGDIAGGISPCLSRLYLAASTSRRMFAAAGGPKSKEAPRIFPLVDENSIKSKESLWALYECWCKYWGVSRDREEMVRRFKSFEATAQWVYKMNNSGCSQVSQLGPHADMSESEFDQVFPPLEDDDEDIKEMVPGEDLGQELEEPLNN

SEQ ID NO: 137060 - protein, 165 aa, Triticum aestivum
  Clone ID: PAT_TA_31478.pep
ISHMLFRQYAPLHIELHLICRIACALSPCHASLNRTCIILGCASCHVYVVVVYYVVCFFPVCFFGLVPITSCGEDSFVYVRLSSSWTRSSSLRDFRQDDHTLEITTIFAMLVCSLFCHANATMPTFACQPPKMPCQTSNPPCPSKPLIGYVPALLSPSYSVVSCR

SEQ ID NO: 137061 - protein, 171 aa, Triticum aestivum
  Clone ID: PAT_TA_31479.pep
MGGGHDMHGGHNGGVKGFVSGLVNGGKGHGYGSSYGQGHGYGGGHVQGYGGHGQSYEHGYGGHAQHGHGGYEHGYGGGHAQHGHGHEHGYGGHVQQHGYGGGHAQLGYPPAAGAYPPHGGYQAHGYAPAAYPSHGAHHGHMGSYHTGHGGGHHHGGKHGGKYHGGKHGSRW

SEQ ID NO: 137062 - protein, 358 aa, Triticum aestivum
  unsure (1)..(358): unsure at all Xaa locations
  Clone ID: PAT_TA_31480.pep
CTMLNDLESGLQRRFERHGAYEMFQELKLIFQANARIERYEVSNKFYSCKMEENSSVSEHILKMSGYNNHLIQLGVNLPDDSVIDRILQSLPPSYKSFVMNYNMQGMDKTIPELFAMLKAAEVEIKKEHQVLMVNKTTSFKKKGKGKKGNFKKNSKQVAAQEKKPKSGPKPETGCFYCKQTGHWKRNCPKYLADKKDGKXTKGLRIKRGLAKDEVTMHVGNGSKVDVMVVGTLPLHLPSGLVLDLNNCYLVPALSMNIISGSCLMQDSYSFKSENNGCSIYMSNIFYGHAPLKSGLFLLNLDSSDTHIHNVEAKRCRVDNDSATYLWHCRLGHISLKRMKKLHTDGLLESLEYEPLGT

SEQ ID NO: 137063 - protein, 258 aa, Triticum aestivum
  Clone ID: PAT_TA_31481.pep
QLDVKALNGTDPGSLEYAKLVQEIQNDTKELLLVGAVYLLFAIVVSSAVRIILLFATVLTYSGEQRATFSELLGKAKAQLKGPLLTLAFVYVLEIVYIVFLALMGALLVVLMAKQYFVLLILASLLVLSAAISLVYFSFVCSFSVVVAVAEPGCQGAAALCRACRLAKGKKWQVVLYVAVTCALASVLSPVHTLATTCAGNSVALGLLLGFVYAVLMALVQLFAVCAMTAFYYERRENIDSQLGDTAYAKLSTEEANA

SEQ ID NO: 137064 - protein, 80 aa, Triticum aestivum
  unsure (1)..(80): unsure at all Xaa locations
  Clone ID: PAT_TA_31482.pep
DLRSRPPPSTMPKQIHEIKDFLLTARRKDARSVRIKRTKDAVKFKVRCSRYLYTLCVHDTDKANKLKQSLXPPGLNVQEV

SEQ ID NO: 137065 - protein, 529 aa, Triticum aestivum
  Clone ID: PAT_TA_31483.pep
MVQLPAMGKRQHPAAEPPMAPAAAVKMEADELRDYEHGPLGKRARPAQPSPPPPPHQDMYHNVLDEPSPLGLRLKKSPSLLDLIQMRLSQANSDAGQSSTDNAEPSKKKDLKSGTSSAGERLKASNFPASVLKIGKWEYTSKYEGDLVAKCYFAKHKLVWEVLEGGLKSKIEIQWSDITALKVTLPEIGDGSLDVMLARPPLFFKETDPQPRKHTLWQATSDFTCGQASINRHHFLQCPTTSLGKNFEKLVQCDQRLHQLSQQTDVILDSSVFEPRCSIFEDPVELKCHDFANLKDECEDLPGFSGSVSPCAGSSMSTKNDTNDFFGKQPEFVAQPMNPGASAVNAQPVSRNVNGVAQEFNIPNWWSQLKVPGLRPSMSVDDLVSHLGNCISEQITSGNPSMANNEVPTKESLEEIAQYLLGDAQGPQAPASDERLMARVDSLCCLLQKDTAPVSQPKPEPNDSGSIGGVDSEGSDDEFSSASTRKTADANQQPPAMSRKDSFGDLLMNLPRIASIPQFLFKIPEDSEN

SEQ ID NO: 137066 - protein, 362 aa, Triticum aestivum
  unsure (1)..(362): unsure at all Xaa locations
  Clone ID: PAT_TA_31484.pep
MAHARILSWALAVLATAAVAVASSSFAXSNPIRPVTERAASTLESTXSXALGRTRHALRFARFAXRYGKSYESAAEVRRRFRIFPKSLEEVRSTNRKGLPYRLGINRLLGTXSWEEFQATRLGAAQTCSATLAGNHLMRDAAALPETKDWREDGIVSPVKDQSHCGSCWTFSTTGALXEAAYTQATGKNISLSEQQLVDCAGGFNNFGCSGGLPSQAFEYIKYNGGIDTEESYPYXGVNGVCHYRLKXVVQVLDSVNITLNAEDELKNAVGLVRPVSVAFEVIDGFRQYKSGVYTSDHCGTTPDDVNHAVLAVGYGVENGVPYWLIKNSWGADWGDNGYFKMEMGKNMCAVATCASYPIVAA

SEQ ID NO: 137067 - protein, 303 aa, Triticum aestivum
  unsure (1)..(303): unsure at all Xaa locations
  Clone ID: PAT_TA_31485.pep
ALAILMNLGLIEESKLSRTLPWRPPTNVFRVKEDVRPIFWANRPKSYISRTTGWDQYPHGRWGDSRNPSYGALNDHQFTRPRGRGKKLQEEWAVPLKSVQDINERFVNFCEGKLKSSPWSELDGLQPETTIIDDQLVKINSKGFLTINSQPAVNAEKSESPSVGWGGPGGYVYQKAYVEFFCAKEKLGQLIEKSKAFPSLTYIAVNKEGESISNIPANAVNAVTWGVFPXGKEIIQPTVVDSASFMVWKDEAFEIWSRGWACLFPEGDSSRELLEQIQKSYYLVSLVDNDYISGDLFAAFKEI

SEQ ID NO: 137068 - protein, 141 aa, Triticum aestivum
  Clone ID: PAT_TA_31486.pep
LKFVLSMSASKDVLALASLEVDLSSIEPGSTVTVKWRGKPVFIRRRTDDDIKLANSVDVASLRHPEQDAERVKNPEWLVVIGVCTHLGCIPLPNSGDFGGWFCPCHGSHYDISGRIRKGPAPYNLEVPTYSFLEDNKMLIG

SEQ ID NO: 137069 - protein, 174 aa, Triticum aestivum
  Clone ID: PAT_TA_31487.pep
ERYPPGDPSKRAFAYFVLSGGRFVYASLLRLLVLKFVLSMSASKDVLALASLEVDLSSIEPGSTVTVKWRGKPVFIRRRTDDDIKLANSVDVASLRHPEQDAERVKNPEWLVVIGVCTHLGCIPLPNSGDFGGWFCPCHGSHYDISGRIRKGPAPYNLEVPTYSFLEDNKMLIG

SEQ ID NO: 137070 - protein, 243 aa, Triticum aestivum
  unsure (1)..(243): unsure at all Xaa locations
  Clone ID: PAT_TA_31488.pep
MPTSVDEAVVAPLIHALRPLLGSGKHAGVECDSWVLGVEAHNVRDWKTVPASCEGYVGHYMLGKHFRRDSKIVIDQAVAYVDSLKLAGNGKEVWVFDIDETTLSNLPYYAKHGFGATPFNATSFNAYVLEGSAPXLPETKRLYNKLRSVGIKPVFLTXGRTEDQRAITVTNLRRQGISGWMNLLLKQPGFKGSAVTYKSGERQKLQDAGYIIVGNIGDQWSDILGAPEGARTFKLPDPMYYIG

SEQ ID NO: 137071 - protein, 239 aa, Triticum aestivum
  unsure (1)..(239): unsure at all Xaa locations
  Clone ID: PAT_TA_31489.pep
MPWWRRSSTALRPLLGSGKHAGVACDSWVLGVEAHNVRDWKTVPASCESYVGHYMLGSHFRRDSKIVIDQALAYVDSLKLAGNGKXVWVFXDIDETTLSNLPYYAKHGFGATPFNATSFNAYVREGXSAPALPETKRLYNKLRSVGIKPVFLTGRTEDQRAITVTNLRRQGIXPGGMNLLLKQPGFKGSAVTYKSGERQKLQDAGYVIVRNIGDQWSDILGAPEGARTFKLPDPMYYIG

SEQ ID NO: 137072 - protein, 132 aa, Triticum aestivum
  Clone ID: PAT_TA_31490.pep
VLFKKSSHVTFGPREDRVQVSHVLDSDSDCTDIPDSKRQQLFHTDSELGDSFLLESRFRDLSNPIGITLKSIRSGELWMKQSDAAADSESNYKSKGVTSPPLGPMSLVRPRVGFRLPWVVLPPPWPPPLAPI

SEQ ID NO: 137073 - protein, 130 aa, Triticum aestivum
  Clone ID: PAT_TA_31491.pep
MAGRSNIPANNSALIAIIADEDTVTGFLMAGVGNVDLRKKTNYLLVDNKTTVKQIEDAFKEFTAREDIAIVLISQYIANMIRFLVDSYNKPIPAILEIPSKDHPYDPASDSVLSRVKYLFSADSVASDRR

SEQ ID NO: 137074 - protein, 281 aa, Triticum aestivum
  unsure (1)..(281): unsure at all Xaa locations
  Clone ID: PAT_TA_31492.pep
MAMARVPILIAVALVAAAASCSAWEPTIRMPTAEAAAAAVDDAVAPLIHALRPLLGSSGELGSRGGVPCDSWRLGVEAYNVRDWKTVPANCEGYVGHYMLGSHFRRDSKVVIDQAIAYVDSLKLAGNGKEVWVFDIDETTLSNLPYYATHGFGARPYNATSFDAYVLEGTAPALPXESKRLYYKLLKVGIKPVFITGRTEDKRAITVANLRSQGISGWMNLTLKQPGFHGSAISYKSAERKKLQDAGYVIVGNIGDQWSDLLGAPEGARTFKLPDPLYYIG

SEQ ID NO: 137075 - protein, 586 aa, Triticum aestivum
  unsure (1)..(586): unsure at all Xaa locations
  Clone ID: PAT_TA_31493.pep
IRHEGKVISSEVVPDVQPAMDAMEYAECEATVKNYPPFVEAMKKRGVDDMELVMVDAWCAGYYSDADAPSRRLARPLIFCRTESDSPMENGYARPVEGIHVVVDMQNNIVIEFEDRKFVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGHVETIENCVCLHEEDHGILWKHQDWRTGLAEVRRSRRLTVSFICTVANYEYGFYWHFYQDGKIEAEVKLTGILSLGALMPGESRKYGTTIAPSLYAPVHQHFFVARMDMAIDCKPNEAHNQVVEVNVKVESAGTNNVHNNAFYAEEKILKSELQAMRDCDPSSARHWIVRNTRAVNRTGQPTGFRLVPGSNCLPFAXPEAKFLRRAGFLKHNLWVTPYKSDEKFPGGEFPNQNPRLHEGLATWVKKDRPLEETDIVLWYVFGLTHIPRLEDWPVMPVEHIGFMLMPHGFFNCSPAVDVPPGTSDAADVKEAESPKAIQNGALVSKL

SEQ ID NO: 137076 - protein, 282 aa, Triticum aestivum
  Clone ID: PAT_TA_31494.pep
RPPHLLLLHFGLPRPLPVPHTRLHLLLFEMLLRIASSPAAVAAASQLSASSPAHGYARLPPLAKVSSTACRAAGKGKKEEVLLSGVMFQPFEELKGELSLVPQAEGQSLARQKFVDECEAAINEQINVEYNASYAYHSLYAYFDRDNVALKGFAKFFKESSDEEREHAEMLMEYQNRRGGRVRLQSIVTPLTEFDHSEKGDALYAMELALALEKLVNEKLPNLHSVATRCNDPQLSDFVESQFLQEQVDAVKKISEYVTQLRRIGKGHGVWHFDRMLLEEEA

SEQ ID NO: 137077 - protein, 322 aa, Triticum aestivum
  unsure (1)..(322): unsure at all Xaa locations
  Clone ID: PAT_TA_31495.pep
MTGLGGGAAAPGDYVYFKSVVPLHKISIGSKLWRYYDFGPKAVPPLICIPGIAGTADVYYKQIMSLSMKGYRVISIDVPQVWXNHHEWIHSFEKFLDSMNIHHVHICGTSLGGFLAQIFAQYRPRRVKSLVLSNTFLETHKFAAAMPWSPLVSWTPSFLLKRYLLTGIRDGPHEPFIADSVDFVVGQVETLSREDLSSRLILNVNVASVGSLSLPDSFITIMDTNDYSAVPRQLKDQVNERYSSAKRAVLRTGGDFPFLSRPDEVNLYLQLHLRRVGVEPRPDLVQGFTRDGSSGSNDHEDGNSFDDHPTDDGDRSSGSGWP

SEQ ID NO: 137078 - protein, 130 aa, Triticum aestivum; identical to SEQ ID NO: 137073
  Clone ID: PAT_TA_31496.pep

SEQ ID NO: 137079 - protein, 173 aa, Triticum aestivum
  unsure (1)..(173): unsure at all Xaa locations
  Clone ID: PAT_TA_31497.pep
SAPSYDRYHAVPLDLLXFLDRKLXESVQELDRRVPPVVKEVPTYARSAAAEVQKTGIMGTATGLAKSAIARAEPKARDLYTRYEPVAERKAAEAWAALNRLPLVPSVTRAVLPTAAQLSAKYNSAVLDGAKRGNSVATYLPLVPTERIARVFANPAADTAPATAPEMQPIPTQ

SEQ ID NO: 137080 - protein, 280 aa, Triticum aestivum
  Clone ID: PAT_TA_31498.pep
MAMARVPILIAVALVAAAASCSAWEPTIRMPTAEAAAAAVDDAVAPLIHALRPLLGSSGELGSRGGVPCDSWRLGVEAYNVRDWKTVPANCEGYVGHYMLGSHFRRDSKVVIDQAISYVDSLKLAGNGKEVWVFDIDETTLSNLPYYATHGFGARPYNATSFDAYVLEGTAPALPESKRLYYKLLKVGIKPVFITGRTEDKRAITVANLRSQGISGWMNLTLKQPGFHGSAISYKSAQRKKLQDAGYVIVGNIGDQWSDLLGAPEGARTFKLPDPLYYIG

SEQ ID NO: 137081 - protein, 267 aa, Triticum aestivum
  Clone ID: PAT_TA_31499.pep
DGKIEAEVKLTGILSLGALMPGESRKYGTTIAPSLYAPVHQHFFVARMDMAVDCKPNEAHNQVVEVNVKVESAGTNNVHNNAFYAEEKILKSELQAMRDCDPSSARHWIVRNTRAVNRTGQPTGFRLVPGSNCLPFALPEAKFLRRAGFLKHNLWVTPYKSDEKFPGGEFPNQNPRLHEGLATWVKKDRPLEETDIVLWYVFGLTHIPRLEDWPVMPVEHIGFMLMPHGFFNCSPAVDVPPGTSDAADVKEAESPKAIQNGALVSKL

SEQ ID NO: 137082 - protein, 257 aa, Triticum aestivum
  Clone ID: PAT_TA_31500.pep
MLPRVAPSPATAAAAAAAVGQLSGAGLTAGSVRLPGALPSAAGSAVCCRAAAKGKEVLSGVMFQPFEELKGELSLVPQGKDQSLARHKFVDECEAALNEQINVEYNASYAYHSLFAYFDRDNVALKGFAKFFKESSDEERGHAEKLMEYQNKRGGRVRLQSIVTPLTEFDHPEKGDALYAMELALALEKLVNEKLHNLHSVATRCNDPQLTDFVESEFLQEQVDAIKKISEYVSQLRRVGKGHGVWHFDQMLLEEAA

SEQ ID NO: 137083 - protein, 280 aa, Triticum aestivum
  unsure (1)..(280): unsure at all Xaa locations
  Clone ID: PAT_TA_31501.pep
KWQRPGQRRQRSSSSPRLSSWPTCSAWEANIPELPTSAADVDEAVVAPLIHALRPLLGSGKHAGVACDSWVLGVEAHNVRDWKXTVPASCEXGYVGHYMLGSHFRRDSKVVVDQALAYVGXSKSTGNGKEVWVFDIDETTLSNLPYYAKHGFGATPFNATSFDAYVLEGSAPLLPETKRLYNKLLSVGVKPVFLTGRTEDKRAITVTNLLRQGISGWMNLLLKQPGFKGSAATYKSGERQKLQDAGYIIIGNIGDQWSDILGAPEGARTFKLPDPMYYIG

SEQ ID NO: 137084 - protein, 259 aa, Triticum aestivum
  Clone ID: PAT_TA_31502.pep
MAGKEDSRIFVGGLSFHTDERKLEDAFRRFGKVVDTQIMLERHTNRHRGFGFVTFSDPRAVETAINDMHNKELDGRTISVNRAEPKMQTDDTRYSSGGGGDRGDYRGGKGDGPPPGNCFECGRAGHWARDCPNPGGGRSGRFPSKFSGGGGRGDRFSGSDRFGDRYVDDRYDGGRYGGYREPIDSRDRYDGGRDRYASDRYPSGGDRFGADRYGAAPDCYAPSGGGGGYGRERERSYERDGIRGGGAYDRSGPRRRCKL

SEQ ID NO: 137085 - protein, 256 aa, Triticum aestivum
  Clone ID: PAT_TA_31503.pep
MLPRVAPSPATAAAAAAVGQLSGAGLAAGSVRLPGPLPSAAGSAVCCRAAAKGKEVLSGVMFQPFEELKGELSLVPQGKDQSLARHKFVDECEAALNEQINVEYNASYAYHSLFAYFDRDNVALKGFAKFFRESSDEERGHAEKLMEYQNKRGGRVRLQSIVTPLTEFDHAEKGDALYAMELALALEKLVNEKLHNLHSVATRCNDPQLTDFVESEFLQEQVDAIKKISEYVSQLRRVGKGHGVWHFDQMLLEEAA

SEQ ID NO: 137086 - protein, 243 aa, Triticum aestivum
  Clone ID: PAT_TA_31504.pep
MSKLFHSACKAARSFLASSPASASAPRAASSVLADGRNAALAALANLGRNSTLPAAYAHHTNAAASSHGYAWIAAIPAAVYMLQDQEVHAAEMERTFIAIKPDGVQRGLISEIVSRFERKGYKLVAIKLVVPSKQFAEKHYHDLKERPFFSGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 137087 - protein, 377 aa, Triticum aestivum
  Clone ID: PAT_TA_31505.pep
MGQLSKKLLVASMVAAVLAVAAVELCGAIPLEDNDLESEEALWDLYERWQTAHRVPRHHAEKHRRFGTFKSNVHFIHSHNKRGNRPYRLRLNRFGDMSQAEFRATFAGSRVSDRRRDGLPRPQSVPGFMYAAVNVSDLPRSVDWRQKGAVTGVKNQGKCGSCWAFSTVVSVEGINAIRTGKLVSLSEQELIDCDTADNDGCEGGLMDNAFEYIKKNGGLTTEAAYPYRAANGTCKAAKVAKSSPMVVHIDGHQDVPANSEEALAKAVANQPVSVGIDASGKAFMFYSEGVFTGECGTELDHGVAVVGYGVAEDGKAYWTVKNSWGPSWGEKGYIRVEKDSGAEGGLCGIAMEASYAVKTDSKPKPTPRRALGAWESQ

SEQ ID NO: 137088 - protein, 398 aa, Triticum aestivum
  unsure (1)..(398): unsure at all Xaa locations
  Clone ID: PAT_TA_31506.pep
MTGLIDKLVVLKLNGGLGTTMGCTGPKSVIEVRNGFTFLDLIVIQIESLNKKYGCSVPLLLMNSFNTHDDTQKIVEKYSNSXIEIPHFQTRANTLALVTGNSLPLPSKGQTGKDGWYPPGHGDVFPSLNNSGKXDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAXGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 137089 - protein, 130 aa, Triticum aestivum; identical to SEQ ID NO: 137073
  Clone ID: PAT_TA_31507.pep

SEQ ID NO: 137090 - protein, 129 aa, Triticum aestivum
  Clone ID: PAT_TA_31508.pep
MPMLTARAIPAVASKKITFFLPPIWTRTKTWTATSTGRTSPPTNPRRRLLLLLGCAQSSTMPKQIHEIKDFLLTARRKDARSVRIKRTKDAVKFKVRCSRYLYTLCVFDADKANKLKHSLPPGLSVQEV

SEQ ID NO: 137091 - protein, 94 aa, Triticum aestivum
  Clone ID: PAT_TA_31509.pep
RPGRDSFPRRRRLRRLLLGCAQSSTMPKQIHEIKDFLLTARRKDARSVRIKRTKDAVKFKVRCSRYLYTLCVFDADKANKLKQSLPPGLSVQEV

SEQ ID NO: 137092 - protein, 166 aa, Triticum aestivum
  Clone ID: PAT_TA_31510.pep
MAFIVSKLARAALASRPVGDIAGGISPCLSRLYLAAGTSRRMFAAAGGPKSKEAPRIFPLVDENSIKSKESLWALYECWCKYWGVSRDREEMVRRFKSFEATAQWVYKMNNSGCSQVSQLGPHADFSESEFAEVVFPPLPDDDDEDIKEMVPGQDLGQELEEPLNN

SEQ ID NO: 137093 - protein, 243 aa, Triticum aestivum
  Clone ID: PAT_TA_31511.pep
MSSSSKLFQSACKAARSFLASSSAPAAASSVLADGRNAALATLANLGRNSTLPAAYAHHLHTNAASSQGYAWIAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPETAKDEIALWFQPRELVSYTSNEEKWIYGVN

SEQ ID NO: 137094 - protein, 115 aa, Triticum aestivum
  Clone ID: PAT_TA_31512.pep
VYLDTFVVVVDACNSDEDINTIVTPTAPAAIHTGPITRARARQLNYQVLSFLGNDSNVHENMMLPKLDTFVLLTNEGPSLEKDEHWSKNKHGDDGMRKGNKNGVTSDDFRTLKPP

SEQ ID NO: 137095 - protein, 255 aa, Triticum aestivum
  Clone ID: PAT_TA_31513.pep
MLPRVAPSPATAAAAAVGQLSGAGLTAGSVRLPGALPSAAGSAVCCRAAAKGKEVLSGVMFQPFEELKGELSLVPQGKDQSLARHKFVDECEAALNEQINVEYNASYAYHSLFAYFDRDNVALKGFAKFFKESSDEERGHAEKLMEYQNKRGGRVRLQSIVTPLTEFDHPEKGDALYAMELALALEKLVNEKLHNLHSVATRCNDPQLTDFVESEFLQEQVDAIKKISEYVSQLRRVGKGHGVWHFDQMLLEEAA

SEQ ID NO: 137096 - protein, 212 aa, Triticum aestivum
  Clone ID: PAT_TA_31514.pep
NSLRTKFMKWHDEDMTTLDMTKNIAYMHICQVISSANYSIIYLCYPEQKYFTHFCVLSNCRCMGHLYNPHMKIRKKEMFICCPKSSLTSLLAQEKIESKSLTFWIQIRTAQTHLTQNAHKFFIRTPNWVILFLLETRFRALSNPIGITFKFVRSVELWTKQSDAAAESESNYKSKGVTSPPLGPIDLVRPRFSFRLPWDVLPPPWPPPLAPI

SEQ ID NO: 137097 - protein, 252 aa, Triticum aestivum
  Clone ID: PAT_TA_31515.pep
MAQSGNNDAAPISTQPAAEEVTVERTPEEEEARLRYLEFVQQAAAQAVVLAAAAYAYAKQGAGPLRLGVDHVEGTVKAVVGPVYDRYHAVPLDLLKFLDRKVDESVQELDRRVPPVVKEVPTYARSAAAEVQKTGIMGTATGLAKSAIARAEPKARDLYTRYEPVAERKAAEAWAALNRLPLVPSVTRAVLPTAAQLSAKYNSAVLDGAKRGNSVATYLPLVPTERIARVFAYPAADPAPATAPEMQPIPTQ

SEQ ID NO: 137098 - protein, 474 aa, Triticum aestivum
  unsure (1)..(474): unsure at all Xaa locations
  Clone ID: PAT_TA_31516.pep
MAAAAVAADSKIDGLRDAVAKLGEISENEKAGFISLVSRYLSGEAEQIEWSKIQTPTDEVVXVPYDTLAPPPEDLDAMKALLDKLVVLKLNGGLGTTMGCTGPKAVIEVRNGVTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 137099 - protein, 597 aa, Triticum aestivum
  unsure (1)..(597): unsure at all Xaa locations
  Clone ID: PAT_TA_31517.pep
MKVIEKIQEAAANGRTVFSFEYFPPKTEEGVENLFERMDRMVAHGPNFCDITWGAGGSTADVTLDIANRMQNMVCVETMMHLTCTNMPVEKIDNALDTIKSNGIQNVLALRGDPPHGQDKFVQVAGGFSCALDLVEHIKAKYGDYFGITVAGYPEAHPEVILGEEGATEEAYSKDLAYLKRKXVDAGAXDVIVTQLFYDTDIFLKFVNDXCRQIGITCPIVPGIMPINNYKGFVRMTGFCKTKIPAEITAALDPIKDNEEAVKAYGIHLGTEMCKKILASGIKTLHLYTLNMEKTALAILMNLGLIEEFKLSRTLPWRPPTNVFRVKEDVRPIFWANRPKSYISRTTGWDQYPHGRWGDSRNPSYGALNDHQFTRPRGRGKKLQEEWAVPLKSVQDINERFVNFCEGKLKSSPWSELDGLQPETTIIDDQLVKINSKGFLTINSQPAVNAEKSDSPSVGWGGPGGYVYQKAYVEFFCAKEKLGQLIEKSKAFPSLTYIAVNKEGESISNIPANAVNAVTWGVFPGKEIIQPTVVDSASFMVWKDEAFEIWSRGWACLFPEGDSSRELLEQIQKSYYLVSLVDNDYISGDLFAAFKEI

SEQ ID NO: 137100 - protein, 367 aa, Triticum aestivum
  unsure (1)..(367): unsure at all Xaa locations
  Clone ID: PAT_TA_31518.pep
MAHARILLLALAALATATVAVASSSSSSSSFAVSNPIRPVTERAASTLESTVLAALGRTRHALRFARFAVRYGKSYESAAEVRRRFRIFSESLEEVRSTNRKGLSYRLGINRFSDMSWEEFQATRLGAAQTCSATLAGNHLMRDAAALPETKDWREDGIVSPVKDQSHCGSCWTFSTTGALEAAYTQATGKNISLSEQQLVDCAGGFNNFGCSGGLPSQAFEYIKYNGGIDTEESYPYKGXVNGVCHYKAENAVVQVLDSVNITLHAEDELKNAVGLVRPVSVAFEVINGFRQYKSGVYSSDHCGTTPDDVNHAVLAVGYGVENGVPYWLIKNSWGADWGDNGYFKMEMGKNMCAVATCASYPIVAA

SEQ ID NO: 137101 - protein, 297 aa, Triticum aestivum
  Clone ID: PAT_TA_31519.pep
AASASTTACAAACCTNSRCLSLAASSSGVLSTVTSSAAGWVLIGAASLLPDRAISAAAPLGIDRCAAYAGFNSTLRQGNITHHEYIQVGKGRDVGLNQIALFEGKVAGGNGEQVLSRDVYRLGQLFDFFRMLTFFYTTVGYYVCTMMTVLTVYIFLYGRVYLALSGLDHSISRQARFLGNTALDAALNAQFLVQIGVFTAVPMIMGFILELGLMKAIFSFITMQLQFCSVFFTFSLGTRTHYFGRTILHGGAKYRATGRGFVVRHIKFADNYRLYSRSHFVKALEVALLLIVYIAYG

SEQ ID NO: 137102 - protein, 366 aa, Triticum aestivum
  Clone ID: PAT_TA_31520.pep
MAHGRILPLALAVLATAAVAVASSSSSSSSFAVSNPIRPVTERAASTLESTVLAALGRTRHALRFARFAVRYGKSYESAAEVRRRFRIFSESLEEVRSTNRKGLPYRLGINRFSDMSWEEFQATRLGAAQTCSATLAGNHLMRDAAALPETKDWREDGIVSPVKDQSHCGSCWTFSTTGALEAAYTQATGKNISLSEQQLVDCAGGFNNFGCSGGLPSQAFEYIKYNGGIDTEESYPYKGVNGVCHYKAENAVVQVLDSVNITLNAEDELKNAVGLVRPVSVAFEVIDGFRQYKSGVYTSDHCGTTPDDVNHAVLAVGYGVENGVPYWLIKNSWGADWGENGYFKMEMGKNMCAVATCASYPIVAA

SEQ ID NO: 137103 - protein, 473 aa, Triticum aestivum
  Clone ID: PAT_TA_31521.pep
MAAAAVAADSKIDNLRDAVAKLGEISENEKSGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGQTGKDGWYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKTIPSIVELDSLKVSGDVSFGSGVVLEGNVTIAAKAGVKLEIPDGAVLENKDINGPEDL

SEQ ID NO: 137104 - protein, 112 aa, Triticum aestivum
  Clone ID: PAT_TA_31522.pep
IRRPTGGNANDMLIFNDFIRTQSLVELPIKGRTYTWSNMQDDPLLVQLDWFFSSVHWSSSYPNTTVSPLGKPASDHVPCVIGIDLCIPKSKVFHFENYWIQHSGFHEIVQCS

SEQ ID NO: 137105 - protein, 283 aa, Triticum aestivum
  Clone ID: PAT_TA_31523.pep
SDKQISTGQGSILEEDDMMGSRTGLGTGYGQTKWVSEQLVREAGRRGLRGTVARPGYILGDIETGVCNTDDFLVRMLKGCIQLGVRPHIVNTVNAVPVNHVANVVVACALNPLPNGVHVAHITGHPRLRMNEYLSSLEYYGYKAPEVDYTQWKDELENYVTAGGQAKDQEQHALMPLYHFWGNDLPANTRAPELDDSNTVKMLKEDAEHWTGIDESSGYGISRTDIGRFLHFLAETQFVSWPTGRGRPLPEVNLTAAQLEAVGAVGGRGGNGAPAATAAAAKV

SEQ ID NO: 137106 - protein, 153 aa, Triticum aestivum
  Clone ID: PAT_TA_31524.pep
MPGASSPRGRAGAGRRWCARGDLLTVAVAAMLCSATYCFSIWHNGRNAADKIVIGPASFVVAGAALCGGDATELDFAAHHTAERAGLSVSSSSPTVTGRRALRAVAVPMDGTGRRGLVLAGNSVGSSEAADAKKRARVNGDKFRSTHAGTVRA

SEQ ID NO: 137107 - protein, 176 aa, Triticum aestivum
  unsure (1)..(176): unsure at all Xaa locations
  Clone ID: PAT_TA_31525.pep
IHSCLPYRKIHYITSQTNNKVLGKYLIRLKESSREIFQQDGLLHHLLLLLLPRTRGRTRGRTRGLLPQSSPTTTTYLPPSPRPTTTPPSLPPPPPPPTTTTRRRRPRCPPWRQQGVXEGHGXFRVSSXSTRXTXIPLXSSKRKVGKRRXATPXXTRXDRRNAISARSQXGRWXGAX

SEQ ID NO: 137108 - protein, 185 aa, Triticum aestivum
  Clone ID: PAT_TA_31526.pep
MLKIWSMKKEQKDAENAEGQASGGKKKKVTAAQLRVQKDLSELSLGSTMKTEFPDPDDILNFVLTIDPDEGMYRSGRFTFDFAINQNFPHEPPKVRCREKIYHPNIDLEGKVCLNILREDWKPVLNLNAVIVGLQFLFLEPNASDPLNKEAAEDLRNNREGFKRNVRTAMGGGVVKGTNYDRVLK

SEQ ID NO: 137109 - protein, 160 aa, Triticum aestivum
  Clone ID: PAT_TA_31527.pep
PSPARWRRPPRPSNSSSRRGFSQAVAVAQLPPPPRHQKHQPATSPRGCSPEPPLPPLLRRPPRPCPCSGTRPRLPAQAPAVPPQQAAAAASHNQPLRWLLRDVASATGRRPWEPCAPTSCGPTEPTNQGMRLRFTILCNSAVSVNRASHQNQSVARLILA

SEQ ID NO: 137110 - protein, 308 aa, Triticum aestivum
  unsure (1)..(308): unsure at all Xaa locations
  Clone ID: PAT_TA_31528.pep
GPSTSSSPAGRSAAPPRSWASSTPRRRAPHRAGAPHWARAAPRPAGTPSELFTLPRHCAPQILLRLLPVWITRVIVSSAFSQMNTTFVQQGSAMEMTILSVPVPAASLASFGGDLRHDMGAPLQLRVFVPXCRSFSSSGDGEPSQLQRMGAGRLLMAHTMSVAALVEMKRLDSAARGEEISISWQLPQYFFLAGGEVFCYIAQLEFFFDEAPDTMKSMCTSLALLTIARGSYMSSFIYAIVRDLTPTGERIPLISNDTLNGKVDYFFSEVAAFCTQLVARFQLHRYTLHARKKNVRYACFFLVVLIVS

SEQ ID NO: 137111 - protein, 183 aa, Triticum aestivum
  Clone ID: PAT_TA_31529.pep
MRWRSCSVQSLDNVLHSGGQKIPPQDEEYDDHDGESSTSLAFVRKSDPQAGGTYIILDVSQTRALTCHKGQLRLEPVHLSDDHISEQAQWFCTAKNGFKGFKNVAEGRFLGHDVWWDFCANASSHSLWEYFTIARRPGGLYWMQILHWWTQWQVTVREDGSGVYAEKDIGTDWEFVKVLSMSD

SEQ ID NO: 137112 - protein, 166 aa, Triticum aestivum
  Clone ID: PAT_TA_31530.pep
MYPLEMEGNSNPKTTNKPKYSKFTQQELPACKPLLTPEIVIAAFALIGALFVPIGLASLHASRQVVELVHRYDASCVPVDDKVGFIQNSRTDKTCTVTMTVPKYMKSPIHVYYLIDGFYQNHRRYVRSRSDKQLRYKSAAHLTSDCVPEGDTADHAPIVPCGHCMI

SEQ ID NO: 137113 - protein, 136 aa, Triticum aestivum
  Clone ID: PAT_TA_31531.pep
MARTKQTARKSTGGKVPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 137114 - protein, 306 aa, Triticum aestivum
  Clone ID: PAT_TA_31532.pep
MVADAQSSDSMAGSSGSAAEKHVDRCLDKRAQEKAPKKNHKAEREKLKRDQLNDLFVELSSMLDHDRQNRGKATVLGDVARVLRDLITQVESLRKEQSTLLTERQYVGSEKTELQDENTTLRAQIIELQNELRARIGNSSLNLSSLAVPHPIGSSCTSNLATHPTPHDTWSNASNLSTMRMVPPNQHTISTAESAASLCCFWSGCITASGAPALSRVHQHQRTENVPGIEATQLLRALRIPCLDSFASAFHQHPKKKAAAAAEAHREIEKDEVPVTGSTGYNKSVLGDNSSLVNTNKLLTLLVQTY

SEQ ID NO: 137115 - protein, 260 aa, Triticum aestivum
  Clone ID: PAT_TA_31533.pep
MGTLVGHVAPGAGFLLIGLWQLFNHIRLFVLRPGSYVAPLWFPARGVRHLELILIIAGTVASILMELVIGPARHQPFDDDGTIPSDHLHNFEHASISLALLAFAAVTIHMDRVRAPMRDAVSQLVAAAAFAQELLVFHLHSTDHMGVEGQFHWLLQTVIVVTLATTLLGIPYPRSFVVSLVRSASLVLQGVWLIVMGVMLWTPGLVSKGLLPHRPPPPPPGPRRPPGAPYRPRRPRRAPPPGRPGGRRGPDPRARLGAAR

SEQ ID NO: 137116 - protein, 179 aa, Triticum aestivum
  unsure (1)..(179): unsure at all Xaa locations
  Clone ID: PAT_TA_31534.pep
ALTGFIPFFGSSPNLEELDLSYNRLETGKWGFMSSLANCTRLAKLLLVGNNLQGKMPSSIGNLSDSLEWLWLRENQISGSIPPEIGNLKSLTRVYMDYNLITGNIRPTIGNLHHLVHLSFAHNKLSGQIPDTXIGNLVKLMSLKLDENNISGRIPASIGSCTQLKELNLCQNSLDGSIL

SEQ ID NO: 137117 - protein, 88 aa, Triticum aestivum
  Clone ID: PAT_TA_31535.pep
VNTMEHGGQMGMLFELLRNCAGFYRKIQEDIQANLSEPDVERRERGEVFATKVALKLGRSLSDLKQFRKMASPSVKDEDIREFAGKLF

SEQ ID NO: 137118 - protein, 87 aa, Triticum aestivum
  Clone ID: PAT_TA_31536.pep
NGISKLHKSDMRLKTTGARVNSSNSIVCTGVTRTGIHRIGLLGLNVSCHRYLQAWTQNATIFLIRHMHRSIRAMQPADWKRYLLFLC

SEQ ID NO: 137119 - protein, 226 aa, Triticum aestivum
  unsure (1)..(226): unsure at all Xaa locations
  Clone ID: PAT_TA_31537.pep
SCRIRHEAGHWFEHLITKRNPSLVSSFALLSCGYLLSSYHEVRSVVLNTLNRARFTVAVDSFIKTGYVPSLKEGNSQETIFIHPWRHEPVSIGSRFGEAFQEPVSFVATRPLFEDERYMVTYNPTKDKVYALLKDQAKPDDILKAAFHAHVLLHFINVSHERKRMSSNRSRSLQGTRIXLAHIAESCKIVSSSYRTFRKKAKEQGWIMSESLLNPGKARLCVTRPQ

SEQ ID NO: 137120 - protein, 143 aa, Triticum aestivum
  Clone ID: PAT_TA_31538.pep
TGRPLLPSSSSCAAPAKVVEVRQVKKAKINNKVKAWEVEMVAKINNKFKREEVVINGWENQQIHTATTYLSKIERKLEEERAKATEKAQNEVARARRKAEGKRASAEAARGTKTARVMDLANFMKAVGRLPTKRSFFSFSSSS

SEQ ID NO: 137121 - protein, 274 aa, Triticum aestivum
  Clone ID: PAT_TA_31539.pep
RRPKASQGGGRPRATGRRRRWRISSYWGIEQSKKLVREDGTEWKWSCFRPWETYTADTSIDPTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 137122 - protein, 125 aa, Triticum aestivum
  unsure (1)..(125): unsure at all Xaa locations
  Clone ID: PAT_TA_31540.pep
IVMGVMLXTPGLVSKGCFLNHEDGHDVVQCRTDEALHRAKALVNLQFSWYLTGTMVFVVVLYLQVSRLYPEEPQYLPLVKGRHAGGRFSIGDDREDDDDEEDLEATKRGYGHVVSGGTKPMEVER

SEQ ID NO: 137123 - protein, 225 aa, Triticum aestivum
  Clone ID: PAT_TA_31541.pep
MSIQAILNDPLESEVESEPESKMKKVTVVPPPVEPVAPIATSIEAVEEGQAADAEQSKRKKQPRRVHKEDTPPARVRTPGDYLLTPLLLSEPEMAWIQCTNCDEYFVQQNAYFTRASCPRCERHSKLYGYIWPKTDKEGPNDKEERILDHRTIHRFLDPDNERRVRNRKSFGASKTNTEEAEDVERGRKRFGTAGLMGRNASTTEDSGHRRSGRLRRVNSRFLDP

SEQ ID NO: 137124 - protein, 93 aa, Triticum aestivum
  Clone ID: PAT_TA_31542.pep
SSGRPAGAPPARRPAGPSPVRATGPWWCAGCARCLVGLWAGPAKCSQREEAAAACRSLTYYLDSVTFGTRSRLFLLFFLHGEVLIFFRCCMHG

SEQ ID NO: 137125 - protein, 213 aa, Triticum aestivum
  Clone ID: PAT_TA_31543.pep
MMDVRGLRLGYFLVLCLVPFLRHAVAIRFVMDRGECFSHNVDYEGDTVHVSFVVIKADTPWHYSEDGVDLVVKDPNGNQVHDSRAKVSDKFEFIVQKRGVHRFCFTNKSPYHETVDFDVHVGHFSYFDQHAKDEHFGPLFEQIRKLDEDLYNVLFEQHWLTAQTDRQAILNENMSTRAIHKALLESAALIAASAVQVYLLRRLFERKLGTSRV

SEQ ID NO: 137126 - protein, 106 aa, Triticum aestivum
  unsure (1)..(106): unsure at all Xaa locations
  Clone ID: PAT_TA_31544.pep
IRFEFPKGPAAHPFIRVAGDPXNQPLPTNDETVVVEISPLRQVPMLANGPCKSKSVEEPPTPSSHGPENDDSASLEDKDEWKKGRKKFGAAEPFKFPDEVAIAHFS

SEQ ID NO: 137127 - protein, 253 aa, Triticum aestivum
  Clone ID: PAT_TA_31545.pep
PTRPPTRPKPDSEPVILDNAPSCPVVVFINSRSGGQLGSGLIKSYREVLNEAQVFDLSEESPDKVLHRLYANFQRLKSNADTLAIQIEKSLRLIVAGGDGTASWLLGVVSDLKLTHSPPVATVPLGTGNNLPFSFGWGKKNPATDQEAVKSFLGLVKGAREMRIDSWHIIMRMRVPQEGPCDPIAPLELPHSLHAFHRVTGSDELNVEGYHTFRGGFWNYFSMGMDAQVSYGFHSERKKIQRVQNQLTNQGTY

SEQ ID NO: 137128 - protein, 322 aa, Triticum aestivum
  unsure (1)..(322): unsure at all Xaa locations
  Clone ID: PAT_TA_31546.pep
SLVLGGGNDIKLTHSPPVASVPLGTGNNLPFSFGWGKKNPATDQEAVKSFLGLVXSTFRGGFWNYFSMGMDAQVSYGFHSERKKNPEKFKNQLTNQGTYAKLGLKQGWFAPSLTHSSSRNISQLAKVKIMKIPGGKWEELKIPSSIRSIICLNLPSFSGGFNPWGTPGTRKKQDRDLTAPYVDDGLIEVVGFRXAWHGLVLLAPNGHGTRLAQAHRIRFEFHKGAADHTFMRVDGEPWKQPLPSNDETVVVEISHLRQVTMLANGHCKSKSVEDPMTPSSHGHENDDSDSLEDEDEWKEGRKKFGAADTFKLPDEVDIAHLS

SEQ ID NO: 137129 - protein, 241 aa, Triticum aestivum
  Clone ID: PAT_TA_31547.pep
MAAAAAARAWWRPEIPASAPAAAARCFVPARGSHLVTGLQMTGRASSILPHVKSGEAAEGSPNADADTAIATAPVVDEETLRHDLETAIEEEDYGRAAKLRDELRHLREDGRSSLLAANARFYDAFRDGDLAAMHAVWAKGEHRYVVHPSAGRISGYETVMRSWEMVCDADHEFPLRFDLQDVEVHVKGDIGYVTCLEMVKTRGSGGSWGKQLATNVFEKVAGEWLMCVHHASHLDDDDDE

SEQ ID NO: 137130 - protein, 158 aa, Triticum aestivum
  Clone ID: PAT_TA_31548.pep
LQLRRYAVLFEGWRSTGTRGDRWFALHDSACWEPSRRAVHRSRGLSTATAARSVLIQAVMAERRTVRLDWDRRVGTPGCYGEGVCFSSLACIFVLCLWLCVDGRLCSNQNVIVYIYIYFRRVVANCLIISYVHSLNIDMVSNPAKKKVSQSWRDYSGS

SEQ ID NO: 137131 - protein, 425 aa, Triticum aestivum
  Clone ID: PAT_TA_31549.pep
MLEGQSCLISRSLPSSCEQESRLAYMTYHLLEITRTKRPSGVLAIEHDGIAVAAVLAKRPKSEDSHDAVPVDCQGGNQGYSDSSTLISSIGRDNSINCLARCSRSDYGSIASLSRNFRSLVRDGGLYRERRRLGIAEHWVYFSCNVQEWEAYDPYRERWMTLPRMPPNECFMCSDKESLAVGTELLVFGKEILSHIGLSYSILTNSWSRGVEMNAPRCLFGSASFGEKAIIAGGMDSFGSVLSSAELYNSETKSWVTLPSMNKRRRMCSGVFMDGKFYVIGGMASNTEVLTCGEEYDLEKGTWRLIENMSEGLNGASGAPPLVAVVDNELYAAQYAGKLVRKYNKSDNTWTTLGELPERPEAVNGWGIAFRGCGERLLVIGGPRVLGGGMIELHSWIPREGPLQWNMIGSKPSGNFVYNCAVMGC

SEQ ID NO: 137132 - protein, 256 aa, Triticum aestivum
  Clone ID: PAT_TA_31550.pep
TDSVLLVDQAAYNACNTTTYVSKFQGGSTVFTLDRSGPFFFISGNEASCKAEQKLIVVVLSVDHTPPGLLPPPPPPSMPPSSAPPMPSPMSPPSMTPPSAAPMPSPMSPPSMTPPSAAPMPSPMSPPSMTPPSAAPMPSPMSPPSMTPPSAAPMPSPMSPPSMAPPSSEPMPSPMTPAAAPGTTPVSPASPAGPAPSPGTPGGGSSPGTPGSDTSSPPAPAADGANSTTPGSAAAPVTAGLIGTLAAGIGYAMLAI

SEQ ID NO: 137133 - protein, 66 aa, Triticum aestivum
  Clone ID: PAT_TA_31551.pep
WPKSKPTRGPQVGPTRPGFDMVRGPSAGTPSFGKLFWRTEKLHISVGATLSLGEKVIHYFFLWWLL

SEQ ID NO: 137134 - protein, 118 aa, Triticum aestivum
  Clone ID: PAT_TA_31552.pep
FRRLAFRVSETEVARARNQLKSSLLLHFDGSTAVSENNGRQMLTYGRVMPFLELFARIDAVDCDTVMKTAKEFIIDKDVALAAVGPISNLPELSWFRSQTVSDDKFTSRVFSLFAQNN

SEQ ID NO: 137135 - protein, 229 aa, Triticum aestivum
  Clone ID: PAT_TA_31553.pep
MASSSSFLLLAVLLALVSWQATASDPSPLQDFCVADMNSPVRVNGFVCKNPMKVNADDFFKAATLDKPRVTNKVGSNVTLINVMQIAGLNTLGISIARIDYAPLGQNPPHTHPRATEILTVLEGTLYVGFVTSNQPAPNRNKFLSKVLNKGDVFVFPVGLIHFQFNPNPHQPAVAIAALSSQNPGAITIANAVFGSDPPISDDVLAKAFQVEKNTIDYLQAQFWENNHN

SEQ ID NO: 137136 - protein, 230 aa, Triticum aestivum
  unsure (1)..(230): unsure at all Xaa locations
  Clone ID: PAT_TA_31554.pep
MASSSSFLLLAVLLALVSWQATASDPSPLQDFCVADMNSPVRVNGFVCKNPMEVNADDFFKAAALDKPRVTNKVGSNVTLINVMQIAGLNTLGISIARIDYAPLGQNPPHTHPRATEILTVLEGTLYVGFVTSNKPAPNRNKFLSKVLNKGDVFXVFPAGLIHFQFNPNPHKPAVAIAALSSQNPGAITIANAVFGSDPQISDDVLAKAFQVEKNTIDRLQAQFWENNHN

SEQ ID NO: 137137 - protein, 234 aa, Triticum aestivum
  unsure (1)..(234): unsure at all Xaa locations
  Clone ID: PAT_TA_31555.pep
MASSSSFLLLAALLALVSWQATASDPSPLQDFCVADMNSPVRVNGFVCKNPMEVNADDFFKAAALDKPRVTNKVGSNVTLINVMQIAGLNTLGISIARIDYAPLGQNPPHTHPRATEILTVLEGTLYVGFVTSNQPAPNRNKFLSXKVLNKGDVFVFPVGLIHFQFNPNXPHQPAVAIAALSSQNPGAITIANXAVFGSDPXQISDDVLAKAFQVEKXNTIDYLQAQFWENNHY

SEQ ID NO: 137138 - protein, 353 aa, Triticum aestivum
  Clone ID: PAT_TA_31556.pep
MDNNCADVDYNSEDRVEHGDTFLSSSSELIPDLNSNHFASMASTHSSHSVSIESLADSIADAKNKKNDLLPSLELVTKMIEDVELLEEKAKVAKRESSISGTSILTKVEELKEMLNHAKEANDMHAGEVFGERSILTTEARELQSRLQRLSDERNSYLVVIEEIRQTLEERLVAAQQEYEAAVKEKDEKEASAQALLSEQEKEMNSIVEESRKLQKEAEENLKLKEFLVERGRIVDTLQGEMAVICEDVSQLKQIVDERLSWSKLQRSTMSSLSSSLHSSLHRSASSSDRTTEAVESKDKHTVAEVARPVAEDPDVDGRKVEMLDGCDSEGASSVGEDNSKQRGSNEDGWELC

SEQ ID NO: 137139 - protein, 325 aa, Triticum aestivum
  Clone ID: PAT_TA_31557.pep
SHPATLHQILATYILSKLQESTSQRKKCARARVKEERRMNPTKNSGRGGEFDIPSNNPHGNRAERIQKNIDTIGSRSAHGTTTSILPGTCRGRHTVGHRCARPPPPRLPHRPADLASNRASPASPVAQPPTGELHHHGTGMPSPPPTQAGPRLDEALAFSGSTRADEAARDHRPDLGGHAQVAEAVDVRIEPKPTQGSDTGLAARSGDAAPKRHPWRPLVVPHRQGGLLPWPPPATTPAHAEEWAATWARGTAGGLAARRGDGGRERRAGRRHGVGHWQGGVVGWAPPATTVAHSGKARPSCSWARSGWMKKRRWNGDVCCVRPR

SEQ ID NO: 137140 - protein, 224 aa, Triticum aestivum
  Clone ID: PAT_TA_31558.pep
MARALLRRRGALSSLLSPAAPTAPSLLPSFSSAALAQLRSPLDERLLRLLRSEISYVADRRPPHQPPTGFKSFAVEDRPGEQWVRLRAARRGAGVGAEEEAIKIDATLFDGVAELPPDASLFNRVEALEQGPRLHLSLIVEVARADRVLGFICSAWPDNLTVRHVLTLRGAGAATDDRGARDFTKLEPAEREAVKKFLQEREVDAELAEFLHDYVANKERMEML

SEQ ID NO: 137141 - protein, 120 aa, Triticum aestivum
  Clone ID: PAT_TA_31559.pep
MARAAAANIVVVAVVAAMLLAAAHTADAAISCGQVNSALGPCLTYARGGAGPSAVCCSGVKRLAAATQTTVDRRAACNCLKMAIGRMSGFKAGNIASIPSKCGVSVPYAVGASVDCSRVS

SEQ ID NO: 137142 - protein, 128 aa, Triticum aestivum
  Clone ID: PAT_TA_31560.pep
MGFLSLLVVASMPIVQVLLIGVIGAFLASGYSKVLTASARRDMNKVVFTVFTPSLIFANLAKTVTLSDVISWWFMPVNIAITFLVGSALGWLACKILKPPPHFRGLIMAFCSAGNLGNLLLIVVPAVC

SEQ ID NO: 137143 - protein, 114 aa, Triticum aestivum
  Clone ID: PAT_TA_31561.pep
SRPRRGPLQRRVGGVSAEIKANNLVGEESPTVPQQSRRRMENLFCNLEGEIPSDLYGVEPIGTEGAITSTDSVVCDLEENTGIGEDVSLLPNVLVIYSPGLESSERNQGVHPYH

SEQ ID NO: 137144 - protein, 243 aa, Triticum aestivum
  Clone ID: PAT_TA_31562.pep
VHRDIQASSVLLDDKFEVCLGSLSEICLQPSDGSRSFFSRMLRSSKSLDKNMSGPPASRTYDIYCFGKVLLELITGKFGVSGSNDTDSEEWLASTLDYIETHDKENVINIVDPSLVVDEDHLEEVWAVSIVAKTCLNPKPSRRPLARYILKALENPLGVVREELFSSPSSARLTSTSSRSSWRSAFHGHSYQYSEVQTSGKVLTCRQSAKSEGSDEEENSFSFKKASQEMLPDPVELEDRAVV

SEQ ID NO: 137145 - protein, 78 aa, Triticum aestivum
  Clone ID: PAT_TA_31563.pep
RLQTRRQNRRGRSWDRWNKSPAWWLGSSGASHGSTGVRVSFTRFCMSVNHVRYACVCTCFCLSVNSFQLHVCNLCHQN

SEQ ID NO: 137146 - protein, 91 aa, Triticum aestivum
  Clone ID: PAT_TA_31564.pep
PAVPAGAGGRTAAATDATGTEGAPGATYTDMIKSAAAGTTEYGKKLASTVTVYEKVAGVGTAVASKAQQVTTSAGTAVLHGAAPTTNTNVV

SEQ ID NO: 137147 - protein, 92 aa, Triticum aestivum
  Clone ID: PAT_TA_31565.pep
PFPSQVSGGSTQHLRYCGYRTKASAATTQKDPTQVNRVLMQNLNKTGKAYLAHPVVGDKFVLRFAIGSSLQEDRHVRSAWDLIKKTTSNIMD

SEQ ID NO: 137148 - protein, 113 aa, Triticum aestivum
  Clone ID: PAT_TA_31566.pep
MANSASGMAVSDECKLRFQELKAKRTFRFITFKINEQSQQVVVDRVGQPGETYADFTATIPADECRYAVFDFDFVTDENCQKSKIFFISWSPDTSRVRSKMLYASSKDRFKRE

SEQ ID NO: 137149 - protein, 121 aa, Triticum aestivum
  unsure (1)..(121): unsure at all Xaa locations
  Clone ID: PAT_TA_31567.pep
QEQKRKLSFRVIKINIKVQQEEVERDGVEHPGEADVAVSLPVHDYHYPLSVFDFVSVTNGKXRKSTVISCTSSPSTVRGRSQMLGASSRYRFKRELDEXQLEVHDTEPSDMALDNVKARAL

SEQ ID NO: 137150 - protein, 159 aa, Triticum aestivum
  Clone ID: PAT_TA_31568.pep
EFMSTLVNYKIPLAVASRRPRKAVEAAIEAVGARGFFDAVVAAEDVYRGKPDPELFLYAAQLLGFIPERCVVFGNSNSAVEAAHDARMKCVAVASKHPVYELGAADLVVKRLDELSIVDLKNLADIDSPEFGMEPEPEMEEEEDEAPPSTAVGVDDIFL

SEQ ID NO: 137151 - protein, 230 aa, Triticum aestivum
  Clone ID: PAT_TA_31569.pep
MDPDEVKSKLQGLAFGNVLAAAARDYKKEVIAKEKAQAAPAIHDEVDLDELLDDPELEKLHAERLAALKREVEKREVLKRQGHGEYREITEGDFLGEVTRGDKVICHFYHREFYRCKIMDKHLKALAPVYLGTKFVKLDAENAPFFVAKLAIKTLPCVILFKKGIAVDRLVGFDDLGSKDDFSTRALENVLKRKGIIEEKKKDDDEEDDETDMSKDRRVRSSTAYGSDSD

SEQ ID NO: 137152 - protein, 151 aa, Triticum aestivum
  Clone ID: PAT_TA_31570.pep
ELGSRHSVTGVQTLYHADKAKTEEHILELVVLLHHLVVQVKSRGYVQNMPTKQDQSPSRKLSSEPQADTKHCMSDTSPTNNCEICPSPVSDSERHMLDPLSLRRCEPQPGRGDKAHRSHGSSPAREFVRSRSSASDRELVKHLDVIDGLAD

SEQ ID NO: 137153 - protein, 444 aa, Triticum aestivum
  unsure (1)..(444): unsure at all Xaa locations
  Clone ID: PAT_TA_31571.pep
MIKWGISSGTPADSYYEIRSDCTDDVPKSKFKIKAGKTLSVRKWQAAFNPDGCLDIVSVLSRIQKGGVHPTVRGEVWEFLLGCFDPRSTFDEREEIRQIRRLQYARWKEECKEMDSHVGSGKVITAPLITEDGRPIKDPLVLLEATSNQNTSEGASTSNHNGIEVDESAERITDKQIIEWKLTLHQIGLDVLRTDRTMVFYENKENVSKLWDILARLAWIDKDVGYCQGMSDLCSPMIVLLNDEADAFWCFEKLMRRLRGNFRCTDQSVGVANQLQHLASIIQVLDPKLHDHLETLGXGDYLFAFRMFMVLFRREVSFGDSLYLWEMMWALEYDPDIFFAACEEASGAHKKVSASWVRGVRQVADWDKDKDVSEETDGPVPISVFMVASVLKEKREKLLQEARGLDDLIRILNDVNGNLDAKKACAGALKLHKKYLKLVQAKKT

SEQ ID NO: 137154 - protein, 114 aa, Triticum aestivum
  Clone ID: PAT_TA_31572.pep
MAVDLTPRQPAKAYGGEGGAYYEWSPAELPMLGVASIGAAKLSLAAGGMSLPSYSDSAKVAYVLQGKGTCGIVLPEATKEKVVAVKEGDALALPFGVVTWWHNNPGVGNGARRP

SEQ ID NO: 137155 - protein, 322 aa, Triticum aestivum
  unsure (1)..(322): unsure at all Xaa locations
  Clone ID: PAT_TA_31573.pep
MAVDLTPRQPAKAYGGDGGAYYEWSPAELPMLGVASIGAAKLSLAAGGMSLPSYSDSAKVAYVLQGKGTCGIVLPEATKEKVVAVKEGDALALPFGVVTWWHNTPESATELVVLFLGDTSKGHRPGQFTNFQLTGSSGIFTGFSTEFVGRAWDLKEDDAAKLVSSQPASGIVKLTAGQKLPVPVDADRKDMALNCLEAKLDVDIPNGGRVVVLNTANLPLVKEVGLGADLVRIDAHSMCSPGFSCDSAYQVTYIVRGSGRVQVVGPDGKRVLETRIEGGSLFIVPRFHVVSKIADASGMEWFXIITTPNPIFSHLAGKTFVW

SEQ ID NO: 137156 - protein, 359 aa, Triticum aestivum
  unsure (1)..(359): unsure at all Xaa locations
  Clone ID: PAT_TA_31574.pep
MAVDLTPRQPVKAYGGDGGAYYEWSPAELPMLGVASIGAAKLSLAAAGMSLPSYSDSAKVAYVLQGKGTVGIVLPEATKEKVVAVKEGDALALPFGGVTWWHNTPESATELVVLFLGDTSKGPQAXGQFTTFQLTGATXIFTAFSTEFFGPARGLTGDDAAKLVSTRPPSAVMEMTAGGKIPLPXAADRKNTGRKSAAAQRGTGTSQGGRAGGRPTADRRRLHEVLVVVLLFRVAAHSLCPPQRSPDSRHPGRHTSPGGAPVQGLXPDGQRLLEAPNEGGNPFIVPRFPLLAPIAADSCMEWSASLSIPNPIPILSAGESSEREVDAPVVLKGSYTTIPDIAKHFQSKRLDSEIFLDLN

SEQ ID NO: 137157 - protein, 252 aa, Triticum aestivum
  Clone ID: PAT_TA_31575.pep
AFGAWQMIPGANVSRILARSGVDWVLVDCEHGNIDDGAMHDAVPAIAALGVSPIVRLPDMQGWMVKRALDSGAHGIVVPLLRTPEEARQLVQFAKFPPQGRRGFGSPIAPERFHPEPTFTQYLQQANNSLLTIVQIETKEALESIDDIAAVNGIDVLFIGPFDLGNAIGHPIIEGVMASELKGAIAKILAASQKAGKKTGVYCTGGEQAKVYADMGFDMMNVVTDYTSLALVAKEQLSFADGSSAPARGKGY

SEQ ID NO: 137158 - protein, 355 aa, Triticum aestivum
  unsure (1)..(355): unsure at all Xaa locations
  Clone ID: PAT_TA_31576.pep
MPGPHGSRIKVIAATSSVAAFVVLLLTVATVLYLSLKTRYNAEIHLKVEMFLKTYGTSKPTRYTFSEVKKMARRFKEKVGQGGFGSVYKGELPNGVPVAVKMLENSTGEGEAFINEVATIGLIHHANIVRLLGFCSEGMRRALIYEFMPNESLEKXIFSDDSNIFRPTGAADVSNRIAQAVEYLHQGCXSDIHHFDINATQNLARNYNFNPKIPNFGLAKLCSRDQSIVTLTAARGTMGYIAPELYCRNFGGVSYKSDVYSFGMLALEMVSGRRNTDPSVESQNEVYLPEWIYEKITTEQEWELNLEMTAEDKEKMRQLTIVALWCIQWNPKNRPSMTKVXKHANREVAEPADST

SEQ ID NO: 137159 - protein, 397 aa, Triticum aestivum
  unsure (1)..(397): unsure at all Xaa locations
  Clone ID: PAT_TA_31577.pep
MAKWTPQRVAAPAAPAPLAAAASPAQFGFSAARPALPRQAVALPPLARRFPGSSLLASPSWRRHALATEVEGVNIAEDVTXLIGKTPMVYLNKIVKGCVANVAAKLEIMEPCCSVKDRIGISMISDAEEKGLITPGKSVLVEXTIGNTSMGLAFIAASMXYKLIRTLPKSVNMDRNEHGEAXFYSIVLADDARSKMLQLEXDTEILNKTPNSYMLELIYAXPFDNPANPKLRXEIWEDSKGKVDIFIGGIGTGGTISGAGRFLKEKNPDVEKSRXKVIGVEPTESNILSGGKPGPHKIQGIGAGFVPRNLDSDVLNEVIEISSDEAVETAKKLALQEGLLVGISSGAAAAAAIKVAQRPENAGKLIVVVFPSFGERYLSSVLFQSIREECEKMEAEA

SEQ ID NO: 137160 - protein, 281 aa, Triticum aestivum
  Clone ID: PAT_TA_31578.pep
DRYVEKAHTEDITGVKFSTDGQILLPGRGRGTLKIWDLRKMKTPLKVFDGLPNNYAETNASFSSDEQLIFTGTSVEKDGRNGGLLCFFDRRKLELVSRVGISPHYSVIRSLWHPRINQVFATVGDKKEGGTHILYDPSVSQRGALVCVGRAPRKKSVDDYEVQPLIHNPHALPLFRDQPSRKRQREKMMKDPLKSHKPEAPVSGPGFGGKIGTTKGSLLTQYLMKEGGLIKETWMDEDPREAILEYADAAKNDPKFIAPAYAQTQPETVFAESDSDGEEKK

SEQ ID NO: 137161 - protein, 161 aa, Triticum aestivum
  unsure (1)..(161): unsure at all Xaa locations
  Clone ID: PAT_TA_31579.pep
SRADGGMIRGHKKAVFCLAAAGALLFSGSADNTIMVWRRDAGVHSCLSVLSGHTEPIRCLAVVEYNKENVAAAAAETGDNSGVGRWIVYSGSLDKSIKVWRVTDEPDGHAARGXPAKGSXMFDRYPGXPFGANKLEISAKGRRKTPNGAKSFLNILGRGTK

SEQ ID NO: 137162 - protein, 222 aa, Triticum aestivum
  Clone ID: PAT_TA_31580.pep
MIQLLFVVLVAEAAVATVLLFKTPLRKLAMLGLDRLKRGRRAPVAVKTVAGVVITLLASTLYSMAEISARAGDPEAGGGAALSPTDQVLFSRHLLEASLMGYTLFLALVIDRLHQYIRELRGLKKNVEAVSKQNKTLEEGKHGRSQEIAKYQEEVATLNEEMKKLKLQVQEKTEEVHVAEDKALAIQKQSESLLLEYDRLLEDNQHLREQLQSIDLRLSNPS

SEQ ID NO: 137163 - protein, 475 aa, Triticum aestivum
  unsure (1)..(475): unsure at all Xaa locations
  Clone ID: PAT_TA_31581.pep
MSGASGPLAVLLLVLVAAVSASSTGKGESWRAEQERDRVPRVPGQAFNASFAHYAGYVTVSEERGAALFYWFFEAAHDPASKPLVLWLNGGPGCSSIAFGLGEEVGPFHVNADGKGVHMNPYSWNQVANILFIDSPVGVGYSYSNTSADILSNGDERTAKDSLVFLTKWLERFPQYKEREFYLTGESYAGHYVPQLAQAIKRHHEATGDKTINLKGYMVGNALTDDFHDHYGIFQYMWTTGLISDQTYKLLNIFCDHALSAPGSGQSDTNLDIASTEAGNIDSYSIFTPTCHSSFASSRNKVVKRLRSVGKMGEQYDPCTEQHSIVYFNLHEVQKALHVNPVIGKSXKWETCSEVINTNWKDCERSVLHIYHELIQYGLRIWMFSGDTDAVIPVTSTRYSIDALKLPTVIPWHAWYDDDGEDSGXRNGRKVXNFRTLWLDRKVLPPHLPKHDLTLIKSFLAGSPMPVLSDLRSDM

SEQ ID NO: 137164 - protein, 124 aa, Triticum aestivum
  Clone ID: PAT_TA_31582.pep
IHTPAYPVVDVGTYAKIKTGEIQVLPAMKAVHGNVVEFADGKRHPFDAIVFATGYRSTTKKWLKSDDGLIGEDGMARRSFPEHWKGENGLYCAGMVRRGLYGSCEDAESIAEDISKKKKKPHQA

SEQ ID NO: 137165 - protein, 128 aa, Triticum aestivum
  Clone ID: PAT_TA_31583.pep
PVMLILLIFFPPRAPSMPPQPQHPEPPATISLSSVAHVLPGHLRDRVARLDEVAEIHALTLPHVPPPRKKNQEKGSDMWIWDSMRISFLMRHGDVVLRRRQIGRNGGCAGGAWWGIVRGEGERVPRAE

SEQ ID NO: 137166 - protein, 286 aa, Triticum aestivum
  unsure (1)..(286): unsure at all Xaa locations
  Clone ID: PAT_TA_31584.pep
THASGRRGRTRRHKYPSKAAGHPAIRKKVGDGKQCDRQYTPCGCQEMCNKNCPCVENGTCCEKYCGCCKSCKNRFRGCHCAKSQCRSRQCPCFAASRECDPDVCRNCWVSCGDGSLGEPPERGDGYXCGNMKLLLKQQQRILLGKSDVAGWGAFIKNPVHKNDYLGEYTGELISHKEADKRGKIYDRANSSFLFDLNDQFVLDAYRKGDKLKFANHSSSPNCYAKVMMVAGDHRVGIYAREHIEASAELFYDYRYGPDQAPAWARRPEGAKKDEASGSHRRAHKVA

SEQ ID NO: 137167 - protein, 330 aa, Triticum aestivum
  unsure (1)..(330): unsure at all Xaa locations
  Clone ID: PAT_TA_31585.pep
VDPRVRADEGGAGAEPVERRGEAGGRDRRRERVQRGARAVVQGVQLHRSEAPRRRRQGGGGGQGGAVGRVQGERGEPAVPAAXASAEEEADEPLAALLDRVAARFGPVFEQLQESQESESYRGTIRRHVDLEAMRRKLDGAAGYASSAELYRDLLLLCANAAVYLPRHAPDHAAAALNALRLVSAQVSASLRESPTKREPPSGANPPPAPAVGLDPRRAEADIVGPLIQKAAKPLIFCRKRSSIAKAAAAAAVARKEEAAEKRDVEEEAESDGEKKAAVAAAAKGKAWGTGTKKTRGPGKNSALSRKKAAAAAEEAASAAAEKKDNGDSD

SEQ ID NO: 137168 - protein, 152 aa, Triticum aestivum
  Clone ID: PAT_TA_31586.pep
LHQAWWWQTLQVEGCSASAKWGVDFCSAHRKSMLGEGDTADGAPKPKRRAKKSGAKKAERAKRAKKTADPAGPSSEDVTMPAVISADMPEMGAIHVAAPVPDRPKSPETAIALEQPPLQLQQPPPLQSPAPSGLAASAEEGLPATGSVFFGL

SEQ ID NO: 137169 - protein, 195 aa, Triticum aestivum
  unsure (1)..(195): unsure at all Xaa locations
  Clone ID: PAT_TA_31587.pep
LFSARRKDFWLLHTAKRVLKEFIPSLCHDADGLIFQGWDDPYVTRTHEGLLKWKYPESRXVNSVDFLFEVGNDNRQLVFLCERGKKKLMDGSRMVFPNGEDPSSISGRIVECSWNKEQQCWVCMRVRFDKSTPNDINTYRKVMRSITDNITEDKLLEEITEIISLPMYADRKKADERMAHAKMAQHRRRGQMPPQ

SEQ ID NO: 137170 - protein, 89 aa, Triticum aestivum
  Clone ID: PAT_TA_31588.pep
PTGNRYIAPPNLAAKLITKRLYAEEAEWKNWVWHSEGDLMLNDAVFADSGGPNQRKFEKDDLIPPKPGSYVTRLTRFAGCLPCKPGKPC

SEQ ID NO: 137171 - protein, 378 aa, Triticum aestivum
  unsure (1)..(378): unsure at all Xaa locations
  Clone ID: PAT_TA_31589.pep
NNHSECLENALGYTLPSXICNQLTXSGKXYQYRSEIIQTFNKTXQWKKRGXSFVPIVHKVLSRPTPGKVSILNDGSIVVEVGGIELGQGLWTKVKQMAAFGLGQLWADRSQDLLERVRVIQADTLSVVQGGWTTGSTTSECSCEAVRLACNIMVDRLKSLKEQLQEKHGKVSWDGLISQAKMAGVDLSAREYYIPGASGSYLNYGAAASEAEIDLLTGATTVLRSDLIYDCGQSLNPAVDMGQVEGAFVQGIGYFMSEEYVTNTDGLVVSDGTWTYKIPTVDTIPKQFNVELRNSGFHKKRVLSSKASGEPPLLLAASVHCATRDAIAAARKELHCCGSGPSSPSFFELEVPAIMPVVKELCGLDNVEKYLETLVGSK

SEQ ID NO: 137172 - protein, 143 aa, Triticum aestivum
  Clone ID: PAT_TA_31590.pep
MVLRRFAWPFGGQRASFCGSFTGWRECPMGLVGTEFQVVFDLPPGLYQYRFLVDGVWRCDDTKPIVRDEYGLISNEMLVTLVENNTHPAVQLEPPPIRRMNLDEGTILTTMPPEPPSRNSGMQIAVFRHRVSEILLHNTIYDG

SEQ ID NO: 137173 - protein, 355 aa, Triticum aestivum
  unsure (1)..(355): unsure at all Xaa locations
  Clone ID: PAT_TA_31591.pep
MVHRRFSWPFGGQRASFCGSFTGWRECPMGLVGTEFQVVFDLPPGLYQIAILDARLPVKQAFNIMHDEGLALVPLWDDGQETVTGMLTASDFVLILRKLQRNIRVLGHEELEMHSDSAWKEAKLQYYGGXDVAGMQRRPLVHVKDSDNLRDVALTIIQNEISSVPIFKSSTDISGIPLLNLATLPGILKFLCSKLQEQPEGYPILRNQISSIPIGTWSQHTGRASTRQLRTSGLSAPLITCLDFLLEDRISSIPIVDDNGSLLDVYSLSDIMALAENDVYACIELEQLTVENALELQYQVNGRRQCHTCLSTSTLLEVLDQLSVPGVRRLVVIEPMTRFVQGIISLRDAITFLLG

SEQ ID NO: 137174 - protein, 234 aa, Triticum aestivum
  unsure (1)..(234): unsure at all Xaa locations
  Clone ID: PAT_TA_31592.pep
TVQDAXIIDPANPPEVAPILKDAIQAGKINLTAIVNTHHHWDHAGGNKKLLAELGTPKLDIIGGKDCEGVTKTPGHGETFKLGDITFKGVHTPCHTQDSICFFAQDGNDKAVFTGDTLFIGGCGRFFEGDAKEMHKALNERLAALPDDTVVYPGHEYTKANVQFAASISKKEAGHCLHSFAENNKVTTGKFTIGDEKEHNVFMRVEDPEIQKQTGETEPVAVMAKLREMKNNFK

SEQ ID NO: 137175 - protein, 194 aa, Triticum aestivum
  Clone ID: PAT_TA_31593.pep
ETSCLWHYFQIQLQEHSVSDILHILKHAGVGVLSFRRAPNLGKLARATRIPVPGYSGSSLAHHDKPSVGICRTQLPTFGVHRGAVLCYHSAAGFAVRAGPFFVFTAVASRRLSSSGRGLDIDTPPEWPRGAARPRRWPRHLRHLRDDVAAISSAGLYIDPSPERPRETTHPRRRLRPLRHHCCDADRPSQLRVA

SEQ ID NO: 137176 - protein, 189 aa, Triticum aestivum
  Clone ID: PAT_TA_31594.pep
CGGWQGGRGGDGDGDGDGGDRGATDAHYRRMIRANPGNSLPLGNYARFLKEVQGDAARAQEYYERAIVANPGDGDALAMYAGLVWETSRDAERADAYYNRAVQAAPDDCYVLGSYAGFLWGAEGEDRLNDGGAPPGPPSFYGGVLHSYISCVIVNERTNLNCRMNKRHPNSARKREMPPCGRRPGRGRP

SEQ ID NO: 137177 - protein, 212 aa, Triticum aestivum
  Clone ID: PAT_TA_31595.pep
MRQGGGGGDGVSPGNVPVCYYGAGGRVSATLERRVRAAEVLLRCAACGLAVLAAALLGADRQSRTFFSIQKVARYTDMQSLVILVIASGMVACYSLLQGARCLVSIIRGGILLNRPLAWAIFSCDQVMAYVIIGAVAVAMEAALLGKTGQVEFQWMKTCELYQRFCTQAGGGVACAVAASATMPGVARVSRFNLLRLYRHSRGSSKRTQSPS

SEQ ID NO: 137178 - protein, 329 aa, Triticum aestivum
  Clone ID: PAT_TA_31596.pep
MRASLASYAQDLAMPALDVMPEKAHQPAMSPSHHGHGWDASGAPTPMHKRLDGKVAIVTGGARGIGEAIVRLFVKHGAKVVIADIDDAAGEALAASLGPHVAFVRCDVSVEEDVERAVDRAVSRYGRLDVFCNNAGVLGRQTSAAKSILTFDAGEFDRVLRVNALGTALGMKHAGRAMMARRYGSIVSIASVAGVLGGLGPHAYTASKHAIVGLTKNAACELGAHGIRVNCVSPFGRVLINAWRQGHDASAADDADADIGLEVAVPSDQEVEKMEEVVRSLATLKGSTLRPRDIAEAVLFLASDDSRYVSGHNLVVDGGVTTSRNLIGL

SEQ ID NO: 137179 - protein, 145 aa, Triticum aestivum
  Clone ID: PAT_TA_31597.pep
PCPSIGPTSSETQHVVDGHPLGRQLAHRRTGYQQSQSGLLPVQTPDLHRPSPEGTRAGPDLGCQDCQQTPPAPGTCQPHPVGTPFLLRPSVSSFTVEHTRWRRHPLQRPRRTLSPFGFPRRRGASRRNHGKRIVFLVFSSDAWVD

SEQ ID NO: 137180 - protein, 169 aa, Triticum aestivum
  Clone ID: PAT_TA_31598.pep
PFEESTFQGPQVTKAQYERILSFVDVGKKEGAKLALGGQPFKVGDGKGYFVEPTVFTDVTPKMRVFQEEVFGPFVVVTKFSSEDEAIHLANDTQYGLGSALFTTNLTRAHQVAKRIEAGMVWVNSSNDSDWRIPFGGVKQSGIGRELGEAGLAAYSNIKAVHVNIAAKL

SEQ ID NO: 137181 - protein, 102 aa, Triticum aestivum
  Clone ID: PAT_TA_31599.pep
VVRIGYNTILFQPMDCANCRPSFRTVASADKTSTWRSIFQFQAATKIPLASRITAADAPARRSTSEAASTFNFTWPRGGLIQPPFLFFTVGVCCCSLICSKS

SEQ ID NO: 137182 - protein, 181 aa, Triticum aestivum
  Clone ID: PAT_TA_31600.pep
NTTNTNTFMCTDTKTGIGTYICSNAKSNVSASIRTNTSTTVCTATKTIIGTYICSNTYICSKTSTSTNTFMCTDTKTGIGTYICSNASSNVSAPIRTSTSTSTSTATKTSIGTYICSNTYVCSKASTNTSTSASIRTNTNISTNRFMCTDTKTSTTISICTGTKTSIGTYIWTLLAPPMPN

SEQ ID NO: 137183 - protein, 78 aa, Triticum aestivum
  unsure (1)..(78): unsure at all Xaa locations
  Clone ID: PAT_TA_31601.pep
PAPAPAPAPPFAPTPTXAPIDLCARTPRPAPPFPFAPAPRPALAPTFAPTPTFAPMPAPAPAPAPPFAPTPILAPTDF

SEQ ID NO: 137184 - protein, 475 aa, Triticum aestivum
  unsure (1)..(475): unsure at all Xaa locations
  Clone ID: PAT_TA_31602.pep
ECPSTRREADLRYVGKTEVVDDKGVKXDRQELQARVASNYNLLLESDRLPRSLLPDHQMQARAHLRDTEPFEHAFGPKGKRKRPXLSSRDYESRSXKADDCQGAYEGKNACLGLGERKGMGACAGRCGHVIIGANXMPMKVLVAVLKEVLVLVRMESLKGEWALEDILGPREVXQSVKSNVVVFSQGTDTVVCLINISDLILVWTTNVRMSKSIQGQYXISFHLSINKXFKKLSRLSIVRHMTCLKYDKIVIFFLFFGYPNVGNSSVINTLRSKPVCKVAPIPGETKVWQYITMTKRIFLIDCPGVVYQNNDTETDVVLKGVVRVTNLDDASEHIGEVLRRVKKEHLQRAYKIQDWADDNDFLVQLSKMSGKLLKGGEPDLTTAAKMVLHDWQRGKIPFFVPPPQQNEDGPSKITEPVEGSGEEVVSSDRAAAAMKAIAGIISSQQTMNVPCQKELGRNGEDSELPEQSDLLVKE

SEQ ID NO: 137185 - protein, 434 aa, Triticum aestivum
  unsure (1)..(434): unsure at all Xaa locations
  Clone ID: PAT_TA_31603.pep
MKVEVVDTTLVTPSEPTPRHTLWLSNLDLAVPKTHTPLVYYYPAPPAGDGDGEKGERXVFFAPERLREALARALVPFYPLAGRMATGPEGRLEIDCNGEGALFVVARADFTGDEMFRDFEPSPEARRLLVPFAASGDPPCLLAMVQVTFLKCGGVAVGTGMHHVTMDGAGAIQFIRTWTTLARGLDAASVHPTPPVHDRTVLRARSPPHATFEHPVYSPSNLNGLPRPFVTRVYAVSPKLLAGIKSSCAPGVSTYCALTAHLWRAMCVARGLAPDAESRLRVPANIRQRLRPPLPANYFGNAIVRDLVTVRVGDVLSQPLGFVAERIKRAXARVDDAFVRSVIDYLEVESEKGSQAARGQFMPETDLWVVSWLGMPIHDADFGWGCPKFVAPAQMFGSGTAYVTQAPDKDDGVSVLFALEPEYLQCFEKAFYGE

SEQ ID NO: 137186 - protein, 147 aa, Triticum aestivum
  Clone ID: PAT_TA_31604.pep
RSSAAVIPTIRRRSLPHPPPLPAPSTAAAHRIQPLLHPSTSVPPYHLSPRSSLLDHMRRRMLPVVWPSAVRFSNKDLAVCVPFIVLPPAPIPPLPPIVMSGTGALLSCGSDAYGDNNVLLCPSTLRTADARKYAEKISLRSANSSMS

SEQ ID NO: 137187 - protein, 167 aa, Triticum aestivum
  Clone ID: PAT_TA_31605.pep
AESFVVIGRGQRKMICLRNSADRNMKKYPSTPIILKNEKRLNATLEEGTSETCQQLSSSSEDLSEDEQNINPDVDGAYVFDSHLYKCRTEVEALLVCYLSCPLPLSHFESLYEQRYKKTLDYQSCGVDGLEELLNKLKDVVELNVNEISNMKFIKAKSPKCSPSKPC

SEQ ID NO: 137188 - protein, 117 aa, Triticum aestivum
  unsure (1)..(117): unsure at all Xaa locations
  Clone ID: PAT_TA_31606.pep
TPNAFIALPXGYGTLDELLEVXSXWAQLXHPXPKPVGLLNVDGYYDFLLAFIDKAVDDGFIRPSQRHIFVSAPDASELVHKLEEYEAVQDEDPATPKLRWEIEQVGYNATLHAGIAR

SEQ ID NO: 137189 - protein, 59 aa, Triticum aestivum
  Clone ID: PAT_TA_31607.pep
DAWVEFQWMKTCELYQRFCTQAGGGVACAVAASATMVGVALVSAFNLFRLYGHGKGSSK

SEQ ID NO: 137190 - protein, 75 aa, Triticum aestivum
  Clone ID: PAT_TA_31608.pep
IIGAVAVAMEAALLGKTGQVEFQWMKTCELYQRFCTQAGGGVACAVAASATMVGVALVSAFNLFRLYGHGKGSSK

SEQ ID NO: 137191 - protein, 221 aa, Triticum aestivum
  unsure (1)..(221): unsure at all Xaa locations
  Clone ID: PAT_TA_31609.pep
TMQYEXGTFRISXWADIVTVHVVPGPGIVXGLKLKGLPKGKGLLLVAEMSSXGNLAHGDYTATAVKFAEQHSDFVIGFLSVNPASWPAPAPSPAFVQVVDPXLMLIAGGRILLGQQXYDTPHXVVNERGAADVIVVXGAGFIRGRADPAGAAKEYRARGWRRPYPDQLVVKLKLHRIHLLAVLLNPCKKWGFQAGDGCNNKERGSIVRGASPGPSYQKISE

SEQ ID NO: 137192 - protein, 376 aa, Triticum aestivum
  Clone ID: PAT_TA_31610.pep
FVLWKEEESQIWWNSLGVESAPALVFLKGPGAKPVVYHGTFSKSEFTEIMEEHKHQELQQLRSDTSLDLGCDARGHSRAGKEIMIWYCVIAAGRPGVELSKKRQILRKAQDQLLSAAGESATGNLENLVEVASAATALKNDRLTFVWLDGELQKKICAFYLATDYHGACGPRGFEDDNDKPEVFIVRFQRNATYEALKADKKNNLIETLQGQDTPDASQLVARYNGPDGILEINKWVSQIIKDGDTREIPYFTSKVPDLVPEETNKEWLSGTKGIRSAGKSLKERVQNSGFSFRDYLTDPRIGPALLMLACISWGTIWFKNIQSAQKTPKDEAPKDKTDKRRRPKLSTTLFGQPESSADPEPRDARQWEIEDSDSD

SEQ ID NO: 137193 - protein, 56 aa, Triticum aestivum
  Clone ID: PAT_TA_31611.pep
TGFMSMVKRDLRIRFVTMGHCHGVSQSIDTPMDPWMIYIFLLSQFIHICIRLSTPF

SEQ ID NO: 137194 - protein, 322 aa, Triticum aestivum
  unsure (1)..(322): unsure at all Xaa locations
  Clone ID: PAT_TA_31612.pep
MGRXXFDMXICEALGSAVAKXDTMLRAAIPVRQRVAVCIWRLATGEPLRLVSKRFGLGISTCHKLVLEVCGAIKSVLMPRFLQWPDEAAAGRFKEGFERSFGVPGVIGAMYTTHIPIIAPKISVAAYFNRRHTERNQKTSYSITLQGVVGPDRAFTDVCIGWPGSMPDDQVLEKSMLHQRAAAGMMHDACLVGGASYPLMDWVLVPYTHQNLTWTQHAFNEKVGDIRNVAVEAFARLKTRWACLQKRTEVKLQDLPVVLGACCVLHNICEMRREELEPEVPFALFDDDTTPETPVRSETAKQERDSIAHNLLHRGFAGTTFF

SEQ ID NO: 137195 - protein, 323 aa, Triticum aestivum
  unsure (1)..(323): unsure at all Xaa locations
  Clone ID: PAT_TA_31613.pep
MAGKGIGCLAEAMGALRVSVKPATIPRAFTRSMATQVSSSDASTETTKDTSTTQTILGSWKPIETVPVTIHNFPSLEPTALERWSVDHLYLPLRRDLLHLAVVYEGDNTRQGTASTKTRFDVHGSHRKMRPQKGTGRARMGTKQSPILRGGGKTFGPHPRDFGTHLNRKVYDKAWRTXALSYRYRQGDLIVCEDGMDLVLPTDYEMVAGKYLKDGLKEAYLKRYMTGVMSNLGLGRAAGRTLFVTGDRREALFDAMEQIPWDGRALGIEDVDVKDLLETGKVVLERSVLKELIEKHQSPLVSRVVMQGLVKGGPEAGTRVIGA

SEQ ID NO: 137196 - protein, 247 aa, Triticum aestivum
  unsure (1)..(247): unsure at all Xaa locations
  Clone ID: PAT_TA_31614.pep
KMEETSSSSDVKQGGKAGPGILGVNLGKNKTSEDAGADYVQGVHSLSQYADYLVINVSSPNTPGLRQLQGRKQLKELVKKVQDARDEMQWAEDGPPPLLVKIAPDLSKQDLEDIAAVALASKLDGLIISNTTISRPPPADAHPLAQEAGGLSGKPLFDLSTQVLRDMYIRTAGKVTLIGCGGVTSGEDADHLLRSGASLVQLYTALAYXGPTLIXPRIKGELAXCFGKKXLKSVXEAVGANXKPLKG

SEQ ID NO: 137197 - protein, 163 aa, Triticum aestivum
  Clone ID: PAT_TA_31615.pep
MHPTKPAGVTPRSAPPGAGEWRPSGVVRLLQAPAVVALAAVLAVASPAQARPAGAPPPTPPTQQKAADTAPEDTMCDVPRTLSGEDGKEAERIKHPRSREAARCTSKCVSTCVLGGAGAPGVGGPFNVRRPLVVFKEGFRSRQYCLVECSDVCNLIKDGEDGQ

SEQ ID NO: 137198 - protein, 150 aa, Triticum aestivum
  Clone ID: PAT_TA_31616.pep
AESPPTHSTYPAHPPPSFLPNPSGLSRAGGRSPVEGHVPYVHQPIKEQGRSRGPGGGVPGGRRGHGRGPRRPGPEAAVAAQGAAGPAAGPGPRGDRAAAGADRLAGGPAGARAAAAQGQERPRLRLHRRRRRVTAEHVRACFRVDGPKAR

SEQ ID NO: 137199 - protein, 114 aa, Triticum aestivum
  Clone ID: PAT_TA_31617.pep
MKNKSITVVKCDTSCTHYGCFVLCKICSDVVATTFWQRSSNASGLLTVPAVETGNRCGRDGDDDLLLLLGDTTLFRPTSAIAIAFRVEPQQVGQVRRRGVDRARQEVHQRPDAW

SEQ ID NO: 137200 - protein, 241 aa, Triticum aestivum
  unsure (1)..(241): unsure at all Xaa locations
  Clone ID: PAT_TA_31618.pep
MGESRQELVAWLNSLLQLNITKVEQCGTGAALCQVFDSIYMDVPMSKGKFNVNSEYLYIQNFKGLQNTFAKHQIDKPIPVPSLIKCKMQDNLEFLQWTKRFWDLNFPDHEYDAXSRRKGGSMPPSAAAPKPVSATTGAARRGGSTPSGGPRVAKAAGPATAALQQENATLKETVVGLERERDFYFSKLRDIELLVQTAVDEDPELEKLEDGLVKQIQTILYSTEEGFEIPAEGEVDDQETF

SEQ ID NO: 137201 - protein, 143 aa, Triticum aestivum
  unsure (1)..(143): unsure at all Xaa locations
  Clone ID: PAT_TA_31619.pep
PIFRSHGXENLKYLALSWCHLGEDEDPLGMLAPHLRNLTYLKLNNMRSANILVLSADSFPQLKTLVLKDMPHVNELKIMDGALPCIDGLYVVSLSKLDKVPRGIESLGSLKKLWLLRLHRDFKTQWDINGMHQKMTRVPEVRV

SEQ ID NO: 137202 - protein, 89 aa, Triticum aestivum
  Clone ID: PAT_TA_31620.pep
PRVRPRVRDMYIRTGGKVTLIGCGGVTSGEDAYKKIRSGATLVQLYTALAYGGPALIPRIKAELAECLERDGFKSVQEAVGADFKPLKA

SEQ ID NO: 137203 - protein, 101 aa, Triticum aestivum
  Clone ID: PAT_TA_31621.pep
SEGGNSSGASRTAVKERFRSFNLQFEEIYQKQCGWSVPDSELRESLRLAVAEILLPAYRSFQKRFGPLIENSKAPGKYVKHTPEQLELFLGNLFEGKQERP

SEQ ID NO: 137204 - protein, 377 aa, Triticum aestivum
  unsure (1)..(377): unsure at all Xaa locations
  Clone ID: PAT_TA_31622.pep
EATRAVSQKKTRAKVGKSMPTCPPTTYPDRAQLQAFXDVTGTEKLKAVAYLDSTFDRCHQGHXIMXWAPHILPVYMTPTPYAAVNVGVSLCLQDPMPPVSHSYSPYPVQARNGTVQTPTPGAGGSETDKSNKNKRKTPLKRSKGSLGSLDVVTVKDKTPPAKPLVSSSNEGSSQSESGSGSYSGGSSTNSKSGSHTKDGSEHGPANDASNKGVTAQGTAVEPTQVSSGPVVLNPMMPYWPVPPPMPGQATGVSMGVDYWGAPTSVPMHGKAVAAPTSAPSSNSRDIVLSDPVIQDEREVKKQKRKQSNRESARRSRLRKQAEWEEVASRADLLKQENSSLKEELKQLQEKCDNLTSENTSLHEKLKALDSEKPNGNL

SEQ ID NO: 137205 - protein, 182 aa, Triticum aestivum
  Clone ID: PAT_TA_31623.pep
MASPLRNGDQAAAGGRRKESRRLGTLLLVLRVAALCFSLAAAVFAATDGAVLRLAPFRFLLAANAILAVYSVFEVAAAAWEVAKGATLLPEALQLWFDFGHDQGFGYMALAAAAAAAREAALCGGGQERNISSTACLQSDIAVGLGFAAFAFLALAALATGFRLVRFLATGSRLPAGASSPY

SEQ ID NO: 137206 - protein, 173 aa, Triticum aestivum
  unsure (1)..(173): unsure at all Xaa locations
  Clone ID: PAT_TA_31624.pep
FVSRIYSTNPARIKAKKMLASQHQRVQQSLRRCPSFSFSLVVVVVVAAAGQVVLHLLRHVVLDLVLQVARPFRQRQPAQHPRRRAHRQPRPHPHPLLLRSRVTHRPVRGGRSGAVRRLRAASVGGRVPGXXXXRAGAVGGRVAGRRRGVRLLLAIPVPARAVRRRGRVGVALV

SEQ ID NO: 137207 - protein, 248 aa, Triticum aestivum
  Clone ID: PAT_TA_31625.pep
MATAGLLRREKEQFGSSPFTGQTTIESKIQALEDHIGATKVSNRRSCRWLNDRLLLELVPRLGADEIKGLFAPPPWGEELPLSAFCMTSSAAAWDVFRTIDMDVQANLLQFHMRQSCADRKNSRLDEDEEIALNAWHRIGRQTREVIKRNFLPDLLRMYEERVRAFIQDTRGDKDLLALDVQDPFQRLLLHGVCEFYNVAVETRKSPVKEYGGDRLWKTTTIRKRSGTGAPPRIPLVDLLTRKKNGCP

SEQ ID NO: 137208 - protein, 143 aa, Triticum aestivum
  Clone ID: PAT_TA_31626.pep
PSNIISVQLYKLVCSQVSCFIMDSTRKSTTTFSEFDFVNLHVALSHIAHELIQVSRVQTTTINRSEGAPVLYQMVRNGDPFRIFDYYICMPEFAAVCCAVIFGYDARLRGCIVPSFSSSNSIFLGHGVLMLICSPDDSPWEGG

SEQ ID NO: 137209 - protein, 56 aa, Triticum aestivum
  Clone ID: PAT_TA_31627.pep
AKHFNRTHRKIGAYSFASQRIHLKGDVNNNNSCYHIQLDICALIFPHHMMLLKGEK

SEQ ID NO: 137210 - protein, 157 aa, Triticum aestivum
  Clone ID: PAT_TA_31628.pep
RPLVLFTVEFDIEGGGPIKMKTKEANVDGFLTEQQENRGYFRYVAPCTFYGSPLPREVAPFAVDDSPLPSEATEEEKKKKPQFMMVFMCIPVAPGKSRVIWALPRNVGVWLDKVIPRWYYHMGPNALFDSDMYLLHVEERNFAAAGVENWHKAVYVP

SEQ ID NO: 137211 - protein, 262 aa, Triticum aestivum
  Clone ID: PAT_TA_31629.pep
SRADGPLKMKTAEADIAGFLSEQDNSGYFRYVAPCTFYGSPLPKEEKGQEKKKKKPPQFMLVFMCVPVSPGKSRVIWAFPRNVGVWLDKVIPRWYYHIGQNAILDSDIYLLHIEERNFAAAGIENWQKAVYVPTSSDNMVIAFRNWFRKHCKSQVGWAAPTVGQLPETPTKDKLMERYWSHVAQCRSCSAALKGMKALEVALQIASVAVVGFLAVAKGTLVTSVVQKAPVVSLAVLCFAASRWLASFIEKNFYFQDYVHAPK

SEQ ID NO: 137212 - protein, 418 aa, Triticum aestivum
  Clone ID: PAT_TA_31630.pep
MATTQEEQKTSVVEAVEQPSPVAAAAPAEEKTSVKAVEEPSPAAAAPAEEKTSVKAVEEPSPAAAAPAEEKTSVKAEEEPSPAAAAAEGQRRPPAATAARRAGAPASPFDFSTMMNLLNDPSIKEMAEQIAKDPSFSEMAEQLQKTVAPAPAASASARSPQEVAAALDPQKYVSTMQQLMQNPQFVAMAERLGSALMQDPAMSSVLGGLTNPAQKEQLEARVARMKDDPSLKPILDEIESGGPAAMMKYWNDPEALQKFGRAMGVGPSGAAAGAGTEAEEEEEVVAGEEGEYEEESIIHQTASVGDVEGLKKALADGVDKDEEDSEGRRGLHFACGYGELGCAQALLEAGAAADAVDKNKNTALHYAAGYGRKECVALLVDHGASVTLQNLDGKTAIDVARLNSQEEVLKLLEKHAYV

SEQ ID NO: 137213 - protein, 149 aa, Triticum aestivum
  Clone ID: PAT_TA_31631.pep
MADSLTEEQVSEFKEAFSLFDKDGDGQITTKELGTVMRSLGQNPSESELQDMINEVDADNNGTIDFPEFLTMMARKMKDTDSEEEIREAFKVFDRDNNGFISAAELRHVMTSIGEKLTDDEVDEMIREADQDGDGRIDYNEFVQLMMQK

SEQ ID NO: 137214 - protein, 335 aa, Triticum aestivum
  unsure (1)..(335): unsure at all Xaa locations
  Clone ID: PAT_TA_31632.pep
VVSRRAGARYAHGTSDLLGVQIDAAINAGNSGGPAFNEQGECIGVAFQVFRSDEAENIGYVIPTTVVSHFLNDYRKNGKYTGFPCLGVLLQKLXENPALRESLKVPSSEGVLVRRVEPTAPASSVLRKGDVITSFDGVSVGCEGTVPFRSTERIAFRYLTSQKYAGDVAQLGIIREGNVMKVQTILHPRKHLVPFNVDGGQPSYLIVAGLVFTPLTEPFIEEECEDTLGLKLLAKARYSLSTFEGEQIVIVSQVLANDVNIGYEHMGNQQVIKLNGTMIKNIHHLAHLVDTCQDKFLTFEFEDDFLVVLDREEAGRAARDPQGARAPPCEGTGDF

SEQ ID NO: 137215 - protein, 555 aa, Triticum aestivum
  unsure (1)..(555): unsure at all Xaa locations
  Clone ID: PAT_TA_31633.pep
SEAWLEEDQLNSFLHSAPVTVDENQWFHIHEVSPEWAFCSESAKVVIAGDFPSNILWVLFGDVKVPAEIVQQGVIRCYTPSYLGAGKVRMCMLDENGKPCTQDREFGFVEKPTNTMIIGNGKPYSEAREFEFQQRPTKSDNELLLLLNYVQMLFDSHGCELFSKFRLPLPNARSGFPVNPSEIIGXTCEQLDHENAVNCIMEVMLNSKFQDWLSSKFEQTSEGEYLLPKQYHGVIHTIAALGYDWALKPLLNNGVPINYRDANGWTALHWAARFGRQQMVAVLFAAGAAVGALSDPTAEDPAAKTPASIASAYGFIGISAFLSEAELTSTLHSLESQENGKPVDHNGGVSTSSAVDRVSDKCAHVDGGTDDQLALRDSLGAIRNAVQAAGCIQATFRVFSLKKKKQKALQNGDSSASPSMLERAALSIQKNFRCWKKRKEYQKVRKNVIKIQARFRAHRERNKYKELLQSVGILEKIMLRWFRKGVGLRGVAGRAKGVAPEGGEARDEDAGEEREGRAVSEAVSRVSAIVGCPVARLDYRRMLEMHQQAKIGHGK

SEQ ID NO: 137216 - protein, 124 aa, Triticum aestivum
  unsure (1)..(124): unsure at all Xaa locations
  Clone ID: PAT_TA_31634.pep
XXXXXXXXXXXXXXXXXXXXXXXXXXXXXXXXXXXXXXXXXXXXNKPMSPTPRHTPPPCPATPHQIPSNPLSTQRPFPLHTNPVHTATLSQIYQFSYIYENRKTCPTDFATFHFCCNLTPLSKC

SEQ ID NO: 137217 - protein, 476 aa, Triticum aestivum
  Clone ID: PAT_TA_31635.pep
ESRRGGGGPAAAAAAAGDPRGPMPGFGAPQHTIPTNVNVMQPSRVADLGALAHSAGFRIEDLANFSTNNLFNLKPNTHAYTSDPLQFGNYGKSISPTDLATTAAAAAAVTAVDPQALLQQKGVQPNLVALRTHNNDNWGESSMADTSPRTDTSTDPDIDIDERNQMFEQGQLAAPTASDSSDKSRDKLDHKSLRRLAQNREAARKSRLRKKAYIQNLESSRLKLTQLEQELQRARQQGIFISSSGDQSQSASGNGAVAFDMEYARWLEEHNKHINELRAAANAHAGDDDLRKIVDSIMSQYDEFFRLKGVAAKADVFHVLSGMWKTPAERCFMWLGGFRSSELLKLLAGQLEPLTEQQLTGICNLQQSSQQAEDALSQGMEALQQSLAETLASGSLGPAGSSGNVASYMGQMAMAMGKLGTLENFLRQADNLRLQTLQQMQRILTTRQSARALLAISDYFSRLRALSSLWLARPRE

SEQ ID NO: 137218 - protein, 63 aa, Triticum aestivum
  Clone ID: PAT_TA_31636.pep
FSIKWGIRGLFFFFFSFFLWGCYYNQSLMTICIDNYNEILKESNVLLLPINYLQSIKEFECFV

SEQ ID NO: 137219 - protein, 246 aa, Triticum aestivum
  Clone ID: PAT_TA_31637.pep
APSVPAQLGVTKFSYCLLSRHFDDDATVSGELVLGASSAGKAKAMQYAPLLKNAGARPPYSVYYYLSLAGIAVGGKSVALPAQAFAPVSGGGGGGAIIDSGTTFTYLDPTVFKPVAAAMVAAVGGRYNRSKAVEDALGLRPCFALPAGAKTMDLPELSLRFTGGAEMRLPIENYFLAAGPASGEAPEAICLAVVSDVSSASGGAGVSGGGGPAIILGSFQQQNYHVEYDLEKNRLGFRPQPCSSSS

SEQ ID NO: 137220 - protein, 112 aa, Triticum aestivum
  Clone ID: PAT_TA_31638.pep
LSRARPWYSFSAPLHKVEGRAIHYHIADDKGDVDDDIERRSFTFNGSNLEELTQKLQEETGIDDLIVCTRSPISGKLTPLLLQLPPNNAAMHIVLVRESSKVAKTFPWPYGS

SEQ ID NO: 137221 - protein, 152 aa, Triticum aestivum
  Clone ID: PAT_TA_31639.pep
SFKVSFCCLLFVQFIYSWDLKYCPVFDKLETLLINEWFTTIDLPCILQHSPILETLTLQLGDTKELVRATGAEEKIEQSFLCSNLKVVNIECRKVDEGVHKILKILSTCGILRDQISITEQWPYSDRFSFQKPLPLLPSTAALVAVSTSDDT

SEQ ID NO: 137222 - protein, 385 aa, Triticum aestivum
  Clone ID: PAT_TA_31640.pep
MEGGGARNVSAAAAQTEGSGDDGSRKPLPPCCVKAQAAVAESEAKCHATVVSGWFTGTRSRSGKPSKAQYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVETIDICEIDQLVIDVCKDFFPRLYVGYKDPRVRLHVGDAVEFLRNSPEGKYDAIIVDSSDPIGPAQELVEKPFFQTIARARMWLHTHLIQDMLSICREVLNGGVLYACREVFKGGVHYAWASVPTYPSGVIGFLLCAKDGPPVDFLTPVNPIEKIEGATKDGREMRFYNSEIHRAAFILPTFVKRELEAYSTSTEKEKPEKPTAKPVKMKVMRDSAITAS

SEQ ID NO: 137223 - protein, 204 aa, Triticum aestivum
  Clone ID: PAT_TA_31641.pep
DPDKENLCLYGHPDGTWEVSLPAEEVPPELPEPALGINFARNGMNRRDWLSLVAVHSDSWLLSVAFFFGAPLTANERKRLFSMINDLPNVYESMVDRKHRDRSGVDSSGKSRHSSKPKQRTDDVRPKNSRAVAREEDEDEDEEEHSETFCGSCTGIYNASEFWIGCDMCERWFHGKCVRITPAKADHIKHYKCPECSSSKKMRQ

SEQ ID NO: 137224 - protein, 97 aa, Triticum aestivum
  Clone ID: PAT_TA_31642.pep
HASGPRGCARCYEASPNRNCIWNFMCTAVWWGKFCMFLKINTLICQFSQASGLLGPNVGMLRSGDEFMLPEYVNAVGIVFSGMRVYLCNRYATMDAN

SEQ ID NO: 137225 - protein, 141 aa, Triticum aestivum
  Clone ID: PAT_TA_31643.pep
GKRPTKASIVPYEDDAPASSMCFLPSQSLEPSTMKKRKHDNSITGASKSQMLEKTTKEKGKGSKSGSGVAKRSRTQPICVANKKASVVLKLHAKRKSKEVADKLPHLPMVPHDNPAMGTRSKKMNPSSPAMSTRSKRRLSL

SEQ ID NO: 137226 - protein, 206 aa, Triticum aestivum
  unsure (1)..(206): unsure at all Xaa locations
  Clone ID: PAT_TA_31644.pep
LTSSNELALLPKNKKREIPGRRLGRRGGAALSIREECERFFCESMKTTFRGERNSSMNGSGLSGAFFTNAAXDDRLPEHFKPVSDEKLPAYDVTAWLEMWDYAGGASFRAFVADDGEEKSLFVFFDIEGVLGRDLKKALMALIELADGPLDCAHIVTCIDRRIPADDVYSLSKSLQWVGFDMATLDHWARDLDVTSKKWMLMGMEL

SEQ ID NO: 137227 - protein, 184 aa, Triticum aestivum
  unsure (1)..(184): unsure at all Xaa locations
  Clone ID: PAT_TA_31645.pep
GKAVFKNLGTLAFWSXLVCTTVSAGILSFSAVATGNATSPFTFYATGLAIVAAFMPVFRSFGYIRLSKTLRRTATEPEKAPPRAAVVKNLRNSIVLSVVGMGAAVLGMQATVGALVAKALTTSSVPYYQGISAGQSPVLALDVFLVQASANTILSHFLGLSSSLELLRSVTISPADASPVPRPA

SEQ ID NO: 137228 - protein, 319 aa, Triticum aestivum
  Clone ID: PAT_TA_31646.pep
MLRQVKPRNARSKRALEKREPKANENPKTCLFLRGTSCSQIVQDALNDLHQMRQPLAKKFTKKNAIHPFDDAASLEFFSEKNDASLLVFGSSQKKRPHTLTLVRTFGYKLLDMLELYLDPESFRTIAQFKTKKFAIGLRPMVLFAGTAFESPVSNEFTLAKSMFLDFFRGEPADKIDVEGLQYIISISAEDSTGDGDAKPAIHLRVYTINTKRSGQRLPRVEVEEIGPRMDFRIGRVREPDESMLKEAMKTPRGLDERTKKNITTDSMGDKIGRVHLGKQDLSELQLRKMKGLKRSRKDAEDVTDVIEEKEEETKRIKQ

SEQ ID NO: 137229 - protein, 79 aa, Triticum aestivum
  Clone ID: PAT_TA_31647.pep
FRREPGNHNVLSSGLRVNDVVLWTNAAKIKTCQLLIQTTRHLRYVHVHCVLLRQWKKWSCFSPHFIPLLNHDFRTTCRM

SEQ ID NO: 137230 - protein, 207 aa, Triticum aestivum
  Clone ID: PAT_TA_31648.pep
PRCDYYKPTTLEGDIQYIFFFDKLVELTRYRETRDMVFARAIAIARSGFRKMLFFQIKIGVDQCLELMLRGEKMWQRKELYYHIVYETVFGNNKREDVIKHIQEGQVQLFYDLIEFARLDVDDYKVIVEETLDHLVELSRAKLPSKESIKNGAYKKMISEELNKLFPRRTRLYTHFLKKKIDTAEKYGLISEGASKDLDKRRCCFKP

SEQ ID NO: 137231 - protein, 200 aa, Triticum aestivum
  Clone ID: PAT_TA_31649.pep
LKSDGTKFGKTEDGAIWLSSKMLSPYKFYQYFFSVPDVDVVRFMKILTFLSLDEIHELEESMKKPGYVPNTVQRRLAEEVTRFVHGQEGLEEALKATEALRPGAQTQLDSQTIEGIADDVPSCSLRYDQVLKSPLVDLAASTGLLASKSAARRLIKQGGLYLNNMKIDSEDKLVEEGDIVDGKVLLLSAGKKNKMVVRIS

SEQ ID NO: 137232 - protein, 304 aa, Triticum aestivum
  Clone ID: PAT_TA_31650.pep
EAAASPLSPASHSTPPSPLPDLPTTRPRAPEKRSETAARGKTAKGERPPQLAYRRWVGGGVRHASAYQVMDAGGGGLGGFQWTAEEASTIGGIATVSLLHSFIPTHWLPFSIVGRAQRWPLSRTLLVTAFGAVLHVVSTALLGITAVTMANTIAGEETVHKLASLLLIFLGAGYILLFALGKGGHSHAHNHPMEKMAVAGLVLVPALSPCATTLPVFLAVGNSSSMMILAIIVLLFSTITVMTSLVALSFYGASQIKFHWVERYDKVLVGSVLCLVGVLTYVFHHHDGDEHSLHAHVHRKLVGP

SEQ ID NO: 137233 - protein, 48 aa, Triticum aestivum
  Clone ID: PAT_TA_31651.pep
DYMARMAAAESTEEYFEDYAAAMINMGRMEVLTGGNGEIRKFCSAYVD

SEQ ID NO: 137234 - protein, 125 aa, Triticum aestivum
  Clone ID: PAT_TA_31652.pep
DLTSSTLAIFISAMASTINAPDGWTTEPDEMDLDYYWADGVRGKQAAAYRGLDNPTPLMRLSLSDGGDQFLFTSGGKFYLWNMTSDDVSIIISPTSQEDIVKALGAMLTDAGSDDLKMEFVDLKE

SEQ ID NO: 137235 - protein, 170 aa, Triticum aestivum
  Clone ID: PAT_TA_31653.pep
NIGHQSEVNAIKWDPTGSLLASCSDDWTAKIWSVKQDKCVYDFKEHTKEIYTIRWSPTGPGTNNPNQQLLLASASFDSSIKLWEVEKGHLLYSLAGHRQPTRPVAFSPDGEYLASGSLDQSLHIWSVKEGRILKTFRGSGGIFEVCWNKEGSKIAACFSNNTVCVMDFRM

SEQ ID NO: 137236 - protein, 138 aa, Triticum aestivum
  Clone ID: PAT_TA_31654.pep
MKGESSRSAAAAVVRSEWTKHAVEGLSHQAAEKATSPLGNMYDPGLPVISSNVTNKVLRARLLQRRVARFGGLRNWLLTCGLGWFVKILDSEGIGMYQMVSLTMSQLKEMGLIAVGPRRKLIHAIDSICKPGQFEMFS

SEQ ID NO: 137237 - protein, 221 aa, Triticum aestivum
  Clone ID: PAT_TA_31655.pep
MSDFMLQDGVGAPPAQNKTVTKANLTGGSTPTAVYMLCGRHGYLAFGNDAPGNMLTGFGFYEPYWLIDFANVCIVVHLVGAYQVYCQPIYAAVESWAAGRWPNSEFVVRQYHPFSGKFSLNMFRLVWRTAFVIVSTVLAISLPFFNDILGLLGALGFWPLTVYFPVEMYISQSKMKKYSRKWVALQTLSFACFVVTVAVTVASIQGITQSLKNYVPFKTKL

SEQ ID NO: 137238 - protein, 213 aa, Triticum aestivum
  Clone ID: PAT_TA_31656.pep
PTRPVKEKRTGQGYAANSTWARGQAWGILGYSQTYNWTKDTQFLDAAIGLAEYFIFRLLKSPDCVEVPIPGENRTKGRYVPLWDFDAPIDTSAPLRDSSAGIIAANGMLVLSQALAGSGSYELSERYRLMAIRIVKDTLDFSLSQEKSKFALKLDGTFQVQDLEPNSHFEAILKNATANHNAKDYKRYWDHGLVYGDYYLIEFGNRLLKMGLA

SEQ ID NO: 137239 - protein, 161 aa, Triticum aestivum
  Clone ID: PAT_TA_31657.pep
LSRLSLITVVDEKTTMAVRLMLVAALLCAAAAAAAAQQANNVRATYHYYRPAQNNWDLGAPAVSAYCATWDASKPLSWRSKYGWTAFCGPAGAHGQAACGKCLRVTNPATGAQVTARIVDQCANGGLDLDWDTVFTKIDTNGVGYQQGHLNVNYQFVDCRD

SEQ ID NO: 137240 - protein, 148 aa, Triticum aestivum
  Clone ID: PAT_TA_31658.pep
MTMAARLMLVAALLCAAAAAATAQQATNVRATYHYYRPAQNNWDLGAPAVSAYCATWDASKPLSWRSKYGWTAFCGPAGAHGQAACGKCLRVTNPATGAQITARIVDQCANGGLDLDWDTVFTKIDTNGIGYQQGHLNVNYQFVDCRD

SEQ ID NO: 137241 - protein, 146 aa, Triticum aestivum
  Clone ID: PAT_TA_31659.pep
MAARPMLVVALLCAAAAAATAQQATNVRATYHYYRPAQNNWDLGAPAVSAYCATWDASKPLSWRSKYGWTAFCGPAGAHGQASCGKCLQVTNPATGAQITARIVDQCANGGLDLDWDTVFTKIDTNGIGYQQGHLNVNYQFVDCRD

SEQ ID NO: 137242 - protein, 247 aa, Triticum aestivum
  Clone ID: PAT_TA_31660.pep
MGAGITAGATARLVVVPLLLLPLLLARGAEAVSLWRPPPEAGLLGSAPGRFLTQEEHWMSQTLDHFSPTDHRQFKQRYYEFLDYHRAPNGPVFLNICGEASCSGISNNYLAVMAMKFGAALVSPEQPYYGKSSPFEDLTTENLRFLSSKQALSDLAVFRQYYQETLNAKYNRSGVDNSWFVFGGSYSGALSAWFRLKFPHLTCGSLASSGVVLAVYNFTDFDKQIGESAGPECKEALQEVTRLVDGQ

SEQ ID NO: 137243 - protein, 357 aa, Triticum aestivum
  unsure (1)..(357): unsure at all Xaa locations
  Clone ID: PAT_TA_31661.pep
GLPARDLRMLDPLLSYPSTILGRDRAIVVNLEHVRAIVTAAEVLVRDPSNPRLRPFLQELHARLALPDAVTTNPATDGGDDQGNVPISGSAKIPPFEFKVLEVCLEHTSKCMETETSVLESEAYPALDELTTKVSTSNLDDVRQIKNRLVQLSGRVQKVRDDIEHLLDDDTDMCEMYLTRKLAFQGVNNESSVNVDSNKHAFPDHDHDHEKEEEDRGGDTASSQEXSACVKHVEELEMLLEAYFVEFDGTLNKLCHLRDYVDNTENYINLMLDKKQNQLLQMGVMLTTATVVVTAGIVVVSLFGMNIHIELMADPETPEMARIKNMKFWETTWGTVAGCAAIYLLAIYAGKKSKYLQ

SEQ ID NO: 137244 - protein, 81 aa, Triticum aestivum
  Clone ID: PAT_TA_31662.pep
LDHMFRSVLNMVLYFANARVVFPTCETKFSLACNVWIISLQMLILNFLLPVLNRQMSKILRFLAKKKKPARAAARKSLSEF

SEQ ID NO: 137245 - protein, 318 aa, Triticum aestivum
  unsure (1)..(318): unsure at all Xaa locations
  Clone ID: PAT_TA_31663.pep
PRVRFLVGGILPXVLLFVLASDRVGEQLSGVSGSWLGNSNGGSSGAAPAPLEHAVERFPGLAELLPKVCTEDRTVIITSVNEAWARPGSLLDLYLESFNNGEDTAHLLDHLLVVALDPAGFRRCVAVHPHCYLLEVTTVNLTSXARFMSRQYLELVWTKLELQQRVLELGYNFLFTDTDMLVLRNPFRRIPVYADMSVSSDDYSAARARFPGAHDQSVFHNIKRELVQTGGVLVEAWSPPEVGGFCEYHDDLASACTMHADCCVGVDNKVHDLKDVAADWKRYTRMAPEERKKAGGNVTWTVPARCRRSVNWSKPVHP

SEQ ID NO: 137246 - protein, 211 aa, Triticum aestivum
  Clone ID: PAT_TA_31664.pep
TLLFEPYGLQVTPITTFLLVILAMTPCLVKAFANPQPKHIIRWVAYACSCGFMFGWHVHEKASLHFTIPLALIAMDSLDDIRHYFLLSIVSCYSLFPLLFEDQEYPIKVLLLLTYSALMWVGFSTHFAANPAPGGKKLDASDSIVEKKFTGWISLGYLLGMFAIEFWSRLFHHHVFGDRLPFLPLMMVSVYCGVGMMYSWIWQLSWIIRHT

SEQ ID NO: 137247 - protein, 97 aa, Triticum aestivum
  unsure (1)..(97): unsure at all Xaa locations
  Clone ID: PAT_TA_31665.pep
HFSKFKVPKLALVFPGAHLRMELKAQNYXWNVSGGQTCLTILPSTTGGSVLGSLLQTGRTMTYDIHGDGGGQLTFSGAPAPAQVSLATLLLVWALLF

SEQ ID NO: 137248 - protein, 229 aa, Triticum aestivum
  Clone ID: PAT_TA_31666.pep
PRVRGRVGDDPDNGKAFVSLSWAVADHPKAKGSHTPLLVARPNQDPHLYLYYVNLIGLQVDGQLLTDIPAGTFDVRANGSGGVFLSTTLPFTYLEEAAYKVLRRELMSRIRLQGLAPLNATSGHSLCFLTQHFSKLKVPKLALVFDGAHATMELKAQNYFLPVPDGQTTCLSILPSTTGGSVLGSLLQTGRKMTYDIHGDGGGRLTFAGAPAPAKVSLATLLLVWVLLF

SEQ ID NO: 137249 - protein, 158 aa, Triticum aestivum
  Clone ID: PAT_TA_31667.pep
DIKSSNIFLDENFEAHLADFGLARLVCAYDTHVTTDVVGTLGYIPPEYAQSPIATYKGDIYSFGIVLLELLTGRRPVDMCRPKGSRDVVSWVLQMRKEDRETEVFHPNVHDKANEGELLRVLEIACLCVTAAPKSRPTSQQLVTWLDDIAENRSLIIQ

SEQ ID NO: 137250 - protein, 187 aa, Triticum aestivum
  unsure (1)..(187): unsure at all Xaa locations
  Clone ID: PAT_TA_31668.pep
PSAAVFAQPYMGDVARLLAATGAPLLANVYPYIAYRTSPRDIQLNYATFQPGATPVRDAGNGLMYTNLFDAMIDALYAALEKAGAPAVRVVVSETGWPSAGGFAATPENARAYNQGLIDHVARGTPKRPGPIEAYVFAMFNENMKPGDETERNFGLFYPNKLPVYPMRFAXPANHMNSRGFNLVDIN

SEQ ID NO: 137251 - protein, 151 aa, Triticum aestivum
  unsure (1)..(151): unsure at all Xaa locations
  Clone ID: PAT_TA_31669.pep
PGXSTGATMSDDEDNQVDSETNMFDGNDGSDGMGFGPLILTEGERSLIERVRHELKSELKQGYKEKLVDIREEIMRKRRAGKLPGDTAATLKAWWQAHSKWPYPTEDDKARLVQETGLQLKQINNWFINQRKRNWHSSNTASSSEKTKKKR

SEQ ID NO: 137252 - protein, 107 aa, Triticum aestivum
  Clone ID: PAT_TA_31670.pep
EFGTRLRLPSPRAPPPPPPPAPLPLATRRRGDGGLDVVPLPGPAAPEGRCGGPRARWLPPKDDDKPRLLQEGGLQLQHSNNWFIHQRKRNWHSSNTASSSEKTKKKR

SEQ ID NO: 137253 - protein, 106 aa, Triticum aestivum
  Clone ID: PAT_TA_31671.pep
ASAMHWSFWRPALYMTKPSQTILDKLLFSWSYPNSILTVYHHYWLDPSLYGHTSISTANTRCHRTLQVESPSYKTRLLVFWHSLASRIVCIHNGIETTQMKISLLW

SEQ ID NO: 137254 - protein, 136 aa, Triticum aestivum
  unsure (1)..(136): unsure at all Xaa locations
  Clone ID: PAT_TA_31672.pep
LLLAFLNXGAVTMPVHALAAGVGAPQGVLWEAVLTFSVLFTVYATVVDPRRSVGNLGPLLVGLVVGANVLAGGPFSGASMNPARSFGPALASANWASQWVYWVGPMVGGLLAGLVYEGLFMVRPGHQQLPTDGTDF

SEQ ID NO: 137255 - protein, 526 aa, Triticum aestivum
  Clone ID: PAT_TA_31673.pep
IGTESSSTTVELPRLRPLGLGAPVLWPTTRLLEQLWWRPRRLERALRAQGLRGTSYSFLLGDMSDYGRQNKEAWSKPLPLRCHDIGAHVMPFLYSTVQEHGKQCISWFGPVPKVSITDPNLVREIMSNKFGHIQKVKFPALSKLLAVGVATHEGEKWVKHRRILNPAFHVEKLKIMLPAFSLCCEELVNKWTQSLGPDGSCEVDVSLELQSLTGDVISRTAFGSSYLEGRRIFQLQSEQVGRFMAAIHKIMIPGYMSFPTKNNRRMRQINNEIESILRGLIGKRMQAMQGESTNDDLLGLLLESNKTDMNENGQSIPGMSIEEVIEECKLFYFAGMETTSILLTWTMVVLSMHPEWQDRAREEVLGLFGKHKLDYEGLNRLKTVTMILYEVLRLYPPASAFTRQTYKEIEIGGVTYPPGVIFEMSVLHIHHDKDIWGDDVHQFRPDRFAEGISKASKEPGAFFPFGWGPRICIGQNFALLEAKMALCMILRRFEFELAPSYTHAPHTVMMLRPMHGAQIKLQATSS

SEQ ID NO: 137256 - protein, 286 aa, Triticum aestivum
  Clone ID: PAT_TA_31674.pep
MASQMSSAWAAVVVIVSSLLAVALSHDEGGGPSFGYTPGTPDGPENWGKLSPAYKACGDGKAQSPIDIGIANAVPNPNLDTLTRVYAPSNATLHNTGKDIVMSFEQGGEPVMPGSINVTTADGTVKEFKLKMIHWHAPGEHTVNGKRFPLELHMVHVDDQDHKAVIGILYEIGNPDPFYDQLTEKLRELKTTPTVAAGVVELKSLQKRTGSYFRYMGSLTTPPCTEKVMWNILGKGRELSQEQLQLITAPLPHQDNRPPQPLNGRQVAFYNPPNTIISIQSLVLPP

SEQ ID NO: 137257 - protein, 145 aa, Triticum aestivum
  Clone ID: PAT_TA_31675.pep
ENMIGPLNPPAGWGYLVEPFINPQGLVCYNETVKWGFLGPLLFLQAITIGWFTMIVRVIVKVLKGGDAEDVRSDDEGGEEEEEEEFVYEEAQPLEEEVGVEALDLRNWERRSGVKKQASSSGVSLPGHSDRKELLGRIGCEKQVD

SEQ ID NO: 137258 - protein, 87 aa, Triticum aestivum
  Clone ID: PAT_TA_31676.pep
YAVPPSVIDLLIANYNNGVSPRGALDFDNFVEVGMVVKGLTEKFKENDTPHTGSAAFTYDGFLSMVVPFIASYLVLVSVCPPKGKEF

SEQ ID NO: 137259 - protein, 136 aa, Triticum aestivum
  Clone ID: PAT_TA_31677.pep
MADNDSPVTLRTRKFIRNPLLGRKQMVVDILHPNRANISKEELREKLGSLYKAQKDQISVFGLRTQFGGGKTTGFALVYDSPEAMKKFEPQYRLVRVGLATKAERASRQQRKQRKNRQKTLRGTAKVKGAKAKKEK

SEQ ID NO: 137260 - protein, 136 aa, Triticum aestivum; identical to SEQ ID NO: 137259
  Clone ID: PAT_TA_31678.pep

SEQ ID NO: 137261 - protein, 83 aa, Triticum aestivum
  Clone ID: PAT_TA_31679.pep
TWCWSLFVQFPSKKEEMAGSGSITEETTNILQGIVYSGPSKNKGITMHLTYKGAVKDKMLWTQRSGRGEFTNNASRTKRDLDS

SEQ ID NO: 137262 - protein, 311 aa, Triticum aestivum
  unsure (1)..(311): unsure at all Xaa locations
  Clone ID: PAT_TA_31680.pep
MDRSEEETIMSDSDPLLDRKDQSGSLLQLSPPQPATVTVLEIEDEETDGSYAACCRICLEAESEIGDELISPCMCKGTQQFVHRSCLDHWRSVKEGFAFSHCTTCKAQFHLRVETLEDNSWRKIKFRLFVARDVILGFLAVQITIAIISAVAYFLDRDGSFRNSFSDGWDRILSKHPIPYYYCIGVVVFFVLLGFSGLIVHXKKKKNNQDPCLAGCRNCCYGWGILDCLPASLEACFALVVLFIVVFAILGIAYGFLAATMAVQRIWQRHYHILTKRELTKEYVVEDLHGSYSAPKLEPEHEERLKMLKLL

SEQ ID NO: 137263 - protein, 438 aa, Triticum aestivum
  Clone ID: PAT_TA_31681.pep
MPMAGRSSGRGGGGGGRGGRTVLGGRGGGPGVEDAVVMELAAGDGEDNVVTVNCPDQAGLGCDLCRTILEFGLRITRGDVSTDGQWCYVIFWVVPRSPSINVRWGSLKNRLMAMCPSSYAIPFYPEITEPGPPQFYLLKLFSTDRRGLLHDVTHILSELEFIIQRVKVSTTPDGRVVNLFFITDGMELLHTKERQEEICSMLIATLGPSLTCEILSAEGFQQGFSSLPPTISEELFRLELDECESKMKKVQKATIHFDNTLSPAHTLLQILCVDQKGLLYDMLRTLKDCNIKVTYGRFWSDKKGFREVDLFIKQADGKKVIDPEKQDALRSRMRSEMLHPLRVMIVNRGPDTELLVANPVELAGKGRPRVFYDATLALKALGICIFSAEIGRQAASERQWEVYRFLLDDSKEFPLSNSLTNRNRVVDRVRKTLMGCFN

SEQ ID NO: 137264 - protein, 260 aa, Triticum aestivum
  Clone ID: PAT_TA_31682.pep
MALAAIALSLVLVAAAPAAGTSREELAPVLQCHPAPALTDATDGTAFRASLLLLLSALPSAAAPMGFASLHSDGAFARGVCFGDPTTLPSGSECARCLFDAARNLTAGCGATSRRAGILSQRCSLWYADTNFSSPGQDAFRARFHLALPSDAAAPASDSETSAGVLYSPGLHDELVAMAQLMVQRAAGRLSRPAMPATMRVVHKTIVERGCGCDYAIVSSTVYVRAQCARDLTAADCARCLQDSAQAMDWDLDAARGDGG

SEQ ID NO: 137265 - protein, 298 aa, Triticum aestivum
  Clone ID: PAT_TA_31683.pep
LAKAVLRCPLLASPLPAGGATAASCSGSPLPSRVHIRRRRCPSPPLAVSSDSSKPLASSSTGGGADPDEEPVLPLLQELADCLVLPPKFLSLLPRDLRLDLNDAAFDLSNGPVLNECGQEVGDLLLDLGKAWEMANTEASNNLAKQLPSMAPYLTASAKSAFGKRLASAGKKFQTMGQYGNGEFKKISETMIKIGKVLSKRPVIQAEVEATKEKRKLKFAGAEFELTAQNAYIGAAVGLVFGFFSWQLAQGVQSSPDDSQPLKVPLLLLGYTSTALSAAAAVGLVVLALQMNPEDKSD

SEQ ID NO: 137266 - protein, 121 aa, Triticum aestivum
  Clone ID: PAT_TA_31684.pep
RESNLKQFTQYAANCMCIFFSKKFYVYIQHSSLQIHLVMIIYNIDSLNISHNNVTKHYNPVYINKTYNLSRLLFRFFVNSPDGNHIMSWRGLCWVALCSPLPIHTEMSARFKAFTCSAPFP

SEQ ID NO: 137267 - protein, 323 aa, Triticum aestivum
  Clone ID: PAT_TA_31685.pep
LCCYALLLMPGFIQVLYYYFFSSQVHRSVVYGEQPRNRLDLYIPAGTTGLKPVVAFVTGGAWIIGYKGWGALLGRRLAERGILVACIDYRNFPQGTIGEMVEDVSRGISFVCNNIASYGGDPERIYLVGQSAGAHIAACTLVNQAIKECGEDTSTWSVAQLKAYFGISGGYNLLNLVDHFHRRGLYRSVFLSIMEGEESLKKFSPEVVVKEVAARSAVSLLPHIILFHGTTDCSMPSAESEAFLDALQQRGARANLFLYEGKTHTDLFLQDPLRGGRDKMLEEIVAVIQNDDPGASAQHLAVPVARRLVPEFMLRLAGRVSPF

SEQ ID NO: 137268 - protein, 287 aa, Triticum aestivum
  Clone ID: PAT_TA_31686.pep
MCDADRSFVYGDAFGKPSEMTNAIENVLQDLQAQLKQESLLRQQEQQKLAEESLLRQQDQQRLAEEQSRTTSLAAEKREMEEKIAALTKKSSEEASEFAARQAFSMQDREKLENQLHDMALMVERLEGSRQKLLMEIDSQSLEIENLFEENSVLSTSYQEAMSVTMQWENQVHEGLKQNEELRLHLEKLRIEQANLLKTKNTSVELDGQSETSIPPELVTENLSLKDELVKEQSRSEGLSAEIMKLSAQLRKAVQAQNNLTRLYRPVLKDIEGNLMKMKQETYATIL

SEQ ID NO: 137269 - protein, 110 aa, Triticum aestivum
  Clone ID: PAT_TA_31687.pep
MEPAGASLVSLRASTATSRSCFSCRQQGTPKTRMLPAMASKSGAKLVASGCKTCRGKGAVECEGCKGTGRNKKNGNIFERWKCFDCQGFGMRKCPTCGKGGLTPEQRGER

SEQ ID NO: 137270 - protein, 144 aa, Triticum aestivum
  Clone ID: PAT_TA_31688.pep
VARSSRGRGTLEGLLGQQERQPRSRPLLTRQQRAQPRTRLVAAFSCGRVPGPPGSGPSRGGRERRGGPGCFRACRPSPGGNWRLETARREGGRVQWNAKAGRGLAGTRRTATSTGGGREETARGLREGTPPPQGKGRHNAAAEA

SEQ ID NO: 137271 - protein, 124 aa, Triticum aestivum
  Clone ID: PAT_TA_31689.pep
AVLLAVYTIANWSGTVLAQAVSLVGRSAPPEMLQMLTYLAMKHDARVQRVDTVRAYSFGALCVVEVDIELSEDMRLREAHAIGESLQEKIEKLPEVERAFVHADFESTHKPEHTARSRLPATEP

SEQ ID NO: 137272 - protein, 48 aa, Triticum aestivum
  Clone ID: PAT_TA_31690.pep
FKVLAFGRINVATRLTCCVIFFKYLNEWKCSFQLNCSFASFHNSSESL

SEQ ID NO: 137273 - protein, 109 aa, Triticum aestivum
  Clone ID: PAT_TA_31691.pep
SRVDFMEEKLKHYPAAVNDEGMYDHSKEVAEAMLGEANVKVAPRSMGGEDFAFYAQRAAGAFFFIGVGNETAMDRVHPVHSPHFVLDEGVLPIGAAFHTAVAIEYLNRS

SEQ ID NO: 137274 - protein, 365 aa, Triticum aestivum
  unsure (1)..(365): unsure at all Xaa locations
  Clone ID: PAT_TA_31692.pep
RCQELGCTKSAEGKTEFCIAHGGWHRFGVPGXCSKAARGRSGFCIKHGGGKRCMTEGCTRSAEGYPGVCIAHGGCRRCQYPDCSKGAQGGTLFCKSHGGGKRCVSEGCTKGAEGSTTLLCEGHWCGKRCLFEPHQGAPPERVVAGTAVCVVQGGGKRCVAPGCTKSARGRTDCCVRHGGGKRCKSDGCGKSAQGSTDFCKAHGGGKRCAWGAAGCDKFARGRSGLCSAHANLTASTQGLSMIIGHGLFSGGIVVSSSSTVGSGGMDRVISSSLPGGASSDCCGESPEKHLQGGRLIPPQLLLPAGSLQKPSSSFNLPGNEDDWEGGASLNRSYGFVVPEGRVHGGVLMSMLRAGHLGSNINNPES

SEQ ID NO: 137275 - protein, 106 aa, Triticum aestivum
  Clone ID: PAT_TA_31693.pep
VVLRYWETTKLLVHSCILRRSPAKDARSAWPRGSCQDTLGRAKVVTTLNFPSAPDDTTLCWADKMFVSCKIRLFSLQLPMVWRKKIRHTVYTSCCVTLTGPRGHVM

SEQ ID NO: 137276 - protein, 149 aa, Triticum aestivum
  Clone ID: PAT_TA_31694.pep
MDGGDGGEQQTGLATRPVVAPPRAPTERDFAGTPYGPVYVMLPLGVVSVNGDVAEADQLVAQLRVLKAAGVDGVLVDCWWGNVEAHRPQEYNWAGYKRLFHIIRDLKLKLQVVMSFHECGGNVGDDVSIPLPEWVIEIGKSNPDIYFTD

SEQ ID NO: 137277 - protein, 294 aa, Triticum aestivum
  unsure (1)..(294): unsure at all Xaa locations
  Clone ID: PAT_TA_31695.pep
HASGSFRVEFDEYFEDGIISEIEVGLGACGELRYPSYAANHGWKYPGIGEFQCYDRYLQKNLRRAAEARGHAMWAKSPDNAGHYNSEPNNTGFFCDGGDYDSYYGRFFLNWYAQVLLDHADRVLMLARLAFEGSAIAVKVSGIHWWYKTASHAAELTAGFYNPCNRDGYAPIAQVLKKHGAALNFTCVELRTMDQHEVYPEALADPEGLVWQVLNAAWDAGIQVASENALPCYDRDGFNKTLENAKPXTTPDGRHLFGFTYLRLCSTLFEGPNLPEFERFVKRMHGEAVHDLRA

SEQ ID NO: 137278 - protein, 98 aa, Triticum aestivum
  Clone ID: PAT_TA_31696.pep
MAAAGPDGQRERSMALNSEGLEGLVPRAKLLLSLGGTFSLAFGPLIIVTVSLFAGLYLYFGQSFVHDGSKKPVAPPPYIDPYELLEDDMISRPSLDVF

SEQ ID NO: 137279 - protein, 91 aa, Triticum aestivum
  Clone ID: PAT_TA_31697.pep
EEVRLRWSGVEAQCSPRSHYGHRNLLTPSHNARCRDSTIGALGGGDRTFTNEVGAISTTQLEAPNDTMTLHHNGLWLRGDLNRLGCSNTQE

SEQ ID NO: 137280 - protein, 113 aa, Triticum aestivum
  Clone ID: PAT_TA_31698.pep
ILEFLGFSFLFFLSFPSLALVALVGFERGGLGALRGPLPLHLGRRFEFSTVLRGSSKLQQLFTLGCLGALELVPLGCLGALDVGGCSELNHCGVKLRASVGSPIRLWRSPQAI

SEQ ID NO: 137281 - protein, 283 aa, Triticum aestivum
  Clone ID: PAT_TA_31699.pep
LRFSSSRVAEDLAKQWNKEQKKLLGVDLQSIRASALGSAPPPHIAEDYAGSSSCTGCSKPPFLAAQSDLSLGDVHLRNAYSSDRGQHYLSNLGRFNLHGIDNVPRNLSLGGFPGASSSQGRTGSRRRKTTKLQKPYYDNRSPWCQELPQRMPAQFLPINQQPINSLPQWLTKGAETGKSWLNPEMWSSALQAPGHSVADPLNDSLRAAAFLFPDDKKPHAMPDASLKLALKRKAEWRSLGKKLFRTSGDTLDLNQRAAAMAAGPSGATPSDTGASSEETVSDS

SEQ ID NO: 137282 - protein, 109 aa, Triticum aestivum
  unsure (1)..(109): unsure at all Xaa locations
  Clone ID: PAT_TA_31700.pep
FSIYCSIPSFTESIPFLNVQKFWEFSMSGSTGERSFADIITSIRYWVIHSITIPSLFIAGWLFVSTGLAXDVFGSPRPNEYFTESRQGIPLITDRFDSLEQLDEFSRSF

SEQ ID NO: 137283 - protein, 193 aa, Triticum aestivum
  unsure (1)..(193): unsure at all Xaa locations
  Clone ID: PAT_TA_31701.pep
MRVLLLLAVVSAAYAAKGKAEKKESADGPAASGPAASGEGGEYPTAQLGAKPDGTTDCTEAVEEAWASACGSTGNPTIIIPKGDFLTGALNFTGPCKGDGLNIKLEGNLLAFNDLAKFKSNWIEIMRVKKLSITGKGNIDGQGKAVWTKNSCQKNYNCKILPNXLVLDFCDDALIEGISIINSKFFHMNIFQC

SEQ ID NO: 137284 - protein, 179 aa, Triticum aestivum
  Clone ID: PAT_TA_31702.pep
VIIMTSNIGADHLLKGIKGSSTSMEQAHGKVMEEVKGHFHPELLNRLDKIVIFDPLSHKQLRKVARRHMKDVEARLAERRVALVITDDALHVILSQPHDPGHGARPIKGWIEDNIVTVLSVMLINEEIAENSTVYVDAAPNKNELTYRVDKDGGVVNAQAGHESDIVIYVPSGSGAIGK

SEQ ID NO: 137285 - protein, 249 aa, Triticum aestivum
  Clone ID: PAT_TA_31703.pep
QVSYAFHSQRKLHPEKFKNQLSNQKQYLKLACTQGWFCASLSHPMSRNIAHLAKVKIMKKSGKWETLEIPQSIRSIVCLNLPSFSGGLNPWGTPSKRKQRKRDLVLPPLVDDGLLEIVGFKDAWHGLVLLSPKGHGTRLAQAHRVRFKFHRGATDHAYMRIDGEPWKQPLPQEDDGKVVVEISHAGQVKMLATKDCIAKGINDSPGMATACTDSSSSDDSDDDFTEERRNFGAALSFRYMNDVKKTVEA

SEQ ID NO: 137286 - protein, 282 aa, Triticum aestivum
  Clone ID: PAT_TA_31704.pep
MCPRAHGGAAMVRARASSAASAHSFAEEEYIDLDLSSCGEYQFRVCRSKPAAPCPCPDELVRRARQHKVAPRPGGKLLDADAGAAGGCGRRGTATVAPLQHSSHAPPHAGRRRKPGKAMQARLQASRAFLRSLFARTWCSDERCRGVRSGSRATHDRDKGVGVSGKSAFGQINKSYVSGSAAPTTLRSSIEREKLMEEEEHVRQRKSFSGVIKWRPTTAASSARRNSCGSAPALKRSSSCRSESEGLIQGAIAYCKRSQQQRVLLARKSVSDAALCSFRAPS

SEQ ID NO: 137287 - protein, 74 aa, Triticum aestivum
  Clone ID: PAT_TA_31705.pep
CEEVRNQCCKQLRQTTSRCRCKAIWTSIQGDLSGFKGLQQGLKARTVQTAKSLPTQCNIDPKFCNIPITSGYYL

SEQ ID NO: 137288 - protein, 164 aa, Triticum aestivum
  Clone ID: PAT_TA_31706.pep
MKTFFLLAFLALVVSTAIAQYAEVPSPAAQAPTADVFGEWVAIAPSASGFEDCEEEHPKLDSCSDYVMDRCVMKDMPLSWIFPRTWGKRSCEEVRNQCCQQLRQTTPRCRCKAIWTSIQGDLSGFKGLQQGLEAKMVQTAKSLPSKCNIDPKYCNIPITSGYYW

SEQ ID NO: 137289 - protein, 227 aa, Triticum aestivum
  unsure (1)..(227): unsure at all Xaa locations
  Clone ID: PAT_TA_31707.pep
ELAISVAKEERFASADDYATMILVQQDKDVRRLSLCGWKDDTAVKVKLPHLRTVLSLGATSPCRGMLSSILSESNYLAVLELQDSEITEVPTSIGSMFNLRYIGLRRTKVRSLPDSIENLSNLHTLDIKQTQIEKLPRGVVKIKKLRHLLADRYADEKQAEFRYFIGVQAPKELSNLEELQTLETVESNPDLAEQLKKLMQLRKCVXIDNISADDCANLFATLSTKR

SEQ ID NO: 137290 - protein, 179 aa, Triticum aestivum
  Clone ID: PAT_TA_31708.pep
CAPARERQLRLRDGDFSSGEELELEVLSLTPGGRGKAEKWTQEVPPKRGVRPLTSPQSPSSNRKGPSPSQKNPPAQKPQLEETKPIDEELMKTLRTGRGDAKTLRVIKDEQSAQNSDSKTLSSAAGVSFQAAQSGKHKQPKNSQGPPNPPGFPANSPKVFRGEEDDEDEDDEYDGRAGG

SEQ ID NO: 137291 - protein, 222 aa, Triticum aestivum
  Clone ID: PAT_TA_31709.pep
WCLALCRGLASCRRGVGHRSLQAASGGRRWSLLLCLHGGGLRKEPDLANPPIISLLGHWIKPLWLFSRFLPSRWRSFRRGWCRSLIERRASGVNLEADDGDPEHNQQWIQRSYSALHGWPAFSNDLLNLQAEWRLVLFLQGLMPTREAVLLEVESVVQPQRSRRTKWFVPGAGDDWIHWRAVWTRSLFPSSFEVLFISIRDLPVIFSFFGVLFVRCAAHCFE

SEQ ID NO: 137292 - protein, 101 aa, Triticum aestivum
  Clone ID: PAT_TA_31710.pep
EMDDSGYPIIIDQKYCPNKLCTSKGDAGRVQDKERERKNITGTLATPDRLSLLRSEKKPCEGVTMYDVKIEYSGKNNKTMTVCTHVKVTATGVDKANTCDA

SEQ ID NO: 137293 - protein, 138 aa, Triticum aestivum
  Clone ID: PAT_TA_31711.pep
GGRNPGSGGWGLGPNGKGKHNESTLSRAVRECSAGVGLSGAASKGDNWPGSKYAEDTASHDSIQSPYSDTGLALGLAYEAWFPLTTLLWKVPEGTILDLKAVIFFSLTKDGLSTLAHQSGHEGRVLGRQAAPLLGMGL

SEQ ID NO: 137294 - protein, 51 aa, Triticum aestivum
  Clone ID: PAT_TA_31712.pep
GMNDTHDYKNYDLSNNNRTETLYVHWPRARKNLYEVGGKGNVSWWEHRSHT

SEQ ID NO: 137295 - protein, 171 aa, Triticum aestivum
  Clone ID: PAT_TA_31713.pep
MQERPAVDGTDTAVHATFRVHPQDAAMLHGTYGATLKDTSVQIEPFDMPGTVITNNLTLSAQKSAGSFFNIVPGLDGKPNSVSLELGTKPGCFLVSGADYSAGAKIQVSCKSSVQSIGGILEQAASFAQAAPLRQYHPVSFVAKGVKRNFLLEPFYSLRDEFYTVYFNLAA

SEQ ID NO: 137296 - protein, 360 aa, Triticum aestivum
  Clone ID: PAT_TA_31714.pep
MMFNHPPVGDEPLKNELHRLRLYIDSRNKAHELKQSQLMTECSQEIEKVKQKYNSLLEENDSTHLQQRKVLDSLCEKVILNQSLADDFRAKFISSSGAQARAHSPPNHQRPQASQQVPMRPSAAASTASPTASSTAGRPPVQMHHVQPLQVDQPSPTSSSSPSSPNPSVLQSIDRSTSTTFGLAPVLPRGNFGVQSEVTRAPAPHLQHRLPPQVHSMAHANQQQPPIWLESTSARTRSTPVTALNIRQSCPQAIPPGNPSLSSLHPRTHPTVPAPLGPSSSHQIQQPSLLPSSSQPTRLLSPVSSVPSPVLPLSSPKSSSTTNITARFDYDVLALPRAASNVLPSRGVGSFRIRLDAVRF

SEQ ID NO: 137297 - protein, 98 aa, Triticum aestivum
  Clone ID: PAT_TA_31715.pep
TVVHRNGRAIVKEVKEGYNLNDLPGGYMGKMLVYKSGKVKMKLGDAVFDVSPGTECGMQQHAVAVNTRRKHCCQLGEIERQHVVVTPDVNSLLNDNRD

SEQ ID NO: 137298 - protein, 154 aa, Triticum aestivum
  Clone ID: PAT_TA_31716.pep
HTTQRMPLLFRVYTIRHASFNPIRDSPDPSSSGTCTRAACMQLTFHGTRHDAGGDSEVHNAGDESSDPHTQALEVARREDAQGAVGQEVGGDEHAEGAAQHPPELGRRRRRGGLPPRQGHGGEHLHLHRAHRVDAEDEHRAIDVHGHTSKQDPS

SEQ ID NO: 137299 - protein, 159 aa, Triticum aestivum
  Clone ID: PAT_TA_31717.pep
RDSARAHNKAAAKNHLQLARVLLCLRGHGHLQRGVRLLRLRGGHDGGAGALCHGPGAPEGRPAADGVQARADAGQLPLRVRRHLLPGARHPERPRAVPLPVLPCADRCSRRRRRGPRCHRQHHAASRGRLAACMRMCRRKMKHFGTWRVTNWIRNWPAL

SEQ ID NO: 137300 - protein, 65 aa, Triticum aestivum
  Clone ID: PAT_TA_31718.pep
EIWPYVPYSQVSQPYVAGTYDKRAPAGYVRSQEPGYGNVSGQVSRQDDQLTDMFNDDNANSCAVM

SEQ ID NO: 137301 - protein, 235 aa, Triticum aestivum
  unsure (1)..(235): unsure at all Xaa locations
  Clone ID: PAT_TA_31719.pep
MAGGGSDEVKLLGMWASPFVLRVQLALSLKGVGYEYVEEDLKSKSELLLKSNPVLQKVPVLIHDGKPVCESSVILQYIDEAFAGVGPSLLPEEPHGRAVARFWAAYIDGTLVKASSQASMAKTEEEKAEGKKQVAAAVETLEGALRDCSNGKPFFGGDTAGYVDVMLGGLLAWVHAGDKMKGVKTFDPATTPLLGXPWADNFGSLDAVEAVMPDVGKLVEFAMAMHARAAAAATN

SEQ ID NO: 137302 - protein, 157 aa, Triticum aestivum
  Clone ID: PAT_TA_31720.pep
MAMRAVAVLLLLAVASVLAAGAAAQSTGTPACASKLTGCAGYMNGTDAQKPPETCCGPLRDAVKNEKPCLCALYASPEIFKAFNINVTDALRLSKRCGVSEDVSSCPSTSLTKSPPGSSSSPSGGAPSGGKSAGHPTMSASFAGLMSLFLVLWSALA

SEQ ID NO: 137303 - protein, 194 aa, Triticum aestivum
  Clone ID: PAT_TA_31721.pep
HRNSSEPTDVCFIIHGKHAEKRVYTHQPNITKHFINSTHIVHTKTGGRYKNLELNLPNFKTKRSHCSQQHGNPSHILQNGTMELVSTPSHVACLCFTSPLPSERETSGTEILIGKASTSSEWHTEEESWTDGHRPLILSGKSLPTILIRCKPPSHHAGHGILGRHTRSGLPRTKNISQAPLTHRLCATMKPVRL

SEQ ID NO: 137304 - protein, 233 aa, Triticum aestivum
  Clone ID: PAT_TA_31722.pep
MPTIIIKVDLDCARCHRKIERVLDRIREKGEFVIDDIEYDEKNNKVIVKGPFDADKLSDKLCCKACKIIKEIEIVEPPPPPPPEEPKKEVPAPPPPEPEVVVPPPPAVVEEPKCPEPAPEPPKEEPPKEEPPKEEPPKKEEPAPPPPKIVEVPYPWPYPYPYPAWPSDCCCCHGHGGCSCKEEPAPAPAPAPPPPQFNIYPQYPPYPQQPAYPPCGGYKIVCEEDPSYACAIM

SEQ ID NO: 137305 - protein, 242 aa, Triticum aestivum
  Clone ID: PAT_TA_31723.pep
MTSEVDPQLRICCDLLMTELTKEKCRTADKLQDSIGDGTVGVPGGATAACWDCSICLETASEPVVTLCGHLYCWPCIFRWLTTSSRSKSRASSSARCPVCKAAVSEDHLVPLFGRARAATLIPAGGRGGSVCQVPRRSPVPGPNAEERLQGPDLHDGGNFYYYENIGINGLDCSNEERLLGGIALAVLLPWATRGGGTGRPPPPSLYRDGEGWRMARQRRVARLRQMWVFLAMVAFLCFLLL

SEQ ID NO: 137306 - protein, 223 aa, Triticum aestivum
  unsure (1)..(223): unsure at all Xaa locations
  Clone ID: PAT_TA_31724.pep
MEPVVKVYEPAMSWNIARVLVSLEESGVKYELVAVDFAAAEHKSAAHLARNPFGQVPVLEDGDFCLWESRAITKYICRKYKPELLGVGNLKGSAMVDVWLEVGAHQYWPLIEAILMEIRIRPIFGQRVDERAVEENIDKLKKVLDVYESRLSSSKYLAGDFISGSXLADLNHVSTMLCLGITIYTSVLDMYPHVRAWWDDLKGRPAARKVSDLMHMSVKDDLK

SEQ ID NO: 137307 - protein, 186 aa, Triticum aestivum
  Clone ID: PAT_TA_31725.pep
RGFFFFFFKGVSYFNRRQKIITRDYHLLRTTCVVQLHTQANPKKSHHTHYKHKAKELALNRTTKPRLDQHRSPQRNNCHRTPLVDAPATLECRKGDGEWVAGLSRSRDSHRLELTGADVHSAEEDLLGPATSTEEPQHRASMPSLHTRCSQRRNDVKTPPSPVRERTKAFARRQQPKLEGGDADTP

SEQ ID NO: 137308 - protein, 279 aa, Triticum aestivum
  Clone ID: PAT_TA_31726.pep
MAAAQKPAKRLGGMAEAVAIAGDLGFPAPPAQEDQNTDKSDDLVRVLRELTVVQRNIANLQVELQGRKDDKNIAHLTHVSEMEKKCESLARITAILKDVIQNKDRIIARLQQPYSLDCIPVEAEYQKQFSELLLKAASDYGALTASVGDFQWSQNFRESPAVWGEMLRPIPAALASCTRFFEAMSAMRESFSTLQTLRVGPSSLSMTPGGSSDDSKFLTPPQWREGSTLNSWKQVDDVNPESDGLDSVNQRRCHGILLDPGPGGLSAPSGCLQARRRPH

SEQ ID NO: 137309 - protein, 66 aa, Triticum aestivum
  Clone ID: PAT_TA_31727.pep
WHRYRNEQFSFAIRKRRTKENRILLLRASSGHMIIYLYSFQQKRTGLFLLRASSGRMVIHVYSFQQ

SEQ ID NO: 137310 - protein, 157 aa, Triticum aestivum
  unsure (1)..(157): unsure at all Xaa locations
  Clone ID: PAT_TA_31728.pep
KGKGLLFLKXVQLDNLKNLNLHGVSLTEYPFKKVLNGFPLNGENPPTRPPTRPDMHPWILSVQRTLENYVASEATTNKLARDAFCSWLRAYTAHRGELKKIFMVKKLHLGHVARSFGLKEQPSLVGRSHQVQLKKRKKEQKREGQGPTKRRKFPTKK

SEQ ID NO: 137311 - protein, 237 aa, Triticum aestivum
  Clone ID: PAT_TA_31729.pep
FQNLTLILHYILLYAKTEDIHYVGFLSKLLETKIMQVLRFKYGQVYSVNVGVFLGGNKPSRSGDVRGDISVNFSCDPDMSSRLVDFVLEEISYLQTEGPSEEDVWTILEIEQRAHENGLQENYYWLDRILRSYQSRIYSGDVGSTFMVQDEGRVKVREALTPQAMQMALRRVISFPCKKQYTVVILMPKSSCWNSLISVVSWSSGGFSRDAKILAGMAGALVVAASLWRYSRGASRS

SEQ ID NO: 137312 - protein, 421 aa, Triticum aestivum
  unsure (1)..(421): unsure at all Xaa locations
  Clone ID: PAT_TA_31730.pep
AIFWSEVHFLECVTQDGNDHIHTAKLVLIVATIVSAIAIPKFFFVLCRFLLAPLAVWIFLAYKYMKTRIIIDAVEKFLRIQQMIGPARYSYTDIVAVTSHFRDKLGQGGYGTVYKGVLLPGDVHVAVKMLEGNSNCNGEDFISEVSTIGRIHHVNVVRLVGFCSEEMRRALVYEYMPNGSLDKYIFSAEKSFSWDKLNEIAWGDRGRGXLHQGCDMQILHFDIKPPDVLRVSMLLPEVAGFGLAKLYPRGDTFVPLSAMRGTVGYIAPEMISRSFGVISXKSDVYXLGMLLLEMAGGRSNADPNMGSSSQAYYPSWVYDPLTREEAGEISHISDVAADMHELEKKLCIVGLWCIQMRSRDRPTMGEVIEILEAGADGLQMPSRPFFCDEGHIHVEDSYQFTSELTAVSEEDLTTVSEEDNM

SEQ ID NO: 137313 - protein, 75 aa, Triticum aestivum
  unsure (1)..(75): unsure at all Xaa locations
  Clone ID: PAT_TA_31731.pep
QAMEHGDAATGSGSRSGAGTSIQVTALDGIVNVNSLFTLAAFLGLAWRPSSDGPGLADGADHLXACAAXDRIESD

SEQ ID NO: 137314 - protein, 918 aa, Triticum aestivum
  Clone ID: PAT_TA_31732.pep
MNPDNFTHKTNEALVAAHEAASEAGHAQITPLHLAAALAADKSGILRQAVAGASGGNASAGDSFERVLSGALKKLPSQSPPPDSVPASTALIKAIRRAQSAQKKRGDSHLAVDQLLMGLLEDAQIADCLKEAGVSASRVRAELEKLRGGDNSRKVESASGDTNFQALKTYGRDLVEVAGKLDPVIGRDEEIRRVVRILSRRTKNNPVLIGEPGVGKTAVVEGLAQRVVRGDVPSNLLDVRLVALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVYVAEPSVADTISILRGLKEKYEGHHGVRIQDRAIVVAAQLSARYIMGRHLPDKAIDLVDEACANVRVQLDSQPEEIDNLERKRIQLEVELHALEKEKDKASKARLVEVRKELDDLRDKLQPLTMKYRKEKERIDEIRKLKQRREELQFTLQEAERRMDLARVADLKYGALQEVDAAIAKLEGETGENLMLTETVGPEQIAEVVSRWTGIPVTRLGQNDKERLVGMADRLHTRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVVFDPLSHEQLRKVARLQMKDVAVRLAERGVALAVTDAALDVILSLAYDPVYGARPIRRWIEKRVVTQLSKMLIQEEIDENCTVYIDAANKDELAYRVDRSGGLVNAETGQRSDILIQVPNGALGGGGGGEAAKAVKKMRVMEDGDEDGMDEDV

SEQ ID NO: 137315 - protein, 142 aa, Triticum aestivum
  Clone ID: PAT_TA_31733.pep
MSTGGASLVRRALEAVRRTPRWQKRLVVLTAGAGTLSYACQDNRVLQISDGTGGKKKVVILGTGWAGASFLRNIDTSLYDVHVVSPRNYFMFTPLLPSVTCGTVEARSIVEPIRNIVRKRGGAFRFWEAECYMIDPTSKKVH

SEQ ID NO: 137316 - protein, 141 aa, Triticum aestivum
  unsure (1)..(141): unsure at all Xaa locations
  Clone ID: PAT_TA_31734.pep
LQEAMSRRLSDATTELSSNDDSSVDEKPKPRKKTESTAGKAKAAAPKITLHDAKWTDGSIPLVAVSDKLSKIGKXATERRDAAAAAXADALQEALXTDSVIRNLREYFICFCKHYPFVEPRITPTVDCSCAMSSGERIAPT

SEQ ID NO: 137317 - protein, 220 aa, Triticum aestivum
  Clone ID: PAT_TA_31735.pep
SYDTTIMIWHAFRGRSNDKRSKNASNDLSTKDHVIIENPSHILCGHDDIITCLFVSKELDIVISGSKDGTCIFHTLREGTYVRSIRHPSGAGLSKLVASQHGRIVFYSDSDLSLHMYSINGKHIASSESNGRLNCMELSCCGEFMVCAGDHGQIVLRSMDSLGVVWRYDGSGKTITSLAVTPEECFLAGTKDGSLIVFSIENPLLRKGGIQRNKVKSSVG

SEQ ID NO: 137318 - protein, 328 aa, Triticum aestivum
  unsure (1)..(328): unsure at all Xaa locations
  Clone ID: PAT_TA_31736.pep
SSSREWMESDVGEGFPLCGFDSLYEKYSQRMVAFDKTITQVFKDSGSFNISKKSPRSASKLASTLRSLSFKRRDELQEDCENLQQQQSEDDPYQILETAYVAQVSLSWEAIHCTYMHLSLILVEEQDXPTTMAVLAAAVCPDGHQSGVEGAENGQAEQGAAAVVRGVDEHSGNRLQQPAAGXDDLTSSAADAFPLAFIPXLVNVRLAPILSIRVFLNEGQVYVQCPHGXVHVKTXSSIQQVQSSLDTKEMKVNALHXEEKFLEEQEQPMEXEEVQLQFDLVDIKVVSRVLRMAKLSKEQLLWCEEKMSKLDLSDNKLRRDGCPILFPC

SEQ ID NO: 137319 - protein, 212 aa, Triticum aestivum
  Clone ID: PAT_TA_31737.pep
MGWAARFLTAVSFLAAGVLFAPDALFGGAPGRPAAGVAAARLAHVLCFATAWGAALWVTFIGGIVMFKHLPRHQFGSLHGKIRPRVCPCVRVCSAISVAAFAYLNPWKTASTVERYQLGFLLAALGFDLSNLLVFTPMTIEMMMKRHKIEKDLGIGGEVGRSRNAELAKTNPALAAMNKKFGMIHGLSSLANIMAFGSLAMHSWYLASKLEL

SEQ ID NO: 137320 - protein, 349 aa, Triticum aestivum
  Clone ID: PAT_TA_31738.pep
MLGIEPLELHFSFQLNKQMSCTIQLTNETGSYIAFNVEHMNPLSYCAQPQKDIIPPRSKCNVEITMQPQAKAPRDHTSEFTVWSTKVNDGLAIEDITTNMFTNEAVNVVDDVNLDVVFDVIEPQEASEETSVTIQPLIQIIGITAEMIDCIDANQTEPLIITGHQRGGVQIWNSDTQKVVASIKVSQEAVSTVKFIARKRWLVAMSKDCFVHVYKYEKELEKVTSFKAHNYHDSDWCPLDVHPTQPYVLSGSIDQIKLWDWDQGWNCIQTFGEQPYELKALKFNPEDTNSFASASGYFTVEVWSLDSPKSKYTLSGHSGKVYCVDFFNRDGQQYLISGSDDKTAKIWNM

SEQ ID NO: 137321 - protein, 94 aa, Triticum aestivum
  Clone ID: PAT_TA_31739.pep
GSEDENDEDIDWDDRLHFPAGEKEIDISKNLRDIIHLEITLDAFCSSTCKGLCLVCGANLNTSSCSCSTEEPQAKDARRPGTLKDLLKPMQRRL

SEQ ID NO: 137322 - protein, 95 aa, Triticum aestivum
  Clone ID: PAT_TA_31740.pep
MENMVSNEEFNVALDTLKTSMTTAVENMFTKFLEGLKLPTSSLKVGDPTNKVTDANSDKGEANSEKGPSTSGRMAPTSLPMWNLQLMEDRFPLLI

SEQ ID NO: 137323 - protein, 95 aa, Triticum aestivum
  unsure (1)..(95): unsure at all Xaa locations
  Clone ID: PAT_TA_31741.pep
VSSSYPKQHFGSRVXSMSTGAMDLLERMLVFDPSKRITVDEALCHPYLASLHEINDEPVCPAPFSFDFEQPSFTEEDIKELIWREALKFNPEPIH

SEQ ID NO: 137324 - protein, 221 aa, Triticum aestivum
  Clone ID: PAT_TA_31742.pep
STPLFYLSFLGIGVDGDFEHRSSTTNLQRWGPWKPHVRIYTCFREDDPLFQIIFAEDAGDIFSMLFWLGAMVIYYLNSFCKKQSSLEIKFSRHSQAALAAFFSSQSSSSLGCACDLHRVRKNCNWRIIVPPPIKSKNSIHGSQLNNQLCLHLCLGYQFLVCIVQHHHHAITNRCNRKGESMLPYVAAGLRCPRITLQEEGSGEGRRPVGEWEGAGRRRGAS

SEQ ID NO: 137325 - protein, 100 aa, Triticum aestivum
  Clone ID: PAT_TA_31743.pep
MSTRIGQLQQLSCKVFSNVYNPTCARTGNKVLRQRLLGPTLTAYNPKQIVHFRDIQALYPQLGLVDLEEKERLDEIARRKRRGKGAPKKGQGKRAANKKK

SEQ ID NO: 137326 - protein, 208 aa, Triticum aestivum
  Clone ID: PAT_TA_31744.pep
MPQLFLLFLSFSLAVEALHSFMQDESEHKHYLIVSAVTNLLVNLLGVWFFRSYARVNIVSRKAEDMNHHSICLHVLLLLSPSAGLILASWFLSLGIENAEVLCLGIVSVAVFMLVMPLFKATGNVLLQIAPGNVPPSAFIKCGRQITACEDVSEVSQARFWELVPGHAVGCLSIRLKNSSDDESVLEYVHGLYEDLGIHDLTIQTEKS

SEQ ID NO: 137327 - protein, 229 aa, Triticum aestivum
  Clone ID: PAT_TA_31745.pep
MREVTMRSLCYVTFLLILSISNVQLSASVRLLAESPHGQPGAPAPLPPGGLSGNIPANVPASMSDNIPGNLPASLPENMPVNLPANVPPGVLANVPPGMLASVPPEMLANLSTTMTPAMLSKIPPEALASIPPDKLPPNVTPDMLVTLAAMKQQEQQQPGQPAAGASKGNAAAGLPQIPKMPDLSGLTNLSFPPMRSASLPKMPNLSLFGFDVKIPKFINKMVKENTDS

SEQ ID NO: 137328 - protein, 275 aa, Triticum aestivum
  Clone ID: PAT_TA_31746.pep
PEISCLSVGDLAAPPRLRWPAWPRQVGGASGKHGPVDRFQEASLRRRRRRRVGIKVPRLRPRFVGSPTSGEKLVGVWFLLLQPCSGDVLLCGAEERVRTMCVLLQGSTGGTAGSSADGALLGMDGVHGWHRIWLAVEGPGCLQGGRVASSPGLEVKELGEHGRHGRCLRPMEKLGSNPVLCIWCLLRLTNANVQGVPSALCEPLLRVISGLQRWWLASTRRSGIGGEDQGWGCKFSLFGVFCDVWRGQLYGLYPSCIFVFVRLVSTFVCTVFRLV

SEQ ID NO: 137329 - protein, 90 aa, Triticum aestivum
  Clone ID: PAT_TA_31747.pep
SHSLPVLSGSFVPSVCKSQNYVVVPMLVALCINFFMQVEALLVTARRVDLSSNCFYHYIVVSFNSRIYSYAKYTINLMVQPVMHFVARPE

SEQ ID NO: 137330 - protein, 106 aa, Triticum aestivum
  Clone ID: PAT_TA_31748.pep
YTKFQAPSSHQASFFCFQSEEYMVSHVRRVMKAAVNLGDVYLYDRVTCIYCEGVEPLKPIVFPKTDEQMSSVEKQIREGTESPAIIHFLSAAEISDDYLARICEDG

SEQ ID NO: 137331 - protein, 138 aa, Triticum aestivum
  Clone ID: PAT_TA_31749.pep
RSVRRLLSLSHAPGSARVLLPLVSSKPVVSSSAPSQPPHATWCEPTNPRYGCSFSWDPVMEGGSVTSPLGVPMVAMTTACAPALSAVESINIVRNQDYNNATLFAEINSPMLLNDDFSTPKKKESFSQELSRMNRSSV

SEQ ID NO: 137332 - protein, 528 aa, Triticum aestivum
  unsure (1)..(528): unsure at all Xaa locations
  Clone ID: PAT_TA_31750.pep
MESETAARGGRSQPLAEEAVGSSRTMERVAAAKKIIENDYRERMKNLRERNERRLILEQQLASSQVPREEQIKLIKELQRKETEYMRLKRHRICVDDFELLTIIGRGAYGEVQLCRDKSSGNIYAMKKXLKKSEMVVKGQVEHVRSERNLLAEVGSHCIVKLYYSFQDAEYLYLIMEYLPGGDMMTLLMREDTLTENVARFYIAETVLAIESIHKHNYIHRDIKPDNLLLDKNGHMKLSDFGLCKPIDCTKLSTLNEDEPMTDENLRESMDIDYSLPDTANGRRWRSPNEQLQHWQKNRRKLAFSTVGTPDYIAPEVLLKKGYGVECDWWSLGAIMYEMLVGYPPFYSDDPITTCRKIVHWRSYLKFPENPRLSPEAKDLICRFLCDVDHRIGSGGADQIKAHPWFHGVEWDKLYEMEAAFKPQVNDELDTQNFQKFDEVNPAPARTGSGSSRKMIPNSKDLSFVGYTYKNFEAVKGLRQSAGLGRSSSFTSQPSESASDTADMDSSAEPNGSDTHMRTVSSADHMMQ

SEQ ID NO: 137333 - protein, 375 aa, Triticum aestivum
  Clone ID: PAT_TA_31751.pep
MAQSAAKAAPATPFSSQPHGGGVLLRRPSSPPPPAAALRLGPLFWPWQKVKVGPLSVSPMGFGTWAWGNQLLWGYQESMDSELQECFNLALKNGINLFDTADSYGTGKLNGQSERLLGKFIRECQGPIKSPDDVIIATKFAAYPWRLTSGQFVNACKSSLERLQIDRLGIGQLHWSTANYAPLQERALWDGLVEMYDKGLVRAVGVSNYGPKQLLKIHSYLASRGVPLSSAQVQFSLLSMGDEQMELKTVCDSLGVRLIAYSPLGLGMLTGKYDASNLPNGPRSVLFRQILPGLESLLSCLSGIADRKGKTMSQVAINWCICKGAIPIPGVKTVRHVEDNLGALGWRLSPDEISELEAAAMECPKKMVQNIFQTA

SEQ ID NO: 137334 - protein, 229 aa, Triticum aestivum
  Clone ID: PAT_TA_31752.pep
HASAHASAHASGIFACTGLFIDWNGCTTILTSASLIRDPNDGNKIAENLKIEVNIPNEGCKKGILQHCNLHYNVALVDVEKFRPLCSSKILEEKWDPRILEDPNVVAVGRCFKSGVLMATHGKRTDWSGMLDCRDLRYSSCTITKAGIGGPLFDFRGRFVGMNFYDKKIGTPFVFKDHICRLLAQFEGKSTVDEVGSVDKPIRWPVPKPCWRHPDDELDDLRHWAWGKI

SEQ ID NO: 137335 - protein, 250 aa, Triticum aestivum
  Clone ID: PAT_TA_31753.pep
MNARVYTVVTLLETSIQPRRRRPHPPPQPPRKMPVRVVDTATPSSQASSGQDASRGRRSPPSCSLLTAGRCFAGTQNVSSLQKDEAWKVNVRIHGCDIEQGYLCGTMEALNVPLADTPVVTFWEGEIVDAKNYTFFTGKWEASAEDDVRHWSKFPSFTPLLSQIEADGGKSVDLSNYPYIFMRWKEQYFVNVGVDCGLTIAGFYYVCFSCSDGSISGFYYDPNSSPFQKLELKCTNEKQSGFTFSSYELQ

SEQ ID NO: 137336 - protein, 411 aa, Triticum aestivum
  Clone ID: PAT_TA_31754.pep
KELSVARDSVKTNARRPRSAGPRQGTDQPINTGKVSNFITGLVVGILFCVNLGLGVSVLFRLALNCIRGRYRSKSGMVIFTPKLIKRADHLAFLEKEDMLSSLAVIGRGGCGEVFKAQLPVESEGEEPKFIAIKKIKKQVGDGHGHGQNNLSDEESRQLDKWSRQIQSEIRTVGHIRHRNLLPLAAHVPRPDCHYLVYEYMKNGSLHNALKPTPSEEDGGSGGGVRLAWPARLRVAVGIASGLEYLHVLQQPQIIHRDLKPANILLDDDMEARIADFGLAKAMPDAHTHVSTSHVAGTMGYIAPEYHQSLKFTAKCDIYSFGVILAVLATGKEPTDQFFVTEVEEVGLVKWLRRVVQNSDYAEAIDPAIAGAGHEEQIMLVLRIAVFCTADEAKERPEAKDVRCMLAQIKN

SEQ ID NO: 137337 - protein, 86 aa, Triticum aestivum
  Clone ID: PAT_TA_31755.pep
MVRSLPSVSMEGRRLEEEEQREVLLIHSQVRRIKREDEETRRHLLKLQLLETRPAAGQGQEASPPASRSLSPLRRAGSAIPVGDWA

SEQ ID NO: 137338 - protein, 360 aa, Triticum aestivum
  Clone ID: PAT_TA_31756.pep
MALASPVDYAGIITSSQRQLSSVMPRCNGLQCTIGYGNKSRATGHLVVRAMSMDRPKLDFSNPNWKNQFQEDFDRRFSLPHLTDIIDVESRPTTFSLKSRTPLENVDGSLEESWNGYVNDDDRALLKVIKFASPTSAGAECIDPDCSWVEQWVHRAGPRKQIYFEPQCVKAGIVTCGGLCPGLNDVIRQIVLTLEKYGVKNIVGIQHGFRGFFEDHLAEVPLNRHVVQNINLAGGGASISDIVDSIQARRLDMLFVLGGNGTHAGADAIHGECRKRKLKVSIIGVPKTIDNDILLMDKTFGFDTAVEAAQRAINSAYIEAHSAFHGIGLVKLMGRSSGFITMHASLSSGQVDICLIPEVP

SEQ ID NO: 137339 - protein, 335 aa, Triticum aestivum
  unsure (1)..(335): unsure at all Xaa locations
  Clone ID: PAT_TA_31757.pep
MARRHAPVLRAMLNLVSVLKSGTGGNELAMLRARRYCGNLGCVALRNGSHCGNTGPIGLTGLXTWKYPIPQGEIHHVMNPDPYRGAFGSDAAAYAREVEEHINFGSSGRVGGFIAETFQGVGGTVELAPGYLKSVYDTVRKAGGVCIADEVQSGFGRTGSNYWGFQTQDVIPDIVTMAKGIGNGLPLGAVVTTPEIASVMAQKIQFNTFGGNPVCSAGGLAVLKVLDKEKRQAHCADVGVHLVERLKSLQQKHEIIGDVRGRGLMLGVELVTDRTEKTPAKAETALLFEKLKDLGVLVGKGGLHSNVFRIKPPMCFSKDDADFLVDAMDYAMSGF

SEQ ID NO: 137340 - protein, 180 aa, Triticum aestivum
  Clone ID: PAT_TA_31758.pep
RNYPTYKFGTHIPPINPSLTHSSYPGGGRQAADTSLAAVRLTAEAGQRGEARLLAPVGRPSLAADGPVRADTASRRLGGQYLTRTLVLKLNALISSLVAAQCPHRPIPYWPTSQSVAPLPSSQSSVWQLITSSSLLAQCLQQDQGLLLQPQPEEQENILPSDVEEEEEEVENQEVKEDID

SEQ ID NO: 137341 - protein, 100 aa, Triticum aestivum
  Clone ID: PAT_TA_31759.pep
MDELGGGGGKKGKAWPWWLGASAAQITGALVWFRRGKGGSDMTMPFRAFAVASLFVGAGATTVTAGVSAAGVGSVEEMKGLGARIRKWSRVPPRRVEGGE

SEQ ID NO: 137342 - protein, 204 aa, Triticum aestivum
  Clone ID: PAT_TA_31760.pep
MAAPTAPPPPKTVLRVAAISGSLRRASANTGLIRAAAEICRESIPGLQIDHVDISELPLLNTDLEAGGRFPPAVEAFRDKVRAADCFLFASPEYNYSISGPLKNALDWGSRPPNCWADRAAAMLSASGSTGGSRSQYHIRQVGVFLDIHFINKPEVFTKAHLPPRKFDADGNLIDSETKEQVRNMLLSLQEFSLRLQGKSEQGN

SEQ ID NO: 137343 - protein, 113 aa, Triticum aestivum
  Clone ID: PAT_TA_31761.pep
RSTPLYIIKQPHQHPSTREVSGSKFNNKEGKKSNRIQIGLAGGTAQHPLNKSTPPHTRCKKLIHPEDYIAQVNQNGCVRLNYVNQQQHWPGRVQNVKCCCPRASLLHMSLQAE

SEQ ID NO: 137344 - protein, 343 aa, Triticum aestivum
  Clone ID: PAT_TA_31762.pep
MAEVSNKRVILKRYVTGFPSEDDMELVPATARLAVPPGSAAVVVKNLYLSCDPYLRSRMSGNDEPSHVPDFVQGEVLTTLGVSKVVESGHQDYKPGDLVWGMTGCEEYTLITNLQSHFKINHPELPLSYYTGVLGMPGLTAYAGFFDVAKPKKGDYVFVSAASGAVGQLVGQLAKISGCYVVGSAGSDEKVNLLKTKFGFDDAFNYKKEQDLNATLKRCFPEGIDIYFENVGGAMLDAVLLNMRLHGRVSVCGMISQYNLEQREGVHNLFCIVAKRIRMEGFIVRDHYGSYRKFEEEMAGYLKEGKITYVEDVAEGIESFPAALIGLFYGRNIGKQLVAVARE

SEQ ID NO: 137345 - protein, 134 aa, Triticum aestivum
  Clone ID: PAT_TA_31763.pep
LDLCAIDEKVYLYAILMYDEKLEDRTLEEVLFFMRLHGRVSVCGLISQYNLEQSEGVRNLFCIITKRIRMEGFIVTDHYGSYRKFEEEMAGYLKEGKITYVEDVAEGIESFPTALIGLFYGRNIGKQLVVVARE

SEQ ID NO: 137346 - protein, 144 aa, Triticum aestivum
  Clone ID: PAT_TA_31764.pep
MAFKHQLILSTAILLAVLAAASASFREQCVPGREITYESLNACREYAVRQTCGYYLSAERQKRRCCDELSKVPELCRCEVLHILMDGRVTKEGVVKGSLLQDMSGCKKLTREFIAGIVGREECNLETVFGRYHYCPTEYPEVVV

SEQ ID NO: 137347 - protein, 91 aa, Triticum aestivum
  Clone ID: PAT_TA_31765.pep
MSYYNQQPPVGAPPPQGYGDKGGYPPPGYPPAGYPPPAQGYPPAGYPQQGYPPQYAQQPPPHQQQQQSSGPSFMEGCLAALCCCCLLDACF

SEQ ID NO: 137348 - protein, 91 aa, Triticum aestivum; identical to SEQ ID NO: 137347
  Clone ID: PAT_TA_31766.pep

SEQ ID NO: 137349 - protein, 223 aa, Triticum aestivum
  Clone ID: PAT_TA_31767.pep
HHPLGCSLLPYFLHMRMDTHMRFVHGSSNRLIHARAIYKVTRPLQVQDIRTGSNGTARRRSFFFFFFFCTARSSPMSSVACNLKFRPKSSRNSSQRVICTARSSLKSSAACNLKFTPKSSRNSSKLVICTARSSPMSSMAHNLKFRPKCSTNSSKRVICTARRSLMSSVACNLKFRLKSSRNSSNLVICPARSSPMPSMAHNLKFKPKRSRNSRKRVICIARS

SEQ ID NO: 137350 - protein, 181 aa, Triticum aestivum
  Clone ID: PAT_TA_31768.pep
WFSLHRICKSSSKILDTVELRLPPYSYDSEAVWIRIPRSAKIAVEERKLEFRGGSHAASHALLNILPLHMMCSASDLGTECVNPHETRGMPERILLYDKHPGGIGLATQVKKLFGELLLAALELVSTCSCPSASGCPNCIQSLTCSEYNEVLDKEAAILILKGVIEHERSYFEVEEASDRS

SEQ ID NO: 137351 - protein, 137 aa, Triticum aestivum
  Clone ID: PAT_TA_31769.pep
MSAASGAACRVCGGGAEDCSCLLQRGRGAAGVRCGVADLNRGFPGMFGQAAEEPAVDVVAGGGGAAAVGLQDFQFFGQEDHESVACLFNDHAPLGGEDRLQHRPATTEQLQRRQAFDAYAEYQPGHGLTFDVPVPLS

SEQ ID NO: 137352 - protein, 166 aa, Triticum aestivum
  unsure (1)..(166): unsure at all Xaa locations
  Clone ID: PAT_TA_31770.pep
MVGQMQISWPSTIVELILGLLWHLVHLLVSLFDLWSHLSDNLECYLISSELLPKYQDLHFERLNYVGVVVDSREANNVLKIKQLLXTVSTIVVKYVVLYDIEIVLKEWLKPGIVTPRDENSGSNLDLSAHGGMTIECLSGSDGKEGIAKAANLLCSDFCNRNTHGA

SEQ ID NO: 137353 - protein, 121 aa, Triticum aestivum
  Clone ID: PAT_TA_31771.pep
MAPKAEKKPKVEKRVPGKEGETRKKKAKKSNETYKIYIFKVLKQIDPNMGISSKSMSIINSIINDIFEKLAGESAKLARYNKKPTITSREIQTAVRLVFPGELAKHAVSEGTKAVTRFTVY

SEQ ID NO: 137354 - protein, 207 aa, Triticum aestivum
  unsure (1)..(207): unsure at all Xaa locations
  Clone ID: PAT_TA_31772.pep
MGKPRASGDVESRALASGSGGATAPLLHRNDRKEDAKTQGGSLSMVLFSTAVAVCGSFEFGTCVGYSAPTQLGIEHELGLSIAEFAIFGSVLTIGAMIGAVTSGRLADSLGRKMTMRIAATICIFGWLSIHFAKGATMLYFGRTLLGFCTGVLSYVVPVFIAEIAPKDLRGGLATXNQLLIVCGSSSTYIIGALVTWRNLVFVGIVP

SEQ ID NO: 137355 - protein, 69 aa, Triticum aestivum
  Clone ID: PAT_TA_31773.pep
MADEEVSDPKALLEDRTKAKCVYQWYEYQKCVKRIEGDETGQKHCTGQYFDYWKCIDKHVAEKLFDSLK

SEQ ID NO: 137356 - protein, 198 aa, Triticum aestivum
  unsure (1)..(198): unsure at all Xaa locations
  Clone ID: PAT_TA_31774.pep
MYQYSVVWVLFWHSTKENLREMFGSVGKRFXGEAARRTEGIAGDVWQHLKTGPSITDAAMGRIAQVSKVISEGGYDKIFQQTFECLPDEKLKKAYACYLSTSHGPIMGVLYVSTAKLAFCSDSPVAYVTEDNQTASAIYKIVVPVPHLRSVTPTASQQNPAERYIQVVSVDNHDFWFMGFVNYDSAVKCLQDAARGGA

SEQ ID NO: 137357 - protein, 173 aa, Triticum aestivum
  Clone ID: PAT_TA_31775.pep
MEKALTKLGSFTIPRKAKQELSAIGGDISRISSTVEEKAKWVFEKLKGKPNKSLSDLLREYNLPPGLFPRNIICYEYDQTSSRLVVHLAKPCEVSFKDSSMIRYATRVKATLSRGKLSAIEGMKTKVVVWVKVTTVNLESFRSDKVCFIAGVKKLRQKDAYEVPREAASVEEF

SEQ ID NO: 137358 - protein, 110 aa, Triticum aestivum
  Clone ID: PAT_TA_31776.pep
IITRTHDTRHTTHDTPPAKTTPISRHGHEELHHELLTAQHQIRTHVVLRMLRVRTPSRPAQWMNPRWVVMDLVVHMLLAIISWYLRYDSCFSSKNFAWNLAMNFSASPSA

SEQ ID NO: 137359 - protein, 129 aa, Triticum aestivum
  Clone ID: PAT_TA_31777.pep
PRRRRPRPPARHPTTSPPPANTGTRTPPCRRTPPPPPPPRPPPSPEPQRSTPPRTRSRCMTNSRARGWRPTDPSLELAGRRCRRSASSRSRRSCSSASCRRSSSPTSSSSDRSGRTRRCQLSRRPSSSC

SEQ ID NO: 137360 - protein, 66 aa, Triticum aestivum
  Clone ID: PAT_TA_31778.pep
HTYFIVQNIHRMCKTIISTILNDMLGLWLLDQTWKSRAPTCSQETTEHPTYKSFFCSYDVLWLQIL

SEQ ID NO: 137361 - protein, 80 aa, Triticum aestivum
  Clone ID: PAT_TA_31779.pep
MQHHSSSNELGEKYKCAERLGIKIVNHRWLEDCLKSWKILPEDDYSESGWELEIVEAQAKERLNFPIRDRQVRKWEVCRE

SEQ ID NO: 137362 - protein, 210 aa, Triticum aestivum
  Clone ID: PAT_TA_31780.pep
MASGLVTEDVTVGRLVRIRRTVMHMLRDRGYLVVEHELSMTRRDFQRKYGESFHREDMLINKCKKNDPNDQIYVFFPNDEKVGMKHIKKYVEMMNAEKVSRAILVVQQNLTPFAKSFLQELEPKIHLEVFQDAEMLINIKEHVLVPEHQVLANEEKKTLLARYTLKETQLPRIQITDPIARYYGLKRGQVVKIIRPSETAGRYVTYRYVV

SEQ ID NO: 137363 - protein, 103 aa, Triticum aestivum
  Clone ID: PAT_TA_31781.pep
NEPEEPEATAKAFLEVLASSKKPLYAGAKISQLDAISQLIAVKAEYGCIQKCFEAFLGVWANSLPEGHELPKSMYDTKNIMKALSMDYDKIDVCPKNCLLFMH

SEQ ID NO: 137364 - protein, 202 aa, Triticum aestivum
  unsure (1)..(202): unsure at all Xaa locations
  Clone ID: PAT_TA_31782.pep
MAAEKPAPAKVLYCGVCGLPAEYCEFGPDFERCKPWLRAHAPGVYPDELVASSSGGDDKDVGKVGERLQGVSISTADGSTSAGGASASSKTEEVKRLPGGXKLKKKDKQEVIIEKIVRNKRKXVTVVKGLDLFGVKLSDASKKLGKKFATGASVVKGPTEKEQIDVQGDISYDVVDFITATWPDVPESAVYFIEDGRKVAAA

SEQ ID NO: 137365 - protein, 332 aa, Triticum aestivum
  Clone ID: PAT_TA_31783.pep
MATTVVPLAAAMAAAPRSLLLGAPDPFPFLGIRPLLCRSPRGVACALRRPSKYKNKIKNEVVVAEDDIDGSDEDDDDDEGGLEALFKQLEEDLKNDDLSVEDDDDDDEISEEDMARFEQVLAEAIGDVDVADESAVDLVSGSEVVGNDEAADPVERPELKSWQLRRLARAMQIGRRKTSIKNLAGELGLDRGLVIELLRNPPPELLLMSDSLPDEAPSKPETKEIEPSPVADEVVVDEIDATEANPQMDLPVHVMSTEWSAQKRLKKAQLETLEKVYFKSKRPTNTMISSIVQVTSLPRKTIIKWFEDRREQDGVPDRRAAYMRSLSETMAS

SEQ ID NO: 137366 - protein, 191 aa, Triticum aestivum
  Clone ID: PAT_TA_31784.pep
MGETRSWSSLLVHILVIALCLTGFGFAIAAERRRSTGSIVTDINNSTYCTYDSDISTGYGVGAFLFLLSGQSLLMGVTKCMCFGQPLAPGGSRAWSIIYFVSSWITFIIAESCLIAGATNNAYHNKYMHMIYAGSWTCDSLRKRVFIWGAVFVVVTMTLNVYFYMYYTKSTRQAAKKTNKATANVGMAGYA

SEQ ID NO: 137367 - protein, 341 aa, Triticum aestivum
  Clone ID: PAT_TA_31785.pep
IRWPNGAEVLLQVTWDEPDLLQNVKRVSPWLVELVSNMPAIHLAPFSPPRKKLCVPFYPDLPVDGQFPAPMFHGNPLGRGGVGPMCYFPDGTPAGIQGARHAQTGLSLSDLHLNKLQSSLSPHGLHQVDHGGQPRIAAGLIIGHPAARDDISCMLTIGNHQSNNKKSDVKKASPQLMLFGKPILTEQQITLGNSGGFCPSAARKSPSDMSAEKSANNSDLPSPQSNQNGTTKNLSCGGVPLCQDNKVLDLGLDIGHCKIFMQSEDVGRTLDLSAVGSYEELYRRLSDMFGMEKAELMSHVFYRDAAGALKHTGDEPFSDFTKTARRLTILTDTSGDSSVVS

SEQ ID NO: 137368 - protein, 408 aa, Triticum aestivum
  Clone ID: PAT_TA_31786.pep
WGAHETEIVEVVADQVAVALSHASLLEESQAMRDRLAEQNRELLQARRDTLMANEARDAFQRVMSQGMRRPIHSILGLVSVVQEDDLTPEQKLVVDTMGRTATVVSTLINDVMEMSATNRERFPLETRPFQLHSMIRDAACVSRCLCDFRGFGFAVHVENTLPNLVIGDERRIFHVILHMVGNLISRIDSGHVTFRVRADDEVAEDTLGQRWDPWRPSYSSGYSSVKFVIGVKSQQSSGSMIPPPGQFKRKPSGEGFDLRLSFSMCRKLVQMMRGNIWAVLDGQGLPESMTLVLRFQLQPPAPLMSSSTSGGSFERQYASPSCQLTGLKILLIDDDDINMVVARKLLEKLGCVVSSLPSGSGFLNSVGPSSGAYQVVLVNLEMTRVSALDVAARVQQYRSGRWPFVMA

SEQ ID NO: 137369 - protein, 125 aa, Triticum aestivum
  unsure (1)..(125): unsure at all Xaa locations
  Clone ID: PAT_TA_31787.pep
XXKRXTILALEAXREKVEVDKELQSMQQLSVKKDAEEVFIKLGSDKXKKKESTEREERAKKSLSINEFLKPAEGERYNGGRGRGRGFRGRGEARGGYNGGGGGGRRPAAAPAIEDQSQFPTLGGK

SEQ ID NO: 137370 - protein, 235 aa, Triticum aestivum
  Clone ID: PAT_TA_31788.pep
QQQVHQENISYMALSYRNERNKLRLKQDTGGWRWAGAPPVYTGYTDGDEDTATDKKTDGRNDDTLLSTDNSTRTQSGANHRGAAASRIRARDTDPFTSHLASETGTGLRSPEQQLDACQAAACVVPATGLAIARSSKLVGPATAGRLCFTPLPALGAAEARPGPRPSFVALALSRLQESVDAEGLLSTLLSCYVLYRLQLVVALHPLSSQRFVRELHCRLLLQYFVILIQCHLLI

SEQ ID NO: 137371 - protein, 243 aa, Triticum aestivum
  Clone ID: PAT_TA_31789.pep
MASPGPAPAGELLRIDPIELRFPFELKKQISCSMQLSNLSDDYIAFKVKTTSPKKYSVRPNTGVVLPRSTCDVVVTMQAQREVPSDMQCKDKFLVQSVVAPSGINVKDVTGEMFMKESGNKIEEMKLRVTYVAPPQPPSPVPEESEEGSPSRVESENGDGPAGGFTRALRERIEPQEKSLEAGALISKLTEEKNSAIQQNHKIRQELDMMRREVSKRRGGGFSFVIVIIVALIGIFLGYMMKS

SEQ ID NO: 137372 - protein, 88 aa, Triticum aestivum
  unsure (1)..(88): unsure at all Xaa locations
  Clone ID: PAT_TA_31790.pep
SCGKAXRQXXRNFGQTVDFXPRFVEPERARGGARGGRAGRGGRGGERGGDRAREGNRGGRGGAPQGAAKGNAAINTNDQSAFPSLGGN

SEQ ID NO: 137373 - protein, 148 aa, Triticum aestivum
  Clone ID: PAT_TA_31791.pep
MPRARRPRREWSPGVPPALLAVIFLDLACLSYLASSSAVCRASPTVAGFAGTPRAWRSVAWLLGAPPEPRSFFWLLLPAQRKPSLFKLLSGAKLWATHDRRWDAVAFWQAPMKAGNLLPSSSGGVSPDRLRTAHPAPFPRRTPAASTT

SEQ ID NO: 137374 - protein, 102 aa, Triticum aestivum
  Clone ID: PAT_TA_31792.pep
IEQRLVSSGYKPDLSEARMVAGMDHTKGAALRLHSERLAISFGLLKATPGAPIRILKNLRVCKDCHTISKLISELYGVEIIVRDRIRFHHFKDGACSCKDYW

SEQ ID NO: 137375 - protein, 293 aa, Triticum aestivum
  Clone ID: PAT_TA_31793.pep
SARGFGECTNTAGGHLCRCPRGAQGDPLIRNGCIKSSLGLSVGIGVGSGASPSLMVLGAILITRKMKQRRAKMLKKRFFKQNRGHLLQQLVSQKADIAERMIIPLVELQKATNNFDKAREIGGGGHGTVYKGIMSDLHVVAIKKSKVAIQREIDEFINEVAILSQINHRNVVKLFGCCLETEVPLLVYEFISNGTLYHHLHVQEPAPSLTWEYRVRIATETARALAYLHSAVSFPIVHRDIKSQNILLDGTLVAKVSDFGASRCIPLDQTGDETAIQGTFGYLDPMYLPGRPL

SEQ ID NO: 137376 - protein, 178 aa, Triticum aestivum
  unsure (1)..(178): unsure at all Xaa locations
  Clone ID: PAT_TA_31794.pep
AKRRRRRRPSPFSGHLAASLRLRPSTQKKKKEGEKTGSQTQVAILCDASTRTTRPPVAESAGAHVRERERRGAVGTDRRGTRAASSSEMFLGLLNPHAPHGKLLAVGLVAAWTSIAAAASSLSEQVWCSQKSFNCMPCSMIYISDAYPGTFTPPLAQHNGLADVPDSSDLCKGLTNXP

SEQ ID NO: 137377 - protein, 122 aa, Triticum aestivum
  Clone ID: PAT_TA_31795.pep
MPPWISPGLQQRCARWCPFRPRRLGASRTSPSCPPAQLRPLQLRKSTRAWRRSRLGSKGRSVSGTRTRRPRPAPRPSPTPSPAPFPSSSPSPSPSPSPRSAPPPAPPPAPAPTRDRLIGFHI

SEQ ID NO: 137378 - protein, 140 aa, Triticum aestivum
  Clone ID: PAT_TA_31796.pep
LFSYTSLLLKRSGVAVSLLLLLVLKRSGLAVNQSGPSGSASCCSCARRRRRHQLHLQKRSAPPLRGRRSVSCRPSCRWRRQSRRRRRRRSRAGWCRGCTCWRRTHRRRSPARCRSRTRGSSRRSTCRTPTSQARPWRPPP

SEQ ID NO: 137379 - protein, 247 aa, Triticum aestivum
  Clone ID: PAT_TA_31797.pep
EAHPVMLPPQAPVQLTRAAHRAIETVQQLIGEPLREDGPVLGDHFDPLPPGAFGAPMPVVPEQRKQPYRSHETSVFSAHDPKPMKASAFLPSIDPSVSSTVTGKRKYMSGNSSHLPSRAVHEYQFLPEHTSDIYERTSQSCFYDASAEASNSRISSLSTGSRLVHGAEKASSYAFDGQVSGSSHLNQHGKPLISLSGSTDYEMASNIDVSPAPIEGQFGIPQVAGLQNPLASAEGVDYHDDAYRLDR

SEQ ID NO: 137380 - protein, 129 aa, Triticum aestivum
  Clone ID: PAT_TA_31798.pep
WRHTLEYWEASRRSPDQVLFLRYEDMLLDPSGSLRKMAVFMGCPFSPEEEADGVVRDIVELCSLGTLKGLEVNRSGSTMLGLKNEDFFRNGTVGDWSSCMTPDMAARLDGIVAEVLQGSMLTFGATSKD

SEQ ID NO: 137381 - protein, 211 aa, Triticum aestivum
  Clone ID: PAT_TA_31799.pep
MAPNAAVARVPLAVTVFVAVATSMLLAPAEAGLYSDRDALLALRGGLQDPDGALRSWILEVNPCEWTQVTCDRVANRVTEITIGHANLSGPLSPELGKLDQLTKLWISWTNIQGTIPEELGNLENLNSLHLHNNSLSGQIPASLGKLKSLKQLHLQQNHLTGPIPSELDGLSDQTSVNLSSNDLCGQIPTDGPFKNINSSLADNPRLGGNC

SEQ ID NO: 137382 - protein, 241 aa, Triticum aestivum
  Clone ID: PAT_TA_31800.pep
MAPKAAGARVPLAVTVFMAVVTTMLLQPAAAGLYGDRDALMALRRGLQDPDGALYTWIPEVSPCSNWSHVTCNGQANRVTEIVIGFVNLTGPLSPELGKLDQLTKLWISYTNIQGTIPEELGNLENLNTMHLHNNSLSGQIPASLAKLKSLKQLHLQQNRLTGPIPSELDGLSDQTSVNLSHNDLCGPIPTDGPIKNINSTPRRQPAAGAATARPIHGVGCRPEWQIYWVLLLLLLACSAG

SEQ ID NO: 137383 - protein, 241 aa, Triticum aestivum
  Clone ID: PAT_TA_31801.pep
MDDVWCSLDMAADIAGLHSALADPFWPADLDLMVSTHEVEGIADMDASGFFVGGGDDRFMLPSSTTSSLSSKRSLSLDSGGSSGSGSFSLDLADATRYQAPALPVPHNPLAGAVDHDDEAIMRAMMAVMSSSSASPSSSASSHPQPFCRDRDSNMQQQSAAMARQLRGGRSGHVMVKSSLSMSPERSSSGGPGQQQEDPTRAASGHTGQLYHMMSEKKRREKLNDSFHTLRSLLSPCSRKT

SEQ ID NO: 137384 - protein, 110 aa, Triticum aestivum
  Clone ID: PAT_TA_31802.pep
FWSASHSGQSENRGCVVAGLERDGGGAARAWATALPPAVLRRRRGDVQTRRSTEVTMVVLTAKEGSLCGQRRTASVNVRLLDWVLHRDGDEIHRESFCQRRKFREIGREV

SEQ ID NO: 137385 - protein, 349 aa, Triticum aestivum
  Clone ID: PAT_TA_31803.pep
WAPSVARRHGAACASLFTQAPAVNVAYAHAGAGRLAVPVVAGTVPPELPGLPAVLGPDDVPSFMAKTDECPAYLDLLVRQFVGLDAADYVLVNSFHEQIWKESEYMASMWGAKTVGPTVPSAYLDNRLPDDASYGFHLHTPTTAATKAWLDARPARSVAYVSFGSIAALGPEQMAEVAEGLFNSGKPFLWVDWALATSKIPDGFTDKADGKGLIVPWTAQLEVLAHGAVGCYVTHWGWNSTTEALSAGVPMVAVPHWSDQPTNAKYMEDVWRVGVRARPDPGGVVRREEVERCVREVMGNEEYRTRAASWSEKTKAAMSEGGSSDRNILEFFRGLGSRKSERSGAAEDL

SEQ ID NO: 137386 - protein, 303 aa, Triticum aestivum
  unsure (1)..(303): unsure at all Xaa locations
  Clone ID: PAT_TA_31804.pep
STQGRKEYAAEVRIISQLRHRHLVRLVGWCHEHRGDFLLVYELMPNGSVDQHLYGKGVHLTWPTRYDIALGLASALLYLHEECLQCIVHRDIKPSNVMLDATFXSAKLGDFGLAKLVEHGSQPYTTVLAGTLGYLAPECLTTGKSSRESDVYSFGVVALEIACGRXPSEPTAEPSKARLVPWVWELYGKKALLEAADWRLKVEFDEKQMEHLMVVGLWCAHPDYTRTRGIRQALNALKFEAALPVLAPKMPVPTFFPLPDLAALVSSVGGASDTQNPGGVTECESSGANAGKGSSVRDRLLEP

SEQ ID NO: 137387 - protein, 131 aa, Triticum aestivum
  Clone ID: PAT_TA_31805.pep
MAKTGWWEKAAKKIREEDAAKLKKKKEEELEKERKAKQRASNAMRAREQVLMRKCEEAQKKRQQDFEERTMKLWAIAAEKEERDNQIFMERVVKEAHLIKKRRRKRKKRGRRRERGLALRNRAMSSSSIWL

SEQ ID NO: 137388 - protein, 131 aa, Triticum aestivum
  Clone ID: PAT_TA_31806.pep
RPPTVSFGREVDEEPVGGPRPKVEDDLEIGTDLLKISQRRNYEDVDAETGGRRSRSSEVEGTASARPVACSESQIPAVGGTDVRVRHSSWDRRSGNWDMSSAVLTRSASDVIGRSSVFAADAARPSLEETR

SEQ ID NO: 137389 - protein, 614 aa, Triticum aestivum
  Clone ID: PAT_TA_31807.pep
MGCIPTYCSYQTNSVGSLKLSPHIQLQQSCNNGVMLLSMRNKTQLAKRRATNYGTHHNSSRTPAPIVCSTGMPIIFVATEVHPWCKTGGLGDVVGGLPPALAAMGHRVMTIAPRYDQYKDTWDTNVLVEVIVGDRTETVRFFHCYKRGVETETVRFFHCYERVWGKTGSKLYGPTTGTDFRTGSKLYGPTTGTDFRDNQLRFCLLCLAALEAPRVLNLNNSEYFSGPYGENVVFVANDWHTAVLPCYLKSMYKQNGIYENAKVAFCIHNIAYQGRFPRVDFELLNLPESFMPSFDFVDGHVKPVVGRKINWMKAGITECDVVLTVSPHYVKELTSGPEKGVELDGVLRAKPLETGIVNGMDVVDWNPATDKYISVKYNATTVAEARALNKEILQAEVGLPVDSSIPVIVFIGRLEEQKGSDILIAAIPEFLEENVQIIVLGTGKKKMEEELMLLEAKYPQNARGIAKFNVPLAHMMFAGANFIIVPSRFEPCGLIQLQGMRYGVIPICSSTGGLVDTVSEGVTGFHMGSFNVEFETVDPADVAAVASNVTRALKQYKTPSFHAMVQNCMAQDLSWKGPAKKWEEALLGLGVEGSQPGIEGEEIAPLAKQNVATP

SEQ ID NO: 137390 - protein, 293 aa, Triticum aestivum
  Clone ID: PAT_TA_31808.pep
FDLEAGEHGKFAVVLVHGFGGGVFAWRHVSNLLARQVGCTVLAFDRPGWGLTSRPRRKDWEDKNLPNPYELESQVDLLISFCSDMGLGSVILVGHDDGGLLALRTAEKLRASGDSRKVEVKGVVLIGVSLSREVIPAFARILLHTPLRKKHMVRPLLRTEITQVINRRAWFDATKLTTDVLNLYKAPLYVEGWDEALHEVGRLSFSTVLSSKRATELLRSVEDLPVLVVAGSEDALVSLKSAQTMASELVNSRLVTISGCGHLPHEECANALLSALSPFISKLVSSDDSLQRL

SEQ ID NO: 137391 - protein, 205 aa, Triticum aestivum
  Clone ID: PAT_TA_31809.pep
MAAAEGEASRLFRVRRTVMQMLRDRGYLVLDADVDLTMGEFVGRYGDPVRREDLVINRAKKDNPDDQIYVFFPNEPKPGTKVVTSYAEKMAQENVPNGILVVQQALTAFARNKLVETSKFRLQVFQEGELLINIKNHDLVPEHVLLTQEQKKTLLEKYTVKETQLPRIQHSDPIARYYGMRRGQVVKITRPSETAGKYVTYRYVV

SEQ ID NO: 137392 - protein, 122 aa, Triticum aestivum
  Clone ID: PAT_TA_31810.pep
WYAPGSGTCQQLDPMDPVDDAPLPVPTVETNFEKDQTAALHRAYGGFRVVAAETGSLYERIRQGDYLTNDEIMGTLDKLQKIALHQMKDIASHGVVYSEVPTQPMHNASTSTTRPSDHQSSL

SEQ ID NO: 137393 - protein, 308 aa, Triticum aestivum
  unsure (1)..(308): unsure at all Xaa locations
  Clone ID: PAT_TA_31811.pep
LWSEIQTLKPNLVGPFADARLERNPAAKNAGKFMTLAEFLDFAKASNITGILIGIEHATYLIARSLDVVDAVSKALVKSGYDKETCKQRVLIQSEDAPVLAAFKTFPKFQRVLTIEFDISDASKPSVDEILEFANAVKLRRSPAARVCARVLGGCACSVVLRLHAPTPLVAGGALFIVLVHLAFDYWADPLVEIATDTLSVGADGIVTEFPATAAAYFRSPCANYEXKDLPFTINPAEPGGLLQLADXNSVPPAPPPAPVLEPQDILQQQLPVCPNDPMFRTFRCRLGPKETPTGKPEYNINMASLDD

SEQ ID NO: 137394 - protein, 69 aa, Triticum aestivum
  Clone ID: PAT_TA_31812.pep
RGRGRGIHGTTHEHFMSFFQKMLNLRDVQLREDYYPAPENDMMITEMRAESCLRFEQQLNNRQFRQIPD

SEQ ID NO: 137395 - protein, 139 aa, Triticum aestivum
  Clone ID: PAT_TA_31813.pep
ISRPALDSVGTPVCVEEILTLGIKPGWTKGTKITFPEKGNETRNVIPSDLVFIIEERAHPKFKRDGNDLVYTHKISLVDALTGCAVQLTTLDGRSLTVPVKSVISPTYEEVVQGEGIPITREPSKKGKAQVSDQVPPPL

SEQ ID NO: 137396 - protein, 278 aa, Triticum aestivum
  Clone ID: PAT_TA_31814.pep
MAGGGDNSQTNGGSQEPRAMEEGRKEDYDQGCGLAISLPFVQKIIAEIFGTYFLIFAGCGAVTVNKSKGQITFPGVAIVWGLTVMVMVYSVGHISGAHFNPAVTFAFATVRRFPWRQVPAYVLAQMLGATLASGTLRLMFGGRHEHFPGTLPTGSDVQSLVLEFIITFYLMFVISGVSTDNRAIGELAGLAVGATILLNVLIAGPVSGASMNPARTVGPALIGSEYRSIWVYVVGPVAGAVAGAWAYNLIRFTNKPLRELTKSTSFLRSMSRMNSVSV

SEQ ID NO: 137397 - protein, 100 aa, Triticum aestivum
  Clone ID: PAT_TA_31815.pep
TCSSSSHIDTHSELPAYIAHCPAMLTYSLEGRLRPRYYVVKFLKENGLLEHGRGYYTTLVKTEKVFMEKFICPHKEAAPHLAEDYAAACKGEVPARFRFT

SEQ ID NO: 137398 - protein, 456 aa, Triticum aestivum
  Clone ID: PAT_TA_31816.pep
MDETLATVLSYLPPPSVSTTASPSSSSTASDDDDRINCLPDVLLRNIISRLPTKDAARTTILSSRWRSLWASTPLRLDDAGLVPTAVTAALNSHPGSVTSARLSSEHLAYQEPDVLDSWFASLSAKNVEELSVVNGSWPAECEWRPPPSLLGCASLRRVWLGLCQFPDISGLAPAFPSLQELGIVHCSMQDRELHAVLPRCPELERLAFVLTQDYPRYIHIWSGSLQSLVVWRSMVREVHLDDAPNLERLLLEPIGGASTHVKIINAPRLKIFGYFDVGLHQLKIGPTVIKDGIGMKVKPNAMVRTLRTLALKVQFGDEKQVKLVPLLLRCFPCLETLYIKSSPSESPTNVDVDFWDQVGHTECVTSHIKKFVFEAARGEDTELAFVKFVMERAQILEEMRVFVDDGCSRDVVLRRLSSEECVSADASVVVERQDMSHAWSFERASNMSQCDPFGC

SEQ ID NO: 137399 - protein, 122 aa, Triticum aestivum
  Clone ID: PAT_TA_31817.pep
ALGIPPRPRPRPDGATASAPPPLPPPRRRWRRRGDRGRGRPRRRPPPPRAPSTSSAAAGARAAARPAPHGGRGAGGHRGGCLLRRRHRLHSRVHPPPPPSARPGPARSRLPLRPRDGARVTP

SEQ ID NO: 137400 - protein, 272 aa, Triticum aestivum
  unsure (1)..(272): unsure at all Xaa locations
  Clone ID: PAT_TA_31818.pep
MWPLCFISDRLFKVPGDDGGDGDGPGAPLPPDARIPLARRSYFIDVPHVQQAFTWDCGLACVLMVLRTLGLDCCRGIPELEKRRRTTSGRTVDLAYPLHEFSVNFSFFTVTIGANPQYSAETFYREQLQEDIVRVDELFGTALFAGFTTLLHSRRSAAPQASGLSXSISCIAIALVDKSKLNSSWMNDVHDMQQFDEDSDYMGHYVVICGYDADACEFEIRDPASSRKREMVPMKSLDEARKSFGTDEDILLVSLTGKNGMKLSRKLPVGSP

SEQ ID NO: 137401 - protein, 258 aa, Triticum aestivum
  Clone ID: PAT_TA_31819.pep
MRAQLALSLLLFLVVASTSPLASAHGDLDYGGGVKKSEATGGYTAGIEKKPEAVSASAEKKPDAISADEKKPDVVSGSNVSSSTKTKPDVAPKNVDAEKKPVSASGYAGKKKKPEGGSKAAEEKKAEVASEKKSKRKSEPSQPSTIEKKPKSKNEKKSKGKNDASGYTGAEKKPKEKVDTPKKEKPKEEVMAMKPNKYTKPKEEAKKEVTAATVTSDSYTAPKNAQPETPAASTTDTYAAPKTAQPEMAAASTTGGYP

SEQ ID NO: 137402 - protein, 106 aa, Triticum aestivum
  Clone ID: PAT_TA_31820.pep
RNLKLPADTPPVLRRNPKLSRPVLRRNPKQSPVMRKKSKDRSRQPSHPKSKPYQTFTIRRKPKKRNTTLYKRKRDANWIHWLRRRNQNEKSGYTQKGRRQRRRSCL

SEQ ID NO: 137403 - protein, 201 aa, Triticum aestivum
  Clone ID: PAT_TA_31821.pep
PTRPRTRGVKIPVLLIYDDIKSTYGDIKPGSIIPYLVKVILHVDVPVIGRISLPLEKAGEIPVPYKPDVDISKIKFEKFSFEEATATLHLNLDNKNDFDLGLNALDYEIWLSNVSIASAETKESTNIKKQEVTTMTLPISFRPKDFGSAMWDMIRGKGTGYTIKGHIDVNTPFGHMKIPISREGGTTRLKKEDDDDDNDED

SEQ ID NO: 137404 - protein, 249 aa, Triticum aestivum
  Clone ID: PAT_TA_31822.pep
MHSFLVSSPTSSEIVTTDAYVAACVVPVIKRLLPSEWREWDMFDNIYKLDGVPVVTVQLRYNGWVTEVQDLEKSRQLQKAVGLDNLLYTPDADFSCFSDLALSSPADYYIEGQGSLIQAVLTPGDPYMPLPNEEIISKVEKQVLDLFPSARGLEVTWSSVVKIGQSLYREAPGNDPFRPDQKTPVKNFFLSGSYTKQDYIDSMEGATLSGRRTAAYICGAGEELLAIRKKLIVDHSEKASGMVQMLQTS

SEQ ID NO: 137405 - protein, 82 aa, Triticum aestivum
  Clone ID: PAT_TA_31823.pep
MGRLHTKGKVFFAPPPPYSRFSPGGLKTPPEKVDENISKFARKGATPSQIGVFPRDSHGIVQGKHVPGNRILQILSPRASPP

SEQ ID NO: 137406 - protein, 202 aa, Triticum aestivum
  Clone ID: PAT_TA_31824.pep
HASASPRPLEDLPPRAHSKTSRVPRLRFESARRVWHAKLVGEYARRNKREVCRVGLTLSKIPRRARQLLTLDEKDPNSTFGPNAFIRRLVRVGVLDESRMKLDYVLELKIENFLERRLQTCVWKLGLAKSIHHARVLIRQRHIRVGKQIVNVPSFIIGLDSQKHIDFARPSPFGGGRPGRVRRKKAKAAEGGEGGEDEEDEE

SEQ ID NO: 137407 - protein, 349 aa, Triticum aestivum
  Clone ID: PAT_TA_31825.pep
TRPDKDIEDKQDESDFSSDCDDFCVEIAKSCCGQEGVPSRAKVGGDRTDDLEGTTICANAAISNLPSKDPEMDQYVVLPVSARQKVQSPDSKKLAAYGKAPSDSSYSEELSKKGTPEKDNGKESEAGSFVRQSNEFTPQRSQQSFHGSVNGQNAEELLTPNGSSTTGQKRQYGPIINQRLHEQFKTDQYPSRAVKESLAQELGLTFRQVEKWFESRRRHIRVASNKGSTHVENHSTKENPNECKSDALNEDTPSGILNEGITQDGPLKQDIGGGLRTNASPPNSSQRYTTPLVRRPKGESRENHMKNTSSSSSGRPEGSDAGYAVLALEALDEKTRSKMLQELKKRKIG

SEQ ID NO: 137408 - protein, 364 aa, Triticum aestivum
  unsure (1)..(364): unsure at all Xaa locations
  Clone ID: PAT_TA_31826.pep
TRPPTRPPTRPHRVVSSVCILLSKDELVVLLHSCTLAACDKVKQSADGSIQAIIVFIIRRGKDLREADVLRTTQSLLSSAIALTDKHSRQEVLNAISCLAENTNHIVVFDEVLFVAGRDICTKDITRIRGGWAIQDVFYVFSQHKVLATLFLEYILSILHKEPVATNDSEKGEINSESSADDCILQATMFALNAFLRGGGKVGKQAVEQSYPSVLSALILKLGGLHGLAELGRNELLRSLLIAFQSFCDCVGDVEMGKILARDGERTEKEKWIDLVQEVACSSSVKRPNXNQRAAAVAPAAAPSGSMRPSRAEPALPGLVPAHLRQLVSPDSPTVRPPCARALGLRPGGHILYPGRPALHVLLS

SEQ ID NO: 137409 - protein, 119 aa, Triticum aestivum
  Clone ID: PAT_TA_31827.pep
MNLIANVLRFIPPGFPFLHSYGSESSPIGDLSEVCRTVPTYTYVDGDCTVPVESATADGFPAKERVGVRADHARAPVLMRMCSSLLKKWLGVSENARGRVSKSQIMDMPPERIPDQASL

SEQ ID NO: 137410 - protein, 202 aa, Triticum aestivum
  Clone ID: PAT_TA_31828.pep
DFVEREDEFDINAYAERVEELMIDQDAEIDVETCEKNSSFSDFEDSADEIIYLPAIPSPDAPDEQPDKCLVSSSKLEDSNHSGSPPSSMDAVQNGLAIPPASSPLEVVDNSMAEEPSAEAANAKRKRRLSAKGLEMQQAEKVKKPPIKMSSNGKPSKPKSKPVVEPVNGNSSAKIKQQVVEPVNGNSSAADIDDEATEEDEM

SEQ ID NO: 137411 - protein, 393 aa, Triticum aestivum
  Clone ID: PAT_TA_31829.pep
MAQDEVPESSSPSSAAAGRLNAAAPEFTPRSAAPHQAHPHRRGPHHHHHHHHQPHHQHQHQYRHQHHHQGEDEGDAAAVVDNAQLVLPEELARRVVKQVEFYFSDVNLATTDHLMKYITKDPDGFVPMTVVASFRKIRELIDRSLLPGALRTSTELVVSDDGKMVRRRVPFSDVDAEEVQSRIIVAEKLPEDHRYQNLMRIFSTVGSVKSIRTCYPQGIDISAGKSSRIEMLFANKLHAFVEYGTVEDAEKAVAEFSGGRNWRDGPRVRSLLGCLKHGIGQGRKGGDEEAADEDDPEEYEAEDAAQGEDGFYDKAGMRQGRGRGRGGRGRGRGQYHGQSRDGGHPIGTPPSNHSAEHPVVSKPPPGPRMPDGTKGFAMGRGKPQVSPAVLSDA

SEQ ID NO: 137412 - protein, 181 aa, Triticum aestivum
  Clone ID: PAT_TA_31830.pep
MALANARLGVLIVAAMLSASFLPLATARGRGGPINPLVAGVCAHTPFPELCKGTAGKHADKYPTIDNLAVLNMQVDAFAKRTAQARKFVSSASRKGTPAQTQALSFCDTMYMNTQDTIGAAQRAITFKDKGTAKIMLQLAVQDFQSCDRPFQQSGIPNPMLKYDEELSQMANNCMQLANMM

SEQ ID NO: 137413 - protein, 47 aa, Triticum aestivum
  Clone ID: PAT_TA_31831.pep
KTILIPYRTNLVRLQTGPNYADAFADFMKRMASSSGRAMTGGEKQRF

SEQ ID NO: 137414 - protein, 276 aa, Triticum aestivum
  unsure (1)..(276): unsure at all Xaa locations
  Clone ID: PAT_TA_31832.pep
MGDNKSPLSLSPMGGRDRDRELLIPVSGGGSAPGVDDEGADRASSASAALSSSGREAFHKVVRSWASKKFMTGCVILFPIAITFYFTWWFIHFVDGFFSPIYAQLGINIFGLGFITSVTFILSGILGGCHHATSXIGVIDWIIKRMPLVRHIYNASKQISAAISPDQNKQAFGDIFMVNSKDVIRPNLSVREGIEIVQSCAMSMPQNLSTVGSKSISACNPLIPRWKEQILRHLSGIPVRRYQVYNSQQMPQVLSTLDPHPHLHAIHTDRGGASRS

SEQ ID NO: 137415 - protein, 610 aa, Triticum aestivum
  unsure (1)..(610): unsure at all Xaa locations
  Clone ID: PAT_TA_31833.pep
MVAALVHLLVAFSAAVLAAAGGEQPLSKIGVHRATLAIHPGASVDVSPLLLGLQGQDQEWVTIGFNNPRPSKDDWIGVFSPANFSDSICPSENQWVEAPLLCTAPIKFQYANYTTADYAKTGKGSLRLQIINQRSDISFALFSGGLSNPKLITRSNSITFANPKAPVYPRLAQGKSWDEMTVTWTSGYSTKEATPFVEWGIQGQIQILSPAGTLXTFSRDTMCGPPARTVGWRDPGFIHTSFLKDLWPNLKYTYRIGHRLFNGQIVWGRQNSFKAPPYPGEDSLQRVVIFGDLGKAEIDGSNEYNDFERGSINTTYQLVKDLKNIDMVMHIGDICYASGYLSQWDQFTAQVEPIASTVPYMVASGNHERDWPGSGSFYGTLDSGGECGVPAQNMFYVPAENREQFWYSTDYGMFRFCVANTELDWRPGTEQYKFIEHCLSSVDRQKQPWLIFLAHRVLGYSSATFYGAEGTTEEPMGRESLQLLWQKYRVDIAMYGHVHGYERTCPVYENVCVAKGSDRYSGAFTATTHVVVGGGGASLAEYTAERARWSHAQDLDYGFAKLTAFNHTTLLMEYKRSRDGSVRDSFTVSRDYRDVLACGVDNCASTTMAS

SEQ ID NO: 137416 - protein, 185 aa, Triticum aestivum
  Clone ID: PAT_TA_31834.pep
HEEASAPAMEAIQKIPGDPCGVAVVETTPDGVRKIIGDISAYKLWKCDYVAAAWALANLSAGQFVIGADENGSTPISAFPLPHASASLSEEAAEPGRSPRLLKKFSSRNIGFLNSQANQVRSMYRGRSSPLMCRSTSSLAAVMAQMLSHRATHVWVTDAEAEEDDVLVGVVGYTDIFAAVTRSSA

SEQ ID NO: 137417 - protein, 108 aa, Triticum aestivum
  Clone ID: PAT_TA_31835.pep
PRVRPGVRGRVGLFKGLIDPLALVGARNSRMDGRSAATCFLVMLVLFGSTTFAEKCLTCSFYRLVFCTKGICKSVCVGWFGYPGQKILELWCSNFFFGTCTCKVSVDG

SEQ ID NO: 137418 - protein, 247 aa, Triticum aestivum
  Clone ID: PAT_TA_31836.pep
NSARVDMRGGDVDDRQLRDDLMTMLIAGHETTAAVLTWSIFLLAQNPTKMRKAQAEIDSVLIDGVITAEKLKKLEYIRLIIAEALRLYPQPPLLIRRSLRPDKLPGGYIGAKEGYEIPAGTDIFLSIYNLHRSPYFWDRPNEFEPERFTVPKKDENIEGWAGFDPDRSPGAMYPNEIIADFAFLPFGGGPRKCVGDQFALLESTVALALLLQKFDVELRGSPDEVEMVTGATIHTKNGLWCRLRKRS

SEQ ID NO: 137419 - protein, 118 aa, Triticum aestivum
  Clone ID: PAT_TA_31837.pep
APPTRVPCRLLAFPSSLTASIPLATAPWLPSSPRHCRRPPTIAGGPTRTWIVRPLSPSLAPTACAPRASTHPLVAARTAASAFWTSCAHLDVAVLPLVVPTAYGGIAWRCLTYFGALI

SEQ ID NO: 137420 - protein, 60 aa, Triticum aestivum
  Clone ID: PAT_TA_31838.pep
MYIHKRATYSTIVTSSRCGFLYYYKICWLFKLESSVPLLMTFLSDDLFRYCGLAVYFTYF

SEQ ID NO: 137421 - protein, 253 aa, Triticum aestivum
  Clone ID: PAT_TA_31839.pep
PIILCGAFYYSDWNGSKRGQVYKFLRSQGFVSSYDTAHQYSDSEEDAHKWVSHRNHRGNICGVDFIWLLNPDKCRKPLKTSWNEAVFGIIKFSFQYLLLQVASLPENAFALLKADSSDDRITYSSFCQALCQLGMVHPDRVNSEEMEDLWSEVDHDGNGAVDYKEFQRCIWSPKCYNQEEEDDTEIDAAEGSIITFEPNDETFGFTVKEAVLFPPEVEKGMWPENYSLSDHAPLTVVFSPVRMPCSPRTPQHP

SEQ ID NO: 137422 - protein, 388 aa, Triticum aestivum
  unsure (1)..(388): unsure at all Xaa locations
  Clone ID: PAT_TA_31840.pep
MERVDGGAGLGARGSAGAMLGMEMHLVHQPQPQIHAASSFQQPPEHLRHANGGFQVQHHQAMPMRQQHPPPSYAAYVAPPSRAVNAHEEEEMGNGVGAVQQPGAGTAGCSWSRMKWTDAMVRLLIAVVYNAGEDGEGVSAGAKAAAADSHGKAVASAAAQQKKGKWRSXVSRAMVERGFKVSPQQCEDKFNDLNKRYKRVVDLLGRGTACKVVENPALLDAMGELTAKAKEEARKLLSSKHLFFREMCTYHNPPGAAAAASHGTDDGAACFHNPRPATAPAGRQVVNSSTRSEDDSEDDVLSSKEVEEEEEDDDDYDLDDVEEKAPGTKRRDDRVDDSNASTTTAGTRTSSVVARAAPRREGAGRGRTPQARGRRAQRPACRASRGGA

SEQ ID NO: 137423 - protein, 325 aa, Triticum aestivum
  Clone ID: PAT_TA_31841.pep
MSGRDRLPRRFVEDGRGYVDARVAEDRRGHHPGIRVVDDRRGHHEIRVVEDRRTYPAVRVIEDRRAYPEIHERPLMRVAPRSHPDVLEEEIQLHEVDFRRLMADRHALAEERMELHRELQAGKEEVRHLNMIIAEINAKKEAYISELVDKRRKLEAELRSNEPLRDEVVHLRGEIEKLLAVRKELSAKAASLMQELSRERSDKQQLPMLKAEIEGLQLELTHARNACELEQKGNFELVEQRKAMEKSMISMAQEIQQMRAELANFDGRPWGTGGAHGMKLGSPEATFPTQYGDKYNIHAGVSEKGPSHPPESSWGTFEKNRFQYR

SEQ ID NO: 137424 - protein, 119 aa, Triticum aestivum
  Clone ID: PAT_TA_31842.pep
RVDPDYTVLAFAAMMRKKVTMPAHLMYDGQDDNLFEHFSAVAQRLGVYTAIDYADILDFLVQRWNVANLTGLSGEGRRAQDFLCSLGPRFRKLEERAQGRAKQLPVVPFSWIHGRQVQL

SEQ ID NO: 137425 - protein, 477 aa, Triticum aestivum
  unsure (1)..(477): unsure at all Xaa locations
  Clone ID: PAT_TA_31843.pep
YSSCYIYHPNQTKPNQTHRSIACRPSSIYIDRRSNKLATPPAPKAIAVAAYPSXNAPGDTLDGLPVAHETSHQSGVHPWYPVAFVLTTGVNXAYVLGYSGSLMVPLGWVGGTVGLLLAGRRVXMYANALLGRLNLLGAKRHNRYQDLADHMCGPKLHHLHGEPRLNHNCRASTQGTILAGQSXRAMNLPYCIAVSGFVCALFAFGIPYLSALWIWLGFSTIFSLTYIFAACVLSLKDGFRTPPRDYSIQGDPSSRVFTTIGAAASLVFAYNTGMLPEIQATVQAPVVKNMEKALWFQFTAGSLPLYAIIVIGYWAYGNQTTTYLLNNVTGPLWIKAVANLAAFLQTVIALHIFASPMYEYLDTRFGSKVGGPFAMHNVIFRVGVRGGYLAVNTLMAAALPFLGDFMSLTGALSTFPLTFVLANHMYLVANRQRLSSLQKSWHWLNIVFFTVLSITAAIAALRLIARDSKTYHIFADV

SEQ ID NO: 137426 - protein, 154 aa, Triticum aestivum
  Clone ID: PAT_TA_31844.pep
RWLVAMLETPTRRCYNQWGWGHSLSCKGLQHWTYLFRQKGGQPRQGARGRLLLTPGAWGACCPTAARQPGGELRSPSGRGAPLLNASGRLFFVSFGEGKKHCGSNRPACGCMYRAVRGRPPKRFRPAPRRLVVPFSEKPSCPSILIIKKKGLPF

SEQ ID NO: 137427 - protein, 39 aa, Triticum aestivum
  Clone ID: PAT_TA_31845.pep
SLRNMQVNHRAKKLGNSKPSMLIHINTFRSASRTENLLI

SEQ ID NO: 137428 - protein, 177 aa, Triticum aestivum
  Clone ID: PAT_TA_31846.pep
MDGGKDKGAGGYSGYPGGYPAPAGYPGYPVPVSSYPPAPGYAAPPGQYAPPPGAYPQPGGYQPPNVAYPPNGYPATAGYPQYPTAHPPAGYPAQGPPMQVPPYGHAPMYGGGGHGVAGGMVAGGAVAAGAVYGAHKVSHGGAHGMYGHGHHHGKFKHGKFKHGKFGKHKKMYGRKWK

SEQ ID NO: 137429 - protein, 100 aa, Triticum aestivum
  Clone ID: PAT_TA_31847.pep
TKNIEGKTPKHTCKEGNCIHSDYQSEQLRLLMTTRSSLSGRKALWKWHMGTSADPSSLPHWPVGATTDFVLLASAVDKNNQNMGQRSNEETIHPCIHGDT

SEQ ID NO: 137430 - protein, 65 aa, Triticum aestivum
  Clone ID: PAT_TA_31848.pep
MSDRRYGYSYPHNQGYYNGPPVMAPPQYAPPPRRQTGFLEGCLAALCCCCLVDECCCDPSIIFVS

SEQ ID NO: 137431 - protein, 511 aa, Triticum aestivum
  Clone ID: PAT_TA_31849.pep
MASKLPDATKGLGAGAIDVEDGSGAGAGGKKVTGRWPGFVHFFFVLTVVTCALVYAPRFLSPTVPVDFLGPRQPSSGRAAAVQGRSLDALVLDNQVNSPCASMGGHGICCDRSDFNTDVCFMAGDVRTDAASLSFLLFAPQAPNGTASANATVAEKEERVQPYTRKWEKHLMANIQEVRLRAARPDEAQDGHRCDVRHDAPALVMTAGGYTGNLFHAFNDGFLPAWLTVQHLRRRVVLAVLAYNPWWAGTFRELVSGLSDHHVIDLLHDKRTHCFPGAIVGTRFHGILAVEPARTKDNRTLVDFHDFLAGAYKDDSTPPEAKQQQQQQQQPRRRPRLGLYSRKGTRMIENEAAVARLAESVGFDVSILETANGAPLSSEYAAVSACDVLVGVHGADLTKLLFLRPRRAALLQIAPLGVPHVARGCYEKATAMMEMQYEQYDAAANESSLVRKYPADDVVLRDPEAATRERGWDLTARVYLGGQNVSLDLGRFGDTLRRLHSRALRLPAAGP

SEQ ID NO: 137432 - protein, 175 aa, Triticum aestivum
  Clone ID: PAT_TA_31850.pep
RLPRGAVEEIARSSQLADEAHTPQRTATKPTTSSTALGHEEDGVVEDEYDAVGVAHAEAQGDGGHPADDVVEGVGVEATESVREDSEEPGHPAAERRRDHPGRPGRGRLRRRGEEHDQPLEARAQLLLRRGAAVRGPQRGISLRQGICRVEGDGVEREGGRGQAEDDVRRRPRVR

SEQ ID NO: 137433 - protein, 182 aa, Triticum aestivum
  Clone ID: PAT_TA_31851.pep
MGRPDSEAPTSSIAAGLAAALGGGGEAPAPAGADSAFETNVVIILAAVFFTLLFAIGLHSLARCALRYVGRGAAAAVAAGEGRASARVACSGSGIKRRVLRGLPVEVYGCGEDIDDVCAICLSEFVDGEKVRVLPLCGHGFHVRCVDAWLVSHGSCPTCRRPVLEGAPAKSETDTVITVAIA

SEQ ID NO: 137434 - protein, 227 aa, Triticum aestivum
  Clone ID: PAT_TA_31852.pep
MNDTDVSKQIQQMVRFIRQEAEEKAGEISVSAEEEFNIEKLQLVEAEKKKIRQEYERKEKQVDVRKKIEYSMQLNASRIKVLQAQDDLVNKMKEDAMKELLNISSNHHEYKNLLKELVVQGLLRLKEPAVLLRCRKEDHHNVESVLHSAKNEYASKADVHEPEILVDHSVYLPPSPSHGDEHGQICHGGVVLASRDGKIVFENTVDARLEVVFRKKLPEIRKLLVAA

SEQ ID NO: 137435 - protein, 180 aa, Triticum aestivum
  Clone ID: PAT_TA_31853.pep
GSGFVDCEGRLHAFALRDDTGEGFVDCEGRLRFTPSRDDARELRNGMRHVLRILEGAGAAEVGTHRSDGTIVRWPVVRDEDLEAFLDEVTIEKGPMHSTADKWAAFSSAHQMGSCRMGSSPKDSAVDGSGESWEAEGLYVCDGSLLPTAVGVNPMITIQSVAYCLSKGIAESMTNGQKHY

SEQ ID NO: 137436 - protein, 227 aa, Triticum aestivum
  Clone ID: PAT_TA_31854.pep
RLVFFGNSTTRLPDRSDTFQARSIKTALEAIGVTKFGLVGVSYGGFVGYRMAAMYPPRVRRVTLVCAGVCLEEKDLAEGLFPVAAVDEAAALLVPRRPEEVRRLVRLTFVRPPIIMPSCFLWDYIKVMGSDHIQEKTELLHALISGRQISTLPKLRQKTLIIWGEQDKVFPMELAHRLKRHLDGNSRLAVIHNAGHAVNLEKPAEVCKSIIEFFQEPIPEASNDERV

SEQ ID NO: 137437 - protein, 100 aa, Triticum aestivum
  Clone ID: PAT_TA_31855.pep
QPRPPAPVVPRHRPAGLRPRLAPHARAPAAQSGGSEGAETSRRRANNSQVNSWCSCTMCLFHRPRVLVFELLNSQLSESCKRILQRTCNYLSTYRTFTVR

SEQ ID NO: 137438 - protein, 231 aa, Triticum aestivum
  Clone ID: PAT_TA_31856.pep
MCTMEVHIIHTKDIDTPSKICQQRHREVVKIMEHSHSLPQLKEMQLHNETVEDTIVHPEPVQIQLPSLERRIQLQRDKSSQGSKRDSLSSEDIDHEEGALSDCILARFTRLTTDQKKAVKEKVQFIDSETPIFVAMMQQTNVTGRYTLSISKKYINKYLGDEVQSICLERLGERCQVWFGRKPQDKRIVGGWTKFVKANEVEVGDICLFELLKHRKLCAMKVHIIRAKDFS

SEQ ID NO: 137439 - protein, 280 aa, Triticum aestivum
  Clone ID: PAT_TA_31857.pep
MHIVPKLVLFHLCRNKIKILDAGALEPLLGYLQSSDLNLQEYAAAAILTLSASSTNKPIISVSGAIPLLVKVLEEGNPQAKNDAVMALYNLSTIADNLQTILSVQPIPPLLELLRAGKRSSKTADKCCALLESLLAFDQGRVALTSEEGGVLTIVEVLEEGSLQGREHAVGALLTMCESDRSKYRDLILNEGAIPGLLELTAHGTPKSRVKAHALLDLLRNSPYSRSKLQPNTLENIVSNIASQIDGEDRGGKAKKMLAEMVKVSMEQSLRHLQRRASFA

SEQ ID NO: 137440 - protein, 340 aa, Triticum aestivum
  unsure (1)..(340): unsure at all Xaa locations
  Clone ID: PAT_TA_31858.pep
FGARHAPRDGRLRMQGDISLTDATLSLXEIQEVILVGGSTRIPAVQDLVKKMTGKDPNVTVNPDEVVALGAAVQAGVWSGDVSDIVLLDVTPLSLGLETLGGVMTKIIPRNTTLPTSKSEVFSTAADGQTSVEINVLQGEREFVRDNKSLGSFRLDGIPPAPRGVPQIEVKFDIDAKGILSVAAVDKGTGKKQDITITGASTLPKDEVEKMVEEAEKFAAEDKEKRDAIDTKNQAESVEYQTEKQLKEFGDKVSGGVKEKVVGKLKELQYAVGGGSTQTIKDALAALNQEVMQLGQSLYQQQGSGPTPGADGAADSTGPGPSEKTGDGGDVIDADFTDSN

SEQ ID NO: 137441 - protein, 193 aa, Triticum aestivum
  unsure (1)..(193): unsure at all Xaa locations
  Clone ID: PAT_TA_31859.pep
YVSQCAVKIINQAMIKKSIYKQYHFCRSYTGLHQFLLFPLLYQDCICVWLDSPDHARKETKHFASMARRRWMISPGSVSPAGCILSPKLSPANSKEHSKKNLISLSRPDDLHSHLLGRHLGELGLRYLRVGRRREVPHRVAVVAGVARPSDAAXRXRGEHEQCHGHRQGGERXPRRPRAAAHRRALVAHDVRE

SEQ ID NO: 137442 - protein, 104 aa, Triticum aestivum
  Clone ID: PAT_TA_31860.pep
TCRSSRSLRLSPSAGPIPIPELLCWSRLRRHRPQSRRRASAPSDTHLLFFCRPPWWVSSLLYFLMSSPAAFCLGDCGSRTRCWLPSPIVFLLRPPPCACSWWLW

SEQ ID NO: 137443 - protein, 61 aa, Triticum aestivum
  Clone ID: PAT_TA_31861.pep
GTRAFLKAVTDETQKELHSTRGVLAGERARAFQLQVEVFHLKQRLQSMDGWSPTQRKPQNL

SEQ ID NO: 137444 - protein, 269 aa, Triticum aestivum
  Clone ID: PAT_TA_31862.pep
MPANFFDNQGMKRQSDGTGSEGRSVRHQVASAQPATKEASANKPSVRMDQAPNKGSKGSTDVKGILPGNFFDYTEEDEDEVPTPAPAPKEPTRTSGNTTNPNTVQVKGVPDGFFDSSNTQPSETSASSQAANNLETAQVKALPEGFFDNKDADLRARGIQPPKVDINDAYKEFEKEIQEDLQEVDDRLEEEEIDAAAEREEYLTLEQEEYRQRVDMLKKQLTESKAARTAKANSKPIGMDTDSSASDSSSDDEDEGTDFAVDWRAQHMK

SEQ ID NO: 137445 - protein, 122 aa, Triticum aestivum
  unsure (1)..(122): unsure at all Xaa locations
  Clone ID: PAT_TA_31863.pep
XRQCKSLAQLKRNMPPESPQGNDAAPKVVEDEALAVANTMPMLKQLELAYGLFSDVGLDAILTKCPLLRTLDILGSLNVRLDGDIEERCCALESFREPWEPDYDENSSSGGDYDYDDTESDD

SEQ ID NO: 137446 - protein, 349 aa, Triticum aestivum
  Clone ID: PAT_TA_31864.pep
NRDGFLLSLQHIPHGKNGVPDNTGPPVFLQHGLFQGGDTWFINSAEQSLGYILADNGFDVWIGNVRGTRWTHASATFTVHDKLFWDWSWQELAEYDLLAMLSYVYTVRQSKILYVGHSQGTIMGLAAFTLPEITKMISAAALLCPISYLDHVSASFVLRAVGMHLDQMLLTMGFHQLNFRSDMGVQIVDSICDDGHVDCNDLLSSITGENCCFNGSRIDHYLEYEPHPSSTKNLHHLFQMIRKGTFARYDYGLWGNLRRYGKLSPPPLDLSSIPESLGMWMGYGGLDALADVTDVARTVKELRSTPELLYISGYGHIDFVMSVKAKDDVYVDLMRFLRLRANGSLHSSY

SEQ ID NO: 137447 - protein, 140 aa, Triticum aestivum
  unsure (1)..(140): unsure at all Xaa locations
  Clone ID: PAT_TA_31865.pep
SSINVAVAVXIEGGLLTPVLEDVDKLDIYLLAQKWRALLKKTRMKQLQPNEYNSGTFSLSNLGMFGVDRFDAILPPGQGAIMAVGASRPTVIADKDGFFSIKNEMLVNVTADHRIIYGADLAAFLQTFAKIVEDPESLTL

SEQ ID NO: 137448 - protein, 247 aa, Triticum aestivum
  Clone ID: PAT_TA_31866.pep
FALVWWPYLHSYEAAMQVISRLAPFERGIYEDYVANFWCTTSVLIKWKRLYAIKSLKLMSLSATILAFLPSFIQQVKSPSNLGFLYSLLNSSFSFYLFSYQVHEKSILLPLLPASLLALHEPHLHGWFTYYALFSMYPLICRDQLLLQYIAVLGLFVLIYYSPGGNYGKGMKISSGTMAVLSLPLLCSILLHTMYLQIEPPKRYPFLFDALIMFICFSQFIILTLYTNYKQWMLDFHPRPVGSKKDL

SEQ ID NO: 137449 - protein, 365 aa, Triticum aestivum
  unsure (1)..(365): unsure at all Xaa locations
  Clone ID: PAT_TA_31867.pep
GWGGNDDGRKDAAQAVVKAGRNACGAAGTQKIVIPPGNFLVGALELSGPCTSSIIIRLDGNLLGTGDLTAYKKNWIEVMRVDNFAINGHGIIDGQGPLVWEKNQCSKHYDCKILPNSLVLDYVNNATIRGITLKNAKFFHLNLFNCKTVLVENVEITAPGNSPNTDGIHMGDSEDVTIKATNIGVGDDCISIGPGTKEVKIXGSRCGPGHGISVGSXGRYKDEKDVEDIQVTNCTIKGATNGLRNKXYEDSRSALRATRFVYDDVKMDNVSYPIVIDQKYCPNNICAKAPGASKVVVADIVFKNIVGTSATPEAVTLNCVNNVPCQGLQLVNVNLKYTGTNNKTMAVCKNAVGTSVNVVKELACL

SEQ ID NO: 137450 - protein, 264 aa, Triticum aestivum
  Clone ID: PAT_TA_31868.pep
LQKERERAEKKKEKRNDKKACHQGGGETKHSKRSHKKRKHEDTSIAGLESKTAPKELFDQLEKSGLSEEYGAPSFIQTVHGSPESSQDSSKRRKVVLPGPSQNKNGTVLRIKIKRDQDSPSASGRNDKKASHPGGGETKHSKRSHKKRKHEDTNIAGPESKTASKEQFEQLEKSGLSEEYGAPSFIQTIHGSPESSQDSSKRRKVVLPGPSQSKNGTVLRIKIKRDQESPSAMSDGSRVLQQPPVQQMATPLSLLSKQNASQPC

SEQ ID NO: 137451 - protein, 94 aa, Triticum aestivum
  Clone ID: PAT_TA_31869.pep
PPLACDSQIARAHPTDLIRTNRQEHMIRGRACCKSDGSTNLSGRLHHGNGGHGHWVSHVARRRVGEAPRHGGRCESRCAMREPSESRERRRGPP

SEQ ID NO: 137452 - protein, 211 aa, Triticum aestivum
  unsure (1)..(211): unsure at all Xaa locations
  Clone ID: PAT_TA_31870.pep
VVPPPTKTAQRVDIPPAKVIDIPHAKALQKVDPLVPSKVLRRDAPPQSLPVLQKETIKVASSHQPDRQPQPVLHKPKVPVVSPLIKQQQSSTLAKEEPCSSGRNTEKQXPEVKQSKSDRKKSRKAEKEEKKERKFRDLFVTWNPPSLEIEETWNLGDQDWLLGGAKKPDAYNSSCKASDCLAPMELEFSWQPRAIHLPDLDVYQLPYVVPF

SEQ ID NO: 137453 - protein, 201 aa, Triticum aestivum
  Clone ID: PAT_TA_31871.pep
MAVATPRSSLIIFFVLLVSAASLVVDGGSIVKEACAKTPQPSDCEELLKSSTATDAKTLAQAAVAAAAKTATEAATAAKAERDKLPNGKTQWRCMDSCAAGFDEAATKFKPAAGGNAAGADAQLTEVLDFVVVDEDVEKSRDWEWKWSCNECKADPTAPAGLVAKNKEFDKIMDIIPAIIKQAVAGADNSTKSDTKSKSKS

SEQ ID NO: 137454 - protein, 391 aa, Triticum aestivum
  Clone ID: PAT_TA_31872.pep
MTRDGVPPSAPAGGGAGDGPRRCSQCGHHGHNSRTCTARPVKLFGVRIGDKPIRKSVSMGNLAQLAEGSGGARAEGYGSEGDDDKPHRKRGESWSEEEHKNFLLGLNKLGKGDWRGISRNYVVSRTPTQVASHAQKYFIRQTNVNRRKRRSSLFDMVIEDPGDQPLSRSSSQEMPLSRSSSQDVEEFVDDLRPVTAPVTPPAPMPVITSVSVPPPVPVMAPPAPVPMLTYASAPSPVLAMAHQPQGNESAGSSSIAGEAGMVMPQVMPPYGYPPPMMIPAPHYVQAVFPYPYYGYAPMFYGPPVSMQASSPVTVQASHEPVRPVAVHSAPPVNVEDLYNMSKLNLKGDSSTNGVAPNLALPPNPNGRPERQSAFHGKGAENGSSNGLIPTK

SEQ ID NO: 137455 - protein, 160 aa, Triticum aestivum
  unsure (1)..(160): unsure at all Xaa locations
  Clone ID: PAT_TA_31873.pep
KLFSTXMLSVTLFVGRFDMRMLQAAINKGPDESKSSDLLYDHLDGKDELLFDFIADVGDGDFIAQPSLVVKSDDFRLILPRGQLLLIGGNLAYPNPCSFTYEQRFFXPFEYALQPPAWYTPEHITLEKPELPLGVFELNXQNSRPQCFMIPGNHVIYTYL

SEQ ID NO: 137456 - protein, 282 aa, Triticum aestivum
  Clone ID: PAT_TA_31874.pep
PNNHKVCSGPSASEDQVYWLLNLSLYRMLENNLQEAQVAVNKALKLARGESYEHCLREHAAINMLERPSCTDTQARATLNLMRGYLADLRNLPVKELLSRRFIQNVKKHKLRQLIDDTIGPASADSSVINSTLEVCYGQSLLPEKIGGVKYLVDFVESVMEVLPANYRLALAVGAFVVKHYKGADPTSMGTRFWASSVLINAIFRAVPVAPESVWIEGANLLEELQAAETVKRFHQQATSVYPFSFKLWHAYLTACKASGSNTDSITEAARQRGIELNVMPP

SEQ ID NO: 137457 - protein, 204 aa, Triticum aestivum
  unsure (1)..(204): unsure at all Xaa locations
  Clone ID: PAT_TA_31875.pep
MSYCISLNFSMYRFPQSIASKRREKTGCEGEMGSRLDARTLKDEVASMDRRPLLDLGHPLLNRVADSFIRAAGVGAARAVSREAYFVXVEGMGGDSTGLDSTAKRSHFSSARGDDGQKSLDSVVKSASKEAIQWGLAAGVYSGITYGLREARGHHDWKNSAIAGAIAGAAVALTGDNGHSDHVVHFAITGAALSSAATMLSGIF

SEQ ID NO: 137458 - protein, 173 aa, Triticum aestivum
  Clone ID: PAT_TA_31876.pep
MGSRLDARTLKDEVASMDRRPLLDLGHPLLNRVADSFIRAAGVGAARAVSREAYFVAVEGMGGDSTGLDSTAKRSHFSSARGDDGQKSLDAVVKSASKEAIQWGLAAGVYSGITYGLREARGHHDWKNSAIAGAIAGAAVALTGDNGHSDHVVHFAITGAALSSAATMLSGIF

SEQ ID NO: 137459 - protein, 162 aa, Triticum aestivum
  Clone ID: PAT_TA_31877.pep
STPRVRNKQKRRRGRNQASSMAMIQPLVVLALICGVGVSATPTLAPAPAPTALLTEDKLCVGISLKNHRLACVVNTAVVCFASNSVTGEASFQACFVAGIMTANCLAKAKDDNKYHCVGLEISDDLVPCFGEVAWNCYDSFMVYTAPTFAFCFYAKVATCFL

SEQ ID NO: 137460 - protein, 142 aa, Triticum aestivum
  unsure (1)..(142): unsure at all Xaa locations
  Clone ID: PAT_TA_31878.pep
LLLSRCSSGGGGFLLVLPVSDRSWVRVLGCGGGALCAGVDTVRLTLLSVGWCCSSGLRLEGIASVKFPIQKMIFIRVGRHRDDAVLCCWLLGRREQRCTCLYVLGTWGCSDLLHMGVPTPLCKKKKVLKEYYAHSAXKKKTS

SEQ ID NO: 137461 - protein, 146 aa, Triticum aestivum
  Clone ID: PAT_TA_31879.pep
MSSWAQHSRRGWRHGWAARALSSATLPPWRLLAFFAIVVSFLATSSYVDYRAVERRAEIGARVFAAPLAAMAAFLLFAALGYWRRRTRWALRRHAVNAQPALASSQSSGASPWGVAAMVAVLLVMVTFQPAVHSMWFRPLWSSDYS

SEQ ID NO: 137462 - protein, 273 aa, Triticum aestivum
  Clone ID: PAT_TA_31880.pep
PVRNFRVDPRVRDPLRICDVCGVRLECIQPYLMNQISRACQLPTKDLTDLSTLRSWLNLPWAPTMEYEIYKAANSIHGYCKVGKLNPEKSIPDSILRQAKGLAIITVVKVGMMVTYKIGTGLVIARRADGSWSPPSAISTCGVGYGAQAGAELADFIIVLRNTDAIKTFSGNAHLSLGAGFGAAAGHLGRVAEADFRAGDGGYAACYTYSCSKGAFVGCALNGSVVSTRNNENARFYGGPVKASEILLGSLPKPPAAATLYKALSTLFDRIGK

SEQ ID NO: 137463 - protein, 182 aa, Triticum aestivum
  Clone ID: PAT_TA_31881.pep
YKRGCTALYTYVTPTRGNPIILIFTSKRTSCSLGKKGGKPIIHTHKQITNTHPLTQAHGQQAQVRQQRCHWHWQHGPGSHRLPRPRPCCPRALAPAPPPRHAPRRRAALRSPSERAETGLWPCRSCSPAPPPGSRGRSASCSSPGGVPRGVHRPLGCFLRARPCPPKRSSCSPRPPLAPTDI

SEQ ID NO: 137464 - protein, 116 aa, Triticum aestivum
  Clone ID: PAT_TA_31882.pep
MAVPVWFFSLASLGALHVVAISFRLIAYFSVFLRRPIDLRRRYGAWAVVTGPTSGIGRSMALELAERGLNLVLVGRDPPKLGDISETISRAHAAVQTKTVLFDFSLVSTAQGDEAM

SEQ ID NO: 137465 - protein, 174 aa, Triticum aestivum
  Clone ID: PAT_TA_31883.pep
MGRSTHALLLLVVAVAAATCSSAAAQAPPEVAAVCKSTPFADLCSATAGKQAGHYTTVDAVAVLNMQVDAFAKRTSAAKEHVTQMSAEASPAAKKALELCDSLYSDVEDNLGAARRALGFKDASTVRAMMSMAAQDMQNCDEEFRKAGEKNPMDRFDQSLLKISENCRALSNMI

SEQ ID NO: 137466 - protein, 100 aa, Triticum aestivum
  Clone ID: PAT_TA_31884.pep
EGCWVSSLCVNDDKKKSFSGSRSTQSSQSSGRCSHCDDEKGGSHPSAKANIVEPKADELQERNVVTSPMKLKMQNQKINNKVEQGTASKEPFTSVSTDIR

SEQ ID NO: 137467 - protein, 250 aa, Triticum aestivum
  Clone ID: PAT_TA_31885.pep
HASGLSNKNEFVGGICARTVANGSRISDSHSAEGAVNQATGQDTSQSFSAFSGTAVQEKQFKQPEKNEFVGGSCTRTVANGSRISDSHSAKEAINQATGEDTSQCFSAFSGTAVQGKQFKQSEKNEFSGGIYESEIANGSRICDSHSGPPKLSTDEESITAFKCALGEFIKNILRPLWEEGLLSREVHKIIARKAVDKVALTLGPKVPRTEAAIFRFFAEESQSVEQLVQGYLDIYLGKQVLKRTMPGSI

SEQ ID NO: 137468 - protein, 412 aa, Triticum aestivum
  unsure (1)..(412): unsure at all Xaa locations
  Clone ID: PAT_TA_31886.pep
TRSGSTSFRYSDNNLAENNYVVDSSVKHATHWSQNASPSLSLSQKMLSLSGPPVALSVVSRIRNGSNLLKGAVHGAAAFATGVSSPISGAIASTFHNCKGGVNSDDSLLCMKYYLLVFSPSGSIIQYVLHHSAEPDSGIDYPSDATSYGSQRETDTRFVIEPLQKWDVCQKRNRRDTAESNLYNDFDSGENNKIFQKVVRKGTSIYPSNGAATERLKLSADENHNYYISESELQTHVVQIPVWSRSGVHFQVIGSDTLEAYATDNISGEIEIEKVQSYNVESRSKNLIPVFDSLHTSRFQQTRVNTPDSNRSGLLQRHKSGFSADGRLSSRSSCSSLDCMSXEVPNSSDDNTVGQYLVEDSAAAAAVNKNLNVNHQAELVNNTESLNTEAQLGVVNSKDDCEDSELLPDLCQ

SEQ ID NO: 137469 - protein, 69 aa, Triticum aestivum
  Clone ID: PAT_TA_31887.pep
SKCIWEDKGGWAGVPTWLKKNMYFICTLPCISPLKYSRCCLVNNSRNGMQCGNSSPYARIIHVANESSC

SEQ ID NO: 137470 - protein, 132 aa, Triticum aestivum
  unsure (1)..(132): unsure at all Xaa locations
  Clone ID: PAT_TA_31888.pep
MGCSGSKEVAVAEVAYRPPATSVSLFDISAVEEPWLIAKQNAAAANGDVEADQSDDEYEDDDEEEEEEEEQDAKKPTAGVALPILDKLDGYELAPASWSEVSKALEVIKPTLDSKQTAEPKPAPKKKKXXKK

SEQ ID NO: 137471 - protein, 190 aa, Triticum aestivum
  unsure (1)..(190): unsure at all Xaa locations
  Clone ID: PAT_TA_31889.pep
ASRWPAPSSLLLRAVASRRPTPACPSGAPKQPHADPSTRPSPSSGTPXASACVPVRPPRPAPACPSXSSASSASPSSSQLRPHPPAEHTPAPPAAHPSPSTTRAPPHPPAGRSASRAPPVTHRSSPNSLVCLPVAPKRISSRGRLGRTAARLSRAWRRRDEQAGRRRGGGWAGWRGEQGTTVEKKGRIAF

SEQ ID NO: 137472 - protein, 123 aa, Triticum aestivum
  Clone ID: PAT_TA_31890.pep
GPTVPWLFRRAEIYPEAYRGMCGGMSATVNWISNLIVAQTFLSIVGWVGTGPTFIIIAGIAVMALIFVATFLIIAGIAVMAFIFVALYVPETKGLSFEEVDLLWKERAWGGQGSHESLLGSAP

SEQ ID NO: 137473 - protein, 85 aa, Triticum aestivum
  Clone ID: PAT_TA_31891.pep
LISGGLLRFSVAPMYRSARWLQSSPASSLEAAQAVEQQLVRAQQGGGGRQRQRGRVGHVVVGGVREVGRERVAGHERGAAERAGA

SEQ ID NO: 137474 - protein, 127 aa, Triticum aestivum
  Clone ID: PAT_TA_31892.pep
RSSLTRLSLSLSHPLLSHCWARVPEHRPLSPLLGGGGRGIGLQATVSAAVWQKATASGRERDLQQASTLLLIFKPGSSHVLLWRPNGERLPGAAEAADLLRHDNPEVLQKLEGKAFGSPRTILFWFW

SEQ ID NO: 137475 - protein, 216 aa, Triticum aestivum
  Clone ID: PAT_TA_31893.pep
YVLGTLTWRAFGARAYLLVAAYFVVGTAVTKLKIKQKEALGVAEKKGGRRGPGSVIGSSAAGCVCALLSVYNVGGGAFAELWTLGFVASFCTKLSDTVSSEIGKAYGRTTYLVTTFKVVPRGTEGAVSVEGTLAGILASMFLAGIGYILGQVNLPQSVLCVLASQIANFGESLIGATLQDKEGFEWLNNDVVNVVNISAGAVLAALMQQLLVSWRS

SEQ ID NO: 137476 - protein, 210 aa, Triticum aestivum
  Clone ID: PAT_TA_31894.pep
PQIPSAPLPPRRSRPPPSPPCAPRQSPPPPSAPRQSPPPPSVPRRSSPERAHLARPRRCGPPPPSPYLQRREHHAGRWHAPSQRCPHRPAVPAPPDLCPNRGACLLRLPWRWRGCGEGDEEVGEEREWGVESGERETMRRGEMVGDAAGGGCRPHLYDATVLATTRDTCCPTCGRLHACTKGRRNTNKYVYGRAYVYGQAYDLSGPVRAS

SEQ ID NO: 137477 - protein, 217 aa, Triticum aestivum
  unsure (1)..(217): unsure at all Xaa locations
  Clone ID: PAT_TA_31895.pep
MAKPWGGVGAWALDAEREDEEREHAAAFPAPEPPAAAGGAASFPSLKEAVVAGGGKQKKKKGTTLSLSEFTTYGAAGAPRRVAPAEPKGLTPQEMMMLPTGPRERSEDELDRSRGFRSYGGDREPRGGGFDDERRSSRDSDFDMPSRADESDNWGKNKSFSPAPTDSGRRDRLSGPSPLGRSDDIDNWSRDKKPLPSRYPSLGTGGXFRESSGGGFR

SEQ ID NO: 137478 - protein, 577 aa, Triticum aestivum
  unsure (1)..(577): unsure at all Xaa locations
  Clone ID: PAT_TA_31896.pep
WDPFALSLPYFRVQAPAHPCEGERSINRGAPGHRPNPRSRSSKREADAITKTWGRVFAPEHRPDPRSRSSEPKATLSPSARAAAAAGGSTLSRSKRSAGAARTSPQKKPPPPRAVSQSTPYRAAAAPRGVGTPKPKGVTPQSMLMLHPGTGERARDSLDGPPGCRILXGDQPRSGDEDDXTAREARARNAAGGTAAAGSDHWATTKSRSVADSNSXRCCRDLDFDMPSRADESDNGARDKKPLPXSRYPSLGTGGGFRESSGGGFRESSGGGFRESSGGGFRDSPGPSDSDRWVRGAVPAPMTNNGDRPRLNLNPPKRDPSATPVPAAEVARSRPSPFGAAKPREEEVLAEKGLDWRKMEGEIEKKTSRPTSSHSSRPNSAHSSRPGSPGSQVIAGRREGAPRARPKVNPFGDAKPREVVLQEKGKDWRKIDLELEHRAVNRPESEEEKNLKEEINLLKVDLKEIEAIAGDGSEQAKEVSEKISQMEKQLDLLTVELDDKIRFGQRPSSGAGRAAAFPPASEEPHVAVAHMDRPRSRGGVETYPKPVEERWGFHGSRERGSFGGGGSSDRSSTRQGW

SEQ ID NO: 137479 - protein, 245 aa, Triticum aestivum
  unsure (1)..(245): unsure at all Xaa locations
  Clone ID: PAT_TA_31897.pep
MGRRRRQPSSPSPAAEHPLEDDDLLREILLRLPPQPPYLLRASLVAKRWRHIAIDPKFLHRFRTDHGKPPLLGDFSLQINGKLSFRSTLDLPYRIPPDHFSLQVNGREPWRLVDCRHRRVLLINSGDXQVIVWDPLTGDRSLLSAPPAFDDMHTAAVLCAAGEQGHAHGACHSSPFKVVVVDSCEHGDETVVFVSVYSSETGVWSDLLSTRXASMGIAGGNRSTLVGNTLRWLLLMSNNILEFDM

SEQ ID NO: 137480 - protein, 93 aa, Triticum aestivum
  Clone ID: PAT_TA_31898.pep
AVCPDDRVPGSVGICQTSGRRRIDEISTKLLSFKISSAVKGSYIAMDSADEPKQGDNLSPAALPGNWENVSAAKADNPAKQNSDCSVVKDSSS

SEQ ID NO: 137481 - protein, 112 aa, Triticum aestivum
  Clone ID: PAT_TA_31899.pep
MATPLIAGLAVAATALAGRYGIQAWQAYKARPIVPRMRKFYEGGFQATMTKREAGLILGIRENVRPDKVKEAHKRVMVANHPDAGGSHYLASKINEAKDVLLGKTKGGGSAF

SEQ ID NO: 137482 - protein, 153 aa, Triticum aestivum
  Clone ID: PAT_TA_31900.pep
MEFNASYFHAFGNPDFAAVFSDGSAQALRPNPSAGDGEGASVKAEKGAAVARPTATPSSVTFVVPDEELGEAHHFLNECSRCHKGLTGDIFMYRGDTPFCSEECRRKQIETEKARHRRKKQNSPKAAATIELHHQSGLCRCTVSACMRACRRA

SEQ ID NO: 137483 - protein, 108 aa, Triticum aestivum
  Clone ID: PAT_TA_31901.pep
FLLCLVCSLSVPQKKTIVSVHGFEPWLRGLMNQLIQPKILQKERELKPSRHIGGIHLRFGNIHHVRFVFSNLLPICMLWTTVAGVLRQGLELQRKEREMGLLEAVIRE

SEQ ID NO: 137484 - protein, 350 aa, Triticum aestivum
  unsure (1)..(350): unsure at all Xaa locations
  Clone ID: PAT_TA_31902.pep
MGTKKSTVALALLVLALSSLPRACLAVTSPYVRPRPRATLSLRRDADAGGQTPQQVHVSAVGPDKMRVTWITDDDAPAMVDYGTASGQYPFSATGTTADYSYLMYHSGNIHDAVVGPLKPSTTYYYRCSSDPSREFSFRTPPSGLPFTFVIAGDLGQTEWTNSTLQHIAAADYDMLLLPGDLSYADLDQPRWDSYGRLVEPLASARPWMVTEGNHDVEKIPLLERAPFKAYNARWRMPYDGGASPSGSNLYYSFDAAGGAVHVIMLGSYTDYDAGTAQHTWLQGDLAGVDRGKTPFVVALVHAPWYNSNKAHXGEGDGMRDAMEALLYGARVDAVFAGHVHAYERFARVY

SEQ ID NO: 137485 - protein, 199 aa, Triticum aestivum
  Clone ID: PAT_TA_31903.pep
PAVFSFKLRGAYNMMAKLSREQLNNGVICSSAGNHAQGVALSARKLGCDAVIVMPVTTPEIKWRSVERLGATVVLKGDSYDEAQSYAKLRCEQEGRTFIPPFDHPDIIAGQGTVGMEIVRQLQGPLHAIFVPVGGGGLIAGIAAYVKRVRPEVKIIGVEPSDANAMALSLCHGQRVVLKHVGGFADGVAVKVVREETFP

SEQ ID NO: 137486 - protein, 158 aa, Triticum aestivum
  Clone ID: PAT_TA_31904.pep
IRHEASRGSGGAPLPPPPAPPRRAVLAHPAVGGFVTHAGWNSVLESLWHGLPMAPWPLYAEQHLNAFELVADMGVAVPLKVDRKRDNFVDRKRDNFVEAAELERAVRCLMGEEGRKAREKAAEMRDVCRKAVENGGSSDAALQGLSEALHDGAVPPTI

SEQ ID NO: 137487 - protein, 76 aa, Triticum aestivum
  unsure (1)..(76): unsure at all Xaa locations
  Clone ID: PAT_TA_31905.pep
MARRDSCLARIGAGVAIGGXAVGGPVGAVYGTYAAIRLRVPGLLKIRHIGQATVGSAAVFGLFLGAGSLIHCGKNY

SEQ ID NO: 137488 - protein, 205 aa, Triticum aestivum
  unsure (1)..(205): unsure at all Xaa locations
  Clone ID: PAT_TA_31906.pep
MHYYAEMALLFLLLAVPTSPGAGFDVDPLKPGQAWQHPKDHKVVNVREANSISSYKAMISEVHSFGVRTSKYKEKGLPILARQTSTPKPDRWLMLELRGDGQDEIMLAIRNDNLYIEAFANSSGKWHTFANIGNLIPGATILPFDDSYRGLVNGHANLRTLVLGKETTLRALTXLAVYKQSVGADTGCVXRALAIMAVTFCEATR

SEQ ID NO: 137489 - protein, 123 aa, Triticum aestivum
  Clone ID: PAT_TA_31907.pep
RFFFLPTSCTHQRTRIRSHSTHSRREFHRRSGRQQWPPPPTSPCLPCRRSRRRLRRPPTPPRPLRRRRRPRRSRRQRRARRRRPQRRRRRRTRRRRRPRSAGSCCPRSAQRRRASRRCPGSRR

SEQ ID NO: 137490 - protein, 89 aa, Triticum aestivum
  Clone ID: PAT_TA_31908.pep
CGGRLRGASRNSRLFEWQGAAILLTGRGTEVVVYELLMGLNYRCRYEQHSTVPAALATMAIVLQPFSSVFIKAKEACCWHCWWDTGDGG

SEQ ID NO: 137491 - protein, 293 aa, Triticum aestivum
  Clone ID: PAT_TA_31909.pep
DAYGTTRCCRQGCSGPGPHIVAHDISLAHAAVSDICREKSKAGQKGEVAMSLDAMWYVPVSNSSADVEAATRAQEFRLAWFADPFSFGDDPATMRSRVGQTLPRFMTKEADLVKGSLDCVGINHYTTFYTKEDHSAVIKYLLNDTLADSGSVSLPFRNGKPIGDKANSIWLYIVPGSMRRLMNYVKDRYDTPTVYITENGMDDSNSPFISLKKALKDTKRINYHNDYLTNLADSIREDGCDVRGYFVWSLLDNWEWTAGYTSRFGLYFVDYKDNLKRYPKNSVQWFKNFLAPS

SEQ ID NO: 137492 - protein, 237 aa, Triticum aestivum
  Clone ID: PAT_TA_31910.pep
MAGELELAGSCESTMHRCLKNNKDERGYQAQGFKCMIKSIFSGKATSVFENAMKLYSSSTGSRKSKALTSSLQPESEEMIKEASADMVEGKNVPVSQDQALLCTDMCDEVHNNGGPHHAAVDSMPGKAGLAKDCSNTGEDKVGSDVEDKSLSINHAEGHACDTEELQFPSNGEGELLPPKALQPCCSSVSSAPDVSKEQFSGVISDATFASGSQSCEDVMPGCRVNFNRIPCSPGST

SEQ ID NO: 137493 - protein, 183 aa, Triticum aestivum
  Clone ID: PAT_TA_31911.pep
APEPGELRRSGRVAGLPEQPNYLDGAEQRGYRGVYEAYAVRKGPTDEERAGAVAKAEELQRRIHRTRCPAFVKPMSHSLAMNAVQMLIPKDFFKYLPEHDEAVVVVDEADDEFHMMYNAHRKGKHCHYYLDKGWKGFAVDHDLADGDCLVFHMTERAKFKVYIFRANPDYESDQTSDDSEDEE

SEQ ID NO: 137494 - protein, 171 aa, Triticum aestivum
  Clone ID: PAT_TA_31912.pep
PVLPVRQPRGRRRGRGGGGVRAASCSFLHPCPACGRRPPRPGRGGDGGGGRRRGRTCSPSSPLSTPSLPRSPHPPRRGCRVQAPRPPPAPPPSVLALLPAPPWGRRPQVGRGPRPGRRTRRGGGRSRDGAGAPTRGDRGGMGARPRPMRRPGPGSSEGSSPQQQHPLDQLE

SEQ ID NO: 137495 - protein, 164 aa, Triticum aestivum
  unsure (1)..(164): unsure at all Xaa locations
  Clone ID: PAT_TA_31913.pep
PAEETFCSSHHRPPRPPPPPSPFSPFRPXLPRASRTSPPTTRPRAPPSPSRAVQADTRLLGDGPSQLPGPRPRMGRGTTPIPPRSPLVGAPPPSRLLPPPRRVLRPGVRPASNLRPPSPRSQIAEKSKHTGRRRWRWSRSLNPTPTPTASRSRSMPRRVRGTRQ

SEQ ID NO: 137496 - protein, 140 aa, Triticum aestivum
  unsure (1)..(140): unsure at all Xaa locations
  Clone ID: PAT_TA_31914.pep
RLALAVKNPCLXMAACLIKQKRFDEAIAQCSIVLSEDETNVKALFRRGKARAELGQTESAREDFLKAKKHSPEDKEIMRELRSLAEQDKAMYQKQRELYKGLFGPRPQPKPKAKNFAVLFWQWLVSLLRYLARMFTRKND

SEQ ID NO: 137497 - protein, 95 aa, Triticum aestivum
  Clone ID: PAT_TA_31915.pep
ELRTNLFYAIKNYDIVTKNKPTLYNKGFKVYCIHWASKSPLVIIKRNEEAHYKNWAPLQRNKIILNRDHFQASSRKVSLARELLRKLLSKAVRPA

SEQ ID NO: 137498 - protein, 362 aa, Triticum aestivum
  Clone ID: PAT_TA_31916.pep
MEEIGHHFGLGATAHGQHHSQLPWGSSPLSAVIAPPPQQQQQQQSAGYLAHSPLSLNTAPPSGSHGGGTGCSNPVLQLANGSLLEACAKAAKEPSSSSYAADVEAIKAKIISHPHYSSLLAAYLDCQKVGAPPEVLARLTAVAQDLELRQRTALGSLGTATEPELDQFMEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 137499 - protein, 161 aa, Triticum aestivum
  unsure (1)..(161): unsure at all Xaa locations
  Clone ID: PAT_TA_31917.pep
MGRSAISQALPVHQEDEDLFETSSSFSCDSDDEAQFSDGEDQFVPASPPVRRLNSDSVYDLSSIKAELSAKKGGLSKYYDGKSQSFACMSEVRCLEDLPKKSPYKKIKSCRSNINLDGNQRDCPVTGSNNSKGIXMMARTSSANMLYRPPAIPVNKSACHQ

SEQ ID NO: 137500 - protein, 170 aa, Triticum aestivum
  Clone ID: PAT_TA_31918.pep
MGRSAISQALPVHQEDEDLFETSSSFSCDSDDEAQFSDGEDQFVPASPPVRRLNSDSVYDLSSMKAELSVKKGGLSKYYDGKSQSFACMSEVRCLEDLPKKSPYKKIKSCRSNIDLDGNQKACPVPGSHNSKGMAKPSGSSCANLMARNNSANMLYRPPAIPVNKSACHQ

SEQ ID NO: 137501 - protein, 170 aa, Triticum aestivum
  Clone ID: PAT_TA_31919.pep
MGRSAGAPRVLPAHQEDEDLFETSSSFSCDSDDEAQFSDGEDQFVPAAQPVRRLNSDGVYDLSSMKAELSAKKGLSKYYDGKSQSFACMSEVRCLEDLPKKSPYKKIKSCRSNIDLDGNQTACPVPAPNTSSKGIAKQSSCANLMMARTSSANMLYRPPAIPVNKSACHQ

SEQ ID NO: 137502 - protein, 249 aa, Triticum aestivum
  unsure (1)..(249): unsure at all Xaa locations
  Clone ID: PAT_TA_31920.pep
QQAAHERRNIPTPRNKSRNISIHIQQQAYLPRLSPCRFIAETRNSQPWTDLLFLRPFRCTTEDEDLFETSSSFSCXDSDDEAQFSRRRRTSLCRLPRRLRRLNSDSVYDLSSMKAELXPRKGCLKYYDGKSQSFXACMSEXVRCLERTCPRRSPYKKINSXASNIDMGCGTKKPTPYLLLTTLSKGIAKQQPGSSCANLMMAPTNSANIXLTRPPAIPVRYRCVLAAEVCPAARIVCPSAVRSPLHCSF

SEQ ID NO: 137503 - protein, 190 aa, Triticum aestivum
  unsure (1)..(190): unsure at all Xaa locations
  Clone ID: PAT_TA_31921.pep
MLAAQCRVTEKVSLVQHEFGMSQAEFAILMLIAGAAGMISQLTVMPIFAPIVGEEMLLIVGLLGGCTHVFLYGIAWSYWVPYFAASFIILSAFVHPSIRTNVSKSVGSNEQGIAQGCISGISSFASILAPLVFTPLTAWFLSETTPFNFXAFSIMVAGFCTLIAFVISIRMRAARCGVSEKVSLVQHEQA

SEQ ID NO: 137504 - protein, 354 aa, Triticum aestivum
  Clone ID: PAT_TA_31922.pep
KELEEQQARSRIWDETWLSGFFYKPCNYELFVKQSLNMEMAIVMARESGMDWIMHLDTDELLYPGGASEYSIRRLLADVPEDVDMVIFPNYESSVERDDIKDPFSEVSMFKKNYDHLPKDTYFGMYKEATRGNPNYFITYGNGKSAARIQDHLRPNGAHRWHNYAKSPNEIKLEEAAVLHYTYTKFSDLTSRRDRCGCKPTKEDVKRCFMLDFDRAAFIIASTASEEDMLRWYNERVVWNDKQLNLKLLRKGVLTRIYAPMAIVQGLRESGVFTSVIRAAVDNAKVRLKESVDRNSTDPDHEDEPRAFVAANARKILNVVEPAPAYRDGGASAAVPPMSPPGLDEARGEGLAGC

SEQ ID NO: 137505 - protein, 135 aa, Triticum aestivum
  Clone ID: PAT_TA_31923.pep
MDDQIKSIKKEKTDKQVTKRHTWKSSEDKILLNILKDQTINGGKEGTGYTKKAWREILEQFNESKVDKLELQQIKNRHKYYRSCYATMDRLLKHTGFGWDDDDKMIKAPEEKWAELILKDKNIQEYRDKVWPSWI

SEQ ID NO: 137506 - protein, 336 aa, Triticum aestivum
  Clone ID: PAT_TA_31924.pep
EFGTREGLTGLEGELKGWRVGETFEGFTGTSSLSTTNDDDASSTNTEPVRVFSPDPRVRRNIKSWMRGALLGSGSFGMVYEGISDEGAFFAVKEVSLLDQGSNAQQSILSLEQEIALLSQFEHENIVQYYGTDKEESKLYIFIELVTQGSLSSLYQKYKLRDSQVSAYTRQILNGLVYLHERNVVHRDIKCANILVHANGSVKLADFGLAKEMSKINMLRSCKGSVYWMAPEVVNPRKTYGPAADMWSLGCTVLEMLTRQIPYPNVEWTNAFFMIGKGEQPPIPSHLSAEAQDFIRQCVRVDPDERPSASQLLAHPFVNRPLRASFDSLSPPINRP

SEQ ID NO: 137507 - protein, 267 aa, Triticum aestivum
  Clone ID: PAT_TA_31925.pep
AQAIIRSVVDFKKDPWPRVSEPAKDLVRRMLDPNPIARLTAAQVLEHPWLHDSKKNPDIQLGDTVRARLQQFSAMNKLKKKALRVIAEHLSLEEVADIKKMFDSMDVNNKGQLTFEEFKAGLRKLGNKMHDSDLQMLMDAADVDKNGTLDYGEFVAVSIHVRKIGNDEHIQKAFSYFDQDKSGYIEIEELRVALTDEVDGACDEDIINGIIHDVDTDKDGKISYDEFAAMMKAGTDWRKASRQYSRQRFSNLSLKLHKDGSISDDQK

SEQ ID NO: 137508 - protein, 227 aa, Triticum aestivum
  unsure (1)..(227): unsure at all Xaa locations
  Clone ID: PAT_TA_31926.pep
EHSNSIELSHDDTKCLEPESLLSSTIMNFYIMYLQGPMSSISTQRGKYHXFNTYFFKKLEALKSKVDKPSYFLNLRRWWKGIDIFQKPYILFPVHADTHWSLVIICMPAKEDQSGPIILHLDSLKFHNSRLIFSVVERFLKQEWNYLKDNGSLAECPIRETVWKNLPRKIEKKPIAVPQQENEFDCGLFVLYYMXAFIEEAPERLHKKDLSMFGKTWFQPEEASALR

SEQ ID NO: 137509 - protein, 219 aa, Triticum aestivum
  unsure (1)..(219): unsure at all Xaa locations
  Clone ID: PAT_TA_31927.pep
MNYREVGSLRKMIKGWQRHEQQEPLCRKIWKQTKPKKEKKEITRELDAEGSQKKGGRKITXKANIYARLHQPKIHIPLNVNGQPVGPDATEFTNFIGTLVRKHVPPPELDWRDVDVQKKLLVWETLKAFHELDSTALSFVINSSHTKWKDWKXDLKRYKFDVVLTDAELMKRHDSRISEADLKTLIIYWRSSVFEVAVRLCRKDKEDQEGTMMLSVCMN

SEQ ID NO: 137510 - protein, 231 aa, Triticum aestivum
  Clone ID: PAT_TA_31928.pep
MPANKTSLANQKDGRNISVDMYPFIRKYKDGSIERFLRSPFVVASPDQGGNRGVATKDVVVDKATGVSVRLFLPLRAADTAGRNRLPLVIYVHGGSFCTESAFGRTYHRYATSLAASAGALVVSVEYRLAPEFPIPAAYDDAWAALQWAASLSDPWLASYADPARTFLAGDSAGGNIVYHTAVRASHEIKDDMMDIAGLIMVHPYFWGAKRLPSELAWADDSDGAAVVFPP

SEQ ID NO: 137511 - protein, 133 aa, Triticum aestivum
  Clone ID: PAT_TA_31929.pep
MCEVTCRGNCEETNKRQKQRKGHSGETAAGPREREVNVTDQFLPDQPMQGHYVLGHNFGLGTSQNLRDDLNHFGQASAVPTLQQQPFPGNGQLTETQAYTGDMHALQFMETNPQIDHENGEEGQSSIPVWDFL

SEQ ID NO: 137512 - protein, 115 aa, Triticum aestivum
  unsure (1)..(115): unsure at all Xaa locations
  Clone ID: PAT_TA_31930.pep
CIHDCQSDLQVWPIEGIKKFETLSYLPPLSTEALLKQVDYLIRSKWVPCLEFSKVGFIFREHNASPGYXDGGHWIGEKLQMYSGNQSXPVINEVEEVKKEYPDAYVRIIGFDNMR

SEQ ID NO: 137513 - protein, 312 aa, Triticum aestivum
  Clone ID: PAT_TA_31931.pep
MALVLLLTLLCIAFPAYLRNPVSVASCFTGADVRAAAAAQPAASASAALVADDGGRRPGQLRILLGVHTMPKKHSRRHLIRMAYALQQMAALRGAARVDVRFALCARPMPPEHGAFVALERRAYGDVLLFNCTENAEDGKTYTYFSDLPAMLGASGGEGRRPPYDYVMKVDDDTYLRLDALVETLRRAPREDMYYGVGLPFMDRVSPPFMLGMGYALSWDLVQWITASDMVRRKAKGVEDVTMGNWLNEGGKAKNRVNIFPRMYDYKSAEAKDFLEDTIGVHQLKADIRWAHTLAHFNATSGDLRPSREGSS

SEQ ID NO: 137514 - protein, 191 aa, Triticum aestivum
  unsure (1)..(191): unsure at all Xaa locations
  Clone ID: PAT_TA_31932.pep
DWRXSEMRGQYGKTWWWMSFFAVYLSQQVFLIGIXCLRMYAIHSSDQPLGIWDXVATVVCITGVVIAYFADTQLHQSVTKEREXLKQLGEPTVPTLRGXGCWGYSRHPXXYXGEQLWWWGVYLFAWNLGQRWMFIGALVNSMCLGYVTVLVERRMLKQEHRAEAYRLYQKRTSVLIPWFRKSLPEPKEKET

SEQ ID NO: 137515 - protein, 273 aa, Triticum aestivum
  unsure (1)..(273): unsure at all Xaa locations
  Clone ID: PAT_TA_31933.pep
MPRPVADPCSVVERARERTSGPRLVLFGDSINXLHSFAPGGWGAGXSRQHLREGRADVVLRGLSGYNTRWALKVLDRAMEGAAXGGADPAAVTVFFGANDSSLPRRCRTRTTHVPXRGSTMDQLRAIFPHLHNNCPSAALILSAPPTIQEPSXPSRHPERTKEVAGTYTQACIAVAKELDAPVIDIXKAWDNQFTDXWQTSTMXDVLTFHPDLDKNVCSHLSRIPWKRVWFNQVQNTVAIVGFTKKILRSDLRHLYEIDHKDPLKVFDPKGRY

SEQ ID NO: 137516 - protein, 100 aa, Triticum aestivum
  Clone ID: PAT_TA_31934.pep
NAKIINMSIGITKSSNKLIQCTRLLMVLGNVSRNENYTYEYKKFICRSLCQNISNGLIISGAIGSHAQPHCPHTYLNLVFKQLNLRVPRDYNQFHMFNNL

SEQ ID NO: 137517 - protein, 273 aa, Triticum aestivum
  unsure (1)..(273): unsure at all Xaa locations
  Clone ID: PAT_TA_31935.pep
ERRDRDTDEGEEDDEAACSNAGANTSSANASTSSSTAPSSGGRRTGGGAAAAGGWGSSPVSGATINLSQEYTXAIQTSSYNEIWGKIHVIVDGERVDGGDQDEDEEDRGTLAGVLRPEDAVVERALGDAPDTELTRLAADYLRSTHNASLHCLFLRRALRRARALYGPITDVLALIPHATPLAVPHCDCAFDAFLLFDKIPNPFLPPAASFQGMHRSFAGLKTHLDLRLLKARRRRRLLRXRTRGSGICLIGCATGAAIAGLVIATHXXXXPA

SEQ ID NO: 137518 - protein, 253 aa, Triticum aestivum
  unsure (1)..(253): unsure at all Xaa locations
  Clone ID: PAT_TA_31936.pep
HRSSERIHRVFRQELETLLRIRHPHIVRLLGFCEQQDEGVLVLEFAANGNLYEKLHGGGKAAGAMPWAWRVSVALQVAQALEYLHERCEPQVVHGDVKASNVLLDASMSAKLCDFGSARMGFSAAVRPRSSAHTMLGSPGYVDPHYIRSGVVTKKTDVYSFGVLLLELLTGIEAFCPVEGRLLTGVLAPRLKAACDARMLVDERLGSAYDAGEASAVAALAXASCVGQNPSLRPSMXANVVRTLEQSAQGFIL

SEQ ID NO: 137519 - protein, 151 aa, Triticum aestivum
  unsure (1)..(151): unsure at all Xaa locations
  Clone ID: PAT_TA_31937.pep
TPYPAAHLRPSPSSPTPTPSLPALPRLSSSSSASSSGDSSMVVVGSADSFEDIHAKVQAEKLPAVFYYTAVWCGPCRAMAPVIEKMSRQYPKIPVYKVDIDMEGLXPTLSYPKTFSIPTFHFYHKGEKSSEVVGADVKKLEAAMESLHKQQ

SEQ ID NO: 137520 - protein, 119 aa, Triticum aestivum
  Clone ID: PAT_TA_31938.pep
GYTFVRNAVEGTVEARILEGPVDFHGRIIARTSSFPCDIMLHDSELAGMLTAGDGGILQTARRVVSVSINETLLLTVAAATSGVHTVEFTPKRGSYDEEEITCGDYKMLVKVTWSIVCW

SEQ ID NO: 137521 - protein, 235 aa, Triticum aestivum
  unsure (1)..(235): unsure at all Xaa locations
  Clone ID: PAT_TA_31939.pep
MHAATSAGSMASIELGRAGAGAGSGSGNGIGIGRGGPAGTTSKKRLVXMIIADPGRESTAAMDWALSHAVVEGDDILLLHVNMPPSGAPSGAAPPRTGSVGSSSSSQLAVFLGGGGSADGEFMETMRAACKARYPRARVHAERVEPATEGREAKAQTILAESQRRGVELLVIGHHRFSAFLRLRSASGTSRPRHDSTAEFLIEHSKCRCVSVQKKGKNAGYLLNTKTHKNYWLLA

SEQ ID NO: 137522 - protein, 219 aa, Triticum aestivum
  Clone ID: PAT_TA_31940.pep
ALNSYLVVSTFIALILSKDKLKRRLKSLEEDMRNGKFNTPASEANRKGTPKRSTSQPRQPSTPRMSQQLASFEGIVDKRRPTSQPRAAVGGKVLKQPNSDTEPAEKTRNIKQPDSPRVRTAAARKERPVRNHLWATRSKVTSDAGKENKEQNPNYKPHSSAPHEQGHDATKPQAVVFDANGDCGVQRSEHHKDMDLENLDDKKADASNAESTQGGNRGN

SEQ ID NO: 137523 - protein, 233 aa, Triticum aestivum
  unsure (1)..(233): unsure at all Xaa locations
  Clone ID: PAT_TA_31941.pep
RNSARGERETSLLGRRDXKKEVDRELENRKNDRRSDNVSARDNNDSRAAPTSGRWDDGSTRNSGNEGRRDGKWSLRWGPDDKEKDSKPEKKMDAEKDEPHGEKHTLPVRLLPESDSRDKWRPRHRQETQTSGTATYRAAPGFGLEKGRVKESNVGFAPGRGRANPNSVPSFSRPSSAGPIGAPPVYGRRAATAGAFRYPRGKLLDIYRQQKVVQSFEDGRRMLESYFSLTCSP

SEQ ID NO: 137524 - protein, 258 aa, Triticum aestivum
  Clone ID: PAT_TA_31942.pep
MGTPTTTLAALAALLLCLCVSMSSAAEYKVGGLDAWGVPPSTKPDVYVRWAKSVPVKLGDALFFLYPPSQDSAVQVTAKAFAACDVSDPLLKLDDGNSVFNLTKPGRAYFTSAAPGRCRKGQKLSVDVPGADGKLLKPSADDEAALKALSALPPAAAPSEALPSLSPDDADDDSAASMALHRAAGSVGLALSLTLLWLRFFFFFFFFFFLFFFFFFFFLPSIPISFFFVRSETRGGRHCIVLYCTLLRSSNLFVWIGL

SEQ ID NO: 137525 - protein, 55 aa, Triticum aestivum
  Clone ID: PAT_TA_31943.pep
DTKTVYQWNRMDDGKHVPTDNVVFHNQYWASNTRRRRLKKKHLRYESLEGLMSML

SEQ ID NO: 137526 - protein, 441 aa, Triticum aestivum
  unsure (1)..(441): unsure at all Xaa locations
  Clone ID: PAT_TA_31944.pep
MPPRPAKCFSRPPRGYSAPQQVHITQGDCDGKAVIVSWVTPSEPAPSQVFYGKEENRYDXKAEGTMTNYTFYDYKSGYIHHCLVDGLEYNTKYYYKIGTGDSAREFWFQTPPAIDTDASYTFGIIGDLGQTFNSLSTLQHYLKSGGESVLFVGDLSYADRYQHNDGIRWDSWGRFVERSTAYQPWIWNSGNHEIEYRPDLGETSTFKPYLHRYSTPYLASKSSSPMWYAVRRASAHIIVLSSYSPFVKYTPQWMWLKGELKRVDREKTPWLIVLMHAPMYNSNDAHFMEGESMRAAFEKWFVKYKVDLVFAGHVHAYERSYRISNINYNVTSGNRYPVPDKSAPVYITVGDGGNQEGLAWRFNDPQPDYSAFREASFGHSTLQLVNRTHAVYQWNRNDDGKHVPTDNVVFHNQYWAGNTRRRRLKKKHLRYESLQSLMSML

SEQ ID NO: 137527 - protein, 252 aa, Triticum aestivum
  Clone ID: PAT_TA_31945.pep
FFHLPESERLKCYSDDPKKAIRLSTSFNVRTEKVSNWRDFLRLHCYPLESFVDQWPSNPPAFREVVGTYSTEARALALRLLEAISESLGLERGHMEKAMGRHAQHMAVNYYPPCPQPELTYGLPGHKDPNAVTLLLQDGVSGLQVQRDGRWVAVSPVPGALVINIGDQLQALSNDRYKSVLHRVIVNSESERISVPTFYCPSPDAVVAPAKALVDGGHPLAYRPFTYQEYYEEFWNMGLESASCLDRFRPIA

SEQ ID NO: 137528 - protein, 240 aa, Triticum aestivum
  unsure (1)..(240): unsure at all Xaa locations
  Clone ID: PAT_TA_31946.pep
ARGGTAHRAHASTEGVTKYLKPAVAGFLMQKELDYLVGAVANPTKPFAAIVGGSKVSTKIGVIESLLSKVDILILGGGMIYTFYKAQGHAVGKSLVEEDKLELANSLIEKPKLTGVSLLLPTDIVVADNFAADAESKIVPASAIPDGWMGLDVGPDSIKKFSETLDTTKTVIWNGPMGVFEFEKFAAGTDAIAKKLADITAKSVTTIIGGGDSVAAVEKAXLVSKMSHISTGGGASLELL

SEQ ID NO: 137529 - protein, 427 aa, Triticum aestivum
  Clone ID: PAT_TA_31947.pep
FGTRERFAILYSQGSGGEGRTSIKVPKVYWTYTRKSILALEWIDGIKLTDAERISKANLNRKKMIDEGLYCSLRQLLEDGFFHADPHPGNLVATEDGSLAYFDFGMMGDIPRHYRVGLIQMLVHYVNRDPLGLANDFHSLGFVPEGTDLHAVATALSVAFGDGRRQSNDFQGVMNHLYDVMYDFNFSLPPDYALVIRALGSLEGTAKALDPDFKVIESAYPFVIGRLLADPSPDMRKILRELLIRDDGSIRWNRLERLIAAISQQSSEESSKKPGDENTASSSDWRSFDMHSVVSATEDLFHFILSRKGWRVRVFLIQDIVKASDAFLQETTFPGIFEEEGNTGELNPERSRMIRRLINGVQSFRQAISLAPNAWTAMLIRVALKPESQRFILDVFLALVNYSHDKVPETCWICMSKYLNYLDRQWR

SEQ ID NO: 137530 - protein, 270 aa, Triticum aestivum
  unsure (1)..(270): unsure at all Xaa locations
  Clone ID: PAT_TA_31948.pep
QLDLDVDSSSSAGGSRQPMVLVNTVEELETMAFASVPGLDVFPVGPAVVSLFTEGESGTSGTAAAVGDLFEHDENGYMEWLDTKPARSVVYVSFGSMAAVSKRQKDELKRGLAASGRPYLWVVRNNNRGDGFDDAGDERGMVVGWCDQVRVLSHPAVGCFVTHCGWNSTLETVAXGAPVVAVPQWSDQDTNARLVVQWGIGVRAATDVDRVLDAEELARCLELIMGDREEGAAIRASSATWKAKLQQAIAAGGSSGRNLRTFLDQFANDA

SEQ ID NO: 137531 - protein, 113 aa, Triticum aestivum
  Clone ID: PAT_TA_31949.pep
SVERTMAPKLEYLAGLGMSRDDAVAMALRCPALFTFNVERNYKPKFEYLVEEMGGGVEDVKAFPQYFTFSLEKRIAPRHRAAADAGVDLPLPDMLKATDEEFSEMLERRRRSG

SEQ ID NO: 137532 - protein, 311 aa, Triticum aestivum
  unsure (1)..(311): unsure at all Xaa locations
  Clone ID: PAT_TA_31950.pep
MIVEVPLVGDTKIWLDEDLNLFHTRPCSPSLNCDTQLVDSIVRTSVVPDQAAVQNDSPNAGQGEEIPSCGQDANTGVFQSATCTKAEPLLQEPIHEVNKSSCQPSLGTKVDPAALPLEATSHDCINNGKLNVVAENIDSTNLKDREQLHKKVGTIFPKKEQDRKMVKQREKRKKNDALPKEDKDQLAENAQKGHAEPKPLPSFKNFVVEEEEGSGGYGIVYRARRSEDGKVFAIKCPREKAHSHHVDNERKMLERFGGKSFVIRYEGCFRSGELDCFILEHVKHDRPEILXREIXVFELQWYGYCLFKALS

SEQ ID NO: 137533 - protein, 57 aa, Triticum aestivum
  Clone ID: PAT_TA_31951.pep
SRVGYIKAEDLRCIIHNLGKFLSNRDVKDLVETALAESNSARDNRVIYTKLVKIVDL

SEQ ID NO: 137534 - protein, 171 aa, Triticum aestivum
  Clone ID: PAT_TA_31952.pep
EDEDPDYEEDPEEVEIYEDDEDMDGDTAEQQDGNLNSREVKLEEVTKEDKLNQKAGKEIELENVACIDEKPVTIAEKGGLVEVGDKAAVSPKGDSAKHEVVDKDLLQAFRYFDKSRVGYIKAEDLRCIVHNLGKFLSNRDVEDLVEAALDESNSARDNRVIYTKLVKIVDL

SEQ ID NO: 137535 - protein, 102 aa, Triticum aestivum
  unsure (1)..(102): unsure at all Xaa locations
  Clone ID: PAT_TA_31953.pep
VLFWKAINSGDKVDNMLMNMEVVMKQRHHNEEAIXAIRSFRHLHSRQAQESLDDLLIDLYKXRDIKMICLCEAFNSKSTKTDXSHDKKFLVSIEQEKSHILV

SEQ ID NO: 137536 - protein, 253 aa, Triticum aestivum
  Clone ID: PAT_TA_31954.pep
YLSPADLRRLPAAGKLVTTLFQTTGRASADLGAVNVTAAGPGLGVVRSPAPFPGSNATVLGSVTSVPYNLSVLAVDGLIAPSGVAEEFEGDERGAGITVFVPTDDAFASLPAGDRLQSLPADRKAVVLRFHVLHSYYPLGSLESIVNPLQPTLATEYASQAGRFTLNITRSNGSVAIDTGVVQATITRTVFDQNPVAVFAVSKVLLPKEMFTRADSAAVVAAALAPPPGTLTRCRRPAQSAGSAAKFASPRLG

SEQ ID NO: 137537 - protein, 184 aa, Triticum aestivum
  Clone ID: PAT_TA_31955.pep
HASEEISSSMVSQSFGASDMAFNSIDSGINDGAFLNKSSWPPAPPVKRMRTFTKVYKRGAVGRSIDISQYAGYEELKHALARMFSIEGQLEERQRIGWKLVYRDHEDDILLLGDDPWEEFVNCVKCIRILSPQEVQQMSLDGDLGSSVVPNQACSSSEGGGNAWRARCDQNSGNPSTGSYDQFE

SEQ ID NO: 137538 - protein, 218 aa, Triticum aestivum
  Clone ID: PAT_TA_31956.pep
GGTLLYKTCKFDCQQLMASTCKTTKAGIGGPIIAADGKFIGMSFYYKDGAPFLPITILQKCLKHFNEFGRVLLPWHGLRIGSLQAEKLRVLEEVHDILPHAHGIYVQKVVSGSPSADSGIKAGDVITKLDDFALSNAQEFHELILDKAESAFRHGERMHLTVSFLRPSSGSEFCATISAEVIDMSEQNMSSQNKSKQNSDGRYPRRSGYIQMTNVMLI

SEQ ID NO: 137539 - protein, 92 aa, Triticum aestivum
  Clone ID: PAT_TA_31957.pep
MVCVACLIPLFLIPFVNALPYLFDLLLSKVYRMLGWEYRRPERVPAACPFKPAANKTEGVAGESKPVANPHVASANPLVEPQSATTEMKKDD

SEQ ID NO: 137540 - protein, 93 aa, Triticum aestivum
  Clone ID: PAT_TA_31958.pep
MVCVACLIPLFLIPFVNALPYLFDLLLSKVYRMLGWEYRRPERVPAACPFKPAANKTEGVTGESTPLVNPHVAGESKTLMEPQSATADGKKDD

SEQ ID NO: 137541 - protein, 171 aa, Triticum aestivum
  Clone ID: PAT_TA_31959.pep
EAGRRPPPASLLLPQTNRADPDPVKIQTTHCFLRPPPPAPPPPPPSLPPAPNPGDRDPGVPAAAPPLPPPSRPAEAIVSVACLVSLYLIPGSQRAPLPLRPPPQQALWQAGIGIQEASESPSCLSVQACRPTETKAVGGMNQNQKANPHVSTRNSSSVCAPLLLPQEMKKE

SEQ ID NO: 137542 - protein, 352 aa, Triticum aestivum
  unsure (1)..(352): unsure at all Xaa locations
  Clone ID: PAT_TA_31960.pep
TAAILDEADNVHSHSPADRRRLVVASLCLVPRPRTPSTASSLSSSFFIVVEYIRLEWLLMSKAXRGGTLLVLPMSSSLYVRPLPWEIXSYGCLSCETVCARILRDLQVLLARSRYLGTRCRYSPIDRCSGLAGMLLFEDLCLDFTLPGXYPDFVLKEGEENTVVCIYNLEEYISLVVDATLKAGIMRQVEAFKAGFNQVFDISSLQIFSPQELDYLICGRRELWEPETLVEHIKFDHGYTSKSPAIVNLLEIMTEFTPEQQHAFCQFVTGAPRLPPGGLASLNPKLTIVRKHSSTAANTSNAAGAAESADDDLPSVMTCANYLKLPPYSTKEVMHKKLLYAINEGQGSFDLS

SEQ ID NO: 137543 - protein, 100 aa, Triticum aestivum
  Clone ID: PAT_TA_31961.pep
PRSLKPCSVCSPSNVLAKADAFFGVPAHGAAGLELHGKGQLLAVEAMFLMSLALAAAHLAMAYRASSREKRRLHVVYRIDIEAVRLKGTHTPKSLKQCIV

SEQ ID NO: 137544 - protein, 208 aa, Triticum aestivum
  unsure (1)..(208): unsure at all Xaa locations
  Clone ID: PAT_TA_31962.pep
ARTWFQKXPCPLNDKPLXRSETAVFLGKEAGGHHDDDQPEGATRKRKRSKVTASSPTISVRPSSMNAFDIISRSSVLDLAKMFDAEHKTSEARFSSKETTTAIVSKLGKIAEAGRFSFKLNKEKGRVELEGSQDGRKRALALEAEIFEVAPSVHVVEMRKTGGDSLEFQDFYKQELKPSLGDIVWAWQGGDSPPPTLTPAVPRSNTNS

SEQ ID NO: 137545 - protein, 250 aa, Triticum aestivum
  unsure (1)..(250): unsure at all Xaa locations
  Clone ID: PAT_TA_31963.pep
FSCVCYSCRFFFPIMKWEASAFGRPVLALVLVASLAIFPLILVPSGPSMWLAGMIFGYGWGFVIIIVGTTLGMVGAYWIGSLFRERLHAWLKRWPQQIALIKLAGEGSWFHQFRVVALFRVSPFPYSIFNYAVAVTEIKFSPYVXGSVAGMTPEAFIYIYSGRLIRTLADVKYGKYKMTPVELTYNIISFVIAVVLTVAFTVYSKRALSHIKSSDDICAEDQPAVSAGVTALKNGQRECSHAHHVALDVV

SEQ ID NO: 137546 - protein, 156 aa, Triticum aestivum
  Clone ID: PAT_TA_31964.pep
MSTMAMSALNPDAPMFIPAAFKKVEDYSPEWWELVKTTAWFRDHWFRQHQLYEDLADDVDVDDVAALLPDDSVDLLDADDLFYSPPSPQPQPDFYHYKPAGFGGDMDAVLKTLSVNSPRGGGPAPAWAPMRHAEKPAQHVGPRAGGGARRAIHQPR

SEQ ID NO: 137547 - protein, 233 aa, Triticum aestivum
  unsure (1)..(233): unsure at all Xaa locations
  Clone ID: PAT_TA_31965.pep
MSRHPEVRWAQRIDKVYITVQLPDAKDAKVNLEPDGVFSFFATAGTDGNSYESKLDLNDKVNVEASKVSVGVRSIFCILEKADAKWWNKLVRDDQKAPHFVKVDWDKWVDEDDDGADVNVDGMDFSNMGGMGGMPGMGXGLGGMGGMGGMPGMEGLGGMGGMGGLAGMXDGMGGMGGMGMPPGMEGLGGMGMDDFEDESDDEGEVSKPQDAGKSDAAEISEVEGKAGTAAQSN

SEQ ID NO: 137548 - protein, 352 aa, Triticum aestivum
  Clone ID: PAT_TA_31966.pep
MARVLPLDIEPGEAPRAGETVASMPSSSAVASNMKDDEYARLVTPAQHATADNNIEIPEQPKSRHFIWWMKVLLGCFLLTLASYIFVKFGVPFAFQKVLLPIMQWEASAFGRPVLALVLVASLALLPLILVPSGPSMWLAGMIFGYGWGFLIIMVGTTLGMVASYWIGSLFRERLHARLNTPEIPPRWPQQIALIKLAGERNWFQQFRVVALFRISPFPYTIFNYAVTVTEIKFNPYLCGSVAGMVPEAFIYIYSGRLIRTLADVKYGKYKMTPVELTYNIISFVVAVILTIAFTVYAKKALSHIKSSDDTCAEDQPGVTALKNGHQEVFPCTSCSFRCRVMSIHRERIRVK

SEQ ID NO: 137549 - protein, 157 aa, Triticum aestivum
  Clone ID: PAT_TA_31967.pep
MMSTMAMSALNPDAPMFIPAAFKKVEDYSPEWWELVKTTAWFRDHWFRQHQLYEDLADDVDVDDVAALLPDDSVDLLDADDLFYSPPSPQPQPDFYHYKPAGFGGDMDAVLKTLSLNSPRGGGPAPAWAPMRHAEKPAQHVSPRAGGGARRAIHQPR

SEQ ID NO: 137550 - protein, 119 aa, Triticum aestivum
  Clone ID: PAT_TA_31968.pep
LSERAVRRRRGGRSRLSHRPRRHRGPRWACGKVARDVWVERRGIRGSCRRRAMTTARGRSARDDGRAGSPNKQNNLITFLLSSKGFHLFFDRFLFVRFLLVLAICIPEQIVLFSMFLVQ

SEQ ID NO: 137551 - protein, 115 aa, Triticum aestivum
  Clone ID: PAT_TA_31969.pep
MSGTVCSMCGDVGFQDKLFRCARCRCRFQHSYCTNYYGDAAPADAGAGVCDWCLSDDPLVKNRRPSAPPAMQHRGPPTGMGCGKVKVTGGGEQEGGRRVAKAAVRRYKLLKDVLC

SEQ ID NO: 137552 - protein, 205 aa, Triticum aestivum
  Clone ID: PAT_TA_31970.pep
MDEEYDVIVLGTGLKECILSGILSVDGLKVLHMDRNDYYGGESTSLNLAKIWKRFKGSDTTPEHLGISKEYNVDMVPKFMMANGALVRVLIRTSVTKYLNFKAVDGSFVYNNGKIHKVPATDVEALKSNLMGLFEKRRARKFFIYVQDYEEDDAKSHEGLDLHKVTTRELISKYGLEDDTVDFIGHALALHRDDNYLDEPALDTV

SEQ ID NO: 137553 - protein, 446 aa, Triticum aestivum
  Clone ID: PAT_TA_31971.pep
MDEEYDVIVLGTGLKECILSGLLSVDGLKVLHMDRNDYYGGDSTSLNLNQLWKKFRGEDKPPAHLGSSKDYNVDMVPKFMMANGTLVRTLIHTNVTKYLSFKAVDGSYVFSKGKIHKVPATDMEALKSPLMGFFEKRRARNFFIYVQDYNEADPKTHQGLDLTRMTTKELIAKYGLSDDTIDFIGHALALHRDDRYLSEPAIDTVKRMKLYSESLARFQGGSPYIYPLYGLGELPQAFARLSAVYGGTYMLNKPECKVEFDMEGKVCGVTSEGETAKCKKVVCDPSYLANKVRKIGKVARAIAIMSHPIPNANDSHSIQIILPQKQLGRKSDMYVFCCSYTHNVAPKGKFIAFVSAEAETDNIQSELKPGIDLLGPVDELFFDMYDRYEPVNEPSLDNCFISTSYDATTHFETTVTDVLNMYTMITGKTIDLSVDLSAASAAEEEY

SEQ ID NO: 137554 - protein, 345 aa, Triticum aestivum
  unsure (1)..(345): unsure at all Xaa locations
  Clone ID: PAT_TA_31972.pep
DHVVQKNNRAQNHAATDFDALKIHMFGSDEKSEAKDFFSKVQDHKGADPKTHGGVYRTIEILRKRIAKNGLTDDIIDLNADALTLRRDDRNQSETTINALQRMXLHYKYSTPFQGRVDYMCCQYGWRSTTPYCARFSAVYGGTYRRKNPRGRXEFHGTGNLSGVXARWKRQTCENAVWNFLYVGQCMDNALRVARAICIMKVPIPDTXASXSVHIILPQKQLRRKSDLYVFCXSTTRNVAPKGKFISFVSPQCXSPDEPEIELIPANGLSLACVEDTFLTTCHDRYEPVDVAEEDNWIWTTSSDATTQFETKVKDVFALYSXITGKELDLSVDLNAASAGEYVAA

SEQ ID NO: 137555 - protein, 276 aa, Triticum aestivum
  Clone ID: PAT_TA_31973.pep
MMAAAKALSSVLLLLLLVAVATPEAAAATITKRDFPPGFIFGTGSSAYQIEGAVAEDGRKPSIWDTFTHSGHSVDGSNADVTADQYHKYKEDVKLLSDMGVDAYRFSIAWPRLIPDGRGAVNPKGLEYYNNLIDELLAHGIQPHVTIYHFDFPQALQDEYNGMLSRKFIDDYTAYAEVCFKNFGDRVKYWSTVNEPNIEPIGGYDQGILPPRRCSFPFGALSCDNGNSTTEPYIVAHHLLLAHASAASLYKEKYQAKQGGKIGLTCSVWWYEPATT

SEQ ID NO: 137556 - protein, 392 aa, Triticum aestivum
  unsure (1)..(392): unsure at all Xaa locations
  Clone ID: PAT_TA_31974.pep
NGLSDQLMAYRVHSHLSIHLYYHAKAIHDEXDGMLRRKFSDDYKVYVDXVCFKDFCDRVNDWSNXNEPNIAPIGGEHQGIVPPRRMFIPLRXSSSCDNGNSTTEPYIVAHHLLLAHASAASLYKEKYQAKQGGNIGLTLLGWWYEPATQTPEDIAAAERMNDFHIGWYMHPLVHGDYPPVMRKNVGSRLPSFTDEELKRLLGSFDFVGFNHYIAVYVKADLSKLDDELRDYMGDAAVKYDMPFLKKNQLLFGXKCDFRTSTPWALKKMLEHLQLKYKNPIVMIHENGAASIADLSAGNAPNDEFRSQYLQDYIEATLESSRNGSNVQGYFVWSFLDVFEYLFGYRMGFGLYGVDFNSGERTRYQRHSAKWFTGFLRGGELRPVALPGQAYSQ

SEQ ID NO: 137557 - protein, 193 aa, Triticum aestivum
  Clone ID: PAT_TA_31975.pep
EFPWTLQVRRERISQRMKFLQDLVPGCNKVIGKALMLDEIINYVQSLQRQVEFLSMKLATVNPLDFSNLPTLLHKDMYGPSASSVFSLESSSSAFPFSDQGDVFQSFLPNSMESQCTLNQLDLALSQATNAAQYAFQDGTATASTNLQQQRNFWEDDLQSVFHVDTNRQSQDNGVSAESFHGDLQAGQMKMEF

SEQ ID NO: 137558 - protein, 298 aa, Triticum aestivum
  Clone ID: PAT_TA_31976.pep
MEAVARASIAASSHARVPLCRRPRPQRHAARCLRGRRSVACAAAADADVVRLFDAAKLTVDEFVKSGMVVGLGSGAASGLAVQYLGTRLRRGSLTGIVGIPSSVICASEAEKAGIKVGSHEEGAQIDFAFTDADVIEEGTLAAVIGRGKTESGQPSFIQEKGIVESADKVAFIIDNDKYVNGIEGSIPVLVKSGNWIDTAEEIDDLFLGDAEVWRRPSIGTAGPSGGDFPLVTKEGHHILDVIFTTPIQDLGKVAEGLEKIVGVVDHGIICNTTPYAVIASKGEVQVLDRKSSVIPNT

SEQ ID NO: 137559 - protein, 279 aa, Triticum aestivum
  unsure (1)..(279): unsure at all Xaa locations
  Clone ID: PAT_TA_31977.pep
VRSISYNVMIKGYVEANKVEEAVGLFTDMGEKGLRLSEKTFAALMPGLCDDEGKAAEARKAVADMAERRLTPKDKSVFLRLVSTLCKAGDLDGALEVHKKSGQFKHVLVDPRQYGVLMESLCAGGKCDGAVQVLDELLEKGTLLSPKSPVMEAPAYNPVIEYLCNNGNTNKAETFFRQLMKKGVDDKSAFNSLIRGHAKEGALEAAKEILAIMTRRGVPTDPHSHALLIDSFLKKNESADAKTALDSMMEHGHLPRPALFQSVMVALFNDGPVQTASXS

SEQ ID NO: 137560 - protein, 182 aa, Triticum aestivum
  Clone ID: PAT_TA_31978.pep
THGPPTRPENEKPFIYIFNLMAHWTIEKDTRPYIQGKIKGLITSVKRFQFRNRREYELLVCIDDGSQISEAFVDSTIVRNIIGHSCEEVSTAVSDPTSESYIAMKQILSGFQHYLEKFEGTMHIEYNGQSSRPIVREMNEGCSTADAWLLLQRLKTCTAQRHIRNLDFMDTTPCLWSAFLLG

SEQ ID NO: 137561 - protein, 241 aa, Triticum aestivum
  unsure (1)..(241): unsure at all Xaa locations
  Clone ID: PAT_TA_31979.pep
MNQVSEEPRDDPSKRVSGGAPAAARAGCFDCNICLDFAVEPVVTLCGHLYCWPCIYEWLXATPAAAPSRRQGGPCPVCKAALTLDSLVPLYGRGGSRSSKSRLHPALPRRPTVHRGAVEQQRAQTSGGSGRRHVSTEPDSPTRSSRHAHVGAAQFDIMYPPPALGRGMNAMNSTAGGVLGGMALALLPWVFGGQAPAPSYPLGELQNLSPRLRRQHMEVERSLHQLLFFLFVFVVLCLLLF

SEQ ID NO: 137562 - protein, 226 aa, Triticum aestivum
  Clone ID: PAT_TA_31980.pep
MASSSSLFLLAALLALASWQVTAYDPSPLQDFCIADMKAPVRVNGFACKDPMAATPEDFFNAAMLDQPRDTKASKVRSNVTNINVINFPGLNTLGISLARIDYGPLGVNTPHIHPRATELLTVLEGTLYLGFVTSNPNRLFSKIVKKGDVFVFPKAMIHFQMNLAHDKPAAALSSLSSQNPGVISIANAVFGSKPPISDDVLATAFQVEKDLIHWLQSQFWGNTNY

SEQ ID NO: 137563 - protein, 249 aa, Triticum aestivum
  unsure (1)..(249): unsure at all Xaa locations
  Clone ID: PAT_TA_31981.pep
PTGVLASSSSSFLLAAPLALAAWQATAYDPTRLQDFCIADMKAPVRVNGFACKDPMAATPEDFFNAAMLXHTRDTKARKHGSNXPTNIIINISRLNNLGGLSLRTDRXALGVNTPDTHPPATDLLAVHDDRLXLSFITTQSKHTSSRSLVKDGXDVCLFIKCYRIHFEXNLTHDKPARAEQSSCSKPAKNHGVVXIANAVSVIKATRFPDDVLAPALQDEKDVIQCDPLSVLWGTPTNKYSILSGHMGS

SEQ ID NO: 137564 - protein, 223 aa, Triticum aestivum
  Clone ID: PAT_TA_31982.pep
FVNLNAVVLMTLCSVLLALRSGDAGESPDRKGYIIGFVVTLGAAGLFSAYLPVMELLYREAVSGGFILAVEVQAVMQAMASVVAAIGLAATGGFANDVAHWKGSHAVYWVVVATLVVTWQACFMGTAGVIYLTSSLHSGVCMAAVLTANVIGGVVVFGDPFGAEKAVATALCVWGLSSYLYGEYIKIKKKADDDQDEDTTLSGARDDGESVHKSLTAAAVDTV

SEQ ID NO: 137565 - protein, 346 aa, Triticum aestivum
  unsure (1)..(346): unsure at all Xaa locations
  Clone ID: PAT_TA_31983.pep
MSAAACVSFCPSPASSRHGGPIVDLAGLPPATEAEERGAQRDLLEFGVNGTIGANSDSDEDAAAAEIDDEEEHSVRRPRAVVQKFMCERKAVGDGFALRRSIGRPELQSLDPFISLDEFEFSRPAGFSDHPHRGFENVTYMLEGGLSYHDFSGHKGTINTGDVQWMTAGRGVVHAEMPGGEGVQRGLNLWLNLSSKDKMVAPRYQELRSRDVPTAEKDGVSIKVIAGEALGARSPIQTRTPAMWLDVTMRPGARLRQPVPAGWSACAYVIDGEASFGQPGDEAAGAHHCVVFGGDGDGVDVRSEGAGTRFLLLAARXPPGAGPLGGPFVPDPRXXXQXXXXDYLNR

SEQ ID NO: 137566 - protein, 712 aa, Triticum aestivum
  Clone ID: PAT_TA_31984.pep
LSLRSASASLSSLPSNLRLLFSHLSLLSSHLSAPRAHLALSSSSLSSLLATADLLLHSHRLVRLSSRLLASSPAPDLARQAELHREIRLLYEEKNLSGINAVDEEMRKVDAAASKLRSEASAVIDRGITESNQNDIWCGLQVYYNLGELKPAVEGLVGKCKAAGAKSVTVALDMKAISMAGGGGGPGGVQRSGTPQLGGSKRAADALWERMRQCMEELHRAVIAAWQLQTVLTKKRVPFTQMLFLEEVWQEGEPLLTERVWDAIVKAFARHLESVFTASSFVKEIFTLGYPRLFSMIENLLERISRDTDVKGTLPALTPEGKDHMVAAIEIFQTAFLALSQSRLSDYINSIFPMSNRGSIPSKDQISRLISRIQEEIEVVRTHGHLLLLVLREIGKILLLLAQRAEYQISTGPEARQVTGTVTPAQLKNFALCLHLHEVHTRISSILSTLPNVASEVLSPSLGVIYGVACDSVTSLFQAMLDRLESCILQMHEQDFGADGMDGAMDNNASAYMEELQKCAVHFRNEFLSKLLPSSASRSETICTIMVRRMASRILIFFIRHASLVRPLSEAGKLRMARDMAELELAVGQNLFPVEQLGSPYRALRAFRPVLFLETSQLDKSPLLQDLPPSVILHHLYSRGPDELHSPLQRNKLTPLQYSLWLDSQGEDQIWKGVKATLDDYEMKVRSRGDKEFSPVYPLMCQIGSALSQATP

SEQ ID NO: 137567 - protein, 157 aa, Triticum aestivum
  Clone ID: PAT_TA_31985.pep
PRVRGRVGKRRASEAAQAQQMPAVPPEADEVSVEFCCTGDTDDDNRRLYMKASVSCDDRPDLVAGFIQALHGLRLRTVRAEVTSLGGRVRHVFTLCKEEEEEGSAAAGRAGLNSLKEAVRHALSKVASPELVCGGSPFQFQSKRQRILESHYSIMSI

SEQ ID NO: 137568 - protein, 278 aa, Triticum aestivum
  Clone ID: PAT_TA_31986.pep
MAAPCQSPQGGNELMAYDACYPTVSRGPAPLPRQASSAPPAGPPELSTTSSSTTGSGRTATEARALKVHSEAERRRRVRINAHLTALRRMIPDTKQMDKAALLARVVDQVKHLKRRAAEAAQQTPAVPPETDEVSIEFCAGDNDSRLYMKASVSCDDRPDLVAGLIQALHGLRLTAVSPEVSALAARVRHVCALSQRVAPPGSAAPGLAAPASPVGAARLALAWGASPALLPRATRSPFQSQTRGTRMAAQLTPAVPPETDEVSIEYCNMNLCVCVCV

SEQ ID NO: 137569 - protein, 240 aa, Triticum aestivum
  unsure (1)..(240): unsure at all Xaa locations
  Clone ID: PAT_TA_31987.pep
KGRVEQSDAVEIKNFYQQYYKMYIQALQNAADKAERDQLTKAYXTTAVLFEVLKAVDQTKCWFHLPAGDXLHIFKTHNHVDPDSSIMRCPKIHATYHTLRDTRGLPWPKDHGKKEDADLLDWPHAMFGFQKNNVSNQREHLILLIGSIHIRQISKHEQHPKLDDHVLDTTMNKLFKNYKRWCKHLGRKTSLWLPAIQQEVQQRKLLYMGLYLLIWGEAANLWFMPECLCYLYHHVMIVFF

SEQ ID NO: 137570 - protein, 218 aa, Triticum aestivum
  Clone ID: PAT_TA_31988.pep
MKIFSWMANKISGKQEASRFPASSSGPSRSNVPDCRNDEFSDWPQSLLAIGTFGNKQIEEVAQVQDTSEDGQSMQDAIKFTEEEVDRIQKEFAMILASKDQAEAHDSHDDEQVTSHKEVDESINEKHRDQLLNKMVVISKAKDSLGKKASTLKPRSVASLFKLLMRKGGFASAIPDPRSLSLNQEWKTAQGNTQKKIHPQNLRPRTETLDWNRMTRNE

SEQ ID NO: 137571 - protein, 142 aa, Triticum aestivum
  Clone ID: PAT_TA_31989.pep
SVYIFLVQVETYIGVQNKTCVVITLSWIHKEKECHVEYSSSLTTKQIIRTYVDYQECLLGSLVRARHPAWTEKKSTYERSPVLRTQENGWPSPVLSPSPQPAPSPPLTHARRPADSQDCAPALIPTAPACCCTYGRGPRASS

SEQ ID NO: 137572 - protein, 122 aa, Triticum aestivum
  Clone ID: PAT_TA_31990.pep
ETPKLCLMLWTPEGIVKGQGIIPHGGEAAADVLVVVQLLPDLAKSASGPVLGSSLHLALIILFTLITFPTPCQMCTGPVTEGSNLSRQIRLGCHAASGAARPADKLLSGVLHPMNKFSETHG

SEQ ID NO: 137573 - protein, 97 aa, Triticum aestivum
  unsure (1)..(97): unsure at all Xaa locations
  Clone ID: PAT_TA_31991.pep
MKDAGLLEAKTDRRGRSTMTALMGVEECTKTLRSTAEELVSRSXLLPLLHHNRILICFDRFKPSVTGRVHIWKGVGKVISVNKMVRAGCKVKILIVD

SEQ ID NO: 137574 - protein, 97 aa, Triticum aestivum
  Clone ID: PAT_TA_31992.pep
MTVTAPAILVSYAPIKLAAACAFILCGLWLVTCAHCSGVLRSCLYQDFHICQTNSVTETFIQASAALVLFLHTYHPELLHLVMPKSLCPRMCGGASP

SEQ ID NO: 137575 - protein, 80 aa, Triticum aestivum
  Clone ID: PAT_TA_31993.pep
MSVKMRTTCTWTERPYEALLFPGIGFGPFLRSLGGRRKKAPFPGGPRTISEIPLWKSSDSNLVSDPRAKGQSQVDSFYGA

SEQ ID NO: 137576 - protein, 238 aa, Triticum aestivum
  Clone ID: PAT_TA_31994.pep
KIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTENPKRKGLKEQMTPLSVFEEQLWTFAFCTWPSFVLLLKRVPFFFVFESA

SEQ ID NO: 137577 - protein, 178 aa, Triticum aestivum
  unsure (1)..(178): unsure at all Xaa locations
  Clone ID: PAT_TA_31995.pep
LAKKIWCFGPETTGPNMVVDMCKGVQYLNEIKDSVVAGFQWASKEGALAEENMRGICFEVCDVVLHADAIHRGGGQVIPTARRVIYASQLTAKPEAXWEPVYLVGDQAPENALGGIYGVLNXKRGHVIXKEMQRPGTRSNQFPPVPWLRVQLGPPCVTPGIWLRFWGCCHGKRRKKAF

SEQ ID NO: 137578 - protein, 311 aa, Triticum aestivum
  Clone ID: PAT_TA_31996.pep
MVKFTVEGLRIIMDKQNNIRNMSVIAHVDHGKSTLTDSLVAAAGIIAQEVAGDVRMTDTRADEAERGITIKSTGISLFYEMTDESLRAYKGERDGNEYLINLIDSPGHVDFSSEVTAALRITDGALVVVDCIEGVCVQTETVLRQALGERIRPVLTVNKMDRCFLELQVDGEEAYQTFSRVIENANVIMATYEDAKLGDVQVYPEKGTVAFSAGLHGWAFTLTNFAKMYASKFGVDETKMMERLWGENFFDTATKKWTNKNTGSPTCKRGFVQFCYDPIKQIINTCMNDQKDKLWPMLQKLGVTMKADEKE

SEQ ID NO: 137579 - protein, 201 aa, Triticum aestivum
  Clone ID: PAT_TA_31997.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQ

SEQ ID NO: 137580 - protein, 203 aa, Triticum aestivum
  Clone ID: PAT_TA_31998.pep
MDSDYGVPRELSEVQQKRTLYQPELPPCLQGTTVRVEYGDVAIAADPAGAHVISHAYPHTYGQPLAHFLRKAANVPDAKVISEHPAVRVGIVFCGRQSPGGHNVIWGLHEAIKAHNVNSKLIGFLGGTDGLLAQKTLEITNEVLSSYKNQGGYDMLGRTKDQIRTTEQVNGAMATCHALKLDALVIIGGVTSNTDAAQLAETF

SEQ ID NO: 137581 - protein, 249 aa, Triticum aestivum
  Clone ID: PAT_TA_31999.pep
MAESNSYEEQRRRQIEENRRRPPPGPSPTPNRSVSSSPFFFLASGLPSPFSPVCMTGPLLPCRRSRRPRSPASSDGPAASPASRSSPATSRAQGSATTVECTRHTLFGKGPTEEERAGAIAKAEELQRRIHRIRCPAFVKPITHACASRANFMTIPKQSTEYLPAHDEPVVVVDEADDESHMMYNASRQGRHCYLSKGWREFAVDYDLENGDCLVFQLIESAKFKVYIFRASPDYESDETSDDSEDEQK

SEQ ID NO: 137582 - protein, 243 aa, Triticum aestivum
  Clone ID: PAT_TA_32000.pep
AIDEGRIGPRDDPKVRSQILSQEFGWDKDLAKKIWCFGPETTGPNMVVDMCKGVQYLNEIKDSVVAGFQWASKEGALAEENMRGICFEVCDVVLHADAIHRGGGQVIPTARRVIYASQLTAKPRLLEPVYLVEIQAPENALGGIYGVLNQKRGHVFEEMQRPGTPLYNIKAFLPVIESFGFSSQLRAATSGQAFPQCVFDHWDMMGSDPLEAGSQAAQLVLDIRKRKGLKEQMTPLSEFEDKL

SEQ ID NO: 137583 - protein, 200 aa, Triticum aestivum
  Clone ID: PAT_TA_32001.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDFLLGDV

SEQ ID NO: 137584 - protein, 232 aa, Triticum aestivum
  Clone ID: PAT_TA_32002.pep
TVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFGPCQKKDLYVKNVPRSVIWMGKN

SEQ ID NO: 137585 - protein, 212 aa, Triticum aestivum
  unsure (1)..(212): unsure at all Xaa locations
  Clone ID: PAT_TA_32003.pep
MKQVLKGKGTQKEKKXNAICHFFCYQARGAMPSKFDCDYAYXVLGHVCYHILAAGLNGYMATVTNLKSPLNKWRCGAAPISSMMTVKGWSRGPATTQIGKPAVHMASVDLRGKAYEMLRQNSSNCLLEDIYRNPGPLQFEGPGADAKPISLCVEDQDYMGRIKKLQEYLEKVKSIVKPGCSQDVLKAALSAMSSVTETLAIMTSSSTGQPPL

SEQ ID NO: 137586 - protein, 185 aa, Triticum aestivum
  Clone ID: PAT_TA_32004.pep
ARGAMPSKFDCDYAYVLGHVCYHILAAGLNGYMATVTNLKSPLNKWRCGAAPISSMMTVKRWSRGPATTQIGKPAVHMASVDLRGKAYEMLRQNSSSCLLEDIYRNPGPLQFEGPGADAKPISLCVEDQDYMGRIKKLQEYLEKVKSIVKPGCSQDVLKAALSAMSSVTETLAIMTSSSTGQPPL

SEQ ID NO: 137587 - protein, 624 aa, Triticum aestivum
  unsure (1)..(624): unsure at all Xaa locations
  Clone ID: PAT_TA_32005.pep
MGNEMSPLQKHRAEYRPELPPWLQGTAVKVEYGDAAIAADGADAHVIRRAFPHTYGQRLAHFLPKTANAPDATVITEHPAVRVGVVFSGRQSPGGHNVVWGLYNAINSHNPSSELIGFLGGTDGLFAQKTLEITEEVFSSYKNQGGYYMLGRTRDQIRTTEQVKAAMTTCQALKLDALVIIGGVTSNTDAAQLAETFAESKCSTKVVGVPVTLNGDLKNQFVETTVGFDTICKXNSQLISNVCTDALSAEKYYYFIRLMGRKASHVALECALQSHPNMVLLGEEVAASKLTISDITKQICDAVQARAEKDKYHGVVLIPEGLVESIPELYALLQEIHGLHDKGVSIENISSHLSPWASALFDFLPPFIRKQLLLHPESDDSAQLSQIETEKLLAQLVEAEMNKRLKEGTYKGKKFNAICHFFGYQARGALPSKFDCDYAYVLGHVCYHILAAGLNGYMATVTNLRSPVNKWKCGAAPITSMMTVKRWSRGPAASQIGKPAVHMASVDLKGKAYDVLRQNSXAFLLEDVYRNPGPLQFEGPXGADSKPISLCVEDQXDYMGRIKKLQEYLEKVKRIVKPGCSQDVLKAAXLSAMSSVTGNTEHHDFIFYRPDSTESLGTISWYGS

SEQ ID NO: 137588 - protein, 408 aa, Triticum aestivum
  Clone ID: PAT_TA_32006.pep
MGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQMTPLSDFEDKL

SEQ ID NO: 137589 - protein, 453 aa, Triticum aestivum
  unsure (1)..(453): unsure at all Xaa locations
  Clone ID: PAT_TA_32007.pep
IYANAIXNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLXAKSDPMVLCTIEESGEHIIAGAGELHLEICLKDLQDDFMGGAEIIVSPPVVSFRETVLEKSCRTVMSKSPNKHNRLYMEARPLEEGIXEAIDDGRIGPXRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVXEIQAPEXNALGGIYGVXLNQEEKERVFRRCKRLVPRLYNIKXYLPGHRXFGSQSTSRAATSGQVSPSVCSTINHSPDPF

SEQ ID NO: 137590 - protein, 306 aa, Triticum aestivum
  Clone ID: PAT_TA_32008.pep
LEICLKDLQEDFMGGAEIIVSPPVVSFRETVLEKSCRTVMSKSPNKHNRLYMEARPLEEGLAGAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQMTPLSDFEDKL

SEQ ID NO: 137591 - protein, 674 aa, Triticum aestivum
  unsure (1)..(674): unsure at all Xaa locations
  Clone ID: PAT_TA_32009.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDESKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKFCRTVMSKSPNKHNRLYMEPRPLEEGLAEAFDXDGRIGPCDDPKVRSRILXEEVGWDRDLGQKIWCFGPETTGPNMVVDMXRECRFLNEITGLLCGLGFPWAF

SEQ ID NO: 137592 - protein, 331 aa, Triticum aestivum
  unsure (1)..(331): unsure at all Xaa locations
  Clone ID: PAT_TA_32010.pep
DPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKXAYLPVIESFGFSSTLRXAATSGQAFPQCVFDHWDIMASDPLDPGTQSATLVTEIRKRKGLKEQMTPLSDFEDKL

SEQ ID NO: 137593 - protein, 432 aa, Triticum aestivum
  Clone ID: PAT_TA_32011.pep
RCGLPAPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTEIRKRKGLKEQMTPLSDFEDKL

SEQ ID NO: 137594 - protein, 617 aa, Triticum aestivum
  unsure (1)..(617): unsure at all Xaa locations
  Clone ID: PAT_TA_32012.pep
MDSDYGVPRELSEVQQNRTLYQPELPPCLQGTTVRVEYGDVAIAADPAGAHVISHAYPHTYGQPLAHFLRKAANVPDAKVISEHPAVRVGIVFCGRQSPGGHNVIWGLHEAIKAHNVNSKLIGFLGGTDGLLAQKTLEITNEVLSSYKNQGGYDMLGRTKDQIRTTEQVNGAMATCQALKLDALVIIGGVTSNTDAAQLAETFAEAKCATKVVGVPVTLNGDLKNQFVETTVGFDTICKVNSQLISNMCTDALSAEKYYYFIRMMGRKASHVALECALQSHPNMVILGEEVAASKLTIFDITKQICDAVQARAEKDKNHGVILIPEGLVESIPELYALLQEINGLHGKGVSVENISSQLSPWASALFEFLPQFIRQQLLLRPESDDSAQLSQIETEKLLAQLVETEMNKRLKEGTYKGKKFNAICHFFGYQARGAMPSKFDCDYAYVLGHVCYHILAAGLNGYMATVTNLKSPLNKWRCGAAPISSMMTVKGWSRGPATTQIGKPAVHMAXVDLRGKAYEMLRQNSSSCLLEDIYRNPGXPLQFEGPGADAKPISLCVEDQDYMGRIKKLQEYLEKVKSIVKPGCSQDVLKAALSAMSSVTETLAIMTSSSTGQPPL

SEQ ID NO: 137595 - protein, 844 aa, Triticum aestivum
  unsure (1)..(844): unsure at all Xaa locations
  Clone ID: PAT_TA_32013.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESXFGFSSTLRAATSGQAFPQCVFDHWDIMASDPLDPGTQSATLVTEIRKRKGLKEQMTPLSDFEDKL

SEQ ID NO: 137596 - protein, 843 aa, Triticum aestivum
  Clone ID: PAT_TA_32014.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQFEGEEAYQTFSRVIENANVIMATYEDVLLGDVQVYPEKGTVAFSAGLHGWAFTLTNFAKMYASKFGVDEVKMMERLWGENFFDPATKKWTTKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDVYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALCEENMRGICYEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDVMASDPLDPGTQSATLVTEIRKRKGLKEQMTPLSDFEDKL

SEQ ID NO: 137597 - protein, 843 aa, Triticum aestivum
  Clone ID: PAT_TA_32015.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTDIRKRKGLKEQMTPLSDFEDKL

SEQ ID NO: 137598 - protein, 844 aa, Triticum aestivum
  unsure (1)..(844): unsure at all Xaa locations
  Clone ID: PAT_TA_32016.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPEGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRXKGLKEQMTPLSDFEDKL

SEQ ID NO: 137599 - protein, 843 aa, Triticum aestivum
  Clone ID: PAT_TA_32017.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVCVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQMTPLSDFEDKL

SEQ ID NO: 137600 - protein, 843 aa, Triticum aestivum
  Clone ID: PAT_TA_32018.pep
MVKFTAEELRGIMDKKNNIRNMSVIAHVDHGKSTLTDSLVAAAGIIAQEVAGDVRMTDTRADEAERGITIKSTGISLFYQMTPESLEMYKGDRDGDEYLINLIDSPGHVDFSSEVTAALRITDGALVVVDCIEGVWVQTETVLRQALGERIRPVLTVNKMDRCFLELQVEGEEAYQTFSRVIENANVIMATYEDVLLGDVQVYPEKGTVAFSAGLHGWAFTLTNFAKMYASKFGVDEAKMMERLWGENFFDPATKKWTSKNTGTATCKRGFVQFCYEPIKQIIATCMNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCTIEESGEHIIAGAGELHLEICLKDLQDDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRQGTPLYNIKAYLPVIESFGFSSTLRAATSGQAFPQCVFDHWDIMASDPLDPGTQSATLVTDIRKRKGLKEQMTPLSDFEDKL

SEQ ID NO: 137601 - protein, 557 aa, Triticum aestivum
  Clone ID: PAT_TA_32019.pep
MNDQKDKLWPMLKKLGVTMKNDEKDLMGKALMKRVMQTWLPASRALLEMMIFHLPSPSKAQRYRVENLYEGPLDDIYANAIRNCDPDGPLMLYVSKMIPASDKGRFFAFGRVFAGRVATGMKVRIMGPNFVPGQKKDLYVKSVQRTVIWMGKKQESVEDVPCGNTVALVGLDQFITKNATLTNEKEVDACPIRAMKFSVSPVVRVAVQCKVASDLPKLVEGLKRLAKSDPMVLCSIEESGEHIIAGAGELHLEICLKDLQEDFMGGAEIIVSPPVVSFRETVLEKSCRTVMSKSPNKHNRLYMEARPLEEGLAEAIDDGRIGPRDDPKVRSKILSEEFGWDKDLAKKIWCFGPETTGPNMVVDMCKGVQYLNEIKDSVVAGFQWASKEGALAEENMRGICFEVCDVVLHTDAIHRGGGQVIPTARRVIYASQLTAKPRLLEPVYLVEIQAPENALGGIYGVLNQKRGHVFEEMQRPGTPLYNIKAYLPVIESFGFSSTLRAATSGQAFPQCVFDHWDIMSSDPLEAGSQSATLVTEIRKRKGLKEQMTPLSDFEDKL

SEQ ID NO: 137602 - protein, 273 aa, Triticum aestivum
  Clone ID: PAT_TA_32020.pep
AWSRPRYDKSFSMNQARSIRMNVTTGAARPNPQGSFHYGEINVTQVYKLRNMPPVTINGKRRTTLNGISYSPPATPLRLADLYDKKEVYTLDFPTMPSDGPPAIGSSVINSTYKHFLAIVFQNNDTKVQTYHIDGYPFWVVGMDYGERTNESRSTYNKWDGVSRCTTQVFPGAWTAVLLSLDSPGFWNVRTENLDTWYLGQETYIRVVDPDGGYNVTESVLPDNALFCGLLREKQKAQKPHGSTSSSASPALKQSGYLLAVLVSLVVFSVIGH

SEQ ID NO: 137603 - protein, 109 aa, Triticum aestivum
  Clone ID: PAT_TA_32021.pep
FQQRFDYRKSSRARKLVTCTHTSAARSVLFQRITEQAAVVEKSTKWSWSNQCCREHHLNSRRNQPTISETRFYYLLPCTHANQTSIQTAARLSCSSPMQRCRDHLPQLR

SEQ ID NO: 137604 - protein, 58 aa, Triticum aestivum
  Clone ID: PAT_TA_32022.pep
KSGSLPWDEFSKLIRSVHANRMGSASRRTVIPDKPKEEDYFYANPQECLRDPDLLRAS

SEQ ID NO: 137605 - protein, 105 aa, Triticum aestivum
  Clone ID: PAT_TA_32023.pep
EKWSKVGFKIEVNDDESFFSCECGTFEHSGLVCCHALQVMVLVRLSKIPEKHIMKRRTRDARDVLPAHLVRYQRDRGPPSSDTFRHHTMYMKALECVLLGDSNVK

SEQ ID NO: 137606 - protein, 116 aa, Triticum aestivum
  Clone ID: PAT_TA_32024.pep
ALTASSSSAPRLGACMRRPVRACGGELRRYGPRYMYISLSLSLSLFSRHLLTSYCSSSENILPSSCFVCGSSFFFRLYPEAVSDAFLAWRSSFVMLGTSMCLVNVLLSLECIGYTL

SEQ ID NO: 137607 - protein, 118 aa, Triticum aestivum
  Clone ID: PAT_TA_32025.pep
IYNQYIQVRLFAREFHSLESLSLLLPTRYLKKMPETYFKKYNSALRLLLQRWNLCCGSYASKCVDPYRLTEVNFFLSISIGLLTAYLFFSNFNSLIFASAHLHITQKVLSAMHHAVIP

SEQ ID NO: 137608 - protein, 235 aa, Triticum aestivum
  Clone ID: PAT_TA_32026.pep
MLFNLLFLCSAVLAHHHSADDSNEWHGPSKWDRRSPCPMVNSLANHGYLPRDGLNITLDDLIEGFTDAINLDPAATTLVGKKALDTGDGTSFNLDDLAKPGILEHDGSLSRDDIYFGDNSRLDPHIWKSTLQHFRAPYISIQEAADARKDRLQVAAANNPEFSMTAEQNKISLIETSLYLTVFGNPEEGNANTHWVRTLFEKEMIPFTEGFQRSENPITVAQILGMVNKVAQASA

SEQ ID NO: 137609 - protein, 55 aa, Triticum aestivum
  Clone ID: PAT_TA_32027.pep
EAPCGGGPSNTSDNFPDARAVFQQSEPTTYINAPLLGLLAYFSAHPNLPQSDGTD

SEQ ID NO: 137610 - protein, 91 aa, Triticum aestivum
  unsure (1)..(91): unsure at all Xaa locations
  Clone ID: PAT_TA_32028.pep
KKYSLQGKVEPPREFSTDHGLIDVDYRDLVCVVLFNHTETDFTVKPGDRVIXMIVQVIAALEVTEVEDLDATVLSRRGGGPRRHCLEAGQV

SEQ ID NO: 137611 - protein, 138 aa, Triticum aestivum
  Clone ID: PAT_TA_32029.pep
SHASGPSRKYSSHDLAAHTSLKPSDYLFKLLLIRDSGVGRSCLLLRFLQVIDEDYCGPMGVVLFNYSEADFTMKPRDRVVEIIVQVIATQEVPGVEDLDATVRRSSSWRTTPPSGVPQGGGPRRFVHTSREVVWLGWW

SEQ ID NO: 137612 - protein, 139 aa, Triticum aestivum
  Clone ID: PAT_TA_32030.pep
KKCSLQGKVEQPSEFSTDHEVIDADYRDSVGVVLFNNSEADFAVKPGDRVTQMILHVIAMPEVAEVEDLDVTVWRSSRWRTSTPPSRGCRGGGPRRHRLEVAKVKDLNALVDTSREVVLLGWWWNTREGTHLSVTVVCV

SEQ ID NO: 137613 - protein, 149 aa, Triticum aestivum
  Clone ID: PAT_TA_32031.pep
MGMEMITNVSEYERLAKEKLPKMVYDYYASGAEDQWTLNENREAFSRILFRPRVLIDVTHINMATNILGFDVSMPIMIAPTAMQKMAHPEGELATATAAASAGTIMTLSSWATSSVERVNSVGPGIRFFQLYVYKDRNIVRQLVKRAEM

SEQ ID NO: 137614 - protein, 349 aa, Triticum aestivum
  unsure (1)..(349): unsure at all Xaa locations
  Clone ID: PAT_TA_32032.pep
NETSRKWRKSSKVYAKIFTSIAILDKAVRGSRPPSKALKTPVMDMVVEDPDSELLVYITGXLKEYGMEEKNITSATPCKAPMKFACWRSXPDFGELDKGGGIRHREKEQMKSKKMTDXQILSFAEQSGELXVPGLIALALDDFKVSRQFTRPVDLSXNEIDAAGDGDVLVILXLSADQSLIEAEVSRGDVNGIQKLRKPAYLEPTDLIDVYYESVDNSNTLEEILQSQDQYIRDVLGNSLVPKAAATSDMVVICEESHTVHDMSFVIYIARCMPVLAADLLSYASGNSDHVEALRVYLLSRSISRLKNEFQTGNGKITVRCIEGYPPIDLQLGKHVFLSAGDFYQANRS

SEQ ID NO: 137615 - protein, 111 aa, Triticum aestivum
  Clone ID: PAT_TA_32033.pep
QPVNGSWPRCLCGRFRKDSDRPFSMYIELMWYISLSISHNARKPPWGSSSVRRYQLHLCCSAAFLRTRKGYRREPLPFGSTVAGSDGDISSPQELRVRRGLGSDDSCVTIL

SEQ ID NO: 137616 - protein, 87 aa, Triticum aestivum
  Clone ID: PAT_TA_32034.pep
EQYSEFLAMAAADLAKKGVSPDCAQEMITKKRRRDEQSSMLGAADVLAAHAQQQITDVDSVLLKHARKMWTTSAEQTQSQTRLIGRG

SEQ ID NO: 137617 - protein, 327 aa, Triticum aestivum
  unsure (1)..(327): unsure at all Xaa locations
  Clone ID: PAT_TA_32035.pep
GGRPRPRARPPAARGRSRTCGRASARAARPPRRRRGRRREEQGVGEGLEARCLDNRGVGRSTVPPHGSYYSTSMVARDALALMDHLGWKQHAGCGRSPRAVLAGVPPPLPPRRRASPPGRCAAAGARAXSPRARTPEQRALVDLETHYTKEYLDEEVESCTRRAILYKEYVKGISSSGIQSNCGFEGQINACWTHKVTTXSIDPMRAAGFLVSVIHGRHDIXAQVCHARRRPHRLPPVARAGGLPRALLPAARMVDLHGAHLVSHERPEEVNNALMDLIKATKYAMAPQEWSSQPENTSGLIVMAFEHVRNIVRVTKPVRVVAIQSS

SEQ ID NO: 137618 - protein, 80 aa, Triticum aestivum
  Clone ID: PAT_TA_32036.pep
MKVLTDSLFMQHSSFIPECEDNLKPQMGMTFEGLKAAEEFYKSYSHHSGFGVRIGQQKKLENEVIHNKSYCTCLVMIPTR

SEQ ID NO: 137619 - protein, 85 aa, Triticum aestivum
  Clone ID: PAT_TA_32037.pep
GRATSAVPRAKWVDVRSVPRSRSLLQTRPRLETRARGWLLANDESSMEETSVALVFENYRVLPYVYHPIWHLIIQKISCNDSVTK

SEQ ID NO: 137620 - protein, 138 aa, Triticum aestivum
  Clone ID: PAT_TA_32038.pep
GVATLPPPPEPLPGHHSLPSHPGITVPASRGLSSPVGIARIQRDDVVSVHEEADQDRDRDRSSGFLHPARWRVRLEDTRTPGHRREGLLYSYSPLRWTTVTDLEGDILAGRHLDDGEQLVEDYLPSHCVDPYVVATHS

SEQ ID NO: 137621 - protein, 133 aa, Triticum aestivum
  Clone ID: PAT_TA_32039.pep
EVAHDLSFIGVPWKVIPFSHWLNSKSKWVAGILSGRIKLPSKDEMPTRPKAIYSRLETRGWPKRYTHNFSGGYQFEYDDWLAEQCGHPPVEEWRKLMYAANAKNKAARPERYRDEWDDDGLVALANEDFKKYF

SEQ ID NO: 137622 - protein, 151 aa, Triticum aestivum
  Clone ID: PAT_TA_32040.pep
MDGEWSDGAVSGGEQKASGDGVSADCNSPGSPSPPAVPSTSGRRRSLHNPVVTVPLADLNVPRPKGVGEGNTPTDSWAWRKYGQKPIKGSPFPSRAYYRCSSSKGCPARKQVERSQADPDTVLITYSYEHNHSSTVARAQSRPTPTPKPNK

SEQ ID NO: 137623 - protein, 104 aa, Triticum aestivum
  Clone ID: PAT_TA_32041.pep
LLALYISLQSHEGTPRCWFVITSDLRCIYNNHINGRLQDDFGNVNGVNKDIGQELSYILIQTQVMIQQCSSPNSNSGEHSLAWDHARATVIVIFMPHISCFCHA

SEQ ID NO: 137624 - protein, 538 aa, Triticum aestivum
  unsure (1)..(538): unsure at all Xaa locations
  Clone ID: PAT_TA_32042.pep
MWGLGFRWLLLLLLAFAAAVELEARFVVEKNSLMVTSPTALRGRHDSAIGNFGIPQYGGSMAGAVVYPKGNSDACEAFNSGRKEHLFRTKPGALPSFLLIDRGNCLFAKKVWNAQYAGASAVLVVDDKDEPLITMDLLQEDDEAAKYIQNISIPSALIDKKFGEQLKKAVKDGEMVNVNLDWREAVPHPDNRVEYELWTNSNDECGPKCDMLMHFLKEFKGXAQLLEKGGYSQFTPHYITWYCPQAFVVSKQCKSQCINHGRYCAPDPEQDFSTGYDGKDVVVENLRQLCVFNVANEIKKPWIWWDYVTDFHIRCPMKEKKYNKKCAETVIKSLGLEVKKIDKCMGDPNDDSDHPLLKMEQDSQIGKGSRGDVTILPTLVVNNRQYRGKLGRKAVLKAICAGFEETTEPNVCLSDDMETNECLSDNGGCWQDKAANVTACRDTFRGRVCECPTFNGVQFKGDGYSNCEPAGPGKCLINHGGCXWHDTRNGKPSFAGQETGVISPGRLGLKSTSRKKHINGGIWTLQSILVKAGLTLRK

SEQ ID NO: 137625 - protein, 120 aa, Triticum aestivum
  Clone ID: PAT_TA_32043.pep
RPTRPQIDLDIFNVIQSSGSIYNADVDSSKRFLKACKVVPEMIRAARGFVKHTSFNHEKIQSFPPKSFLDAPQLAGFRSAKDLDHGAGAAAKQDFKFHSDHTTGRLLGWLRRLHQSGQNS

SEQ ID NO: 137626 - protein, 124 aa, Triticum aestivum
  Clone ID: PAT_TA_32044.pep
HANDPSSPMHHHHHHASSGRSSNSKLLLLPAPSIEIIGFHDIDRWISCSCDMRLVNASIAHDQYRGSPAGRGELGTVQGEGRLGGVYMLSCWQGELLVGEKRLGVVCICIGWGHIGTTPRKIQR

SEQ ID NO: 137627 - protein, 219 aa, Triticum aestivum
  Clone ID: PAT_TA_32045.pep
HVRARAPGRGLRPPRPPPRRRARKTEEAPDTPLDNAVMNRLKQFKAMNQFKKAALRVIAGCLSEEEIGGLREMFKSMDSDNSGTITVDELRKGLGKQGTKLTEAEVEQLMEAADADGSGTIDYDEFITATMHMNRMDREEHLYTAFQYFDKDNSGYISKEELEQALREKGLLDGRDMSEIVSEVDADDDGRIDYSEFVAMMRKGAPEGANPKKRRDVVL

SEQ ID NO: 137628 - protein, 149 aa, Triticum aestivum
  Clone ID: PAT_TA_32046.pep
ARTLREGLLRTGRFDVISKEDGVPLVAFTFRGIRDGSLAFKLSANLRRFGWIVPAYTMPANLEHMTVLRVVVREDFGRPLAERFLSHVRMALSELDLAAKGPVPKMRLTIELGPARSAKEEASVKVVKREAVSGHRSVSLVSGKTKGVC

SEQ ID NO: 137629 - protein, 77 aa, Triticum aestivum
  unsure (1)..(77): unsure at all Xaa locations
  Clone ID: PAT_TA_32047.pep
CHANMDDETNGGGAPRVRXDFVRQHQQQKAKAQRWAARGHLHLSLQRHGAMASQYHALSSPMAALLSPQSPLVHAAS

SEQ ID NO: 137630 - protein, 488 aa, Triticum aestivum
  unsure (1)..(488): unsure at all Xaa locations
  Clone ID: PAT_TA_32048.pep
MASRSAELLSRMAAGDGHGENSSYFDGWKAYDMNPFHPQDNRGGVIQMGLAENQLSLDLIEEWSKAHPEASICTAEGASQFKRIANFQDYHGLPEFRQAMAQFMGQVRGWKARFDPDRVVMSGGATGAQETLAFCLANPGEAFLVPTPYYPGFDRDCCWRSGVKLLPIECHSSNDFRITREAVVAAYESATSNGVRVKGILITNPSNPLGTTADRATLAMLATFATEHRVHLICDEIYAGSVFAKPEYVSIAEVIERDAPGADRDLIHIAYSLSKDFGLPGFRVGIVYSYNDAVVACARKMSSFGLVSSQTQLFLAKMLGDEEFMSRFLRESARRLXAARHELFTSGLREVGXIGCLGGNAGLFSWMDLRGMLREKXAEAELELWRVIIRKVKLNVSPGTSFHCGEPGWFRVCHANMDDETMGVALSRIRDFVRQHQQQKANAQRWAARGHLHLSLQRHGAMASQYHALSSPMAALLSPQSPLVHAAS

SEQ ID NO: 137631 - protein, 136 aa, Triticum aestivum
  Clone ID: PAT_TA_32049.pep
GLGVLRVIMEAVENWGRRRDYITTCRWDGRLGVRRRPSLHAGRSIVAGRCNSAFTDMTFSFFFFFKSVRACVRRRAGAAAGVVSSSMLTMCTYSVQNSRSRRGQAPCGGGDQRARVPPQRQAALLLLHLVPVAAGE

SEQ ID NO: 137632 - protein, 61 aa, Triticum aestivum
  Clone ID: PAT_TA_32050.pep
AMKINIRLVSQNIRRCRLRAFAQPGLRANAANSFLGCLSLMNNVPVLCFLLFDFFLCGCTV

SEQ ID NO: 137633 - protein, 97 aa, Triticum aestivum
  Clone ID: PAT_TA_32051.pep
FLWNNLARSDCAAVTSLRMTTLESEHPGDAFEFASLPPVQLETVEHRSVLCHYLAAQLENHSKHHYTARFPGGPLLCCWPLVSVNLCTNCISMLKLR

SEQ ID NO: 137634 - protein, 139 aa, Triticum aestivum
  Clone ID: PAT_TA_32052.pep
ERPQYGRVHGAGDGVTWKVFYNEVPEAKKQKKKFSQADINEKVKLAVEKKAAEDAKKTAEEKNELLQQAVNAAVTACRNDFATNFVPAIINWTKENPDKTVHDFPLPSFIGSNSVNNNTTAPSLAHATGRPLAVAPAHS

SEQ ID NO: 137635 - protein, 70 aa, Triticum aestivum
  unsure (1)..(70): unsure at all Xaa locations
  Clone ID: PAT_TA_32053.pep
LWFPALCRKXEVPYCIVKGKSHLGLTASVLCLTTXNEDKLEFSKISEAIKXANFNDKFYEVRKKXGGGVL

SEQ ID NO: 137636 - protein, 152 aa, Triticum aestivum
  Clone ID: PAT_TA_32054.pep
WVDGDDSTDEDDDTDSCSTPLPPPPPPGMEWEYTDPITMRPLDFLPSSLADRDDKEVASQVSMDDDWVETNIEFDGQDESVSGNADGILRRVELHPAKSRVMGDENSSMMSSWVTKDSNSSVMAWATDKSLVEIAKEIDEYFLKAAASGTDV

SEQ ID NO: 137637 - protein, 84 aa, Triticum aestivum
  unsure (1)..(84): unsure at all Xaa locations
  Clone ID: PAT_TA_32055.pep
MQDMNGECTRLVNSYTLVFLLSNSKCKRYFRNHLKPAKLIWTAMYRKQQKNXIRIFVLRPAKKRHRTTKSPSRSRLLFASGTRH

SEQ ID NO: 137638 - protein, 48 aa, Triticum aestivum
  Clone ID: PAT_TA_32056.pep
VHGPGEDDAYGDDRADYRKSEPTTYINAPLVGVLAYFVGNPNPGHIRH

SEQ ID NO: 137639 - protein, 576 aa, Triticum aestivum
  unsure (1)..(576): unsure at all Xaa locations
  Clone ID: PAT_TA_32057.pep
EKDPLNWGAAAAELTGVRLDEVKRMVAQFREPVVKIEGASLRVGQVAAVAQAKDASGVSVELDEEARPRVKASSEWILSCLAGGGDIYGVTTGFGGTSHRRTKDGPALQVELLRHLNAGIFGPGADGHSLPAEVSRAAMLVRINTLLQGYSGIRFEILEAITKLINTGVSPCLPLRGTITASGDLVPLSYIAGLITGRPNAQATTVDGKNVDAAEAFKAAGIEGGFFKLNPKEGLAIVNGTSVGSALAATVLFDCNVLAVLSEVLSAVFCEVMNGKPEFTDHLTHKLKHHPGSIEAAAIMEHILAGSAFMGHAKKVNEIDTQLKPKQDRYALRTSPQWLGPLREVIRSATKSIEREVNSVNDNPVIDVHRGKALHGGNFQGTPIGVSMDNTRLAIANIGKLMFAQFSELVNEFYNNGLTSNLAGSRNPSLDYGFKGTEIAMASYCSELQYLANPVTNHVQSAEQHNQDVNSLGLVSARKTAEAVDILKLMSSTYMVALCQAIDLRHLEENIKTSVKNCVTQVSKKVLTMNPTGDLSSARFSEKSLITXIDREAVFSYADDACSANYPLMQKLRAVL

SEQ ID NO: 137640 - protein, 498 aa, Triticum aestivum
  unsure (1)..(498): unsure at all Xaa locations
  Clone ID: PAT_TA_32058.pep
SPPATGPARGPARRAASPRGFCKLSAKAGPANANGTXAGSALAAHRCCSDCNLXAVLSEVLSAVLXEAMNGKAQSSPSHVTHKRRHQPGSVDGRGHQRRPPAPSXSREQAAPTMPPRPRRAPTACTSARENLLSPSEECTKASLGGTPDKAHEPQAKCATKNGIINVHPSQGTPMARATRGGRSRRTTASVRPNITRIXVPLFLYFSNLGSVFHFNVLASELTDIRNLFLNXGCTAMAAPQAFNYSECHYLSKASRPNHVQXSAEQHNQDVNSLGLVSARKTAEAVDILKLMSSTYMVALCQAIDLRHLEENIKTSVKNCVTQVSKKVLTMNPTGDLSSARFSEKSLITAIDREAVFSYADDACSANYPLMQKLRAVLVDHALTAGPGEAESEATVFSKINKFEEELRSALPREIEAARVAFENGTAPIPNLIKESRSFPLYRFVREELGCVYLTGEKLLSPGEECTKVFLGISQNKLIDPMLECLKEWNGEPLPINV

SEQ ID NO: 137641 - protein, 95 aa, Triticum aestivum
  Clone ID: PAT_TA_32059.pep
MARVAAVAMCALLALVVVGPPSVAAQDCDAGKLIVCAAAIIGGAEPSESCCSNLKAQQGCLCKYASNPAYSGYINSPTARKTLASCGIPIPTCPQ

SEQ ID NO: 137642 - protein, 252 aa, Triticum aestivum
  unsure (1)..(252): unsure at all Xaa locations
  Clone ID: PAT_TA_32060.pep
MAQAVEEWYRQMPIITGAYLTAAVVTTVGCSLGIISPYHLYLNPKLVVQHYGIWRLVTNFLYFRKMDLHFLFHMFFLARYCKLLEENSFRGRTADFFYMLLFGATVLTSIVLIDGTIPYISEIFVRILIMFLSNSLTFMMVYVWSKHNXFIHMXFLGLFTFTAAYLPWVLLGFSVLVGSSTWVDLLGMIAGHVYYFLXDVEPPLTGRRPLKTPSFIKALFADDNVVVAARPPNAGVAAARFGGVGAADPQFQ

SEQ ID NO: 137643 - protein, 379 aa, Triticum aestivum
  unsure (1)..(379): unsure at all Xaa locations
  Clone ID: PAT_TA_32061.pep
REKLESRFILDVTVLDGTLMSPSSPFTKIWRMHNNGSIMWPLGTQLIWVGGDQFALQTSVPLEIPLNGFPVDQEMDVAVDFAAPARPGRYISYWRLASPSGQKFGQRVWVHIQVEDPSFVSDNKTAAVNLNQPQESNITNTSGLPQESNMTNTSNLIDVNMEPANQVLDEHVNGTRMELAVPFXCREAAEPKKSPSAFSAAPPYPMVDVPSSSENAAAFVPSVTVLAPEVIPRPAVTTPADVPTSSLTSIPVDLPVAATTPVDVASAPLDIDSLTEEKLLQELEEMGFKQVDLNKEILRQNKYNLEQSVDDLCGVNEWDPLLAELNEMGFDDRETNKELLAKNGGSIKRAVMDLIAREKKDKKIVCSRAPSYLYLVIYA

SEQ ID NO: 137644 - protein, 93 aa, Triticum aestivum
  Clone ID: PAT_TA_32062.pep
AAVAVGLFRLLELSNATEPTVLDKLCAALNINKKSVDRDLDVYRNLLSKLVQAKELLKEYIEREKKKREERLETPKPNEAVAKFDGSAYPLKH

SEQ ID NO: 137645 - protein, 245 aa, Triticum aestivum
  Clone ID: PAT_TA_32063.pep
MAAISSLPFATAGDIPPTVADTKMNFLKSYKRPIPSIYSTVLQELLVQQHLMRYKSTYQYDPVFALGFVTVYDQLMEGYPSTEDRDAIFKSYVTALNEDPEQYRADAQRMEEWARSQNGNLLVEFSSRDGEIESILKDISERAQGKGNFSYSRFFAVGLFRLLELSNATEPTVLDKLCAALNINKKSVDRDLDVYRNLLSKLVQAKELLKEYIEREKKKREERLETPKPNEAVAKFDGSAYPLKH

SEQ ID NO: 137646 - protein, 329 aa, Triticum aestivum
  unsure (1)..(329): unsure at all Xaa locations
  Clone ID: PAT_TA_32064.pep
MKSKREKLESRFILDVTVLDGTLMSPSSPFTKIWRMHNNGSIMWPLGTQLIWVGGDQFALQTSVPLEIPLNGFPVDQEMDVAVDFVAPARPGRYISYWRLASPSGQKFGQRVWVHIQVEDPSFVSDNKTAAVNLNQPQESNVTNTSSLPQESNMTNTSNLIDVNIEPANQVLDEHVNGTRMELLEPLIYPRVXRTRPSLPGRAIAPPRPSPGPVTFPLALPGGVAPSAAVSPSAPLDIDSLTEEKLLQELEEMGFKQVDLNKEILRQNKYNLEQSVDDLCGVNEWDPLLAELNEMGFDDRETNKELLAKNGGSIKRAVMDLIAREKKDK

SEQ ID NO: 137647 - protein, 170 aa, Triticum aestivum
  Clone ID: PAT_TA_32065.pep
MSGLSAPPFDGLASGPDPWDVVVKVKYGDTLKRFNGYVNGTHFTLNLSALRSKIASAFKLAPDADFILTYTDEDGDVVMLDDDEDLHDAAIHQKLNPLRINVQLKNSHAGASHINRQDSSPKPLGATTQDPLAQIKSVIDEALKPISEPLRSTAREDPLAHLKSAHAMKL

SEQ ID NO: 137648 - protein, 409 aa, Triticum aestivum
  Clone ID: PAT_TA_32066.pep
MAAYLSMGEAHRRIADYLSRLDDAISQSDGADLASLLAISSAPASTPLSDALAAFPDFRRLAADRFPHLSDFLPPLLRAIHSHSLRRFGDAYSSFEKAASAFLQEFRNWETPWAMEAMHMVALEIRLLAEKADRELVMSGKNPDKLQAAGSFLMKVFGALAVKGPKRVGALYVTCQLFKIYFRLGTVNLCRSVIRSIETARNFDFEDFPVKDKVTYMYYTGRLEVFNENFLVADQKLTYALMHCNPQSESNLRKILKFLIPVKLSIGVLPRRTLLEKYNLLEYADIVTSLRRGDLRLLKQALDRHEDQLLKCGVYLVLEKLELQVYRRLVKKIHIIQREKEPSKAHQIKLEVLVKTLQWLGITMDVDEVECIMACLIYKNLIKGYFAHKSKVLVLSKQDPFPKLNGKPV

SEQ ID NO: 137649 - protein, 412 aa, Triticum aestivum
  unsure (1)..(412): unsure at all Xaa locations
  Clone ID: PAT_TA_32067.pep
MVKRELLARCMTCPLCNRLLRDATTVSECLHTFCRKCIYKKFNDEEVESCPVCDIDLGCTPVEKLRADHSLQDVRSKIFPFKRKKIKAEDVASPDSPPNKRKERSISSLVVHTPRLTPTGSTGRRTKVVTRKAAAALHSLGPTVDNPVKKENSDKSAHSSSLPANLGKVPKTKRQILSNAEEASNYSSNKDTEDDSKDMADNAELWRPLNCLXVEAANRTKSFRPSLQGSGYHKWHPKQTQKSIPKRPKTEDDKKDAPVPPVTLKRKLLGTGPRRTALRPPADGDPDGASXQNEKRCICIWFSLVASLEQKGDSPLPQIPSHYLRIKDANIPASSIQKYLVQKLSLPSESEVEINCCGQPVNPTQPLRNLVELWLRGRSAQATQAIVGSPAEEFVMVLNYGRPKPMEPLSAQ

SEQ ID NO: 137650 - protein, 285 aa, Triticum aestivum
  unsure (1)..(285): unsure at all Xaa locations
  Clone ID: PAT_TA_32068.pep
MAVAVAAGTLRTCSGVFPAASGNHPLAGWRPLAPAAPAKLRLLSPALRVPRAASPAAVENGSSSNSNTVPTPKVIIDQDSDPDATIVEVTLGDRLGDLLDTMSALRNLGLNVVKASVCLDSSGKHNKFAITKSSTGRKIDDPELLEAVRLTIINNMLEYHPEASSQLAMGATFGLEPPTEVXLRSLLTVDVDIATHIEIYDDGPERSLLVVESADRPGLLVDLVKIIADINITVQSGEFDTEGLLAKAKFHVSYRGKPLIKALQQVLANSLRYFLRRPTTEDASF

SEQ ID NO: 137651 - protein, 245 aa, Triticum aestivum
  Clone ID: PAT_TA_32069.pep
EDDAWSLFEANAGEEAIRGDAQISTLARQVAAECNGMPLFLATVGRAMSNKRTAEEWSDALDKLKKPQLTSSAPGHDKSAHPLVKFCFDSLESDTVRECLLTCALWPEDHNISKDELVQCWIGLGLLPKYDDVDESLRFGHTVVSILESARLLEQGDNHRHNMCPSDTHVRLHDVVRDAALQLAPGKWLVRAGVGLREPPRDEALWRDTERVSLMHNAIEEAPAKAGGALSDAQPASLMLQCNRA

SEQ ID NO: 137652 - protein, 173 aa, Triticum aestivum
  Clone ID: PAT_TA_32070.pep
MAAATRALLVAAVIAAALFGTALGATYTVGAPAGSWDLRTNYTRWTSTIRFYAGDELRFQYPAAAHNVVEVTKTAYDNCSSSSPVATFPSGNDVIPLAAVGTRYFICGLPGHCAGGMKVQVNVRSKVVRCRGRGARQRCTQTTPQPSSAAQAGAQPVLALGLAAVLAGLMLLY

SEQ ID NO: 137653 - protein, 173 aa, Triticum aestivum
  Clone ID: PAT_TA_32071.pep
MASATRALLVAAVTAAALFGTALGATYTVGAPAGSWDLRTNYTQWTSTIRFYTGDELRFQYPAAAHNVVEVTRTAYYNCSSSSPVATFPSGNGVIPLAAVGTRYFICGVPGHCAGGMKVQVNVQSKVVRCRGRGARQRCTQTTPQPSSAAQAGAEPVLALGLAAVLAGLMLLY

SEQ ID NO: 137654 - protein, 897 aa, Triticum aestivum
  Clone ID: PAT_TA_32072.pep
MSSRSGAARMRACGPWGEGGSGVVGDAHALEREMSRDGSHYSLSSGILPSLGARSNRRVKLRRFIISPYDRRYRLWETFLIVLVVYSAWVSPFEFGFIRIPTGGLAATDNAVNAIFAVDIILTFFVAYLDRLTYLLEDDPKRIAWRYATSWLVLDVASTIPSEIARRMLPSKLRSYGFFNMLRLWRLRRVSSLFARLEKDRHFNYFWVRCAKLICVTLFAVHCAACFYYLLADRYPDPKETWIGNTMPDFHSKGLWIRYVTSVYWSITTLTTVGYGDYHAENIREMIFNIFYMFFNLGLTAYLIGNMTNLVVHGTSRTRKYRDTIQAATSFALRNQLPPRLQDQMISHLSLKFRTDSEGLQQQETLDALPKAIRSSISQYLFLNLVQNIYLFQGVSNDLIFQLVSEMKAEYFPPREDVILQNEAPTDFYILVSGSVELVEVPNGAEHGAEQVVGVAKSGEVIGEIGVLCYRPQLFTVRTRSLCQLLRMNRTAFLSIVQSNVGDGTIIMNNLIQLLKEQTDGVMVGVLKEIESMLARGRLDLPITLCFAVTRGDDHLLHQLLKRNLDPNESDQDGRTALHIAASKGNEQCVKLLLEYGADPNARDSEGKVPLWEAVYAKHDTVVQLLVKGGAELSSGDTSLYACTAVEQNNIELLKQILKHVIDVNRPSKDGNIPLHRAVCDGNVEMVELLLRHGADIDKQDSNGWTPRALAEQQGHEEIQNLFRSVIAPRKYTSNGRVTPMLLGRFSSDPSMQKVIHEDVEQQPSKVLPQRRKVSFHNSLFGVISSAHPRRETDHLLSRGLAATGGPTYPQAHHNPLIRVTISCPEMGNTAGKLVILPGSIKELLQLGAKKFDMMPTKVLTIEGAEVDEVELIRDGDHLVLASDDWVPDDTQIRGKN

SEQ ID NO: 137655 - protein, 465 aa, Triticum aestivum
  unsure (1)..(465): unsure at all Xaa locations
  Clone ID: PAT_TA_32073.pep
MAAAVLLAAILALSPLPLSLASPSAAAAADRITRLPGQPPVNFSMYSGYVTVDAAAGRALFYWLIEAAVAKPESAPLVLWLNGGPGCSSVGYXASEELGXAFRINADGRTLSVNXPYSWNKMANVLFLDAPAGVGYSYSNTSSDLLAPGDNKTAHDSYTFLVNWLERFPQYKYRDFYIAGESYGGHYVPQLSQLVYRNNKGVRKPILNFKGFMVGNAVIDDYHDFVGTFEYWWTHGLISDDTYQKLQLACEFDSSEHASDACNKIYDVAEAEEGPIDAYSIYTPTCKKTSLHRRRQIKGRRPWLPRGYDPCTEQYSTKYYNLPEVQKAFRANVTGIPYAWTGCSDVLFEYWKDSPRSMLPIYRELIAAGIRIWVFSGDADSVVPLTGTRYSIDALYLPTVTNWYPWYDEEEVAGWCQVYKGLTLVTIRGAGHEVPLHRPRQALKLFEHFLQDKPMPRPVPSIQSF

SEQ ID NO: 137656 - protein, 186 aa, Triticum aestivum
  unsure (1)..(186): unsure at all Xaa locations
  Clone ID: PAT_TA_32074.pep
TRPILMALLIGNMQTYLQSMTLRMEEMRLKRRDSEEWMRHRHLPDDLRERVWRHNQYKWLETRGVDEDGLVSCLPKDIRRDVKRHLCLRLVRRVPLFANMDERLLDAICERLKPSLCTETTYVVREGEPVDEMFFIIRGRLESSTTDGGRVEFFNKGLLKEXGDFCGEELLTWALDPKAAANLPLS

SEQ ID NO: 137657 - protein, 191 aa, Triticum aestivum
  Clone ID: PAT_TA_32075.pep
SVSGFQLHPARARRTPREAQTQPGEPPHGPRVRPRVRRVVGSPVVGSPMALRVSQCVFAAASSAAMSSAFGSLNYSAYFYLNTALVLQFLWSMGFACQDIFALRNKKDLHAEPELVLLRAIGDWVLAILMFSGSCAAASVTIFFMKDVKFCAEYRRLPCGQFELSVALAFITWSLQAASSFSGFWLVVSFF

SEQ ID NO: 137658 - protein, 324 aa, Triticum aestivum
  Clone ID: PAT_TA_32076.pep
MIMMHRATIIALVALICCLVAAGGARAQPFDYPAARLATTWANTDAALPHHVVYTDGSVARAALLRLNPAGLGPSYAFGFFCTASQPRGNGPAAPCTEFLLGVAVVYCNSGAGMTFVTAGVPQVVWSANRGSPVREGAAAELTPEGDLVLRSSNGAVVWSAGTKGRSVAGARIGSDGNLVLFDGRNATVWQSFDHPTNALLVGQSLKHGARLTANASTTDWRDGRLYLAVDDDGLNAYVNATPPQRYYHLGLSETAPGAYATYTNGSLTVSARPGAPPLAAIQLPTVGAGTVQYMRLEHDGHLRIYEWRSGWAPVYDVLKSATN

SEQ ID NO: 137659 - protein, 174 aa, Triticum aestivum
  Clone ID: PAT_TA_32077.pep
RHEGSSEMLAMPFGACVRAIQRAPSLPIGSWTMAVPLGDARHAVRGLCACSRESAISISSPVVRRPWFCSSETVAMRFRAHACGVRQGPSLPLQSADHDMQFWRLSRAVQGSFACNPTSVRARQVQLASVHSSALPQHSEKEDSPVWKMDSSRIYSSQSLYAALNLRVCCYACL

SEQ ID NO: 137660 - protein, 176 aa, Triticum aestivum
  Clone ID: PAT_TA_32078.pep
FISDKGHTECASCVRFSPNPQNPVIVSAGWDKLVKVWELSTCKLQTDHIGHTGYINTVTISPDGSLCASGGKDGTTMLWDLNESKHLYSLNANDEIHALVFSPNRYWLCAATASSIIIFDLEKIRPRVRPRVRFPAAGKKSREPECVSLAWSADGQTLFAGYTDNIIRAWGVMSRA

SEQ ID NO: 137661 - protein, 316 aa, Triticum aestivum
  unsure (1)..(316): unsure at all Xaa locations
  Clone ID: PAT_TA_32079.pep
MAEQLILKGTLEGHNGWVTSLATSMENPNMLLSASRDKTLIIWNLTRDETQYGYPKRSLHGHSHIVSDCVISSDGAYALSASWDKTLRLWELATGTTTRRFVGHTNDVLSVSFSADNRQIVSGSRDRTIKLWNTLGDCKYTITDKGHTEWASCVRFSPNPQNPVIVSAGWDKLVKVWELSTCKLQTDHIGHTGYINTVTISPDGSLCASGGKDGTTMLWDLNESKHLYSLNANDEIHALVFSPNRYWLCAATASSIIIFDLEKKSKVDELKPEFPAAGKKSREPEXVSLPWSADVQTLFAGYTDNIIRAWGVISRA

SEQ ID NO: 137662 - protein, 92 aa, Triticum aestivum
  Clone ID: PAT_TA_32080.pep
MTKRTKKVGVTGKYGTRYGASLRKQVKKMEITQHAKYTCTFCGKVTVKRQATGIWDCKSCKRTVAGGAYTVATPAAAAMRSTLRRLREIAEV

SEQ ID NO: 137663 - protein, 99 aa, Triticum aestivum
  Clone ID: PAT_TA_32081.pep
QFERLNNSETCEFRVMQLGPGGEYSLLMHHTKEELEEWGLSPEMITDQQWRASANRRSWSEECSSFIATFFDNWMDPLGEGEGDADRQEEDDGKIKSLE

SEQ ID NO: 137664 - protein, 69 aa, Triticum aestivum
  Clone ID: PAT_TA_32082.pep
FYQGPREAPLEAATACPGVYGSGASPGYAGNLAVDATTGASYNANGANGRKYLLPALFDPDTSTCSTLV

SEQ ID NO: 137665 - protein, 283 aa, Triticum aestivum
  Clone ID: PAT_TA_32083.pep
RNLKRTAKADFTNFQRMCRLEWHGLKRWYERNNLEMYGVSANSALRAYFLAAANIFEPTRAAERLAWARTAMLAEAVSSYFQRNGCAPELRERLSAILTPGHSHNLARGAMDSVENSIPHVVNELIMDLSKFDNAADTLREAWKDWFTTWTAKESSGPCEWSTALLLVRTVEVCSGRHGSTQQQLNISEYTQLEGLTSSICRKLSSRVLSQGGQKMENIEDIDRQVDLDMRELTQHVLQSCNGVSGLTRQTFMHVVKSFNYVTLCPHDTIDCHISKVLFEDVI

SEQ ID NO: 137666 - protein, 76 aa, Triticum aestivum
  Clone ID: PAT_TA_32084.pep
QSDTLLDPISLKEDFMKYVINDVYGKVKCTDSELTLSLVGASELPKSMYNDSFYSRHLHQYGVAYQAAADCWSTIG

SEQ ID NO: 137667 - protein, 139 aa, Triticum aestivum
  unsure (1)..(139): unsure at all Xaa locations
  Clone ID: PAT_TA_32085.pep
MAPKAAKKPAAEEKAGDTEEKPKAEERVHGKDGGADKRQKKAKERVETYKIXIFKVLKQVHPDIGISSKAMSIXMNSFINDIFDKVXGESAKVARXYNSKPTITSRENQPAVRLVLPRRARPSTPYAEGTKAVTKFTSF

SEQ ID NO: 137668 - protein, 112 aa, Triticum aestivum
  Clone ID: PAT_TA_32086.pep
SGLRSNFTVAKTCLSWINGKRVSRRNSRRLNRLIPINERKVILERKSDQKSRSKNNRGKSEKKKKSGGWRRGALGLGRRSWASSARASGAPYKGLGQRCPGRVRPIVSSAFF

SEQ ID NO: 137669 - protein, 260 aa, Triticum aestivum
  Clone ID: PAT_TA_32087.pep
ARGCGTTWLKALAFTVATRSRHGLVADHPLLTCYPHHLVPYIEIPGAAGGRVVNLGALPSPRLLATHMPMSLLPPETRSLGCRVVYLCRDPKDTLVSRLHFENKLAARCGGVGPSMDDAFGMFCEGFSPYGPFWDHCLEYWEESVARPDTILFLKYEEIKLDPARVVRRLASFLGVPLTEQEESSGVADKVARMCSFESLTGLEVKQVGGVSHGNRVHVDNSVFYRKGEVGDWANHMSREMGEKLDRIVQQKLHGSGLVF

SEQ ID NO: 137670 - protein, 251 aa, Triticum aestivum
  unsure (1)..(251): unsure at all Xaa locations
  Clone ID: PAT_TA_32088.pep
LRWTAARRPRRSARGRLCRASSRRRLGWSSXRAGGGGARRRPRRARREAGHXRAPTITTASRHRRRSRSRRGSSTTARSTSLHTGRRRWRARRPSWSACAPSASTASTPATLRPNSPPRRTTPWPPSRRQTRRRRRRSTAGAGRSRRGSRARRARSSRGRSRGRRRXMSKSSSEARMXRRLRRRRRWRRPWRAAWTRGRTTSSTASGSSCGCSGSTRCSTTRRCSTAAPSSRPPEKKIVPRCSTTVPPTID

SEQ ID NO: 137671 - protein, 264 aa, Triticum aestivum
  unsure (1)..(264): unsure at all Xaa locations
  Clone ID: PAT_TA_32089.pep
NSARGNDFAVPYPSHFHPSSDAQVVAWQSRMRGLERRRLWCFAGGSRHESRKTGRNQIIEQCGRSSRCALLGKAAVTKSPGEYTQGEYSPSHAMRLLESAEFCIQPRGDSYTRKSIFDXILAGCIPVFLPRVRAYVQYTWYLPRDYRAYSVFIPQRDVIGRNASIEEVLRKIPPAKVARMREEVIRLIPAVMYREPAAKGVQFKDAFDVAVERVVDRVAKRRRAAAEGRECRDSVDGYDSWKYNLLEDGQTEIGPHEFDPFMSM

SEQ ID NO: 137672 - protein, 254 aa, Triticum aestivum
  unsure (1)..(254): unsure at all Xaa locations
  Clone ID: PAT_TA_32090.pep
GGQVSPRDAATSACLDGMDQNSTYVLKINFLANPKKARKDIKCFCFDKVIYSDLTNYKDLVDSIVVHYSARYLEVAHVXYYDDVLKIYPEVTSDQELVSMFEKNSKTKVVHMFVAYCDPLEPYELITEWHSDAXSQPNNIEQDDDDYLHNPIPESEHVGVDEENIYLEDEPIPLIMVPCSNKEKDKDYVPDHEIVAESEVESEDENEDESMLEVEVEEDEEYHEADPSXEYNKLDPSMSEGEXYPNMAEFKLAL

SEQ ID NO: 137673 - protein, 126 aa, Triticum aestivum
  Clone ID: PAT_TA_32091.pep
PCHGARGISTPWRCRPRRRRRARCGADCGPRCAAASATAAGRGGAGGTAAASAGTTRSATRSTSTRAPTTATTTSTTTTSATAASSTVASPRRRRRCLSRPGRGRRRYRRRGRPSRPRRSFASSVI

SEQ ID NO: 137674 - protein, 167 aa, Triticum aestivum
  Clone ID: PAT_TA_32092.pep
MGDLAGRDCREEAAAPAPAPAVGGPDHLVIMVHGIVGSTADWKYGAEQFHKLLEDRVIVHCSNSNMHKLTLDGIDVMGERLAQEVIEEINKRPQITKISFVAHSVGGLVARYAIGRLYRPPGQSLENSPQSLTDSNRGNIHGLDAVNFITVASPHLGSRGNKQVPFL

SEQ ID NO: 137675 - protein, 321 aa, Triticum aestivum
  unsure (1)..(321): unsure at all Xaa locations
  Clone ID: PAT_TA_32093.pep
MGDLAGGDCREAAAPEEEAAAPAPAVGGADHLVIMVHGIIGSTADWKYGAEQFHKLLEGRVIVHCSNSNMHKLTLDGIDVMGERLAQEQAXVIEEINKRPQITKISFVAHSVGGLVARYAIGRLYRPPGQSLENSPQSLRDSNRGNIHGLDAVNFITVASPHLGSRGNKQVPFLFGVTAIEKFACCILRTSSIRGASELPNTYFLLHYDDGKPPLLQLMWVDSTSKIYPHIVYEELSKAETLDQCADVADIDKDNCTLEERLLRGLKRVSWEKVDVSFHNSKARSAAHSVIQRRGRCDKAYDRPFRYLVDSPPSLKTKIVL

SEQ ID NO: 137676 - protein, 168 aa, Triticum aestivum
  unsure (1)..(168): unsure at all Xaa locations
  Clone ID: PAT_TA_32094.pep
GDVYAMEPVAPKFNPWSSCPITFDRRDHPTSICHGGSAALALDPIIDGFHLTRVLMDGGSSLNLLYQDTVRKMGIDPSRIKPSKTTFKSVIPGVEAHCTGSITLEVVFGSPNNFXSEELIFDIVPFRSGYHALLGRTIFAKFNTVPHYAYLKLKMPXPHGVITVNGNT

SEQ ID NO: 137677 - protein, 110 aa, Triticum aestivum
  Clone ID: PAT_TA_32095.pep
NDFMENIIYEGSAKAFHPEGHGQAFDRDETQSQDGHSQDHGVEHIGSHNNQEATDGQGEPWHEDIYCEDEEDGVDIKEEPLFIDDLTLKANAQKRRKAFRRDHTPKMRTS

SEQ ID NO: 137678 - protein, 141 aa, Triticum aestivum
  unsure (1)..(141): unsure at all Xaa locations
  Clone ID: PAT_TA_32096.pep
KGSKRCHXPEPCLQGAGDEHRRGPQYQLGRFCQGGGNERIAYTQDTDLAFKIIRGNYCSLSCPYALEGNHKCIFYTKPSCGPLYYELFRPDSYGMALMVVVEPKLSISMPNYGFVVLVHPLPLCWHLLSNVPACTTELNVN

SEQ ID NO: 137679 - protein, 344 aa, Triticum aestivum
  Clone ID: PAT_TA_32097.pep
MERSVEAFQIDNPYEPVADNTYLPAPDCEEPRLEEDRTAAQGVNACRRVNDTLRSPMPDNYGLEELRELGPGTSGTVYHGKWRGTDVAIKRIKKSCFTGRSSEQERLAQEFWREAEILSKLHHPNVVAFYGVVKDGPGGTLATLTEFMVNGSLRHVLQRKDKCPDLRKRLIIAMDAAFGMEYLHSKNIVHFDLKCDNLLVNLRDHARPICKVGDFGLSKIKRNTLVSGGVRGTLPWMAPELLNGSSSKVSEKVDVFSFGIVLWEILTGEEPYANMHYGAIIGGIVNNTLRPPVPANCGPEWRRLMEQCWSPDPSQRPAFTEIAARLRSMSAAANQQAKAAAAAK

SEQ ID NO: 137680 - protein, 156 aa, Triticum aestivum
  Clone ID: PAT_TA_32098.pep
PTRPAARLDLEVVPAAGPPVEAGQVKKEDVETKVSACHTAAIAKVNNRFKREEVVINGWERDQVDKEEAWHKRVEAKHDAEAQPRPSETNGGLTLSKAGGPSRSRRASGWLPSGGLKLADRPASSANFTQDVGRVPPKRSYYERASAGAGEKSYVV

SEQ ID NO: 137681 - protein, 192 aa, Triticum aestivum
  unsure (1)..(192): unsure at all Xaa locations
  Clone ID: PAT_TA_32099.pep
EELAXMVHGLASTGRPFLWVVRPDCNAMLPEGYLDSVAGRGMVVPWSPQDLVLAHPSTGCFLTHCGWNSTLETLAAGLPVVAFPQWGDQCTDAKYLVEEFKMGVRIGTPLRRDPVRDAVEDVVAGPDAGAMLEKARAWCAAARTAVAAGGSSAPHVQAFVDQVVAGTIGARADKDLVAAEQQGFDSSSLRGN

SEQ ID NO: 137682 - protein, 486 aa, Triticum aestivum
  Clone ID: PAT_TA_32100.pep
MDSSSEAPLLPSRGNEHKGVPDVAGGKRPWWREAAEESGRLAALAAPMIAVALLQLLMQLISTVMVGHLGEVALAGAAIANSLTNVSGFSVLIGLACGLETICGQAYGAEQYHKLSLYTYRSIIVLLIVSVPIAIVWVFIPEVLPLIGQQPEIANEAGKYALWLIPGLFAFSVAQCFSKFLQCQSLIFPMVLSSMITLAVFIPLCWFLVYKVGMGNAGAALSVSICDWVEVIVLGLYIKFSPSCEKTRAPLTWEAFKGIGSFMSLAVPSALMICLEWWSYELLVLLSGILPNPALETSVLSICISTVVLLYNLPYGIGTAASVRVSNELGAGNPEGARLVVGVALSIVVCSAVLVSTTLLALRHFIGIAFSNEEEVVDYVTRMVPVLSISVITDSFQGVLSGVSRGCGWQHLGAYVNLGAFYLVGIPVALFFGFTMQLRGMGFWIVAWSRPRSQVTLLSVITATTKWDKMADKAKERVFEDRLPTQ

SEQ ID NO: 137683 - protein, 235 aa, Triticum aestivum
  Clone ID: PAT_TA_32101.pep
SNRRRPTKHMPTPEQWTNVFNPAYAYYVYYCYANLYTLNKLRDSKGMTTIKLRPHCGATGDIDHLAAAFLTSLNIAHGENLKKSPVLQYLYYLAQIGLAMSPLSNNSLFIDYHRNPFPTFFLRGLNVSLSTDDPLQIHLTKEPLVEEYSVAASLWKLSSCDLCEIARNSVYQSGFSHRLKSHWIGRNYYKRGPDGNDIHQTNVPHIRIEFRHNIWKDEMELIHFGNVKLPEETDR

SEQ ID NO: 137684 - protein, 51 aa, Triticum aestivum
  Clone ID: PAT_TA_32102.pep
SAHASGLLRAKKVINPSSTGAILCGHKQMTEEITRALVADGMSKDKILTNF

SEQ ID NO: 137685 - protein, 135 aa, Triticum aestivum
  Clone ID: PAT_TA_32103.pep
MGWKAMTWYRRFSCDHWSKGSVAYDKEISVDQPMHSVLLPELTDDTAGELTLKDMLASYPVSSLADHCDDVVYMLCESKSGSKKSWLITVDLKKKILVELAPFPLEGYYSPAHPSELSNYLNVAPAEEEDTSEGP

SEQ ID NO: 137686 - protein, 239 aa, Triticum aestivum
  Clone ID: PAT_TA_32104.pep
MPAASTLMRFASAGRSAAATASRFARLAERAALSTKAVAVECHAPTLGSHRAASVDLRLHRPPVVVPPPAMTAPASQTLSYLKEQTPEGKVKFVAEEKDLESDETLWALYERWCEAFNQKRDHDEKVRRFSTFKKTVLHIHNKPNVGYRRGITQFADGKLRKPCCTDLLDRKIAEQVDGYNVEFVTDGSGKLYKRVYADYKVVQDRLYVHLPKGVDVKTITSNPEWAELEKYDSTNPEC

SEQ ID NO: 137687 - protein, 83 aa, Triticum aestivum
  unsure (1)..(83): unsure at all Xaa locations
  Clone ID: PAT_TA_32105.pep
APAVAISYMFWFENMDLNTAYDKLTSXRPCGPSKKAIRSATYDLAKSDPNKEAFETLPERAFEGISVSERKLIQDRVRSLHKA

SEQ ID NO: 137688 - protein, 204 aa, Triticum aestivum
  Clone ID: PAT_TA_32106.pep
GCGPAGQEGDSRFSVPGCTPAGQRLGVRQRQVLPRLHRLGLPHRPSTLQQAGVVPFSGARVGPAHRQRPLDRPVVLTRTPGGRGGARSAAPVPPPPDPPCPCLPRRLGRHRRPFFDGQPRPPCCRCLPRARARIPPAHRLVRLRRGGAGADAPVPLPPDPPCPRPPRARHRRPLYFGQLGPRRRHSIPHPLDRLLGGNLHPRGG

SEQ ID NO: 137689 - protein, 105 aa, Triticum aestivum
  Clone ID: PAT_TA_32107.pep
MPGVKAEERKEKIHRYIKKRNERNFSKKIKYACRKTLADSRPRVRGRFAKNDEYCEASTAIGSQNHEEYEQMPGVKAEDMLDPDALAHISGMSSYMYNHTVESWI

SEQ ID NO: 137690 - protein, 264 aa, Triticum aestivum
  Clone ID: PAT_TA_32108.pep
MALMPVELCYATVASPVAAPSARRVPRRRAAVRCAATAPAPMGEKTKYRDGPLERAFMGLFARKMEKFTGRKKKPGPGGEEEKKAVWEWDYESFVDVSRRVMVGRSRAQQQEAVREVLLSMLPPGAPEQFKKLFPPTRWACEFNAALTVPFFHWLVGPSEVIEVEVDGVKQRSGVLIKKCRYLENSGCVGMCVNMCKIPTQSFFTDEFGLPLTMNPNFEDMSCEMIYGQVPPPLEEDPVSKQPCYPNLCSMSTPSAPVCPKLQA

SEQ ID NO: 137691 - protein, 134 aa, Triticum aestivum
  unsure (1)..(134): unsure at all Xaa locations
  Clone ID: PAT_TA_32109.pep
IFAVIQTRAGYWQWENHIRPGKPKGTNGGLAISISGCNDEGXSSESSVQGFSDTAAIGAMTDSFIRAVESEPGTTYGRLLSAMRATIRDSQGTGRRLPGRIGSFVRKMITSSAVQEPQLCSSEMFDIYRKPFLL

SEQ ID NO: 137692 - protein, 95 aa, Triticum aestivum
  unsure (1)..(95): unsure at all Xaa locations
  Clone ID: PAT_TA_32110.pep
DGAIHRGQPIRESTNDQMGILSLIYSKSGSSVFGSASTEEQITDDIYAAGLTILITHDHNPPNRLLQXVVELLGLKLQRVVLESFIFVRCSGISE

SEQ ID NO: 137693 - protein, 294 aa, Triticum aestivum
  unsure (1)..(294): unsure at all Xaa locations
  Clone ID: PAT_TA_32111.pep
VGVGSKLSKDEWKDVLLCFKESSAQTFIAFSKIVRMMQDIDIPDRMESYSEADHYSDHEIYSNDEDEANMETTSYAIVKLKNHMALILLIVQGIIKLYEEQGKYLHAEHISILLEMISSIATHASEVSSDSSLQMKFHKSCSLLEASEPAVVHXENETYQSYLKLLQAVLHGYPFLSEDMDIESRLLDTCEKILRTYLKCAGNGPSDEASHGNQTLHSIVPLGAAKQEELSARTPLVLLAMQLLHNLEKNSFRRVLPRFFPLLIDLIRCEHSSGDVQHALYKIFKSSIGPMIEV

SEQ ID NO: 137694 - protein, 158 aa, Triticum aestivum
  Clone ID: PAT_TA_32112.pep
MAMMGIIAPETAYETEAVSPATASAAAGAPQRRGLLRRMMPRGHYSPIGADQKTDPGRAPEVAPIAARDSDVAEKPRRGWLRRLVTQRRRWKNLGGASASRLAGLSRSLRWKRLSVNLRGSWASALLDTVAFRVMYVVEAIVLGLALSCFFCCCGCQI

SEQ ID NO: 137695 - protein, 180 aa, Triticum aestivum
  unsure (1)..(180): unsure at all Xaa locations
  Clone ID: PAT_TA_32113.pep
TREREEKERHTTLPPLPPDAQPPPISLPPPASPAXPAPPPPAYPATRRRRPPLPLHPGAAALPLPLPRGAADSTSRVPPDFLPPPPLAPVGLPPLPTSVGTVPRPGSHRRHCPRWGSRHRHRPTMGIEPQAPSHDGDRATATASPHLPSSGSCCRATTTGILPPCDLPSPATVNFFHPPL

SEQ ID NO: 137696 - protein, 245 aa, Triticum aestivum
  Clone ID: PAT_TA_32114.pep
NPLSVRTKVRTIKDTTYLEACIENHTKSNLYMDQVDFEPAQQWSATILEADEHPSVVKSTIRDLCKQPVLIRAAGGIYNYLYQLRPSSDEPGQMKTEGSSILGKFQITWRTNLGEPGRLQTQNIHSTPTPSKDVDLRAVKIPPVIFLERPFMVNLCLTNQTEKTVGPFEVFLAPSVSGEQKTVLVNGLQKLVLPLVEAFESINFDLSMVATQLGVQKISGITLYAVQERKHYEPLPDIEIFVDAE

SEQ ID NO: 137697 - protein, 160 aa, Triticum aestivum
  Clone ID: PAT_TA_32115.pep
RWSLIAGQLPGRTDNEIKNYWNTHIKRKLLSRGMDPHTHRPLTPVDGAAASRPAHIAVPARAAPPTMFAPLTTKQPPMESSSDDGSSGATSTGEPRCPDLNLDLSVGPPAADTPTSHPVCLCRHLGLRGGAVCSCRQADSPGSQGGGFRYFRPLEEGQYI

SEQ ID NO: 137698 - protein, 150 aa, Triticum aestivum
  Clone ID: PAT_TA_32116.pep
MAGMGEMSMRPRPGPPMHRGPPPMARPRPEPIDREKTCPLLLRVFTKVGGHHLNEEFSERGKEPKDEVQIYTWKDATLRELTDLVKEVALPARKRNARLSFAFVYPDKNGRFVVKQVGSTFSYGHGRGDDAKSLGDLGFQIGDYLSVSIM

SEQ ID NO: 137699 - protein, 139 aa, Triticum aestivum
  Clone ID: PAT_TA_32117.pep
PTRPPTRPVRTQNTIRTASKPPRRNRRSMPYAAATASSSSSTSIPKRWRPRPRFSPPATMAADPPTADRLSCKHGWMDPGRYPSSLGGASCTSRSALWSRPSPPPPRRRRHRGSRLHQARAPPHLTDRKGGYLKLGQSK

SEQ ID NO: 137700 - protein, 48 aa, Triticum aestivum
  Clone ID: PAT_TA_32118.pep
YDRTVIPEHHERVTHNVHSQHITTLHSDSQPRYLWIESEASTAVIDGG

SEQ ID NO: 137701 - protein, 144 aa, Triticum aestivum
  unsure (1)..(144): unsure at all Xaa locations
  Clone ID: PAT_TA_32119.pep
EAVPVVRLGVGELVGHRRGHQQEPRHQRPXRRGHGVAVAVVQEWRWGQGAQDGVRRSTPRRVRRRRRAAAEPPATEAGWRRRAGCCVRAVRWLFRLAAPPHPGLASDSHARGEHRGLPDRVSSSRCSGQDEHQGQFIWLSLSVH

SEQ ID NO: 137702 - protein, 387 aa, Triticum aestivum
  Clone ID: PAT_TA_32120.pep
PEATQAPPLPRVLLVQARWPHLFCSFCSSFLEALQRAATARQGCPGSSSEASTTRAVGTGPSRWRSRSSCPVSPRTTTRQADVPGEAPQLRVPRPSTTQAVGTRPTRRTSRCSWPTSTTSHPRAPPLVPGAAARAQRGACAQDAAKRPGSSSRGIDDSGHGRASDAPEERAFTDVISTGGACDHFARLVAETGNASQLFWERAAGAGGLTVFCPEDKALAEFEPKFRSLGADDRLAVLLYHGAATTYGRKLFQAFDWVSVSSLATDAATNKSHAITVRGDGDTVWLWPSCGSGAGARVTKTVSEEAPLAVYVVDAVLLPNHLRQKLDGGDGPAAACEPSGGYFGWLHCCIPVWEVIVMAVASIAGFLAGFLLHDAVDKMSNKANLSG

SEQ ID NO: 137703 - protein, 102 aa, Triticum aestivum
  Clone ID: PAT_TA_32121.pep
IEKIMDPNLAGKVNPESLAKFAETAEKCLCEFGSDRLSMGDVLWNLEYALQLQESNPPDAASAPGGPDPSTVSGASGLTTVPDQSTTSANELFAQLADMKGR

SEQ ID NO: 137704 - protein, 115 aa, Triticum aestivum
  unsure (1)..(115): unsure at all Xaa locations
  Clone ID: PAT_TA_32122.pep
PARRFSSPPPPCPLSPAASSSSPPPRAAPAAPCSPAGSCAPRTXPPPPPLSPSSXPARPPPPPRPWAPGAPPCSHFRQHGLRRARRRRRSATVREPSRPPEQSVFLAPFNFKNKN

SEQ ID NO: 137705 - protein, 219 aa, Triticum aestivum
  unsure (1)..(219): unsure at all Xaa locations
  Clone ID: PAT_TA_32123.pep
QFSSEHVHGLILGTSKLEIFRSESSTWLEDDTLDRDINISGRTHLFVNGMLYVSVGYEVLMFEGLEAMSDGIPPYHQIISXAAGSFGKSSGILHYALPHENGRTIVVWTLDDFGQHSWTWTKMCHLSMTDAFGKDEFVHYDDGGDGGEDKWFWNCDYRIVDLDLERGLVFLHDQKANKLLSYNISGGKLNEIQDAFGWDRYYVYVPCYSELPAQETSVQ

SEQ ID NO: 137706 - protein, 219 aa, Triticum aestivum
  unsure (1)..(219): unsure at all Xaa locations
  Clone ID: PAT_TA_32124.pep
KRSSCTMPSSWSMTDPTTFLIRGESYLLDRQKIKAENTLMQMVGADWIKSDKREDDLAGRPGGLVQKYAAQGGSKFFFIVNIQVPGSTTYSLALYYMMDTPLEKVPLLERFVNGDDTFRNXKGSWIVKQSVGKKACLVGQALEINYFRGSNYLELGVDIGSSTVARGVVSLVLGYLNNLVIEMAFLVQGNTQEELPEFLLGTCRLNYLDASKAVSLDEC

SEQ ID NO: 137707 - protein, 231 aa, Triticum aestivum
  unsure (1)..(231): unsure at all Xaa locations
  Clone ID: PAT_TA_32125.pep
PALGSPPSSAPPSSRLLRSAEPLGFNHRPTTAGDELSAAPSRYLTREERWMSQRLDHFSPTDHRQFKQRYFEFLDYHDDPNGPVFLRICGESSCDGLPNDYLAVIAKKFGAAVVTPEHRYYGKSSPFDSLTTDNLRFLSSKQALFDLAVFRQYYQEKLNSQYNRSAGFDNPWFVFGVSYSGALSAWFRLKFPHLTCGSLASXSGVVLAVYNFTDFDKQVGESAGPQCKAAL

SEQ ID NO: 137708 - protein, 219 aa, Triticum aestivum
  Clone ID: PAT_TA_32126.pep
MQAAVAAAAWTPTTSPSTSSSFKVGVSPRLRGRRTPSAAATSVAVSTRQPLEVVRPIADPNPVVDSPLTAENVELVLDQVRPYLMADGGNVALHEIDGNVVRLKLQGACGACPSSVMTMRMGIQRRLMDEIPEIAAVEAITDKEAGLKLNEENVEKVLDEIRPYLTGAGGGNLRFVAINKFFVKVQLKGPAAGVAAVRVAIAQKLKEKIPSIAAVRLLP

SEQ ID NO: 137709 - protein, 102 aa, Triticum aestivum
  unsure (1)..(102): unsure at all Xaa locations
  Clone ID: PAT_TA_32127.pep
RPLPLELPAPTHPNPSPHTAPPPAPRPXPPPPPPRGPPPLPRHHPPPDPDPTAXPLPPAHRRPPPSPPSPPPPTPSRPPPPSSIPPSPSPSPKGYKWQGDSA

SEQ ID NO: 137710 - protein, 312 aa, Triticum aestivum
  unsure (1)..(312): unsure at all Xaa locations
  Clone ID: PAT_TA_32128.pep
LAGRRLLLLRRCAAGRRLLGTAAEASPGGEEAGGEAGYGRKPSSSSTRDETSVSMPMSFMTGSVVGKRFYRDATVRRADDGAPRTVMLDXSQLMLAGRTLPLTASTPLQRHSLALAMGVAAEWEYQERDGIRPFTMPLMKLACTALXRVPLTRTKIIANLMQKFHQDLVFCRSPADDELTKGVYEKQKEKIDPILDWVKTEFGFKPVVYTSFLGGKHDERLVKAVETVLRFANDCELASIDAMAAAAHSLVIPLAIFRGRLGVDESIELIRLEEDHQVDRWGLVEGGHDVDIADLKVQMSSAVVFLQLSWLK

SEQ ID NO: 137711 - protein, 121 aa, Triticum aestivum
  Clone ID: PAT_TA_32129.pep
MANPMYGSGPLRSRNASSSDEIQLRIDPVHGDLDEEIDGVHSRVRMLKGVAQEINSEAKFQNDFLNQLQLTLTKAQAGVKNNMRRMNKSIIQQGSNHIVHVVLFALLCFFVVYLLSKFSRR

SEQ ID NO: 137712 - protein, 108 aa, Triticum aestivum
  Clone ID: PAT_TA_32130.pep
RRGSSLRLRVKRGGATSASCGGIPLHRRARGVPLGSGGDQRDGIHGGVAAARAACSRRPDQLAAGALRDAGALLEARRAQTPRQPGCLPLRRQDSLQPDGAGPPLRQP

SEQ ID NO: 137713 - protein, 261 aa, Triticum aestivum
  Clone ID: PAT_TA_32131.pep
PTRPLRSSLPAAPAAASASLPPSPTKPGRVVLHSTDGLSDDASFFDAQETPAKINLPAEPIDDDWELVDQDGYDRDSLASGPAPASDPDGMLRDFPARCPPGGDEAVVLYTTTLRGIRKTFEDCNDVRALLDNLAVAFQERDVSMDRGLREQLWAATGEKAVPPRLFVRGHDLGGAAQVLALHEDGRLTSLIQLPSLSPPEAAVSSNKKREKCEACGGLRFVVCGECDGSRKLFDGERGGVRCHGCNENGLVMCTLCLYPS

SEQ ID NO: 137714 - protein, 183 aa, Triticum aestivum
  unsure (1)..(183): unsure at all Xaa locations
  Clone ID: PAT_TA_32132.pep
ATTANINQKAIASPPYLAGAAVASNSAPTASRKSLVLLRAPPASTHIFHLRRLPLHPAATNPEWTTGLLRLARKLKEVDEDVQRHNELFELVKSTPSGKIGDVVAKRRKDFTVEFFNHLYYVAESYKDEPAKQKELATLGNDCVDAPASSXDMCWQSLXALNVAELKLKDILNSASXDAACPK

SEQ ID NO: 137715 - protein, 79 aa, Triticum aestivum
  unsure (1)..(79): unsure at all Xaa locations
  Clone ID: PAT_TA_32133.pep
SGVVVIPFPEGXRSVPXCLTSLREKGAXXSXRELXGLWRNQVAPYKVRSGKVAFVTDIPKNASGKILRKDLIKLTTSKL

SEQ ID NO: 137716 - protein, 353 aa, Triticum aestivum
  Clone ID: PAT_TA_32134.pep
GTSARREAAGGGEAGDRGLHELRGEVERPGPVRDLLGAELRGHRRCPERVRQRPGPGIPRRGPQGVEGVLARPAAPAPGPLRRHARRVPPPRPDPGAPGGPVRAAPVPAPPPRQVTYAVLPQTGYFEFIPLEKPTGEETENSAAIHYIESEPVGLTEVEVGKIYEVVLTTFAGLYRYRLGDVVKIARFHNSTPELQFICRRSLVLSINIDKNTEKDLQLAVEEAAKLLEGEKLELVDFTSYVEKSSDPGRYVIFWELSSEATDDVLSGCANALDLAFLDAGYMGSRKIKTIGPLELRVLRKGTFREILLHFLTLGGAVSQFKTPRFVSPANGKVLQILNRNVAKSYFSTAYGL

SEQ ID NO: 137717 - protein, 98 aa, Triticum aestivum
  Clone ID: PAT_TA_32135.pep
AEAWPRSPPGYGANKPPTRRRRPPRRLRWRGMRRRGRRALRRPAAGGVPPAPARRRAGRLPRLPPLGRAPPSLHVPPHPPPAAGLHRSIGLRGCGSSG

SEQ ID NO: 137718 - protein, 225 aa, Triticum aestivum
  Clone ID: PAT_TA_32136.pep
RSNNPGSTKVPYSTYSIAQVSYELNVLGTRGPRRMRCVMHSIPASSLEAGGSVPCQPDIIFSRSLDESFSSMPVSKSSVMDHSMRFSSARFSDVSIGGGPAIRGQALSDGDDLKDTPLILRNKVPRWHEQLQCWCLNFRGRVTIASVKNFQLTAAPSQPAPPPAGAPTPTPAPSQPAPAPEQDKIILQFGKVSKDMFTMDYRYPLSAFQAFAMCLSSFDTKLACE

SEQ ID NO: 137719 - protein, 193 aa, Triticum aestivum
  unsure (1)..(193): unsure at all Xaa locations
  Clone ID: PAT_TA_32137.pep
IVYDTQPPYXGAIVPSIGRSSRRFNSXEVSPKVPSGSYNIAQVSYELNVLGTRGPRRMNCIMHSIPASSVEPGGIVPGQPDQIMPRALEDSFRSMSSFSKSSIMDRSTDFSSSRYFSSSRFLSDIAGGAISRDEDGENKERPLVLRNKVPRWHEQLQCWCLNFRGRVTIASVKNFQLIAAPSLPAPQPSLTLG

SEQ ID NO: 137720 - protein, 95 aa, Triticum aestivum
  Clone ID: PAT_TA_32138.pep
VAINHILSGSLSLNHRHLQPLTLSTALTSTSSPLPIDTSFTQLITALTSTLGGLKLNQQFAENFAHALDAFVRSLHFRSQARARNLDGETVLNDG

SEQ ID NO: 137721 - protein, 121 aa, Triticum aestivum
  unsure (1)..(121): unsure at all Xaa locations
  Clone ID: PAT_TA_32139.pep
MDRPVGLRKKVPIWHEQRQCCXAFCRGRVTVPSVKNFQLTAAAPELTAAALPPSEPSLPPQQQQLQSSSSSSSSTSDHENVILQFGKVTKDMFTMDYRYPXLSAFQAFAICLTSFDTKLAL

SEQ ID NO: 137722 - protein, 181 aa, Triticum aestivum
  Clone ID: PAT_TA_32140.pep
MPSAMEIYEAGIHFRVSDTDSLLDVHFERGKLSMPAIRVDDRTEKKFLNLMAFERLHPGAGNDVTAYVIFMDNIISSAKDVALLRSKNIIECGLGSDEEVVKLLNNTLNKGGVMSPSSRLHDVQRRVKAQCTMRRNKWRANFIQRYLRNPWVFISLVAAVVLLVATLLQTVYTVLPFYKII

SEQ ID NO: 137723 - protein, 265 aa, Triticum aestivum
  Clone ID: PAT_TA_32141.pep
KRLIHFSGLARGQRILEDDLIVFPDEAVFEKVTESSGRVYILKFRHDSRKFFLWMQETNADGDSQICRQVNAYINRPLDGDAISIEAEMSHEDTADDDISSRAGNLVDQSMTADMAGEVTSAAGPVRLADLQRILSSIQPSDATADPDAGLRLGDILKPDLILPLIETLPIEQLASHLPEGSWTAGDILELLQSPPLRQQLDAFTHVLQTGQIDLAQFGVDPSKYKFTVASFLEALEDSVAKASTDGGNDSKAKKDGGNDPMDES

SEQ ID NO: 137724 - protein, 110 aa, Triticum aestivum
  Clone ID: PAT_TA_32142.pep
PLSELARPAAPGASFGVGCGSPSYSCNSGLYLTSSSPTRALTAGLGLLRIWPGGNPAFCAGSGDTCGCHSLLEGAVMAVICAPLRASGGNPRSGFPDRTVAAASWCRSPS

SEQ ID NO: 137725 - protein, 277 aa, Triticum aestivum
  Clone ID: PAT_TA_32143.pep
LCIYSDSIIEKIFHAMNKKIQAKVVLTSCYMQLRTAVPIPNNDLIRQAMNEPGRRSPQRSHYHCRRGGFRASASLARRRRTSALRASSAVANSGSSASRSASTSTSHQCALPCSSCAALTFSATARSRACSCETCASIHPASRLTAATRAAASSAVSVPASASRKTLRRTESRVGLPKRRGLPTAGKARMARWGAKSSETSQASWTSLSWRYLILSRSLARVRSPPCRRRSVPLAVAIASAAILTPDCFALGLFVGGHTSRRFILPRRAHIGLSRLS

SEQ ID NO: 137726 - protein, 192 aa, Triticum aestivum
  Clone ID: PAT_TA_32144.pep
PRVRPRVRGRVGEWGNSISILIPFYVTGRPTVLVGDSLYWLLAVGGILEIDLKRQSLAVIQWPMDKGKFSLMRAEGGGLGLFFLSDLGAQLWKRKTDCGGVASWELGKTLELNELKTRSGLNSLTIVGFAEDNNVVFLSRGSTFFMVQLEPLELKELSEVDNWCFYYAFESVYTAGMGICGGHGGAEHLHNA

SEQ ID NO: 137727 - protein, 64 aa, Triticum aestivum
  Clone ID: PAT_TA_32145.pep
YFNKFFYLILFFFFFYFIFFFFFFFFYFFFFFLSYQFIYVIELKFVRSLERTWINRRYIFEMKS

SEQ ID NO: 137728 - protein, 161 aa, Triticum aestivum
  Clone ID: PAT_TA_32146.pep
LTAARSCSSGERSCTTLSYEGYSNNGAAASKAGRRRERQPHEVARRKHPMQGRSPAGAGAPVLQGHSPEASDAMTATGGRGHGGCWCCEDDEGSCVVLNGPRRWLIFSACVFCSFSVLYPICTSAFLSSLKMQPSKAVFQGLAIFHLSCGDAAGCVDRASS

SEQ ID NO: 137729 - protein, 133 aa, Triticum aestivum
  Clone ID: PAT_TA_32147.pep
GGEGEKGGGWWPKKKTLRRRWRRHYGSRRARIREGARAFSQFATFKMAAVLGPGQWIGDNVHLANLNHLRHDHRAHDDEHKADLDADAGALLPPRVPIADLRRLHRGRGWGRRKSDSGWETEVEWKMVGTAAQ

SEQ ID NO: 137730 - protein, 316 aa, Triticum aestivum
  unsure (1)..(316): unsure at all Xaa locations
  Clone ID: PAT_TA_32148.pep
MFQVEGIPRLVVLAPGGAEVVCSDAVELVHRYGDPAFPFTPARVAELEADERSKFASQTLEKLFSVGHVNGGDEQVPISSLVGKTVGLYFSAHRCEPCVKFTARLAAIYGNLKGKSAEFEVVYIPMDKEEDGYERSRGDMPWLALPYDGEGVPSRALARYFDVREIPTLVVIGPDGKTVTRDGRNLVNLYFDMAFPFTDAQVRLLQEPEDEPAKGYPPSLRHXGHRHELSVVSDKSGGGPYVCCECDEQGLGWAYQCIACGYEIHLRCGRDAEGGGAGAAGRRPGVRVSPIFHLAGCWLSGLGAMSGPYCPAPCSF

SEQ ID NO: 137731 - protein, 286 aa, Triticum aestivum
  Clone ID: PAT_TA_32149.pep
DQDGNTALHLAVNNASEDIFYSLMANMRVLLNLANKEGYTPLDLAFLSRHLEVSSKGFKEWIFFLLLQGGGDFGIFNWDHLTRNVVKPDWEKESKKVGKSASMLTVCAVLIFNAALLAPFNVLSHKDKLDLNGFLFQIFVTIDTATFVCSATATFFCVRAGFAMSDGSTRLKNLVSGKFFLGIAALSVMCTVALALFLVIPRGTAYYAISAAGASILAYTYISTLASKAIRCAPAMLSRVGVSRLASIMLFQRSTIKPPWMVPSASTGLFWIMALFGIYFAITSYN

SEQ ID NO: 137732 - protein, 76 aa, Triticum aestivum
  Clone ID: PAT_TA_32150.pep
GRCPMPGNASHCSTSLDNSTFFKQPFQSTKLADCHPSSVTLETRETETGGAGIDLIFLEVRVIQELTCRKSFIYRR

SEQ ID NO: 137733 - protein, 129 aa, Triticum aestivum
  unsure (1)..(129): unsure at all Xaa locations
  Clone ID: PAT_TA_32151.pep
PKQRLLVAMLSDQKFISNYLKVNRERLRKAYNLLVDALKQVGIECFKSSGGFYCWADMSKFIRSYSEKGERSLWDRLLEEANVNVTPGSSCHCIXLAWSRPRFTTLREQDIPVVVERLRRVTDGHKSNR

SEQ ID NO: 137734 - protein, 394 aa, Triticum aestivum
  Clone ID: PAT_TA_32152.pep
MGLAENHLSLDLVREWMEEHAGPAMTPARGDEERDLTISGLATYQPYDGILALKMALAGFMRQIMHESVSFDPSQMVITSGATPAMEILSSCIADPGNAFLVPSPYYPGWDRDIKWRTGIELIPVPCRSTDNFNISITALEIAYNQAKKRGVRVRGVLISNPSNPTGSFVPKQTLRDLLDFATEKNIHLISDEVFAGSTFGSGEFVSVAEVVNELEDFDRGRVHIIYGLSKDLSLAGFRVGVIYSYNESIVEAAAKIARFSSVSTPTQRLLVAMLSDQKFISNYLKVNRERLRKAYNLLVDALKQVGIECFKSSGGFYCWADMSKFIRSYSEKGERRLWDRLLEEAKVNVTPGSSCHCIEPGWFRCCFTTLRERDIPVVVERLRRVTASHKSNR

SEQ ID NO: 137735 - protein, 184 aa, Triticum aestivum
  Clone ID: PAT_TA_32153.pep
VGSKAAHTSAGSKKIVGVFYQAGEYADKNPNFVGCVEGALGIRDWLESKGHHYIVTDDKEGLNSELEKHIEDMHVLITTPFHPAYVTAERIKKAKNLELLLTAGIGSDHIDLPAAAAAGLTVAEVTGSNTVSVAEDELMRILILLRNFLPGYQQVVKGEWNVAGIAHRAYDLEGKTVGTCGAWL

SEQ ID NO: 137736 - protein, 108 aa, Triticum aestivum
  Clone ID: PAT_TA_32154.pep
PRVRKGVIIVNNARGAIMDTQAVADACSSGHIAGYGGDVWFPQPAPKDHPWRYMPNHAMTPHISGTTIDAQLRYAAGVKDMLDRYFKGEDFPAENYIVKEGELASQYK

SEQ ID NO: 137737 - protein, 381 aa, Triticum aestivum
  unsure (1)..(381): unsure at all Xaa locations
  Clone ID: PAT_TA_32155.pep
MAAMCRGSAAARQLVDRAVGSTRPAHVCRQTRKIVGVFCQAXGRRTADKNPNFVGCVECALGTRDRPRGTRAHPYMAVEQARLGTNHHFEPHCPGPGNPSPDSKPHLCFCLDDQRMGLDLELLLTAXGIGSDHIXDLPAAAAAGLTVAEVTGSNTVSVAEDELMRILILXLRNFLPGYQQVVKGXEGNVAGIAHRAYDLXGKSVGSVGARYVLAGYLLRGAITPFNCKQDSATKAMVTNYNVIEIKEPLTDKTRGMLNKERLLKIKKGXVCSVQNAHCWNMEVMSRFPQPAPSGHTAGXGGDIWLPHPAXPKDHPWSYMPSHGMDRHIIGNRNVEDLSYAAEINXMLNTYXKRVEFPTQHYTLQENVLEGKCEKRNHCVVV

SEQ ID NO: 137738 - protein, 128 aa, Triticum aestivum
  Clone ID: PAT_TA_32156.pep
IVLEIVFYFHYLGLAQTKHFMHIEVQYTRSFPKNHASTNSSPFPFPMIKYPYCSKCEALPPDAHVSSSFMSCSSTMAIGLYFLKPNGQLNRCVCHRLNRRFIDLFVTKKTRETRSPSLTRARAILDVI

SEQ ID NO: 137739 - protein, 406 aa, Triticum aestivum
  Clone ID: PAT_TA_32157.pep
NSARAYEEQSDLVWQFLCNIPVNMLAEFLPWLSAPVSSDEHQDIRNCLCKIVPEEKLLKQVVFTWIEGKATREVAQSVVSDNLERSHCCKDASFVNQAEKLIYPLEQSKVGHIKYTESNDCQADRHPIDEILYWHNAIRKELNDIAEETRRMQQSGDFADISAFNARLQFIADVCIFHSIAEDQVVFPAVNSELSFVLEHAEEERRFNNFRCLIQQIQMAGAKSTAAEFYSELCSHADQIMEAIEKHFCNEETKVLPQARVLFSPEKQRELLYRGLCVMPLKLLERVLPWLVSKLSDEEASSFLQNMRLAAPSSDTALVTLFSGWACKARSEDKSNSGEYICLTSGAARCLLDDVEELKKCQSFCPCASRISADVALHLENENGSRPGKRGNDAESVPGTCPGGRS

SEQ ID NO: 137740 - protein, 135 aa, Triticum aestivum
  Clone ID: PAT_TA_32158.pep
LRIAFSNTLTRFGQGVLLGASALIPSLSGPPGGAPSCAPALSTAPGCYTCCSSTVAPPLSPGATAAGTIAPSSLLVPQGHWICRLDASETPWWIAAGALLSPPKTPLFPNEHRSGQRTLWILQSICLPVPTRRKS

SEQ ID NO: 137741 - protein, 70 aa, Triticum aestivum
  Clone ID: PAT_TA_32159.pep
RILIMQHKFLSIRTASPSQWQSIEQHISKKAQCINKYPLKLNRHFSSTRSDMMTCIIPSNSQSDNICRNH

SEQ ID NO: 137742 - protein, 87 aa, Triticum aestivum
  Clone ID: PAT_TA_32160.pep
ENQKLVTCVKDSPKPPPERITFTFPVINSSAHIALMVTGAGKAGAVHKALSGNESSSDLLPVEMVEPQDGEMTWFTDKPAMSMLSRI

SEQ ID NO: 137743 - protein, 236 aa, Triticum aestivum
  Clone ID: PAT_TA_32161.pep
GDVVLLRSDLSILRGPHFLNDRIIAFYLAHLSAAFEGDDDGDLLLLPPSIPYLLSNLPDPDSVAAVAEPLRLASRSLVLLPVNDNPDASVAEGGSHWTLLVLDATNGASRPRFVHHDSLGVLNSDAARQLAAVLRPLLPGAAYGALLVEGPTPMQANGHDCGVYVIALARAICNWWRDRRGQQQEGGADWFDTVRKEVDAESVKAMRAELLHLIARLIQDKEDEKKNKAGEGRKED

SEQ ID NO: 137744 - protein, 142 aa, Triticum aestivum
  Clone ID: PAT_TA_32162.pep
GRVRRASGKRRHSPPSPFPHRRRRRSRRAEESFQAATMVNVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 137745 - protein, 105 aa, Triticum aestivum
  Clone ID: PAT_TA_32163.pep
MVNVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 137746 - protein, 148 aa, Triticum aestivum
  Clone ID: PAT_TA_32164.pep
AGYTQAPPFSPHPISATPPLPPFLTAARRRRSRRAEESFQAATMVNVPKTKKTYCKNKECKKHTLHKVTQYKKGKDSLSAQGKRRYDRKQSGYGGQTKPVFHKKAKTTKKIVLKLQCQSCKHYSQRAIKRCKHFEIGGDKKGKGTSLF

SEQ ID NO: 137747 - protein, 113 aa, Triticum aestivum
  unsure (1)..(113): unsure at all Xaa locations
  Clone ID: PAT_TA_32165.pep
RITRRASKTYCKNKECKKHTLHKVTQYKKGKXDSTFCSEGKRHYDRKQSGYSRPIIKPVSLQERRNTTKKIVLEVAVAEVPASITHQRAIXKRCKHFEIGGRQEGQGNISLLS

SEQ ID NO: 137748 - protein, 228 aa, Triticum aestivum
  Clone ID: PAT_TA_32166.pep
MAAARPGSPAPRRLPPSTLLLLAAVLLAASPPARALRFDLESGHTKCISDEIKVDSMAVGKYSVVAPDPSYPDAQLPESHRVSLRVTSPYGNSMHYSENVQSGHFAFTAVEAGDYLACFWAPDHKPPVTVTFEFDWKSGVTAKDWSNVAKKGKVDMMELELKKLEDTIKSIHEEMFYLREREEEMQNINRQTNSRMGWLSFLSLGICLSVAGLQLWHLKTFFERKKLL

SEQ ID NO: 137749 - protein, 226 aa, Triticum aestivum
  unsure (1)..(226): unsure at all Xaa locations
  Clone ID: PAT_TA_32167.pep
HVGGEEEGRRHEAVAACSGGAESAGGGGVQRMWEGDVVIDCXEDGRRALEAACCPCYRFGKNTRRANLGSCFLQAMAYFISLVAVLVSLVAFSVTRHHVYLYRGHGSVHVGAIYTGYFRRRIRKQFNIRGTEGSLGGSDGRLEGRGRPLSRAGRTLWQNAGQCGVWHGRGDAICLGSNGEGNKAFAALHKSPFVLIKSPELCGMDRISSGADEHQPLVPSAQPEQE

SEQ ID NO: 137750 - protein, 147 aa, Triticum aestivum
  Clone ID: PAT_TA_32168.pep
SCGGDNGGVGHGPQRCIGHGGGGEGAARSGSTPAASTSIASTSGSKTSSACNIGAVRHSRFRRSTRGSSTVASAKISGAKSKTMATPSEVRRCRGNGGEPDDDGCRPEGVAGRRIGDHEASLFTFAFLLSALPARVAGVDLPVLCSR

SEQ ID NO: 137751 - protein, 142 aa, Triticum aestivum
  Clone ID: PAT_TA_32169.pep
MIRFILLQNRQGKTRLAKYYVPLEDSEKHKVEYEVHRLVVNRDPKFTNFVEFRTHKVIYRRYAGLFFSICVDITDNELVYLECIHLFVEILDHFFSNVCELDLVFNFHKVYLILDEFILAGELQETSKKAIIERMGELEKLD

SEQ ID NO: 137752 - protein, 512 aa, Triticum aestivum
  unsure (1)..(512): unsure at all Xaa locations
  Clone ID: PAT_TA_32170.pep
MAAEALPRAAAPARRPSVAAASASRLLLGHRPFLAPSASRFAAGRAAVAGPAASLRPRPRRPRLSVVAMAGNDRQVPLEDYRNIGIMAHIDAGKTTTTERILYYTGRNYKIGEVHEGTATMDWMEQEQERGITITSAATTAVWDKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVVDLIXNEAIVWTGEELGAQFSYQDIPADLEELAQDYRLQMIETIVELDDEALEGYLEGKEPDEATVKRLIRKGTIGASFVPILCGSAFKNKGVQPLLDAVVDYLPSPLDLPPMKGTDPDDPELILERRPSDDEPFSGLAFKIMTDPYVGSLTFVRIYSGKLIAGSYVLNSNKDKKERIGRLLEMHANSKEDITVAVTGDIVALAGLKDTITGETLCDPDNLVVLEPMEFPDPVIKVPVQPKPIADADMTANGSGVLPHTETTSFRG

SEQ ID NO: 137753 - protein, 123 aa, Triticum aestivum
  Clone ID: PAT_TA_32171.pep
TAGPGGSAGNKFRISLGLSVAATLNCANNTGAENLYIISVKVIKGRLNRLPSACVNDMVMANVKKGKPHLGKKVMPSVIVRQRKPWRRKDSVFMYFEGAGAAERTVTGVIQGEVHCQVVRYQA

SEQ ID NO: 137754 - protein, 403 aa, Triticum aestivum
  unsure (1)..(403): unsure at all Xaa locations
  Clone ID: PAT_TA_32172.pep
AVAFVALLVLGVGSSDDTPVEQPKKLYISPPNAKRFQLPDGRHLAYEEKGISADRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMANPYDSKMTKDEKRKIWDRWSTKRKLMHILARRFPSLLRLFYQGSFLSGKQGQTESWLSLSMGKKDKTLLEAPTFNTFWEKDVAESVRQGDAQPFVEEAVLQVSDWGFSLSDIQMQKKEDQGVFEFMKSLFSQAEREWVGFLGPIHIWQGMDDRVVPPSVTEFARRMVPGATVHKLLDEGHFSYFCFCDECHXQIFSTLFGTPQGPLNPAPESSEVAPEPAEETSPAYDEEVAEQEQETSGLA

SEQ ID NO: 137755 - protein, 180 aa, Triticum aestivum
  Clone ID: PAT_TA_32173.pep
LMRRCRDAGDRRRHRGSPGRHRRRSLRPVVEYQNAAVADHQDDTSFPSLHHTPPARSRRASIAIDDPLHPTCPGPDAATYQAPPQLHRSKVQRVPSPLIYDCGSRRVCGTGGERSRLVEKLIHDVCVSPWSSGVSSRRSGVPGPYSLQGACRMVWQNGVTSQGFLSRPHTVEPPAYPSHR

SEQ ID NO: 137756 - protein, 85 aa, Triticum aestivum
  Clone ID: PAT_TA_32174.pep
GSAEGRKVGFIPPGGFLMSLLSDVPPNAPHHQKSSNHPGGGSGHIRSDAWAAGRFNQSQQHPGRNSSGPGSSASQSFKRQRDAAR

SEQ ID NO: 137757 - protein, 107 aa, Triticum aestivum
  Clone ID: PAT_TA_32175.pep
LPLSSPDLRRRRKQFISMAATALRIGGRAVRPSLAAAAAQQNHPTTFRLFHSTVKEELYRMMSENRDKIGNQKGLIKHLSSHVEPKPEDPVLALLSQGKMVPFSHDV

SEQ ID NO: 137758 - protein, 154 aa, Triticum aestivum
  Clone ID: PAT_TA_32176.pep
YTGELAGRAVASSSSPSASLASLVGPVDDDEPFCDKEEGPIELKQFDAKRVNNVLILMSDTSGGHCASAEAIKDAFRIELGDDYRVFVKDLCKDHAGWPLNNMESSYKFMVKHMQLRKVAFHGTSPKFFHNFYLAALASFYSKERVQSRGGGGV

SEQ ID NO: 137759 - protein, 48 aa, Triticum aestivum
  Clone ID: PAT_TA_32177.pep
SPAPTARSGWTSLGRPRKAARVIKTSRSLDFYVLYCKNATPMKLLTFF

SEQ ID NO: 137760 - protein, 320 aa, Triticum aestivum
  Clone ID: PAT_TA_32178.pep
FCIGRMTDSFSEYRKLGSGSYGEVYMGESKDGKKIAVKMLHDTIGLNNDQFDTECLNLASLRHHNIVQLVGYCHETRREYVRHDGKLVPAHGTKRALCLEYMNNGTLEKFLSDESKVHDWCTRFSIIKGICNGLKYLHKDLESPMYHLDLKLANILLNENMVPKIADFGLSRLFEGQKTQRTKSIIGTRGYLPPEYRNGEIISNKFDIYSLGVVIIKIMTGPRGYFSSAEIPSWEFIKNVHEEWRKRLQVTSEYLLESYSKQVKRCIEIAVSCLETDRNKRPSIWDIVHELNKTYTMLQFGSGLTNDQGLSFSSIDQSPR

SEQ ID NO: 137761 - protein, 123 aa, Triticum aestivum
  Clone ID: PAT_TA_32179.pep
MGDLQIVLAGGTIEAQHVEMKVPLYSYGCEKKIKKALSNLKGIHSVQVDYHQQKVTVWGICNRNDVLAAVRRKRRAARFWGADQPDLGEDARLLGDAPKHYLRAFAAYRSRKSWKKLFPMIRL

SEQ ID NO: 137762 - protein, 87 aa, Triticum aestivum
  Clone ID: PAT_TA_32180.pep
MGDLQMVICRSCFEGEHVEMRVPLYSYGCEKKIKKTLSNRKGILSVQVDYHQQKVTVWGICNRNDVLAAVRRKRRAARFRGTDEPGG

SEQ ID NO: 137763 - protein, 239 aa, Triticum aestivum
  unsure (1)..(239): unsure at all Xaa locations
  Clone ID: PAT_TA_32181.pep
TSPHPXDFPDELLYLMRDRYNICKLIHLPAQSGSTEVLERMKRGYTREAYLELVQKIRNVIPDVGLSSDFISGFCGETEDDHADTLSLVRDVGYDMAYMFAYSMREKTHAHRNYEDDVPNDVKQRRLAELINTFRETTRKIYDSQIGTTQVVLVEGPNKRAPETELFGKTDRGHRVSFTSLPVPHTSEGDGARKPVVGDFVEVKILRSSTASLSGEPIARTSLGMYCKNHASDAHVVGA

SEQ ID NO: 137764 - protein, 361 aa, Triticum aestivum
  Clone ID: PAT_TA_32182.pep
MMGSSRRRGDRQLQFQLLHRLLALSSLLLLASGEVIFEERFEDGWETRWVKSDWKKSEGKAGMFKHTAGKYSGDPDDKGIQTTIDARHFAISAKIPEFSNKGRTLVVQYSIKFEQEIECGGGYIKLMSGYVNQKKYSGDTPYSLMFGPDICGTQTKKLHLILSYQGQNHPIKKDLQCETDRLTHVYTFILRPDASYSLLVDNRERESGSMYTDWDILPPRKIKDVGAKKPKYKDDREYIDNPDVEDDPDLYVLKPLKYIGIEVWQVKAGSVFDNILICDDPEYAKQVADETWGANKEAEKEAFEEAEKERKAREDKEAQQAREEGERRRRERGDRHRGRDHYKDRYKRRNRDHWDDYHDEL

SEQ ID NO: 137765 - protein, 248 aa, Triticum aestivum
  unsure (1)..(248): unsure at all Xaa locations
  Clone ID: PAT_TA_32183.pep
MLPSRSLLPPHCPTAPAPTPTPTPPGGARSPSSVALRFGSPGGVRLRRGRGSAAVAMASDGRVERIASSIRAIXPNFPKPGILFQDITTLLLGSAGHSGDTTDLFXSERYKDKDITVVXGVRKPEEFIFGXPPIALANXGAKFVPIRKPKKXLPGEVISEEYSLEXYGTDKIEMHVGAVQPNDRXSLIVDDLICHRGNPLCRCQTLLSVVGAKVVECAXVIELPELKGRDKLGDMPVFVXLVQADESV

SEQ ID NO: 137766 - protein, 275 aa, Triticum aestivum
  Clone ID: PAT_TA_32184.pep
MFEGMEGMSYGGGAAGAGAGAAALSPRDPKQRLRWTPDLHDRFVHAVARLGGPDKATPKGVLRLMAMKGLTLYHLKSHLQKYRLGKQSKKSTDLELANSGDFTTQDINFQIGAPLVVPAERDTGREIPLEDTLRYQIQVQRELCEQLEVQKKLQMRIEAQGRYLKEILEKAQENISFDANGSVGLENTRSQLTDFNLALPGLSDNGTQVYEESGEQLVKHMSDDNLHDNNLDFQLYRVRSQEAKSVECTPKTEDLLLLDLNIKGGYDLSSRGMQG

SEQ ID NO: 137767 - protein, 364 aa, Triticum aestivum
  unsure (1)..(364): unsure at all Xaa locations
  Clone ID: PAT_TA_32185.pep
LMKATMDSIFTIAVGVDLDTLSGSEEGSRFAAALDDASEFTLLRFVNAFWKVSRFLNVGAEAALRRRIEVVDKFMYKRIRARAEEISDGDIGKAHDTVSKDDLLSRFIQATTSDAGEVDYKHLRDMILNIVMAGKDPTAGALAWFLYMMCKHPEVQEKISEEAADAGEATSSIDDFSRSLTDEALNKMHYLHAALTETLRLYPSLPLVNKEIFSDETSHNALAVGKGDIVFYAPYAMARMERLCGEDAIAFRPERWLDERGVFXAGEPFQXTAFQAGPRICLGKEFAYRQMKIFAAVLLRFFVLALHDKDASVNYRTMITLYIDQGLHPDGYGQRHRVATFVLKIRVRTRLNISSSETRDMSQV

SEQ ID NO: 137768 - protein, 354 aa, Triticum aestivum
  Clone ID: PAT_TA_32186.pep
MTAAPAITRPATVATTRRSFTALPTHGICKASIPTRPAMERIWSLELFHKRVSWDLPRFVKVVEVGPRDGLQNEKNIVPTSVKIELIHKLVASGLSVVEATSFVSPRWVPQLADAKDVLEGIQHAPDVRFPVLTPNLRGFEAAVAAGAKEVAVFASASESFSKSNINCTIEESLARYRDVTSAAKKHGIRIRGYVSCVVGCPVEGAVHPSKVAYVAKELYDMGCAEISLGDTIGVGTPGRVVPMLEAVMAVVPADKLAVHFHDTYGQALANILVSLQMGIGVVDSSVSGLGGCPYAKGATGNVATEDVVYMLHGLGIETNVDLGKLMDAGDYICKHLDRPSGSKTATALCRLTA

SEQ ID NO: 137769 - protein, 212 aa, Triticum aestivum
  unsure (1)..(212): unsure at all Xaa locations
  Clone ID: PAT_TA_32187.pep
LSQIRNEKARRYLTGMKRKHPIPFPSIFCNADPQAVRLLERLLAFDPKDRPTAEEXFPNLEHEPSPHPFSKLEFEFERWKLTKDGVRDLIYREILEYHPQMLQDYIRAGGQTSFVYPSGVDGMRLQFVHLEENHLRGERGTPLRRRHASLPRERVCAPMGIDNQDCNNERRTASSAAQITIRSQQEGXDTCICLSKWHRHSGLLLRVLLAEW

SEQ ID NO: 137770 - protein, 109 aa, Triticum aestivum
  Clone ID: PAT_TA_32188.pep
MVTSMARGLTIVVFLLVFVAATISSTYAVKLQADDSPNVAEGPADTSSEAEGPADNSSEAEGPDGPAFVEMVIKNPYPASSLNSRSDGLPVDPTPDGLPVDPTPDGQFK

SEQ ID NO: 137771 - protein, 104 aa, Triticum aestivum
  unsure (1)..(104): unsure at all Xaa locations
  Clone ID: PAT_TA_32189.pep
MMSLKPSASAAAEGCRIASTPRSALTARSTPLQVINILGNFVRIWSVYSLYSHLSSTGDSIVXFIFNCLVPXSVIFLILQXPWKGRLXXSXIVPXSVNGGFRYT

SEQ ID NO: 137772 - protein, 285 aa, Triticum aestivum
  Clone ID: PAT_TA_32190.pep
MIGSTISKTCRSTKGSRTLSPPCISRLRVRDSVGLRARLLTRCPPHLVAALVGIGHTSQILMCQPGALSWSVRAYDQCKDFEDMSFYQGKLYAIAKDENLLVVNISQDHSTGDPQVSRIGRVIKGDSPPWYDAVFEDNSSAFKKLYLVESRGMLLMVRRTIWCQFPEPGEDDKVIAGKNEFEVFQADFEHSRWVKVSTVGDDQVLFLGRKCSRSMSVSQYGLPGDRIFFLDDDEDNRIEYAYEEENTSFGVYSMRSRSIRSGDPNISWKRCAEMYLAAWLFPQDR

SEQ ID NO: 137773 - protein, 99 aa, Triticum aestivum
  Clone ID: PAT_TA_32191.pep
LKFNCPQSVGVSSLAPLDTVTPNAFDNAYYSNLISQKGLLHSDQVLFNGGGADNTVLSFASSAATFNSAFTTAMVKMGNIAPKTGTQGQIRLVCSKVNS

SEQ ID NO: 137774 - protein, 233 aa, Triticum aestivum
  unsure (1)..(233): unsure at all Xaa locations
  Clone ID: PAT_TA_32192.pep
MASASCLGLVVLVAMASAASAQLSSTFYDTSCPNALATIKAGVTAAVQNEARMGASLVRLHFHDCFVDGCDGSVLLADTGSFIGEQGAAPNNNSIRGMNVIDNIXKTQVEAVCKQTVSCADILAVAARDSVVALGGPTWXILLGRRDSTTASKTNAKKDLPPPTFDLPNLPTLLSNKQISTTDVVTLSGALTTALSQCGXHRDQNRDATDIHTPFVTSSTPNRLADTGLLRMN

SEQ ID NO: 137775 - protein, 393 aa, Triticum aestivum
  unsure (1)..(393): unsure at all Xaa locations
  Clone ID: PAT_TA_32193.pep
MAAALAPGVSRKLKKVLETRTDSPDLLASLGALSTFYEHNTPQARRNLKSSVEQRALAINRHFLDASLPAQKALDRVEGEVHALDDSWKKIEEALSSCSASTGDIISTTERLQQELEVITQRQEIVSCFLRDYQLSNEEIHALREEDIDEKFFKALLHVQEIHSNCKVLLRTHHQRAGLELMDMMSVYQEGAYERXCRWVQVECXKLGDTDNPEVSELLKKAVRCLKERPVLFKYCAEEVANMRHHALFRRFISALTRGGPGGLPRPIEVHAHDPLRYVGDMLGWLHQALASERELIAALLDPDAISDSGPANRRHSVREGDSSKGESDFTFVLDRIFEGACRPFKVRVEQVLQSQPSLIVSYKLSFIFXFVPLLLSSFFPLCPPSLFFTCLF

SEQ ID NO: 137776 - protein, 166 aa, Triticum aestivum
  Clone ID: PAT_TA_32194.pep
DKINPRYIPLLKETFTFPQSLGILGGKPGASTYIAGVQDDRALYLDPHEVQMAVNSAALCLGAAPPSYLGRAVRVSPRPPSVPSLATAWYCRVRDDCVVFCSRASELAEQANGAPLFTVVQSVQPSKRMYNQDDGSGCSGYGVSDNIDAEDLDGSGETGEDEWQIL

SEQ ID NO: 137777 - protein, 245 aa, Triticum aestivum
  unsure (1)..(245): unsure at all Xaa locations
  Clone ID: PAT_TA_32195.pep
MPPRTHRPQEAPENTSPSWRRREDEGGGGMGRGKIEIKRIENQSNRQVTFSKRKNGILKKAKEISVLCDAEVGVVVFSSAGKLYDFCSPRTSLSRILEKYQNQSXGKILWGEKHKPLSAEFXKIKESESXHTDRSSLQLGDVDSSRTTLQPIKELXIMILREALDNGLTSLHEKQMEHYDRLVKHGKMLEDENKLLAFKVHQHDIALSGSMRDLELGYHPDRDFAAQMPITFRVQPSHPNLQEDS

SEQ ID NO: 137778 - protein, 393 aa, Triticum aestivum
  unsure (1)..(393): unsure at all Xaa locations
  Clone ID: PAT_TA_32196.pep
MDARRDDEEEAAAPLLAAPAPRSHAADVHVLSAAFVCLFSAYSAAQNLQSTVNTDGNLGSISLGLLYTSFTAFSVVGSPVVRAMGSRRALVLGTSGYLLFIAANLAPSWYTMVPASLYLGFTASIIWVGQGTYLTSAALSHARDNNLPDGPTLGSFNGEFWGVFASTQVIGNLISLALLRNGKDGGSVTGKNLLFVVFLGCMIIGIVLMCLLSKRDEKRDNASTHSSFGSMLKYIVAPLXDRRMILLIPPIAYSGLQQAFVWAVPTXSIVTPVLGISGVGGAMAIYGASDVVCSLVAGRFTSGLHSATFIVSVGAIVQAVVLFWLLLFYSPMEGLLGSAIPLFIGALWGVGDGVLNTQLSALLGLLFXDVXEAAFAQVXKVWQSXAIAVXLPS

SEQ ID NO: 137779 - protein, 183 aa, Triticum aestivum
  Clone ID: PAT_TA_32197.pep
MINLFKIKGQKKEEAANSNGGPPVKKQSPGELRLHKDIAELNLPKTTKISFPNGKDDLMNFEATLRPDEGYYLGGSFTFTFQVSPSYPHEAPKVKCKTKVYHPNIDLEGNVCLNILREDWKPVLNINTIIYGLNLLFSQPNDEDPLNHEAAAVLRDNPQKFQRNVQMAMSGGYVDNTHFPRCK

SEQ ID NO: 137780 - protein, 111 aa, Triticum aestivum
  Clone ID: PAT_TA_32198.pep
RTRKNFNRRGRQALVIGPISQGSSKVFCVQLRFRLIAQLPLNATLRSLKDVACTQEMYPICVRRDCYYACLVDVPESCMLKKHAKQKQKPAPVIQLKSWRKCSKRSSVISI

SEQ ID NO: 137781 - protein, 239 aa, Triticum aestivum
  Clone ID: PAT_TA_32199.pep
PALVKLLSSKDPKTQEHAVTSLLNLSIYDQNKELIVVGGAIVPIIQVLRTGSMEARENAAAAIFSLSLIDDNKIMIGSTPGAIEALVELLKSGSSRGRKDAATALFNLCIYQANKVRAVRAGILSPLVQMLQDSSSAGATDEALTILSVLVSHHECKTAIAKAHTIPFLIDLLRSSQARNKENAAAILLALCKKDAQNLACIGRLGAQIPLTELSKTGSDRAKRKATSLLEHLSKLQVL

SEQ ID NO: 137782 - protein, 189 aa, Triticum aestivum
  unsure (1)..(189): unsure at all Xaa locations
  Clone ID: PAT_TA_32200.pep
MSRLSMATLLLLSLALATAPRLAVVEAVVVEGLRVGFYNRTCPDAEQVVRDVVMNDYAMDHTIAPGLIRIFFHDCFITGCDASILLDESPSGDIPEKESSANGFTLHGLQTIDVAKASIEAMCPRTVSCSDILSFAARDAAVAAGLPSYEVAGGRRDGTHSRMDDLPGNXPVPGHTVPGAEAVREPGPV

SEQ ID NO: 137783 - protein, 306 aa, Triticum aestivum
  Clone ID: PAT_TA_32201.pep
RGRVGNGALEFLNEQNRGPRAAKPKKQDRDNSLVDDKSEKTTQLIDSELYNCPDFATEYKDAIFFVIKSYTEDHVHRSIKYNVWASTASGNRKLDSAYRAAKQKEDHCRVFLFFSVNGSGQFCGVAEMIGPVDFDRSVDYWQQDKWSGQFPVKWHIIKDVPNTLLRHITLENNDNKPVTNSRDTQEVKLEYGLQMLSIFKNHEAETSIVEDFYFYEQREKALKENRRQQQPGSAESLKPTDAKAVGNSVTHIADSFSRSVQLKEIEKSDNKLTADGAISVNDAQTATVKAEESNANKTKGPVEESS

SEQ ID NO: 137784 - protein, 191 aa, Triticum aestivum
  unsure (1)..(191): unsure at all Xaa locations
  Clone ID: PAT_TA_32202.pep
LXWXQXTGGPRPGARQNRRERKSEGNTGEHGSAGRRIRGGDLARDRHEARLCPYARTHTKHPSVPRFLSQQGLFIDGRSFRRRRHAAEQLVRDVVGGPVGHRRRPEPAGARRRQRWRRRQEGRRGEDQGGRGHRAEEGQGRHRAGVPVDQGQVPEEERRQERQAGRRLRGGRRVLTGHLRRLDMYGIVMDR

SEQ ID NO: 137785 - protein, 68 aa, Triticum aestivum
  Clone ID: PAT_TA_32203.pep
VARRVHTSIDLISTMHHAHPSNISDILLRSDSIAYIGSGHARSAWIMDGIKGRPVRGRRCRRRRREAR

SEQ ID NO: 137786 - protein, 105 aa, Triticum aestivum
  Clone ID: PAT_TA_32204.pep
LPWRRSPGGLRPGFSRPSPTPSASSPTSTSLTPSSPAPSAPTLCACKPTVPSSSPTTACSSCLSASSSASASAHSSSLDSIHDPCRASMTATYICYGVRYSSLAI

SEQ ID NO: 137787 - protein, 197 aa, Triticum aestivum
  unsure (1)..(197): unsure at all Xaa locations
  Clone ID: PAT_TA_32205.pep
HIGPATIRITGAPKLELLGLLSHGISTLKPGTTVLQKTIDVSLTTIMHKVKILVVDSIGPNLDAIVGLLKCFTFLERLYVISHPQEDMNNVRXYDPLGSIECLEVHLKKVGLKNYDGNRTQVNHIAQFFVLNAKVLMEMEIGVVNRCNSKWMRFQRKRLQVENRXSRDAQIELKWDTKKSFKYHGFSEADPFDMSSC

SEQ ID NO: 137788 - protein, 105 aa, Triticum aestivum
  Clone ID: PAT_TA_32206.pep
EFEFNSKFTDKMRRIKIPLPPVDEKKKVVEDVDKDRRYAIDASIVRIMKSRKVLGHQTLVMECVEQLGRMFKPDFKAIKKRIEDLITRDYLERDKENPNVYRYLA

SEQ ID NO: 137789 - protein, 168 aa, Triticum aestivum
  unsure (1)..(168): unsure at all Xaa locations
  Clone ID: PAT_TA_32207.pep
RKPWRRLDGAGNGAGEEAGGAEFYLRYYVGHKGKFGHEFLEFEFRPDGKLRYANNSNYKNDTMIRKEVFVSPSVLREARRIIQDSEIMKEDDSNWPEPDRVGRQELEIVMGNEHISFTTSKIGSLVDVHDQQWTRMGPTAIFYYLVXDLKCFVFSLINLHFKIKPIQL

SEQ ID NO: 137790 - protein, 100 aa, Triticum aestivum
  Clone ID: PAT_TA_32208.pep
FVRVDPVPGSFLVNIGDVGTAWSNGRLHTVKHRVQCVAAVPRISIAMFLLAPKDDRVCAPEAFVDPQHPRRFKAFNYDDYRKLRLSTGERAGEALARMAA

SEQ ID NO: 137791 - protein, 298 aa, Triticum aestivum
  Clone ID: PAT_TA_32209.pep
MVEIPVVDLRLAGAQPEESARLRDACERLGCFRVYGHGVPAALQAEMKAAVRALFDLPDEAKRRNADIIAGSGYVAPSPANPLYEAFGLLDAAAPVDVDAFCARLDAPPRARETVKSYAEAMHELIVDVAGKVAASLGLEGHPFQDWPCQFRINRYNYTQDTVGSSGVQIHTDSGFLTVLQEDDCVGGLEVLDPATGEFVRVDPVPGSFLVNIGDVGTAWSNGRLHTVKHRVQCVAAVPRISIAMFLLAPKDDRVCAPEAFVDAQHPRRFKAFNYDDYRKLRLSTGERAGEALARMAA

SEQ ID NO: 137792 - protein, 133 aa, Triticum aestivum
  Clone ID: PAT_TA_32210.pep
HRTQTKQWNPLVMISSITDNCIPAIVCSQHTRLVNRNRLCCYRSSHTFPITDLSAAYHTHLVKLNRFCSLGSTQTVHPSELYAVYRTHLYLAARFCCSASSQIVHSSEPYALHRTRLHMAARFFCSSSSQTVN

SEQ ID NO: 137793 - protein, 163 aa, Triticum aestivum
  Clone ID: PAT_TA_32211.pep
MANHGDLSPPADGGSQELIPVIYQSPYSMTPQGPPCSWLFYYRPVPLGGFRRPVYEDGTTRVLCLSQMFSPDQLEDDEYYQKFCRRMTAEGQRSGGKLRRTVVPRPDPSGAPVAGVGKVFLEYADIDSAAYSKTMLHWMWFEGRQVFAVFYPEDKFAAGDYDG

SEQ ID NO: 137794 - protein, 176 aa, Triticum aestivum
  unsure (1)..(176): unsure at all Xaa locations
  Clone ID: PAT_TA_32212.pep
XDLNFQLQNETXXKEARLLVGRRLSYSVKKDGTSNNHNEEEQYITLVRTSPDYPDGRATALLNWKLLAMEFLPKEDAVFVLLLCMAITRTMTEIRREDVAGLLVRRRIREPQVGQRDWGSVMLPHSPSLDPHLQPWYRNAARVLSSAETVLPNRAMPIGNSPTDGKDELYRQALIP

SEQ ID NO: 137795 - protein, 196 aa, Triticum aestivum
  Clone ID: PAT_TA_32213.pep
MGAKLSCFSNHGGSLSQQPHQPAPVRVVAADGSLKELPASPRVTVSDVLGGSAASFFVCNSDALYFEQSPPALASGEVLRPGQIYFVLPAALLGRPLSSAEMASLAVRASSAIAAKKPQRRRGRRSGGRKKVRVMPVREEVEDGEDVLLNEKLNERTLGEFAVSPMSPEKIGVVAARSRLKMKLKRALSIIQEVAE

SEQ ID NO: 137796 - protein, 190 aa, Triticum aestivum
  Clone ID: PAT_TA_32214.pep
MGAKISCSSIHRGTLSQQPHHPAPVRVIAADGSLKELPASPRVAVSDVLAGEAASFFVCNSDALYFNEPPPALASDELLRPGQIYFLLPAAELGRPLSSADMAALAVRASAAIAAKSPEQRGGKKNLRVVPVREEVEDCEDVMFNEKLNERTLGEFAVSLSPAKKSNGKLAARSRLRLKRALSIIQEAAD

SEQ ID NO: 137797 - protein, 202 aa, Triticum aestivum
  Clone ID: PAT_TA_32215.pep
MALLPRTARLALLSASPRTYSAAAAAGASPTPPAPYAGVPPPAAGSKAAEFVVSKVDDLMNWARRGSIWPMTFGLACCAVEMMHAGAARYDFDRFGVIFRPSPRQSDCMIVAGTLTNKMAPALRKVYDQMPEPRWVISMGSCANGGGYYHYSYSVVRGCDRIVPVDIYVPGCPPTAEALLYGVLQLQKKINRRKDFLHWWTK

SEQ ID NO: 137798 - protein, 138 aa, Triticum aestivum
  Clone ID: PAT_TA_32216.pep
QRQHYSRQVIGGEITLNNCPSVLEEKCSKNEHDAAPLGVLSGISKDHEYSNKGPQNLRIPVDSASSDDLAFANGKADNSDFADEDEPSEEITVSATEPTTGALEGRDEHDEDTDDEDEEEEEEEKSSSAKKLWRFLIT

SEQ ID NO: 137799 - protein, 218 aa, Triticum aestivum
  Clone ID: PAT_TA_32217.pep
YKGPNTQLITMFQHQTAGEYRIMMGTDVRIQRDPLAMRMREDQIKQIWGGDPVYPTVNYVQDPDEVIDYRSPEFHEPTPEVVPYLMEHGIMITKEELDARLMEEEEDINQDITYIPEVKDPMSTAVDIGEHSFNEDSDDDEEVDKAVTLPESLEDEEEGGDEAAEVEGKVSQNWSVLKTTGQDEKPKEKLKKDQMSLKDAINESENLTDFLMDFEEDE

SEQ ID NO: 137800 - protein, 81 aa, Triticum aestivum
  Clone ID: PAT_TA_32218.pep
GEIREFSKAATCLDIKNYSSWHQINISSDRPPVYNAASVIIVYVCSTHSIYSVIIPSMQWMQHLLLALPSHLNSGSMRLSP

SEQ ID NO: 137801 - protein, 292 aa, Triticum aestivum
  Clone ID: PAT_TA_32219.pep
SGRQGDPGSSRFFLSLEDNIFRIFGGDRIQGLMQAFRVEDLPIESKMLTRALDEAQRKVENYFFDIRKQLFEYDEVLNSQRDRVYAERRRALASGSLESLIVEYAELTMEDILEANIGPGTPRESWDLGKLIAKVQQYCYLLNDLTPELLESKCSSYEDLQEYLRTRGREAYFQKAEIVEKQAPGLMKEAERFLILSNIDKLWKEHLQALKFVQQAVGLRGYAQRDPLIEYKLEGYNLFLDMMAQIRRNVIYSVYQFKPVMKKQEEESSEKKDPKKNLQKGAKKLGAAQAAS

SEQ ID NO: 137802 - protein, 302 aa, Triticum aestivum
  unsure (1)..(302): unsure at all Xaa locations
  Clone ID: PAT_TA_32220.pep
RVLPTPSXGNXVFKDLPVEFSQKIVHALQMKSRTPSNFTRVLADALAAIGDNMVVIGSPKGPVICRNLNAYMISKEDLHDVPKIMALLCSEERSSVQETLLPEKSDGDKSGNVISGNIPKAVQDNEMEHRSKIDIVEILFEKLEILKADKDGLKDPRRVIEYLISALPWLEGGRLAAIDKRLLEDVRRICSEFENGSDRAQRNACLAVEKLWKGEKKLPMIFRMVTDARLCKIENQATFQRMDDRSNDAAMAAVETHADADGCSDDDDKPDTGEAAASTSKKGAQKQKSKKKSKKSKGRGKK

SEQ ID NO: 137803 - protein, 151 aa, Triticum aestivum
  Clone ID: PAT_TA_32221.pep
PRTVRLTPRSPREERPDKAETAEDKAAEGAAPPPAQPAGVLPRGWRELQVRVRRVLHERVAYHVHVPAASGPVRGGVSLLGRGVLGRRDDVAEAGVSPLLAAGDLDLRRHPPPLHPGRATLLGRAPVPELEVAGGSTRPVRQPVPPPQRRP

SEQ ID NO: 137804 - protein, 412 aa, Triticum aestivum
  Clone ID: PAT_TA_32222.pep
RAPVVLLPGAMAAALAAPTGLLKLPPSYAPPSSPSSPLSGTSYGRRSRRRPRLCRRGAPLLAVAAGEVSYTEPEEALLEALVGVQGRGRAVAPRQLQEVESAVQTLEALEGVPDPTSSSLIEGSWKLIFTTRPGTASPIQRTFVGVDSFSVFQEVYLRTDDPRVVNVVKFSETVGELAVQAEATINDGKRILFRFDRAAFAFKFLPFKVPYPVPFRLLGDEAKGWLDTTYLSRSGNIRISRGNKGTTFVLQKSADPRQMLLSAISAGTGVKEAIDDLTSSKKGVVVDMNTLAGEWQLLWASQSESGGGSWSSVASAGLKDFQTIKEDGQLKNLVNPFPGVSLSARGNICKTGNNNDTFSVSMNEGVIQVGGIQFPLETGGEYVMEILYIDNKIRISRLNQYKLVHLRIVNKT

SEQ ID NO: 137805 - protein, 117 aa, Triticum aestivum
  Clone ID: PAT_TA_32223.pep
RPRGRRPMLVKARCSFFLLFLKFKGNQQHTPSSRRMVLLFSDGWMDGWMGWSWRRRTTRRIESRLFSSLHQCRPGTTTQPPLKGRCLCLLVLERELEVVCQLKLGAARHQGEAQGGA

SEQ ID NO: 137806 - protein, 134 aa, Triticum aestivum
  Clone ID: PAT_TA_32224.pep
GRGLWIRRLQLVVPIAAARHLFLFPDKDVRQRKVKPDLAKSDLSFSFCQRRQICLTRTYSPAPGASRSSGIEVYRPSRLGAASSSYVRPIWIGSARGRGGNFPSRHSPSTLRAEGRGRSMAAAGGPNLAWGHAG

SEQ ID NO: 137807 - protein, 126 aa, Triticum aestivum
  Clone ID: PAT_TA_32225.pep
APTDGVWAPAWAKENAASDAASVVLLGNRLSQVVDALSLSKATMAKVHQNLAWAVAYNIVAIPVAAGALLPQFDFAMTPSLSGGLMALSSIFVVSNSLLLQLHGSFQKAERPGPDDLKSRPNSQIL

SEQ ID NO: 137808 - protein, 167 aa, Triticum aestivum
  Clone ID: PAT_TA_32226.pep
METELSLALGRPETGDSGAAGRGAGNGGKADDEVQPLFPCLFCDRKFLKSQALGGHQNAHKEERAAGWNPYIYGRYPVANPTSSRAAASKKSIPMATHGGGGAAAAPPLHVVREAGTLAPSVHGVRAGAGPFYGVHDDVGDMLSSERSPAAEPESNTGVGIDLELRL

SEQ ID NO: 137809 - protein, 108 aa, Triticum aestivum
  Clone ID: PAT_TA_32227.pep
PHIVHAYNLSQPAKATIMASMARAARLLLVALLVISAAVTGCHGYSIGGPGLIPEPRSGHGRPFDPLYPRPCRGLRCRTLPPRGRGGAPYPYGGPPPPPPPPDNGGQP

SEQ ID NO: 137810 - protein, 118 aa, Triticum aestivum
  Clone ID: PAT_TA_32228.pep
LNAATPPRRAAPRCRAMQLPRASSRCSPPCSSPVLSSGPKNHLFPYRSVGHGDEGGDERACCHGELNTLRQIPSPNSAPDDSSLLGLPPMDEEEDDECCLAEFFRLLPGAVQGDGKLS

SEQ ID NO: 137811 - protein, 81 aa, Triticum aestivum
  Clone ID: PAT_TA_32229.pep
KERITFVLKGKSQHTALWITFPKKKKLLDALIKLPTSKNKKKGIIDNIYFPSYTLQSHIRTDIHIINNKSRRMHACMHVPN

SEQ ID NO: 137812 - protein, 507 aa, Triticum aestivum
  unsure (1)..(507): unsure at all Xaa locations
  Clone ID: PAT_TA_32230.pep
EFGTRELSPPPVKSPPPPAPVHSPPPPVKSPPPPAPVSPPPPPVKSPPPPAPVYSPPPPVKSPPPPAPVSSPPPPVKSPPPPAPVSSPPPAPKKPPPTETPVIPPKEKSMPPPTPAKSSPPPTEKYEPPAKPVESSPPPVKSYPPKEPTPEKSSPPPVKSYPPKEPTPEKSSPPPVKSTPPPTPVSSPPPVPVKPPPAQVSSPPPAPVKVLPPPTPEKALPPPVLAKPPPAPVSSPPPAPVKVLPPPAPEKVLPPPVPVKPPPAPVSSPPPAPVKVLPPPAPEKVLPPPVSVKPPSAPVSSPPPAPVKVLPPPAPEKVLPPPVPVKPPPVPVSSPPPAPAKAPPPPAPVXSSPPPPXRSPPPPAPVSSPPPPVKSPPPPAPVSSPPPPVKSPPPPAPVSSPPPAPVKPPPAPVSSPPPPVKSPPPPAPVSSPPPLVKSSPPPAPVNSPPPAPVLLPPPAKSTPAPVKEEPQSPPAESLTPPKFDEFIMPPVVSAKYASPPPPQFQGY

SEQ ID NO: 137813 - protein, 68 aa, Triticum aestivum
  Clone ID: PAT_TA_32231.pep
MSSSEEKTSWPEVVGLPVEEAKAIILRDKPGADILVLPVGSSSDTQFIANRVRIFVNGTTVAETPIVG

SEQ ID NO: 137814 - protein, 68 aa, Triticum aestivum; identical to SEQ ID NO: 137813
  Clone ID: PAT_TA_32232.pep

SEQ ID NO: 137815 - protein, 292 aa, Triticum aestivum
  Clone ID: PAT_TA_32233.pep
MVFGARPVAKMISVPMVMSYHTHLPAYLPGYNLNWLLGPTWGLIRCLHRSADLTLVPSVAIAEDFETAKVVPANRVRLWNKGVDSESFHPKFRRHEMRIKLSGGEPEKPLIIHVGRFGREKNLDFLKRVMEKLPGVRIAFVGDGPYRAELEKMFTGMPVVFTGMLQGEELSQAYASGDVFAMPSESETLGQVVLESMASGVPVVAARAGGIPDIIPKDKEGKTSFLFTPGDLDECVRKIEQLLSSKDLRESVGRAAREEMENCDWRTASKTIRNEHYSTATLYWQKKTGRTG

SEQ ID NO: 137816 - protein, 283 aa, Triticum aestivum
  Clone ID: PAT_TA_32234.pep
ALATIKSAVTAAVRSEPRMGASLLRLHFHDCFVQGCDASVLLSDTATFTGEQGAAPNARSIRGMNVIDNIKAQVEAVCRQTVSCADILAVAARDSVVALGGPSWTVPLGRRDSTTASLSLANSDLPAPSFDVANLTANFAAKGLSVTDMVALSGGHTIGQSQCRFFRSRLYNETNIDAAFATSLKANCPRTTSSGNSSLAPLDTTTPNGFDNAYYSNLMSQKGLLHSDQVLINDGRTAGLVRTYSSASAQFNRDFAAAMVRMGNISPLTGAQGQIRLSCSRVN

SEQ ID NO: 137817 - protein, 183 aa, Triticum aestivum
  Clone ID: PAT_TA_32235.pep
APLWTVPLGRRDSTTASLSLANSDLPPPSFDVANLTANFAAKGLSVTDMVALSGAHTIGQAQCQNFRDRLYNETNIDTAFATSLRANCPRPTGSGDSSLAPLDTTTPNAFDNAYYRNLMSQKGLLHSDQVLINDGRTAGLVRTYSSASAQFNRDFRAAMVSMGNISPLTGTQGQVRLSCSRVN

SEQ ID NO: 137818 - protein, 167 aa, Triticum aestivum
  Clone ID: PAT_TA_32236.pep
MDIISQLQEQLNEMAMVAVNTFGTLQRDAPPVRLSNSYPDPLNPNPNPEGPASQPQAPPAPGAPAAAPLPPQPPQARPQPALDLAEQPKAMSHALVLAAKKFDALVAALPLSSEEDQLKRIQELQAENEVVGLELQKQLEAAELELERVEVLFNEATDNCINLKKPD

SEQ ID NO: 137819 - protein, 133 aa, Triticum aestivum
  Clone ID: PAT_TA_32237.pep
ANNRSSSPHRRLHHLLFPLLPPLPSAANTGSARRTAGRDDASSGVPHDHAAPEEHGVGDALHVVVQVDVDAAAAADAVTAARRRHRHRRPRAPAPRRRRRRTTSNTHPHSVPLYSQSQAPVSFMCKLLVQGRK

SEQ ID NO: 137820 - protein, 219 aa, Triticum aestivum
  Clone ID: PAT_TA_32238.pep
AWASFHPSLPRPSRCYRCRSSSSPPPPPPPPQKQRGAESKRRPIRNPSSPPLLIRSAGGARLLLTRRALATVAVAVAGRARAAEKDGDGGDGGEGVVGAFKSLFDPNEETKAGKVLPKAYLKAAREVVRTLRESLGEGDAAGDSASFRRGADSAKTSIREFIGGWRGQPAVAKEESYVALEKAIKSLAEFYSKAGPFASLPGDVKNKILDDLNAAEAYL

SEQ ID NO: 137821 - protein, 315 aa, Triticum aestivum
  Clone ID: PAT_TA_32239.pep
AARGAARRWSSSPHRQRGSARRRAGFPSPGLRAWPLAAALDPRPAALPPASLASRLHRGARGILGFSLPALESLHVRKYPIGKLRVQPVGIIIFAAVMATLGFQVFFQAVEKLVVNVTPDKLSPPQLMWLYSIMIFATVVKLALWFYCRTSGNNIVRAYAKDHYFDVVTNVVGLAAAVLGDMFYWWIDPVGAIVLAVYTITNWSGTVWENAVSLVGESAPPEMLQKLTYLAIRHDPQIKRVDTVRAYTFGVLYFVEVDIELPEDLPLKEAHAIGESLQIKIEELPEVERAFVHLDFECDHKPEHSILSKLPSSQP

SEQ ID NO: 137822 - protein, 149 aa, Triticum aestivum
  Clone ID: PAT_TA_32240.pep
SPGHGLQPPLKRGEHRGNHGERRGSDVAPSGLLLRWENEYSCGSGWLCTLMNGTPYSIDSLSSGCLTFDLYAPHLRLTIASGESVCSIAHRRYSMNSEDCNVTAAEEYMYITRPHRRHLALSHTLPHGPHRPRNLPLIVKPTKDLLQPS

SEQ ID NO: 137823 - protein, 167 aa, Triticum aestivum
  Clone ID: PAT_TA_32241.pep
QDDEQASYDDNDGEEAPSGQTKEAHVGDQSGQNKQEDGDNAEHHAGAENSAGSAGATRCVELFLGEEGDVRRIALLPQDGGLAQLMDIARSKFPDLKELSVNFKDDRGDLVTVDSTTDQSAWFDEANSRSQGPLRLYVTEGNRERVSCPDQPIREHHSVDPCLSHDQ

SEQ ID NO: 137824 - protein, 119 aa, Triticum aestivum
  unsure (1)..(119): unsure at all Xaa locations
  Clone ID: PAT_TA_32242.pep
DAWAGSVVPSLPSRPQVASPAIHTSATPRRRRPSPPDLRPLRRLAPLPSPPSSRSPLTSLPLXAEQGPPRGPWRRRPSISPDPAASTPNPPKMDPPRPDPPGSDRACRTTPHGVQQLAH

SEQ ID NO: 137825 - protein, 229 aa, Triticum aestivum
  unsure (1)..(229): unsure at all Xaa locations
  Clone ID: PAT_TA_32243.pep
GRACLPCCGYGNLRLSRFGRALFRGIFVQNLQSCNFLLDDNDHAVLGDXGIPSLLFGLPLPNPDLIQRRGTPNYMXPEHWRPDIRGPISYETDSXWGFAWSILEMFSGVQTWCAKSPDEIYQSVVLKKEKPMFLYNLPMEVANVLSGCYEYEFRDHSLMLDILQSFERFLYISFVYPNFLFLTRSALHMHTYMNKPYMICSFTDGLRRSEMYMKEICPRGNNKVIIYFL

SEQ ID NO: 137826 - protein, 153 aa, Triticum aestivum
  Clone ID: PAT_TA_32244.pep
ASPFSTTSRRSQLPPARAPLAPARRLAGDPTPPPRPAAGDLPRWISDLHGVVGLQSRWIRPPPCQIHRKWIHPGQICPDPTGPRRRRHRSAAPKFWFRTALQSLLICGFETHPSRAALRRGTCCSWRADRQPIPLLSQVRFVTSWSTRGRRHI

SEQ ID NO: 137827 - protein, 201 aa, Triticum aestivum
  unsure (1)..(201): unsure at all Xaa locations
  Clone ID: PAT_TA_32245.pep
LRLGHQSYLGIFKVYAPNINKIWSAEPFIGVLLGHLHVAPRGIFVQNLQSCNFLLDDNDHVVLGDXGIPSLPFGLPLPNPDLIQRHGTPNYMXPEHWRPNIRGPISYYTDSXWGSAYSFLEMFSGVQTWCAKSPDEIYQSVVLQKEKPMFLYNLPMEVANVLSGCYEYDFRDHSLMLDILQSFERLEVTHERWQCKIADIK

SEQ ID NO: 137828 - protein, 100 aa, Triticum aestivum
  Clone ID: PAT_TA_32246.pep
QPDHYRHLSECDHHPASASYFQAFLQYATPSLQVTQPSAHHPLAVGDEDRSPRKMSILILISATIFLALFLVTTNVFTVLFKTLVFITNSNCGMVWMGTC

SEQ ID NO: 137829 - protein, 222 aa, Triticum aestivum
  unsure (1)..(222): unsure at all Xaa locations
  Clone ID: PAT_TA_32247.pep
NRTPFYXAESGGQVGDNGFLYVYGEEGGKQNAVIEIKDVQKSLGNMGGHKGTIKQGSVEVGKKIDAAVDGKLRQGAKAHHTATHLLQSALKSVIGSETSQAGSLVAFDRLRFDFSFHRPLTEKELLEIESLVNQWISDATHLETNVMXLQDAKNAGATAMFGEKYGEQVRVVEVPGVSMELCGGXTHVSNTAEIRXFKIISRTXNTSGSQKIXAVXXDAFVE

SEQ ID NO: 137830 - protein, 115 aa, Triticum aestivum
  unsure (1)..(115): unsure at all Xaa locations
  Clone ID: PAT_TA_32248.pep
PXSARXTTSLLGRIGYRAPXSCRTSASSFGTQTQRTENQRIRKEQEEDREAMEYEHQYISSGSFAKEKRPPAKRGQVMMQMARTLSNLVSPSASGAAAADGSKKVSRDSFTREAS

SEQ ID NO: 137831 - protein, 177 aa, Triticum aestivum
  Clone ID: PAT_TA_32249.pep
SSQRPFAQPGASSHHPWRCSPATELQRISDGASTQHPWRCSPATKLQRSIHGARPKLQSSFDRAPVLRWSSVGVASNEASPEPLELYWGCNGARPELQWSSPERHCCAGASSGCNGAHRRPLVLSWSFPLGLQWRCVEAVTLAAACCNPTLPSILIRRLICSIAQKLWKSDNSGRKE

SEQ ID NO: 137832 - protein, 369 aa, Triticum aestivum
  unsure (1)..(369): unsure at all Xaa locations
  Clone ID: PAT_TA_32250.pep
SSGRPGRYFISLVLENLALXTDDNEDILYCLKGWNRAMDMVKQKDDQWALYAKAFLDRTRLALASKGEQYYNMMQPSAEYLGSLLNVEEWAVDIFTEEVIRGGSATTLSALLNRFDPVLRNVAHLGSWQVISPVEVTGYIVVVDKLLSVQNKTYDKPTILVAKSVKGEEEIPDGVVGVITPDMPDVLSHVSVRARNCKVLFATCFDLNILSELQGHEGKVFSFKTTSADVTYREVSDSELSISSDAQGGEAIPSLSLVKKKFLGKYAISAEEFSDEMVGAKSRNIAYLKGKVPSWVGIPTSVAIPFGTFEKILSDETNKEVAQNIQMLKGRLAQEDFSALGEIRKTVLNLTAPTQLVKELKEKMLSSGM

SEQ ID NO: 137833 - protein, 107 aa, Triticum aestivum
  Clone ID: PAT_TA_32251.pep
TTGVSCVYPMSLSLVVGLAELPVLVGCVSYFTFRHGCCWVRRDGVSDLSFALGIFFAILAWLLALWAARLYLVDVAAIWPGRRGKPPECYTSLMTDHRGLVEAGEAW

SEQ ID NO: 137834 - protein, 248 aa, Triticum aestivum
  Clone ID: PAT_TA_32252.pep
PGPASAPRLRVGFRVPSEASSAFVLDEVARAAGGVRRRAATRAASWDSEKSPYETLELERDADEETIKVAYRRLAKFYHPDVYDGKGTLEEGETAEARFIKIQAAYELLIDDERRKTYDKEHFVNPMKASQAWMEWVMKKRKAFDKRGDMAVAAWAEQQQRELTLRARRLSRSKVDPEEERRLLAKERKASMEFYSTTLKRHTLVLRKRDIMRKREEEDKMSEISRLLAAEGLELDTDEDDDDTTFLK

SEQ ID NO: 137835 - protein, 375 aa, Triticum aestivum
  Clone ID: PAT_TA_32253.pep
SSCTQLGRECSDIRTGSLSGRITHAPLRDAVIQRYLRGPDPALADEVASECAAKPWDGIVARLWPRARCALTIVTGSMAQYIPILRSYCGGRLPIVSPCYASTECAAGVNLRPLDPPGRASYALLPNIAYFEFAEIQPRDEETPTVDGDGDPGEMKLVDLVDVEIGRSYELVVTTFAGFNRYRVGDLLTVTGFYNATPLFLFSGRHDVILSIDHEKISEEELLRAISQAIELHLGPLGYMLSGSTAFADISKLPGHYVLFWELTNARSNGLVGDIPDQTVMENCCSTVEECFDQMYCKIRQRANITALEIRVLEQGAYDALMDFFVSRGASAGQYKTPTAIRSKEAMMVLEERVVARFFSKEIPRGSLYDDYMKK

SEQ ID NO: 137836 - protein, 142 aa, Triticum aestivum
  Clone ID: PAT_TA_32254.pep
RQIEIAVMQYRESLEEKGLHSMEEIERKVASHRRRLQSDYGLSSIDGANNRRSSERLSLERKERADDARDSSRKRPRSRSRSRSPSRKSSLDRDREHNRSRGRLHGNDAGRDRTREKGSGRGKDDHHDRSSRDREKDRRTGR

SEQ ID NO: 137837 - protein, 102 aa, Triticum aestivum
  Clone ID: PAT_TA_32255.pep
DTTNGCMSTGPHFNPAGHVHGAPEDEIRHAGDLGNVTAGVDGVASINITDCHIPLTGPNSIVGRAVVVHGDADDLGKGGHELSKSTGNAGARVACGIIGLQG

SEQ ID NO: 137838 - protein, 152 aa, Triticum aestivum
  Clone ID: PAT_TA_32256.pep
MVKAVAVLTGSEGVKGTIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVVHGDADDLGKGGHELSKSTGNAGARVACGIIGLQG

SEQ ID NO: 137839 - protein, 173 aa, Triticum aestivum
  Clone ID: PAT_TA_32257.pep
MGVGMKRAREEEPVVSLALSLSTDSSATSTTTSDSSTGAPAMVPRKRARRGRAVATSGEGEFVCKTCGRAFETFQALGGHRTSHLRGRHGLELGVGVARVIKERKRQEDKQRHDCHICGLGFETGQALGGHMRRHREEMALSGSVDRWVALSDQEAGHQAAVDSPPVLRQLFV

SEQ ID NO: 137840 - protein, 73 aa, Triticum aestivum
  Clone ID: PAT_TA_32258.pep
MVHLATIPITGTGINPARSLGAAVIYNNEKAWDDHWIFWVGPFIGAAIAALYHQYVLRASATKFGSSAFFGSR

SEQ ID NO: 137841 - protein, 91 aa, Triticum aestivum
  Clone ID: PAT_TA_32259.pep
SYNNLTRSCILSFGLEMSAYSGAQYLVTLGQCLFPRESGGPSIKTCTSAKKLSIFALKFLYSLACHGKYGCSTHQLYIPPQNNHTTSHRSC

SEQ ID NO: 137842 - protein, 184 aa, Triticum aestivum
  Clone ID: PAT_TA_32260.pep
FIGSYQHHARQEESHDTSSTVPYPCPVASQQSAQQEKKGGTWIASSVEMVAPMVIASAGLGMLAGVAMANRTTRDGLPAASRWDARPLLLHVQRHRPGWSASAAVGPTADVGCRTCSGSGRKLVPQLRRLWHRPAAPGSTHRPAAEAADRARATRILKLIDTPSVSRSKSEVQLGRTQHMSMSV

SEQ ID NO: 137843 - protein, 120 aa, Triticum aestivum
  unsure (1)..(120): unsure at all Xaa locations
  Clone ID: PAT_TA_32261.pep
MTLMATIHDAFAGPASCRIRHEVIYNKDKAWDDQWIFWVGPLXXGPPSAAAYHQYVLRASAANSGPTQLITVAPAGLNVIAKEEASKRSPTVASTPLPCSMDSNLCIINCYRSSACAHVM

SEQ ID NO: 137844 - protein, 148 aa, Triticum aestivum
  Clone ID: PAT_TA_32262.pep
GGVCLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 137845 - protein, 166 aa, Triticum aestivum
  Clone ID: PAT_TA_32263.pep
ATRGRHTHPSKSLLPLLTSNRQVHTARKQQVQQLRRFLDWFFCEDGGAHGDRVGGAPDAGGRCDGEPGRRAAGGVQVGARPRCSTCSGTGREECLCSRWSDGDVGCGTCSGSGRKRCRGCGGSGTGRPLPARLIVQEQKLPTPPGATRRLQLIFVGRFPRGNQLCN

SEQ ID NO: 137846 - protein, 109 aa, Triticum aestivum
  Clone ID: PAT_TA_32264.pep
MVSPMVIASAGLGMLAGVAMANRTTGDGLPAASRWNARPRCSTCSGTGREECLCSRWSDGDVGCGTCSGSGRKRCRSCGGSGTGRPLPARLVVQEQKLPTPPGRRGDYN

SEQ ID NO: 137847 - protein, 123 aa, Triticum aestivum
  Clone ID: PAT_TA_32265.pep
MVSPVVIASAGLGMLAGVAMASRGSGDGLPAASRWDARPRCSTCSGTGREECLCSRWSDGDVGCGTCSGSGRKRCRSCGGSGTGRPLPARLIVQEQKLPTGARATPETTTDIHRFPRGNRKCN

SEQ ID NO: 137848 - protein, 64 aa, Triticum aestivum
  Clone ID: PAT_TA_32266.pep
RMWSFYRALIAEFVATLLFLYITVATVIGGGVPPVHPPGGGHQGARLLPEQPEQLSRPPGRPII

SEQ ID NO: 137849 - protein, 424 aa, Triticum aestivum
  Clone ID: PAT_TA_32267.pep
MDWSFAGRAGAAPAVMSFRSAAREEQQGELAYPKQQASRVLTPQRSFGAETHGSVQYAAAARAAYGVQPSQQQHAPNGARVIPMSSPFNPNNPMFRVRSSPNLPNGGAAGSPFKQPPFAMNNAVAASTVGVYKSRDMPKPKTAQLTIFYAGSVNVFNNVSAEKAQELMFLASRGSLPTAPTTVTRSPDATFFTPAKLAAPEASPAKQMLAQIPQRVSPPLPAISKPMSIMSQAACLPKSTSSSNTDSAVPKSSGQLVVPPTSQPSSSTHTATLSSTTAASIMPRAVPQARKASLARFLEKRKAKMLHTRQCLDDNCTIEGSSGRCWAVLDILRLDLTVVHKSSKLYRPHSTAQRKERVTTTAPYPSAKSPMESTDTVGSANDNNSKSSSCTEIAFSSNHEESLRLGRPRNISFSGESPSTKLHI

SEQ ID NO: 137850 - protein, 105 aa, Triticum aestivum
  unsure (1)..(105): unsure at all Xaa locations
  Clone ID: PAT_TA_32268.pep
YGGGANELSAGYSKGTGLAAEIIGTFVLVYTVFSATDPKRNARDSHIPVLAPLPIGFAVFMVHLXATIPITGTGINPARSLGAAVIYNKDKAWXDDQWIFWVGGH

SEQ ID NO: 137851 - protein, 291 aa, Triticum aestivum
  unsure (1)..(291): unsure at all Xaa locations
  Clone ID: PAT_TA_32269.pep
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAXVTFGLFLARKVSLVRALLYIIAQCLGAICGVGLVKGFQSAFYVRYGGGANELSSGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGPSASFGRS

SEQ ID NO: 137852 - protein, 70 aa, Triticum aestivum
  Clone ID: PAT_TA_32270.pep
HRPAAPGATHRPGAEAADRARATRRLQLIFIGFPEEIVSVIKHNIAHQYMQRVHSCVCYTLSPFNTPSVN

SEQ ID NO: 137853 - protein, 88 aa, Triticum aestivum
  Clone ID: PAT_TA_32271.pep
MWESRALLAPLPIGFAVFMVHLATIPITGTGINPARSLGAAVIYNTDKAWDDQWIFWVGPLIGAAIAAAYHQYVLRASAAKLGSYRSN

SEQ ID NO: 137854 - protein, 109 aa, Triticum aestivum
  Clone ID: PAT_TA_32272.pep
MVSPVVIASAGLGMLAGVALASRGTGDGLPASSRWDARPRCSTCSGTGREECLCSRWSDGDVGCGTCSGSGRKRCRSCGGSGTGRPLPARLIVQEQKLPTAPGRRGDYN

SEQ ID NO: 137855 - protein, 291 aa, Triticum aestivum
  unsure (1)..(291): unsure at all Xaa locations
  Clone ID: PAT_TA_32273.pep
MAKDIEAAPPGGEYGAKDYSDPPPAPLFDAEELTKWSLYRAVIAEFVATLLFLYITVATVIGYKHQADPAGPSAADAACSGVGILGIAWAFGGMIFVLVYCTAGVSGGHINPAVTFGLFLARKVSLVRAXLLYIIAQCLGAICGVGLVKGFQSAFYVRYGGGANELSSGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRS

SEQ ID NO: 137856 - protein, 375 aa, Triticum aestivum
  unsure (1)..(375): unsure at all Xaa locations
  Clone ID: PAT_TA_32274.pep
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIXGFAVFMVHLATIPITGTRHQPXARSLGAAVIYNKDKAWDDQWIFWVGPLIGAAIAAAYNNYLLKATPAKLGSYRTTNHPSSGRTEVVRYVRRRRRSQPNALRLLHSKTFPCIDSHPLHHQVVPSVCAHVHVTVHSYAPFSLLAAPSNVLPFYPKSHVVAFPNF

SEQ ID NO: 137857 - protein, 288 aa, Triticum aestivum
  unsure (1)..(288): unsure at all Xaa locations
  Clone ID: PAT_TA_32275.pep
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVXFGLFLARKVSLIRALLYIIAQCLGAICGVGLVKGFQSSYYVXRYGGGANELSAGYSKGTGLAAEIIGTFVLVYTVFSATDPKRNARDSHIPVLAPLPIGFAVFMVHLATIPITGTGINPXARSLGAAVIYNTDKAWDDQWIFWVGPLIGAAIAAAYHQYVLRASAAKLGSYRSN

SEQ ID NO: 137858 - protein, 415 aa, Triticum aestivum
  Clone ID: PAT_TA_32276.pep
MERDFLGTIGHEQLQQQQQQQQRQRAAAEDAAARKESAYFGGGGVPPMDWSFAGRAGAAPAVMSFRSAPREEQRGELAYPKQQASRVLTPQRSFGAESHGSVQYAAAARAAYGGQPPQQHQHAPNGARVIPMSSPFNPNNPMFRVQSSPNLPNGVAAGSPFKQPPFVMNNAVAASTVGVYKSRDTPKPKTAQLTIFYAGSVNVFNNVSAEKAQELMFLASRGSLPTAPTTVTRSPDATFFTPAKLAAPEASPAKQMLAQIPQRVSPPLPAISKPMSIMSQAACLPKSTSSSNTDSAVPKSSGQLVVPPTSQPSSSTLASTTAASIMPRAVPQARKASLARFLEKRKERVTTTAPYPSAKSPMESSDTVGSANDNNSKSSSCTEIAFSSNHEESLRLGRPRNISFSGESPSTKLHI

SEQ ID NO: 137859 - protein, 286 aa, Triticum aestivum
  unsure (1)..(286): unsure at all Xaa locations
  Clone ID: PAT_TA_32277.pep
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVTXVFSATDPKRNARDSHIPVLAPLPIGFAVFMVHLXTIPITGTGINPARSLGAAVIYNKDKAWDDQWIFWVGPLIGAAIAAAYHQYVLRASAAKLGSYRSN

SEQ ID NO: 137860 - protein, 292 aa, Triticum aestivum
  unsure (1)..(292): unsure at all Xaa locations
  Clone ID: PAT_TA_32278.pep
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSXGGHINPAVTFGLFXWPRKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 137861 - protein, 418 aa, Triticum aestivum
  Clone ID: PAT_TA_32279.pep
MERDFLGAIGHEQLQQQQQQQQRQRAAAEDDATRKESAYFGGGGVPPMDWSFAGRAGAAPAVMSFRSAPREEQQGELAYPKQQASRVLTSQRSFGAESHGSVQYAAAARAAYGGQPPQQQHAPNGARVIPMSSPFNPNNPMFRVQSSPNLPNGVAAGSPFKQPPFAMNNAVAASTVGVYKSRDMPKPKTAQLTIFYAGSVNVFNNVSAEKAQELMFLASRGSLPTAPTTVTRSPDATFFTPAKLAAPEASPAKQMLAHIPQRVSPPLPAISKPMSIMSQAACLPKSTSSSNTDSAVPKSSGQLVVPPTSQTSSSTHPVTLSSTTAASIMPRAVPQARKASLARFLEKRKERVTTTAPYPSAKSPMESSDTVGSANDNNSKSSSCTEIAFSSNHEESLRLGRPRNISFSGESPSTKLHI

SEQ ID NO: 137862 - protein, 127 aa, Triticum aestivum
  unsure (1)..(127): unsure at all Xaa locations
  Clone ID: PAT_TA_32280.pep
ANELSAGYSKGTGLAAEIIGTFVLVYTVFSATDPKRNARDSHIPVLXAPLPIGFAVFMVHLATIPITGTGINPARSLGAAVIYNKDKAWDDQWIFWVGPLIGAAIAAAYHQYVLRASAAKLGSYRSN

SEQ ID NO: 137863 - protein, 291 aa, Triticum aestivum
  unsure (1)..(291): unsure at all Xaa locations
  Clone ID: PAT_TA_32281.pep
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGXLAAEIIGTFVLVYTVFSATDPKRSARDSHVPVLAPLPIGFAVFMVHLATIPITGTGINPARSLGAAVIYNNEKAWDDHWIFWVGPFIGAGIAALYHQYVLRASATKFGSSASFGSR

SEQ ID NO: 137864 - protein, 290 aa, Triticum aestivum
  Clone ID: PAT_TA_32282.pep
MAKDEVMETGGGGDFAAKDYTDPPPAPLIDAAELASWSLYRAVIAEFIATLLFLYITVATVIGYKHQTDPAVNAAADAACGGVGVLGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 137865 - protein, 179 aa, Triticum aestivum
  Clone ID: PAT_TA_32283.pep
MAKEVSEEPEHAAPAHKDYSDPPPAPLFDMGELRMWSFYRALIAEFVATLLFLYITVATVTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILGAAAIKALGSFRSSRSN

SEQ ID NO: 137866 - protein, 290 aa, Triticum aestivum
  unsure (1)..(290): unsure at all Xaa locations
  Clone ID: PAT_TA_32284.pep
MAKDIEAAPPGGEYGAKDYSDPPXAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRN

SEQ ID NO: 137867 - protein, 293 aa, Triticum aestivum
  unsure (1)..(293): unsure at all Xaa locations
  Clone ID: PAT_TA_32285.pep
MAKDEVMETGGGGDFAAKDYTDPPPAPLIDAAELASWSLYRAVIAEFIATLLFLYITVATVIGYKHQDGTXREHRRRTPRCGGVWRARHRPGAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAXIKALGSFRSNA

SEQ ID NO: 137868 - protein, 284 aa, Triticum aestivum
  Clone ID: PAT_TA_32286.pep
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPLVGALAAAAYHQYILRAAAIKALGSFRSSRSN

SEQ ID NO: 137869 - protein, 290 aa, Triticum aestivum
  Clone ID: PAT_TA_32287.pep
MAKDEVMETGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKAFRAPTSSGTAAAPTRSPPATPRAPASLRRSSGTFVLVYTVFSATDPKRSARDSHVPVLAPLPIGFAVFMVHLATIPITGTGINPARSLGAAVIYNKDKAWDDQWIFWVGPMIGAAIAAFYHQYILRAGAIKALGSFRSNA

SEQ ID NO: 137870 - protein, 284 aa, Triticum aestivum
  Clone ID: PAT_TA_32288.pep
MAKEVSEEPEHAAPAHKDYSDPPPAPLFDMGELRMWSFYRAIIAEFVATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 137871 - protein, 310 aa, Triticum aestivum
  unsure (1)..(310): unsure at all Xaa locations
  Clone ID: PAT_TA_32289.pep
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGYSTGTGLAAEIIGTFVLVYTVFSATDPKRSARXDSHVPVLAPLPIGFAVFMVHLATIPITGTGINPARSLGAAVIYNNEKAWDDHWXIFWVGPFIGAXAIAALYHQXYVLRASATKFGSSASFRQPLDRPAAVSVMVGGTEL

SEQ ID NO: 137872 - protein, 424 aa, Triticum aestivum
  unsure (1)..(424): unsure at all Xaa locations
  Clone ID: PAT_TA_32290.pep
MTVEKFKNIMAVDKKVAAALPTSTRSSVTPLRASPAGAHRSRVVASTAPAMYPTGVSMVSTVVHVGIGERSYTISIRSGLVDMPDLLQRYMIWKRVLGVTKRTWTQRAGLEIQWELSCPTNCESCSPVLPNRIPSAPXRKQIVVKLELQHFCILSRLXTSVPRGGGGIGDVCGFAAAAFLRCAYCXQIPASRVARVGSPGAGLPGLFHPLGGNLIGAVDQPSGVLIDTETLNTLPDRELASGVAEVVKYGLIRDAPFFEWQEKNMAAILAREPSALTYAIKRSCENKAEVVAQDEKESGLRATLNLGHTFGHAIETGLGYGEWLHGEAVAAGTVMAADMSYRLGWIDESIKKRTFDILDQAKLPVTPPKGMTVEKFKNIMAVDKKVADGLLRLILLKGPLGGCVFTGEYDRKALDETLRAFCDN

SEQ ID NO: 137873 - protein, 117 aa, Triticum aestivum
  Clone ID: PAT_TA_32291.pep
ESGLELSVWTLLTDHSDWIETSKYNVDKIWANVNYQSTVLRQLIPSLPVLSIHEDGVVYLVVNDESIVDHRLDHKGQYLLRVDMKSNEIQISPQPTRRICYQLFASEFSAYRQHLQD

SEQ ID NO: 137874 - protein, 65 aa, Triticum aestivum
  Clone ID: PAT_TA_32292.pep
SRLKNVFSHLVSMQGSNHFLSSSSYCIAYRGTRERERERERELHCNNIHLGSYLSGRGHVVILHG

SEQ ID NO: 137875 - protein, 364 aa, Triticum aestivum
  Clone ID: PAT_TA_32293.pep
MAVAAEGGSVEEGVGESSSPPREAPPAPAVSGGSGGSGGAPRDICTQVFERLVADGNEEVAGPDFRVQLEAHFARLPFSYQLDINVDKSADVLVHQKVLAEAKDPLRRPAFRVRFLRVEDMDSAYGSDASDEGADDGDDLSVRQDTPYTHIHEIVFSTIDKPKLLSQLSALLSDIGLNIREAHVFSTVDGYSLDVFVVDGWPIEDTDGLHKALEASVLRNEGSWSGSSHSSAAERTLPFQVKGGEWEIDKRLLKMGEMIASGSCGDLFHGTYFGEDVAVKVLKAEHLNNNVWNEFTQEVYILREVHHTNVVRFIGACTKPPKFCIITEYMSGGSLYDYVHKQRNVVDLPTLLKFACDICRRMCY

SEQ ID NO: 137876 - protein, 162 aa, Triticum aestivum
  unsure (1)..(162): unsure at all Xaa locations
  Clone ID: PAT_TA_32294.pep
VILFSQVRVFAFVCCCRCHASHIMSSCALHLHTCSSHAFEHFPRCPFCIPALRSPPVVISTFLSCVRIKHFRIGPRLSKRPWFTTGRPPVKFLTIWTSFGAPTVNRGTEKASCVLQPKTPPSWPKTHQNPLHHLDHLITIAWPKTAPHLDSPSSSYVVXRSR

SEQ ID NO: 137877 - protein, 240 aa, Triticum aestivum
  unsure (1)..(240): unsure at all Xaa locations
  Clone ID: PAT_TA_32295.pep
LAWSRPRCDLESWIYPTLINEHHPKSPLCMGSRIAIAVDIAAALVYLHNQCMPPMVHCDLKPSNVLLDDVMGACVGDFGLAKFLHGYYSSSGIDGSTSTSLVGPRGSVGYIAPXEYGYGSKISTEGDVYSYGVIILEMLTGKXPTDEMFKDGLSLYKFVGDSFPEKIGDIXDPTIVPPPGVGDAGSLVGRQFLPPAGTLRCAVGLIGLGLSCAAEAPKDRPVIQDVYSEVTAIREVFSAL

SEQ ID NO: 137878 - protein, 131 aa, Triticum aestivum
  Clone ID: PAT_TA_32296.pep
LNHRESSVPASPNHGCSIPHSRSQHLVLPDAARHGRSILFAGCSKTGRRFQHCHTRMQQFAPAASQLAWSPSPDTTGWPQHRDAPQRSPHGRLAGCDRLVAASACPAGKPCTCSGGAKTEANIPSCGYHGV

SEQ ID NO: 137879 - protein, 69 aa, Triticum aestivum
  Clone ID: PAT_TA_32297.pep
LWHSILMNLHIAVEHRKRGRAWLHWRLSQGEGRAETCNNEGCNRNQYLNIESFPIAFQQVHSYFLIGSC

SEQ ID NO: 137880 - protein, 122 aa, Triticum aestivum
  Clone ID: PAT_TA_32298.pep
MFIDHYMFRWNIVRSFFQFATKFSKKKRSYASPSCGTTIPEPMNSVNIYYIYYGSLHVLLEQGQFGVVYFGYLKDGTPVAVKTRLESSSHGVNEFLAEALHLIRVHHRNLVNLVSHYKDGHH

SEQ ID NO: 137881 - protein, 114 aa, Triticum aestivum
  unsure (1)..(114): unsure at all Xaa locations
  Clone ID: PAT_TA_32299.pep
SWLPSPPPPPPRLASCPRPSRTSPCRENPSSHPLLTLPRLPSPPPTPPRRPQPSSHPLLPPPSRRGRPPPPXGEPPAPRPPPRLGRLPRPRHPPPRPLLSRSRPRGDPSSSVAQ

SEQ ID NO: 137882 - protein, 139 aa, Triticum aestivum
  Clone ID: PAT_TA_32300.pep
MDQELQEADVLWPQNNSDHRRDGGHDDSVINVDGDMAKLSSPELSAPVLVPHRKRRSRSWTTSDGSGSGNDDCSDGDVRCTNDAKRNVPPHVLAERRRRLAGRSTAAYSMCSGKGRTLKGRDLRNIRNLVLRMTGFIEK

SEQ ID NO: 137883 - protein, 140 aa, Triticum aestivum
  Clone ID: PAT_TA_32301.pep
MDHQELQEADVLWPQHNSDHRRDGADGDDGSNVDGDMAKLSSPELSAPVLVPRRKRRSRSWSTSDGSGSGNDDCSDGDVRCTDDAKRNVPPHVLAERRRRLAGRSTAAYSMCTGKGRTLKGRDLRNIRNLVLRMTGFIEK

SEQ ID NO: 137884 - protein, 240 aa, Triticum aestivum
  Clone ID: PAT_TA_32302.pep
MAAVTTASLCPGLGKPRQGHAKPPRTTVCHCLPARRAEEGVNRRDALLGVLLSATAALSAPLLVPAEAFAETAEAQEGFTAYEDEANKFTLVIPQGWQVGAGERSGFKNVTAFFPEQNPNSSVSVVITGIGPDFTSLKSFGSVDEFAENLVTGLDRSWQRPAGLAAKLIDSKASNGLYYIEYTLQNPGEKRRHIVSAIGMAFNGWYNRLYTVTGQYIDDDEESAIYKPEIEKSVKSFKFT

SEQ ID NO: 137885 - protein, 222 aa, Triticum aestivum
  Clone ID: PAT_TA_32303.pep
MATRALHSPRLTSPPLTGRHAAARCKCSAAPLFAKRLPLVVAFPRSVASCCAVQESSPGTTAAAATTVSETKDADGDKKEAAAAEAKPAAKPAAAKPKKAPPKPLPEMMEEEIIPPLKTALEAEEDVSQVVLTFQNNTLEGSFVKEDIPYYFWAFFPQGDLSGPKGFAMTSYSMEVSTIEPFLIDEKRITPQYVVFWVYKRLAGQGVLPVWRAEDLSPAPAE

SEQ ID NO: 137886 - protein, 67 aa, Triticum aestivum
  Clone ID: PAT_TA_32304.pep
MTEAPFLPRERLFKLQHHFQNMTKHTYLKGRYDVITSVAIPLALAASSMFMIGRGVYNMSHGIGKKE

SEQ ID NO: 137887 - protein, 132 aa, Triticum aestivum
  Clone ID: PAT_TA_32305.pep
PTEKLDTITRGWSVLLPCSPAAASPSCCCWLSYSVPWRARQRSKFLWTETARGNDLRRPGHQARGRSTAQAAATTASLRRHRRRLQLRRHLRLTARPWGLLRGSLPREPPILDDIYCFVDDDQTVKSQSREI

SEQ ID NO: 137888 - protein, 92 aa, Triticum aestivum
  Clone ID: PAT_TA_32306.pep
MHELERKLCLVGLCCIQMKSHDRPTMSEAIQTLEGGVEGLHVPSRPFFCDDEHAPVAAGSHHVFSELTALSEDDEFDDASTQDNSAGLRNAE

SEQ ID NO: 137889 - protein, 294 aa, Triticum aestivum
  unsure (1)..(294): unsure at all Xaa locations
  Clone ID: PAT_TA_32307.pep
VLRGGVQQLCKPADEESSDEETDDVEEEPLVRRRSRRIPAGDTESTEPVLPGDSPPSSSQPQNHDRQYNRTDFPSEWGGIPSXEHDEAVMLEAAMFGGIPEAPTYPLSHASSSHYPQVVHSPPPXLTEQRLLREQQDDEYLASLQADHQEEVKTLQEAELRLLEETAAREAALEETKXEEEEQRKMQLEKEELVSYRAAKEASACHWKPPSDKGXLYQVCFPGRTREGRRVLKSDKFKSLFDFLDFGRTCKPETYRLVRTYPRRAFTTADGDQSFTDLGLTSKQEALFIEQITD

SEQ ID NO: 137890 - protein, 214 aa, Triticum aestivum
  unsure (1)..(214): unsure at all Xaa locations
  Clone ID: PAT_TA_32308.pep
PASVQFDNSLKQHHDFLRLDHVEGYHELSAATXFFSTSVGIWDADXFYVKVDDDVHVNLGMLATTLARHKAKPRTYIGCMKSGPVLADKNLKYHEPEAWKFGEDGNKYFRHATGQIYAISKDLATYISINQPILHKYANEDVSLGSWFIGLEVNHIDERNMCCGTPPDCEWKGQAGNICVASFDWSCSGICKSVERLKDVPPPRPRGDSLFGVI

SEQ ID NO: 137891 - protein, 80 aa, Triticum aestivum
  Clone ID: PAT_TA_32309.pep
MSYQQQGASATAYPPPGQQQQQAYVAPPPAGYPQRDQQYPDAGGADTTTSRGGHGHHHGGGFWRGCCAALCCCCLLDACF

SEQ ID NO: 137892 - protein, 80 aa, Triticum aestivum
  Clone ID: PAT_TA_32310.pep
MSYQQGYPQQGASATAYPQQQQAYVAPPPAGYPQRDQQYPDAGAADTTTSRGGHGHHHGGGFWRGCCAALCCCCLLDACF

SEQ ID NO: 137893 - protein, 352 aa, Triticum aestivum
  Clone ID: PAT_TA_32311.pep
RFCVPTGLRDPLSAAPRTAVFSPCRSLSAHPHIAAVPARSSLVAPSAPGRLCWRSPPANRPGGAAGDLAPPRALGRGDLEDHCHDSSMTCCLTNNRRAINDFSTAPAGKQKIIVYPDSQKKMCDGGNVVEPIFDVNTMPVTCSISSIHKQDNQNRAINLNNAESLMDVDHANNIELNSDTVDLVSHASRSAQKRNVDMANWTDGANGSVDKKIKLDNVSSTVESSLSGKVRDGRLSSKVHPLAALPVHDCTDNKTMAGISKSNGKCTFPLDLNVVDDADIDMVDDAATGNSITGLSEDLPEQNTQDLKPAPGDNISSRKPMVEEKLNKGDTQPTDMSGALSLSLAFPASKDQ

SEQ ID NO: 137894 - protein, 84 aa, Triticum aestivum
  unsure (1)..(84): unsure at all Xaa locations
  Clone ID: PAT_TA_32312.pep
TELAXNXIPTXYEFXEPTMDGRNXLEFXYXXEAPGXGVXAFATVAXGNGGYYTLXVTXNERRWXRXXNKLKVVADXFKISDLNA

SEQ ID NO: 137895 - protein, 74 aa, Triticum aestivum
  Clone ID: PAT_TA_32313.pep
RRITSMVILLRKCYPTSHLIVLTRIGSSTFLSSMGYASRYWRSGSSTSSAQIRVVEEIVEQNHREASRGVRCKT

SEQ ID NO: 137896 - protein, 137 aa, Triticum aestivum
  unsure (1)..(137): unsure at all Xaa locations
  Clone ID: PAT_TA_32314.pep
XEAIDSCPVDCIHWTSAAQVTLLEDEMRRVERVNVALMLSGMGSSFDVFRMASTRWEKRQAQVLNKVRMRMSQDDANKGSSWSDIWGSPTRYQKNEEDTKERVKRAAAAARRWREYSRKGADRPPTFKLPEAASNQE

SEQ ID NO: 137897 - protein, 88 aa, Triticum aestivum
  Clone ID: PAT_TA_32315.pep
LALRTIRENKENIWYNCMLFWQQLIKRFLLDGTLDTGNSLPESSLAQLCPDMIDRIWWLQANTSFAVLHACQFAEAALENNWMKTKLK

SEQ ID NO: 137898 - protein, 224 aa, Triticum aestivum
  unsure (1)..(224): unsure at all Xaa locations
  Clone ID: PAT_TA_32316.pep
LELSRACSFIMLLAYVAYLFFQLKTHRQXLFEPQEIEGGDEEEEEAVLGFGSALFWLILMTIIIAVLSEYVVGTIEPTSQSWGLSVSFISIILLPIVGNAAEHAGAVIFALKNKLDITLGVALGSATQISMFVVPLSVLVAWIMGIQMDLDFKLLETGSLFISVLVTAFTLQDGTSHYLKGVLLLLCYIVIGACFFVTRQPAPHANNNGTLLDVPTGPMIVQVA

SEQ ID NO: 137899 - protein, 468 aa, Triticum aestivum
  unsure (1)..(468): unsure at all Xaa locations
  Clone ID: PAT_TA_32317.pep
MDSQSAVTMEAGAPTRKESGRLPSRHGGHAHGHSGLARTAHGMSSSSLRKKSDATLVRKVPVASLRPVLANLQEVLLGTKLAVLFIAVPLAVAAQCFRFGQVWVFALSLIGLIPLAERVSFLTEQIALYTGPTIGGLLNATCGNATELIIAVFALVQGKIEVVKCSLLGSVLSNLLLVLGTSLFCGGIKNLGADQPYDRKQADVSTGXLLTLGVLCQSLPLLLRYAVSSGEHAVATDTTVLELSRACSFIMLLAYVAYLFFQLKTHRQLFEPQEIEGGDDDEEEAVLGFGSALFWLILMTIIIAVLSEYVVGTIEPTSXSRWGLSVSFISIIDVLLAIIGNAADHDFKXARAWIFALLVITCVASWGXATQISMFXVVPLSVLVAWIMGIQMDLDFKLLETGSLFISVLVTAFTLQDGTSHYLKGVLLLLCYIVIGACFFVTRQPAPHANNNGTLLDVPTGPMIVQVA

SEQ ID NO: 137900 - protein, 276 aa, Triticum aestivum
  Clone ID: PAT_TA_32318.pep
MWPESPPLRDAGAAVLTGCVAMAVLRFWEEVGNRALLDQKLCRKLVHISVGLVYFLMWPLFSADDVYAPFLASIVIALNIIKVILIGSGVVKDDGVVNSMTRNGDYRELLKGPLYYACTITLTTVIFWRTSPISIAVICNLCAGDGVADIAGRRFGHVKLPHNPDKSYAGSIAMFFAGFVASILFMCYFHLFGFVEQSWTMVAAFGVTSLAAAIVESLPVSTLLDDNLTTPIASALVGSLVFYYVGGGGGAGSGDGTSISATAAMVFAGSSYYSEG

SEQ ID NO: 137901 - protein, 186 aa, Triticum aestivum
  unsure (1)..(186): unsure at all Xaa locations
  Clone ID: PAT_TA_32319.pep
HVKAEAEVSTQCRRGPPGIQILFFTFCSYCGSGKAPAEFANIYKEDGLVGGHVIMLGGDPASRSAALEALHAYPGGLQVGGGINLENAMSYLNEGASHVIVTSYVFSDGKMNIERLTQLVELVGKERLILDLSCRKKDGRYAIVTDRWQKFNDVFVDGPTLKRLAAYADEFLXHGVDVEGKRLGID

SEQ ID NO: 137902 - protein, 158 aa, Triticum aestivum
  Clone ID: PAT_TA_32320.pep
SHCINSKLQNAVISLLATVILLTALSVFYFSYQNLSGYDGRYAIVTDRWQKFSDVFVDGPTLERLAAYADEFLVHGVDVEGKRLGIDEELVELLGSHSPIPTTYAGGVSTMDDLERIKKAGKSRVDVTVGSALDIFGGDLPYDTVVHWHKEQNLVSQR

SEQ ID NO: 137903 - protein, 414 aa, Triticum aestivum
  unsure (1)..(414): unsure at all Xaa locations
  Clone ID: PAT_TA_32321.pep
LPNLPCLLTVQXQWKKGXLLGSGTFGQVYLGFNSEXGQFCAIKEVQVISDDPHSKERLKQLNQEIDMLKKSSHPNVVQYYDSDMTDDTLSIYLEYVSGGSIHKFPWKYGPFKGPLIRSXRLLWTFSMKNAPXHGRCSELFCLQPLVGSCCDIKLAYCGIEKGLXCFAVFHSVLYISQSISPRGKTISTLNTLXFKLGSLRKTIIVITRGSRLSYQLVGVAPMFMLGKIKRLXERYXEISLANVHVLKLGLKRNPASRATASQLMDHPFVQDHPAVRAAKDSALRNAFSAPADVKHTMSNRELPSRRSITPLRDIGVSARDFTGFSTTVPSPRTSSPIPVRTNMSLPVSPCSSPLRQFKQSNWSCLPSPPHPMLSSGAAAYNSSSYALNQARRMPDPWQDGSLKLQSPYGSPKRF

SEQ ID NO: 137904 - protein, 115 aa, Triticum aestivum
  unsure (1)..(115): unsure at all Xaa locations
  Clone ID: PAT_TA_32322.pep
TRLCCVLCGARVRLMIDSGSIALVCTYCGRVGFGSLLKITVLGSVTNYGRCRAEPRCAENRTGLSILQCRCASRAQAGRLSRNFQTSSGAALRLFGTPNVHVLAEPMKWRKKXXX

SEQ ID NO: 137905 - protein, 53 aa, Triticum aestivum
  Clone ID: PAT_TA_32323.pep
KCKSLCELHQKSFGRKENVMKETEKKRRSKKFRTTLENLWRVVEGSRSFWNLH

SEQ ID NO: 137906 - protein, 45 aa, Triticum aestivum
  Clone ID: PAT_TA_32324.pep
RITMVVRDIMTMKMRNIMSMAMIMMIGHKSLVIFKSCQNQVMLDV

SEQ ID NO: 137907 - protein, 263 aa, Triticum aestivum
  Clone ID: PAT_TA_32325.pep
MRQRAGKPQPGEGKEDEDAGVFLAKEYTPEQLGQMLRELRPADAGKDGKEWFSLQELQGRIAKIAEQERGQADPRYGGEFGLLRQTLTSLHKDQKGQKKHVTSVQHMSLFANIGGKPLPEYMLSNLPPQEELLERYFHPDHMSGEEKMKLELQKVRDEFKMSENDCGSARVQIAQLTLKIKHLSSVLHKKDKHSRKGLQDMVQRRKKYLKYLRRTDWDSYCLVLSKLGLRDTPEYKAADYKKTQPTKAQSKKSKSKRKRKMKA

SEQ ID NO: 137908 - protein, 96 aa, Triticum aestivum
  Clone ID: PAT_TA_32326.pep
NGHDLAHWELHAAVKQFGQPYSAFGGVLGHFFEEQLLLRCSLQEMLAHLVWVARLESHGESEDFIPIRVVVGIYSCIRKHLPSTSRRCKFFVAMRQ

SEQ ID NO: 137909 - protein, 185 aa, Triticum aestivum
  Clone ID: PAT_TA_32327.pep
VRAVRWTPFRVPICSVAVFLNAFPLAPVLLRVLLPVFGRRSRACVRFALPAPARGLAVRPVRWPDLWGVGWAVIFLNCVHDLVGAIFYGVYVSRDQFEPAQGAQASVFTQCARGQWVLPPGHQLPTGFPPELLPSPSHCSRHANFLRRPQAPASTDGGPVARAASSVPLNHLTKMMYIPGDQEHR

SEQ ID NO: 137910 - protein, 362 aa, Triticum aestivum
  Clone ID: PAT_TA_32328.pep
MGSTAVEKVAVATGDEEACMYAVKLAAASILPMTLKNAIELGMLEILVGAGGKMLSPSEVAAQLPSKANPEAPVMVDRMLRLLASNNVVSCEVEEGKDGLLARRYGPAPVCKWLTPNEDGASMAGLLLMTHDKVTMESWYYLKDVALEGGQPFHRAHGMTAYEYNSTDPRANCLFNEAMLNHSTIITKKLLEFYRGFDNVETTVPVAGGVGATAHAITSKYPHIKGVNFDLPHVISEAPPYPGVQHIAGDMFKKVPSGDAILLKWILHNWTDDYCMTLLRNCYDALPMNGKVVIVEGILPVKPDAMPSTQTMFQVDMMMLLHTAGGKERELSEFEELAKGAGFSTVKTSYIYSTAWVIEFVK

SEQ ID NO: 137911 - protein, 126 aa, Triticum aestivum
  Clone ID: PAT_TA_32329.pep
ALPNQRIPRLLLWDPPSAPPGTSNKMLKPRRLDLTKVTFAGFWAMSVTTISTGSPNHWFLIFAATAIASGLFWRLLTHSRNKDMVETANAASFFTHLCIAVATVPFTVMAWEAANKLQVNTCSSRQ

SEQ ID NO: 137912 - protein, 384 aa, Triticum aestivum
  Clone ID: PAT_TA_32330.pep
PNSRPRRPDVCDLAGGSGGVRIHGSTHTVLVPPTIESGGSNPNPQEWRVLPYSRKHMSGIKEITVRELPSAADAPRCAVTSQVPALVFAMGGLTGNYWHDFSDVMIPLYLQASRFDGEVQLVVTNIQPWYAGKYRHIIARLSRYDVVDMDKDDQVRCFPSAVVGIRMHKEFSIDPTKEPTGHSMPVRPRVRPRVRALPRAAPMRVTARLISDKKPRMMIISRRHPRKLVNIAEVVALAKRIGFEVVIGDPPFNVDVGDFAREVNAADVLMGVHGAGLTNSLFLPTGAVFIQVNPFGKMEHIGEVDFGTPAVDMGLKYMAYSCGMEESTLVDTLGRDHPAVKDPESIHRSGWSKVAEYYLGKQDVKLDLQRFEPVLLKAMAMLRE

SEQ ID NO: 137913 - protein, 166 aa, Triticum aestivum
  Clone ID: PAT_TA_32331.pep
RKERIREESTWTLSRFYPILEDLIEKLSKGELPKDEYHCMSDPSSSFRGISSSMSARTSPAHQPAQSMRSRRTGGTWARPRNSDDGYSSDSVLKHASSDMRKLGRRLFIFVVGGATRSELRAVHKLSSKLKREIILGSSSLDDPPKFITKLKMMSNEELSLDDLQI

SEQ ID NO: 137914 - protein, 389 aa, Triticum aestivum
  unsure (1)..(389): unsure at all Xaa locations
  Clone ID: PAT_TA_32332.pep
QIIPSMKYGPTASNEGTSTSGAASQTASGVLSGSGVLNARMPXXSTTSSGLLAQMVSMSADVAREYLEKVADLLLEFAQADTVVKSLMSXSQSLLARLFQMFTRIESPILLKILRCINHLSGDPNCLETLQRTDAIKHLIPILELRDGPLVFQIHSEVLNALFNLCKINKRRQEQAAENGIIPHLMNFVMSDSPLRQYALPLLCDMAHASRNSREQLRAHGGLDVYLDLLEDDAWACTALDSIAVCLAHDNDHRKVEQALLKKEAIQKLVKFFEDCPEQYFVHILDAFLKIITKSSRINTAIATNGLTTLLIARLDHREAIARLTLLKLIKVVYEHHPRPKQLIVENDLPQKLQNLIEERRDGQRGGQQVLVKQMATSLLKALHINTVL

SEQ ID NO: 137915 - protein, 100 aa, Triticum aestivum
  Clone ID: PAT_TA_32333.pep
MASLSMSAAGRAGWTPQQNKLFEQALAVHDRDTPDRWHNVARAVGGGKSADDVKRYYELLVHDIARIEAGKVAFPAYRSPCPGPGHNAGYEADRLKHLKI

SEQ ID NO: 137916 - protein, 191 aa, Triticum aestivum
  Clone ID: PAT_TA_32334.pep
SKVIEQSEISPFIREAAVLTQINHRNIVKLFGCCLESEVPLLVYDYVSSGSLSEVLHADESVGFSLSWGDYLRIALETAGALSYLHSSASISIFHRDVKSSNILLDVNYTAKVSDFGASRLVPIDQTHIVTNVQGTFGYLDQVYFHTTQLNTMSDVYSFGVVLLELLRQENTVQHCESGGIKDVPSPEHRN

SEQ ID NO: 137917 - protein, 103 aa, Triticum aestivum
  Clone ID: PAT_TA_32335.pep
STSPCACMHGSSSTGSTTRTCTCSCLDEVVQPAKRRRRGSAVPKAVGVRHSSVTTMLFQAYLLKHRPAGVSVRRRPHTPRTSLPFTSRAWTERLSTLSRGAGG

SEQ ID NO: 137918 - protein, 80 aa, Triticum aestivum
  Clone ID: PAT_TA_32336.pep
LEMPSYIINQHYKLARTVQRYKCLAPSIREFCQIIYYYTSESPDTSSASRPKTRAGRTQKSQQTIEGTYRGIVAATQIIN

SEQ ID NO: 137919 - protein, 457 aa, Triticum aestivum
  unsure (1)..(457): unsure at all Xaa locations
  Clone ID: PAT_TA_32337.pep
MASALSAPAASAVAAARCKVFGGGRNDGRAGCRVGVARKNTSHITMAVAVDASRFEGVPMAPPDPILGVSEAFKADTSDLKLNLGVGAYRTEELQPAVLNVVKKAEKLMLEKGDNKVYLPIEGFAAFNKATADLLLGADNPVIKQGRVATLQSLSGTGSLRLAAAFILEILXNAKVLISSPTWGXNHKNIFNDARVPWSEYRYYDPRTVGLDFEGMIADIQAAPXGSFVLLHGCAHNPTGIDPTPEQWEKLXDVIEEKKHMPFFDVAYQGFASGSLDEDASSVRLFVKRGLEVFVAQSYSKNLGLYAERIGAINVICSAPEVADRVKSQLKRLARXPMYSNPPIHGAKIVANVVGDPTMFGEWKEEMEQMAGRIKNVRQKLYDSLTAKDQSGKDWSFILRQIGMFSFTGLNRPQSDNMTDKWHIYMTKDGRISLAGLNLAKCEYLADAIIDSFHNVN

SEQ ID NO: 137920 - protein, 124 aa, Triticum aestivum
  Clone ID: PAT_TA_32338.pep
TGSEGVEDAGVGFSPPKKTRRTASSSINDPVTSPATHPVLLELEVMPIAEKLAVVSMRHDNAQHVMAKMYKALDPLRLKVITSSVTFVDGRTVHTMFIEMEETDSVETIKEMVQAALSHLEFLM

SEQ ID NO: 137921 - protein, 142 aa, Triticum aestivum
  Clone ID: PAT_TA_32339.pep
MQPAQQMATDNLGGHNLHTAAMLSAAGRGGPGLVPSSLLPFDVSVVLRGPYWIRIIYRKKFSVDMRCFAGDQVWLQPATPPKGGPSVGGSLPCPQFRPFIMGACCSKVLNALEPAFECYTAWAHTLNTSAGAPHPAPCRQTV

SEQ ID NO: 137922 - protein, 76 aa, Triticum aestivum
  Clone ID: PAT_TA_32340.pep
HMQQLRGSCFSIGASKMNNECTSFRNSCGEENAEGCRRTFQKVKREHAILRQKLESYFQLLRQAGPARTATRPGSM

SEQ ID NO: 137923 - protein, 365 aa, Triticum aestivum
  unsure (1)..(365): unsure at all Xaa locations
  Clone ID: PAT_TA_32341.pep
SNLLDWPEPIVPVQTLSNSGMSSLPQQYVKPPSERPSGVTNDPNLSIPVIDLASFSNAPEHHQEMLKAIASACKNWGFFQLVNHDVDTEAVRRMRSAWREFFDLPMEEKKAHANLPVTYEGYGSRLGVEKGAILDWSDYYFLNLFPSDIRNLDKWPKIPTDLREATEKYACQLISLCQVLXKAMSSSLRAGREGLPPIMPLGASEGISATMRVNYYPRCPQPELTLGLSSHSDPGGITLLLTDDNVEGTQVRKGDAWVTVQPVPGSFLVNVGDQIQILSNGRYRSVEHRALVNSDKERFTIAFFCNPRGDLPVAPASELVGPGSPALYQEPVTFSDYRKYIRTKGPSGKTQVQSISSTMQPGPAA

SEQ ID NO: 137924 - protein, 460 aa, Triticum aestivum
  Clone ID: PAT_TA_32342.pep
KSTRNEAAASNASVDRRSKLPNDLLLNILERVDTLDAIRTCILSKQLLKLPTMLSRFYLTFSRKEVFRTNRAVAHVADNILSTRSPKVTISELKIRFVLLPDVSLTIGRFVARAMATQKVGTAEFEIVTKKRHDLCSSDDLLKCPQQRPDLFGACPRAFAGLTSLWLQNMRFGELDIPNILSTCKRLEYLRLTRCDSGFHSVLQVEHDQLVEIEVDQGKFERVELICLPKLQRLTYDNWFSSEDPLYFGFVPQLSKLSLVKTGIRSDKTLELSQLLANVPSISDLHLDFGSEKIWVLPECPKLLKPVLSKLQHVNLDHLPEGCDLAWTMFILEAAPSLKELCITVWDHWCIMVKDEEFRKKNGYCEKADVKWKPYAPDFKHKNLAKLTIYGFQPDDNFMRYVRCVVEHAINITEISLSDRKGCRRCGDLDPSRYPRTAGERKQTADELGLASGVVVHFRS

SEQ ID NO: 137925 - protein, 84 aa, Triticum aestivum
  unsure (1)..(84): unsure at all Xaa locations
  Clone ID: PAT_TA_32343.pep
LDAELQGRCRHTAMFHLXANLTIFILLCSFSRXGILSEYGKXXSRTDRXXXPFRFQXXLLGSVSIVDSQGXPXTQEANGTVLLS

SEQ ID NO: 137926 - protein, 124 aa, Triticum aestivum
  Clone ID: PAT_TA_32344.pep
RPPRGPFRPLPGLRRRPPGLRRARGPRPPVRRLRRLRHAALPLLRRPVRLLLLGGSGRIRLRPLLREAPPRGRGRRGLCARAQSINQSDRLGIGLLAAHGRKRTNCSWLLCCGNRRPVVAIDDE

SEQ ID NO: 137927 - protein, 103 aa, Triticum aestivum
  unsure (1)..(103): unsure at all Xaa locations
  Clone ID: PAT_TA_32345.pep
MMGSRGTSAVLSRAARMRQKLQSSLXASALDIEDVSYQHAGHAAVKDNANETHFNIKVISPKFEGQSLVXKRHRMVYDLLTDELNSGLHAISIVAKTPTESGS

SEQ ID NO: 137928 - protein, 236 aa, Triticum aestivum
  Clone ID: PAT_TA_32346.pep
MGPDELPKAAAAGAEEAAPFSFSIWPPTQRTRDAVVRRLVDTLAGDTLLCKRYGAVPAADAEPAARAIEAEAFDAAAVTGGAAASVEEGIEALQLYSKEVSRRLLDFVKSRSAAAKAEPSGRGAARRRAGDLPGPTPGREPFGSIMLRDKIHLHLEFLCGVGLCPPCLRRRFPALLPLLPPDAAHARRRGAAPGGLPGRRLPPLQAPRRRAGRRRRARRARHRGRGLRRRRRHRRG

SEQ ID NO: 137929 - protein, 359 aa, Triticum aestivum
  Clone ID: PAT_TA_32347.pep
NGLTPPGPSLPALALRPAAPPAPPGRRSDPRWPGPGGARPRPATASSRARAAARARTATTTPKLRCYNGEYYYDDGLEGSEEDAVGADLERRICLLEHGQDGDVLGQPSLEEEEEGEEGAHLYAEEALLEPAGQETTGFSADEVLHEETVQQRSHLCDDDELPDSPVAGYGVEEGGSDDDGSGSGSDRVYMIDKVHQGAAAPTARVLEKYEDEALEPDIKTLYMRLEVLEADRESMRQALLGMRTEKAQLMLLREIAQQLAKDAAPVGTGAGSVPVVHHLPRKQAVGVADTTVREDKKTAPAGTFSKPLLFKWAIALFCSRKKKPSQSRYTFGLSSNNVGLLILLDKCPRIQKTLMRRK

SEQ ID NO: 137930 - protein, 97 aa, Triticum aestivum
  Clone ID: PAT_TA_32348.pep
LLGGPLFFFFFFFFFFLPFFFFFFFFFFFFFFFFFFFFFFFFFFFFFFVDKLYVLLFICSQPLFRITAGSIQRLSCMLCPSSHEPFNNPYKLEATTH

SEQ ID NO: 137931 - protein, 212 aa, Triticum aestivum
  Clone ID: PAT_TA_32349.pep
MDRRDGAGNRGRRDARGNARGRGWRGRCEDRGRPSTQPPPSTAPAAAVIPSDAPPIVGTCPDMCPATERAQRERLRDLAVFERVCSDPMRTSHSLAVKKFCRTISSTGTQASDIRPLPVLRETMDYLLHLLNSSEYPFEIVHDFIFDRTRSVRQDLSIQNLVNDQAIRIYEDVIKFHILSHQRLARSCQDSDASSLCYLNTEQMMKCLLSLF

SEQ ID NO: 137932 - protein, 189 aa, Triticum aestivum
  Clone ID: PAT_TA_32350.pep
SPRQPPSATGPTPSPPAASRRARRGRRRQGRRPPQPPHSPPPAPPPAPAPLARPAPAAPPSPARRGTRAPRGRGGVAGRLLGRLPATGGAPGGRPVVRPYRQAIVTEQRSEPAQEAVNRIRRARKAKTEQEARQILGISEKRSWEEIVKKYDTMFEKNANSGSFYLQSKVHRAKECLESIYHDKPDIMN

SEQ ID NO: 137933 - protein, 130 aa, Triticum aestivum
  Clone ID: PAT_TA_32351.pep
PGLPSYTHTVSVALVWAEPFHTTVPRQSVGDRRESPVFTCCLSIGPKYCPGGHRTVTTRRGQPPFCRPCCRLLLLVSPPLPDCDLGSSSPSCHSYIHRSAGSRHLRYSLMIGYTAVVFHMHHVGGSQMDY

SEQ ID NO: 137934 - protein, 109 aa, Triticum aestivum
  Clone ID: PAT_TA_32352.pep
DEERADVDPGGGGRGRGGRGRGGGGRRGRGAGSPQGLHVRRSVGPSHPPTTLHAFPLAAAARPPPPPPRRHPRRPRISSPAPRSLPQVNPVFPPPCFNSKLLANGPHAS

SEQ ID NO: 137935 - protein, 386 aa, Triticum aestivum
  Clone ID: PAT_TA_32353.pep
MDGLLSKLRSLDAYPKVNEDFYSRTLSGGAITLASSFIMLLLFVSELRLYLHAVTETTLRVDTSRGEKLRINFDITFPALQCSIISVDVMDISGQEHLDVKHDVFKQRIDAHGNVIATKQDAVGGMKVEKPLQHHGGRLEHNETYCGSCYGAQESPEQCCNSCEDVREAYRKKGWGVSNPDSIDQCKSEGFLQTIKDEEGEGCNIYGILEINKVAGNFHFAPGKSFQQSNVHVHDLLPFQKDSFNLSHKINKLSFGEPFPGVINPLDGAQWIQHSSYGMAQYFVKVVPTVYSHLNEQIILSNQFSVTEHYRSGDSGRVQALPGVFFFYDLSPIKVTFTERHVSFLHFLTNVCAIVGGVFTVSGIIDSFVYHGQRAITKKRELGKFT

SEQ ID NO: 137936 - protein, 217 aa, Triticum aestivum
  unsure (1)..(217): unsure at all Xaa locations
  Clone ID: PAT_TA_32354.pep
AAKAAMEFLDSLCIAGASRNGIQLLKPKSKKKHVQVKLLYRPPSSNGRAIEGAEDAVGGDVTPRPHRRRRESDEGVARKLHRVMNSSPRISFTGPKRPHSIADGKDGGFHSDGGGXDACNGSLTHTPTEVSFVNGGSSVGKSGERAIHSSKTRAPDDDGEQYPWNTAKGSRHIVNNGDGIGNLSAGRKVKIKRKQLFLNQHSNGEQREEHNQETGNQ

SEQ ID NO: 137937 - protein, 236 aa, Triticum aestivum
  Clone ID: PAT_TA_32355.pep
MLEKGPPSHRERHFTAGEVVRDFIMGVSDGLTVPFALAAGLSGASAPSSLVLTAGLAEVAAGAISMGLGGYLAAQSEADHYKREMKREQDEIIAVPDTEAAEIGDIMAEYGLEPHEYGPVVEGLRRNPQAWLEFMMRFELGLEKPDPRRALQSALTIALSYIIGGLVPLLPYMFISTVQDAMLTSVGVTLLALLFFGYIKGRFTGNRPFLSAVQTTIIGAVASAAAYGMAKAVQAR

SEQ ID NO: 137938 - protein, 106 aa, Triticum aestivum
  Clone ID: PAT_TA_32356.pep
AVSSRYGYSLMSIMWLEYMGYSLVLWCVSGSCRCDGTMSHVRASLGRLHSSKISLTPSTPLWSNSRSCSSTLEQRFILFGLQPASNSRMRIFGGKSLLCPYFLFNC

SEQ ID NO: 137939 - protein, 120 aa, Triticum aestivum
  Clone ID: PAT_TA_32357.pep
RSRPRGGLLLSSLFLSCSSLSSLIHTRRHAAPAMALLEVPVQQEREPEVRRDQEEGGKGRGGGARRRCGVAGEAACGGEGSSGRMEQREAERSGLGWVFRVIFVKVKHYPLKQGLRVEFE

SEQ ID NO: 137940 - protein, 171 aa, Triticum aestivum
  Clone ID: PAT_TA_32358.pep
NNPGGLVTAGLDVAQIWLDGDETLVNTVDREGNVQGGRPGGGQSLTHDPLVVLVNEESASASEILAGALHDNGRAILVGHKTFGKGRIQSVTELDDGSALFITVAKYLSPALHEIDHVGIQPDIQCTADALSLPRAPSLTGNNEAASLEMDSCIMVAEQALEIQQSKGSAS

SEQ ID NO: 137941 - protein, 281 aa, Triticum aestivum
  Clone ID: PAT_TA_32359.pep
MRLYSPNLRQAAAGPGAGSGVTNAPFAAALGKSSSSSLIHGRLSFGHASLQTPNHRTKRAGWAVRVLPLTEENVERVLDEVRPSLMRDGGNVALHEIDGLVVVLMLQGACGSCPSSTMTLKMGIESRLRDKIPEILEVEQIHDTETGLELNTENVEKLLDEIRPYLSGTGGGSLELVQIDGFVVKIQISGPAAGVMPVRVAVTQKLREKIPSILAVSVAQEYEAITLQLCINQRKTIFSFVITFPCQYFSLLVHRNHRREKLNLLIQKACTRDRGGREENT

SEQ ID NO: 137942 - protein, 134 aa, Triticum aestivum
  unsure (1)..(134): unsure at all Xaa locations
  Clone ID: PAT_TA_32360.pep
PLVRGITGLFAPGEVAGTRIGFHAGLVDKSLPMAXPMAPTKXNRXVPDGPDRPXLESVPLPPMLVAVAEKDLIRDTNLEXCDALRXAGKEVEVLINRGMSHSFYXNKFAVDMDPTTGERAQELIDAIKSFVARH

SEQ ID NO: 137943 - protein, 154 aa, Triticum aestivum
  unsure (1)..(154): unsure at all Xaa locations
  Clone ID: PAT_TA_32361.pep
GIRHEGTXGFEPGAVIMGDYVLELNGGSNNSMFADGDEFDLEERLNFFTSMDRTLNERIDFYESSEGSLDESIDFLASLFGRGRRIASGDSHSRAYRRHRERPRRNHLGISVDSSDIRQGPVNTQRGQRVAAVRGRAPRRHHPMVTHVRSTRGS

SEQ ID NO: 137944 - protein, 84 aa, Triticum aestivum
  Clone ID: PAT_TA_32362.pep
YYSVGILATKPSCSGRYSAEISSQKPPCSGRHSAEISCRKTLQSRATPCSNIFPENSRLVRRNSVRFHSKKPWFLRGDSAEFFS

SEQ ID NO: 137945 - protein, 185 aa, Triticum aestivum
  unsure (1)..(185): unsure at all Xaa locations
  Clone ID: PAT_TA_32363.pep
MPIAMPSMPAPALALALLGAFGLAIAPVVHSAPTIEAIQSTCAKTIQPDSCKHVXLLANMAAGSPEVNSVPLMSLQVAAKLAKMANXFANARLTTDPHPAKCLANCIDDIHRVAKALEGLPVEAVKPGDEAGVLSFSSEFRPTCGEDCPKPIPERTEDGRATRDKFVGVMRAIGVMQDLFITKTW

SEQ ID NO: 137946 - protein, 125 aa, Triticum aestivum
  Clone ID: PAT_TA_32364.pep
VRKSVLPLLPLSPATRPPSPLFVPGDANGERLPRRREKEPAAAADGAAGRLPVPRDRNPSIGPSVPIGALVTRGCPEGWPGSASADGDSRGWAQYADEGPWGCSKALRLLLNGRQSSSTMVTKSS

SEQ ID NO: 137947 - protein, 772 aa, Triticum aestivum
  Clone ID: PAT_TA_32365.pep
MSMATKQATLPRSGAFSKGYNFAYAWEKNAPVTEEQNAAISALSHAVAERPFPVNLEDGGTAVPEKESALEEAGAMDAVLVNTHQFYKWFAELESAMKSETEEKYRLYESTLEERVNTCDGILQQVDGTQNLFEELQSLHSSVAIKTQTLHDACDQLLVEKQRLIGFAEALRSRLNYFDELENASTSFYSQTMNIGNEQFLPLLKRLDDCILYVENNPLYAESAVYLVKFRQLQSRALGMIRSHVLSTLKAASSQVQAAIRGSGSGKNAVTEGVEASLIYVRFKAAAGELKPVFNEIESRSSKKEYAQTLSECHSLFCEQRLYLIRGTVQQRISEFAKKETLPSFTRSGCAYLMEACQFEHQLFAHFFPASAPDVSTMAPLMDPLCTHLYDTLRPRLIYEGNIDSLCELVDILKVEVLGEQLSRRGKSAAGLRPILQRILADVLERLAFCARTHIREGIANFRPSDEDLDYPGKLERSTISSANVSDNSDMYATWYRPLEKTVSCLSKLYHCLESSVFTGLALEAVEVCTASLQSASKVIAKRATPMDGQLFLIKHLLILREQIAPFEIEFSVTHKELDFSHLLDHLRRILRGQVSLFDWSRSTSLARTFSPRILENQIDARKELEKGLKSTCEEFIMSITKLVVDPMLSFVTKVTAVKVALSSGSQGQNLDSVLAKPLKTQAFASPDKVAELVQKVGTAIQQDLPKAMTKLMLYLQNPSTRLIIFKPIKSNIVEAHIQLQSLLNSEYSAEEIQSIGMLSISDLQSQLDSLL

SEQ ID NO: 137948 - protein, 149 aa, Triticum aestivum
  Clone ID: PAT_TA_32366.pep
MDPEAVRRTLEPTASAADISGSTPYDSFVISGVRLEAAEHGRVLCSFVVTPRIASPQGYLLSGVTATLADQLGSAVFFSSGVGTSGVSLEISVSYVDTAAVGEEIEVEAKLLRAGKSVGVVSVDFRKKRSGKLMAQARHTKYLAVSSRL

SEQ ID NO: 137949 - protein, 103 aa, Triticum aestivum
  Clone ID: PAT_TA_32367.pep
PDVEGDRKFQISTLATKLGVRNIAFLGSGLLLANYVVAIVVPFLIPQAFRSFVMVPFHAALAVALIFQTWVLEQAKYSKDAISQYYRFIWNLFYAEYIFFPLI

SEQ ID NO: 137950 - protein, 100 aa, Triticum aestivum
  Clone ID: PAT_TA_32368.pep
PSALKSIVIMTRMAQSLELTWHKMSTPISSLLSMFSSPLSLFLPLAVRPQPWRTSCSTRMLATMADQPVARVMSPAGSPPPSSPGRLTCLRKLPTQVDPR

SEQ ID NO: 137951 - protein, 115 aa, Triticum aestivum
  Clone ID: PAT_TA_32369.pep
MEAARKEEDGGSRGDDKLPQVVFDRILRRQMVYDALKRGGGAEVPSWVQLLTILLSFGTSALGIAYCSSSQPHRCSNSPQPHRSGSSPQPHRSGSSSPPQFLFPQLLLLEQLLRR

SEQ ID NO: 137952 - protein, 184 aa, Triticum aestivum
  unsure (1)..(184): unsure at all Xaa locations
  Clone ID: PAT_TA_32370.pep
YRPDNLLDSEYWLARLAARQSAHTWSATRRPDHSLPRPRRPPRRPPPRRCSPAAAARRDRSSPSSRAPRRPPPGNPPSXTLASTTAPPPPWPASSTTRRRRTRPSVPGCWRAARRTSPPARPRRRRSPRACRCRRRQASRTMALAAPPARTSWTRRLLPLVKPRACPPRWHPSPPPPWPASSLV

SEQ ID NO: 137953 - protein, 71 aa, Triticum aestivum
  unsure (1)..(71): unsure at all Xaa locations
  Clone ID: PAT_TA_32371.pep
IGFVIVRGFLSIYLKEGTNEDKRNLLLIFFYPSEIYRILFFLFHPKXFFFILFHYFIPSRSKKEPNALKFH

SEQ ID NO: 137954 - protein, 72 aa, Triticum aestivum
  Clone ID: PAT_TA_32372.pep
NNAKGATVGDAVKKIGMLGLFTRGLPLRIVMIGTLTGAQWGIYDAFKVMVGLPTTGGAPPVAPVEEAAKAIA

SEQ ID NO: 137955 - protein, 160 aa, Triticum aestivum
  Clone ID: PAT_TA_32373.pep
MALSDLSRDSLLPSFLYSSRSFAAAAPRFPSSPSPYQAPASPAAAPAAGLVGAGGVGGSRPFSIRAPNEKIDMYSPAFYAACTAGGIASCGLTHMAVTPLDLVKCNMQIDPAKYKSITSGFGVLFKEQGARGFFRGWVPTLLGYSAQGACKFGFYEFFKK

SEQ ID NO: 137956 - protein, 213 aa, Triticum aestivum
  Clone ID: PAT_TA_32374.pep
VRPRVRPRVRKTLIYLAGSASAEVIADIALCPFEAVKVRVQTQPGFARGLSDGLPKFIKAEGAAGLYKGIVPLWGRQIPYTMMKFASFETIVELIYKHAVPVPKAECSKSSQLGISFAGGYIAGVFCAIVSHPADNLVSFLNNAKGATVGDAVNKIGMLGLFTRGLPLRIVMIGTLTGAQWGIYDAFKVMVGLPTTGGAPPVAPVEEAAKASA

SEQ ID NO: 137957 - protein, 397 aa, Triticum aestivum
  unsure (1)..(397): unsure at all Xaa locations
  Clone ID: PAT_TA_32375.pep
MAPSHLSRESGKPRQRCTPPPIRAPTPRPRAAGAPRPPPRLAPPALAVLPALVRRRRVPPLPLLPGALPRASPARPAPGFCPRRPCRGRRAAGPSRSARPTMKIEMYTTAFYPACTAGMESPGCGVIFXSVAPLELRXCNMQIDPXRTRGISSGFGVLLKEQGARGFFRGWVPTLLGYSAQGACKFGFYEFFKKTYSXLAGPENAVKYKTLIYLAGSASAEVIADIALCPFEAVKVRVQTLRLDLLHWYEMMDFPSFIEAEGAAGLYTGIVPHWGXRMPYTXMMKFVLLXTIVVLTVLSFLTLFPTADCCKYSQLGISLAGGDIAVVMWAIVSQPADTLYLHSWNNAKXARVGDDALKSLAWWAFYPRXGLPLGIGKMGTRLXALWVIYSSTSNSMV

SEQ ID NO: 137958 - protein, 45 aa, Triticum aestivum
  Clone ID: PAT_TA_32376.pep
DGAMYICPNEKLQNDTRIHRTMKDTLFKQNSRPNLNLSFSRPPQS

SEQ ID NO: 137959 - protein, 223 aa, Triticum aestivum
  unsure (1)..(223): unsure at all Xaa locations
  Clone ID: PAT_TA_32377.pep
GNQKVQDLLLLDVTPLSLGLETAGGVMTTLIPRNTTIPTKKEQVFSTYSDNPPGVLIQVYEGRPARTKDNNLLGKFELSGIPPAPRGVPQITVCFDIDANGILNVSAEDKTTGQKNKITITNDKGRLSKEDIEKMVQEAEKYKAEDEEHKKKVDSKNALENYAYNMRNTIKDDKIAFKLPDADKKKIEDSIEYAIKWLDDHQLAEADEFDDKXKELESICNPS

SEQ ID NO: 137960 - protein, 202 aa, Triticum aestivum
  unsure (1)..(202): unsure at all Xaa locations
  Clone ID: PAT_TA_32378.pep
MAGKGDGPAIGIDLGTTYSCVGVWQHDRVEIIANDQGNRTTPSYVAFTDTERLIGDAAKNQVAMNPINTVFDAKRLIGRRFSDASVQSDAKLWPFKVIPGPADKPMIGVQHRGEDKQLSAEEISSMVLNKMKETAEGYLGTTIKNAVVTVPAYFNDSQRQATKDAGVISGLNVMRIINEPXSAAICYGLDRCSQRSALPFHL

SEQ ID NO: 137961 - protein, 246 aa, Triticum aestivum
  Clone ID: PAT_TA_32379.pep
MASKGGNKGEGPAIGIDLGTTYSCVGVWQHDRVEIVANDQGNRTTPSYVAFTDTERLIGDAAKNQVAMNPTNTVFDAKRLIGRRFSDASVQSDMKMWPFKVVPGAGDKPMIVVNYKGEEKTFSAEEISSMVLTKMREIAEAFLSTTINNAVVTVPAYFNDSQRQATKDAGVIAGLNVMRIINEPTAAAIAYGLDKKSTSVGEKNVLIFDLGGGTFDVSLLTIEEGIFEVKATAGDTHLGGEDFDNR

SEQ ID NO: 137962 - protein, 161 aa, Triticum aestivum
  Clone ID: PAT_TA_32380.pep
VKLKEIKSTLTTMINEEAEISEVTEVVKQQVKDAKFPDIEVVRMLWDVLMEAVQWSGKNQQQNSNSALRQVNAWAGLMNAFCTSGKLELELIYKVQTQCYEDAKLMKLFPEIIRSLYDQDVLAEDTILLWFRKGSNQKGRQSFVKALEPFVKWLEEAEEEE

SEQ ID NO: 137963 - protein, 487 aa, Triticum aestivum
  unsure (1)..(487): unsure at all Xaa locations
  Clone ID: PAT_TA_32381.pep
PGGDHRQRPGQPHHAVLCRLHRHRAAHRRRREEPGRHEPDQHRLRCEAAHRPAFLGLVGPERRQAVAVQGDPRSRRQPDGIGQQYKRKKSEDISGNPRALRRLRTACERAKRTLSSTAQTTIEIDSLYEGIDFYATITRARFEELNMDLFRKCMEPVEKCLRDAKMDKTHIHDIVLVGGSTRIPKVQQLLQDFFNGKELCKSINPDEAVAYGAAVQAAILSGEGNEKVQDLLLLDVTPLSLGLETAGGVMTMLIPRNTTIPTKKEQVFSTYSDNQPGVLIQVYEGERTRTKDNNLLGKFELSGIPPAPRGVPQITVTFDIDANGILNVSAEDKTTGQKNKITITNDKGRLSKEDIERMVQEAEKKYKTADEQHRKKVDSKNALENYAYNMRNTIKDDKIASKLPEADKKKIEDTIDGAITWLDNNQLAEAEEFDDKMKELEGICNPIIAKMYQGAGAXMPGGMDEDAPXPSAAGGSSGPGPKIEEVD

SEQ ID NO: 137964 - protein, 263 aa, Triticum aestivum
  unsure (1)..(263): unsure at all Xaa locations
  Clone ID: PAT_TA_32382.pep
VMLHQLXNGNEATXISIMSNNITELSFSPKCKNVTTLLMQNNPNLNKMSYGFFRTMSSLKVLDLSHTAITSLPECDALVALEHLNLSHTHIMRLPERLWLLKELRHLDLSVTVALEDTMNNCSKLHKLKVLNLFRSHYGIRDVDNLNLDSLKELLFLGITIYAEDVLKKLNMPRPLAKSTHRLNLKYCADMQSIKISDLSHMEHLEELYVESCYDLNTVVADAELTTSQLQFLTLSVLPSLESVLIAPMSHNFQYIRKLIISH

SEQ ID NO: 137965 - protein, 70 aa, Triticum aestivum
  Clone ID: PAT_TA_32383.pep
LSVIIIKHQGAIFSSQHLSLKLLFLLCAVLGRAKVLRDDGELTKEVHCSDILQALRYSPPFATYQPSDRP

SEQ ID NO: 137966 - protein, 305 aa, Triticum aestivum
  Clone ID: PAT_TA_32384.pep
MDGGGGVGGGMGPVGGGVGGMVGPVGVGGGGGGSDVELVSKTLQFEHKLFYFDLKENPRGRYLKISEKTSTTRSTIIVPIAGVAWFLDLFDYYIRTDERDVFSKELRLDTKVFYFDIGENKRGRYLKVSEASVNRNRSTIIVPAGSSGEEGWEAFRNVLLEINDEASRLYVLPNHPSQQHLEPPERLPGLSDDVGAGFIAGHGSQSASVPEVDVDGPPIEEFSGMGLSKVIRADQKRFFFDLGSNNRGHYLRISEVAGADRSSIILPLSGLKQFHEMVGHFVDIMKDRLEGMTGANVRTVEPSQR

SEQ ID NO: 137967 - protein, 110 aa, Triticum aestivum
  Clone ID: PAT_TA_32385.pep
MQDHASDEQEDHAMVETSRNDTGQSDFPKLRLIVLTGLKKLRSICKPREFPCLETLRVEDCPNLRSIPLSCTHNYGKLKQICGSVEWWEKLQWENREEVACLDSKYFIPI

SEQ ID NO: 137968 - protein, 564 aa, Triticum aestivum
  Clone ID: PAT_TA_32386.pep
RKKTAGATSSLGLSTSFLPGHDTRLRRRRRAAPAAASSFRPVVASAELGAEVGRQLVEAVGVGLPCTVMACGDVIYRSTLPHNDGLTITAPGVALALAAASYLWATPGVAPGFFDMFVLAFAERLFRPTFRKDDFVPGKKLGEGAFGVVYKASLADPKAAEKQGDVVVKKATEYGAVEIWMNERVRRACASSCADFLYGFRESKTKGKGEEYWLIWRYEGEDTLSALMQSKEFPYNVETKILGNVQDLPKGIARENKIVQTVMGQLLFALDGLHSTGIVHRDIKPQNVIFSEESRTFKIIDLGAAADLRVGINYIPKEFLLDPRYAAPEQYIMSTQTPSAPSAPVATALSPVLWQLNLPDRFDIYSLGLIYLQMAFPALRTDSSLIQFNRQLKRCNYDLEAWRNLVEPRATPDLRRGFDILDLDGGIGWELLTSIVRRTARQRSRATASLAHPLIHSIEPLGPSAARNPTLPPARVPARERSEAARWIIGLMAKSGKKAGGGFTEAQLQELREIKPKKDSAQRNVLASMLRVQRKIVRTISESMDELTSQRKSIWWSRWIPREE

SEQ ID NO: 137969 - protein, 106 aa, Triticum aestivum
  Clone ID: PAT_TA_32387.pep
WHPGHSLGMDIHDSTSLTLDKPLEPGVVITIEPGIYIPQVPILNENAPDRFRGIGIRIEDEVLITENGHEVLTASVPKEIPHLTTLMNMGGGGSTTESHEARAACN

SEQ ID NO: 137970 - protein, 100 aa, Triticum aestivum
  unsure (1)..(100): unsure at all Xaa locations
  Clone ID: PAT_TA_32388.pep
AKDSAVATAREPEPGGGSGRDCVATPALGDNGACAAPQDPAAGCFERSSCMKPLSLRYVQFLSMHVRFMMVPIKLTNISHRNLRXXVXEXKXKXPXGGPV

SEQ ID NO: 137971 - protein, 71 aa, Triticum aestivum
  unsure (1)..(71): unsure at all Xaa locations
  Clone ID: PAT_TA_32389.pep
GAISWLDTNQLAXVDELEDKMKELEGVCNPIIAKMYQGAGADMGGMGGAAGMDEDAPAGGSGAGPKIEEVD

SEQ ID NO: 137972 - protein, 106 aa, Triticum aestivum
  unsure (1)..(106): unsure at all Xaa locations
  Clone ID: PAT_TA_32390.pep
SKLGFCRTSSVFLQKRPCCCSYSTRSPRDKSARTGTKEKKTAAPLPLRALPRLLLRHPPPVPSRLAALRKPPLASPRLTVLRRPPPALPRLAPSAASYXRHXPPAA

SEQ ID NO: 137973 - protein, 147 aa, Triticum aestivum
  Clone ID: PAT_TA_32391.pep
NAYNHLMKEIEDSFFSQHVITHFALPRARRPTNSLAVVPALAEATLAPAPAAPAPRGPRAQPLGCLPTIRAAPLETPSGALSTPLDAALTPPLALPWGLPPGSWPARALGHAPRRTRSSTGEMACAAVADARPRRPVRARPCAAPHR

SEQ ID NO: 137974 - protein, 62 aa, Triticum aestivum
  Clone ID: PAT_TA_32392.pep
PLLTELAVRLQQDIYTYASTTFLLYKLSISYSQEQVTCKSLLVIAEVFSYLLDLLSNLTHAS

SEQ ID NO: 137975 - protein, 394 aa, Triticum aestivum
  unsure (1)..(394): unsure at all Xaa locations
  Clone ID: PAT_TA_32393.pep
GIDFERPPGQVLSSNNLEGLIPPNIGSLQQLTVLNFSHNNLQGEIPQISALKQLTTLDLSSNKVTGHIPDSLGQCSGLVSLQMDQNFLSGNIPTTFGKLLSLSMLNLSHNNLSGAIPLALSKLEYLGRXTLSYNDLDGELPRNGVFGNATAVSVEGNCGLCGGXGWVLHMPNVVVVVSLGGQRAQFPFVRALIPLFGFTSVVMLTYIIFFGKKTSRRTYSILLSFGKKFLXVAYNDLARATGNFSELNVVGRGSYGSVYRGKLTQAKIQVAIKVFDLDMKCADKSFVTECEVLSRIRHRNLVPILTACLTIDNNGDAFKALIYEFMPNGNLDTWLHNIYSGSSSKCLSLAQRASIATNIADALAYLHNDCERQIVHCDLKPTNILLDDDMNAYL

SEQ ID NO: 137976 - protein, 95 aa, Triticum aestivum
  unsure (1)..(95): unsure at all Xaa locations
  Clone ID: PAT_TA_32394.pep
EFHDSSGGSGEAXFEGVEICNFNLDGAHYMXYTPVDPXXFVAVKDKDGVXRIAEDDLMDDPSIVSAMDEETEFTALVEEEEALLESILHGDDDVS

SEQ ID NO: 137977 - protein, 158 aa, Triticum aestivum
  Clone ID: PAT_TA_32395.pep
VRGRVGRVWSPELARLIRETAEPFVNVIYDADPLPRLSWAGGSVALVGDAAHPTTPHGLRSTNMSVHDARVLGECLARWGQTPPPRALAEYEAARLPVVAAQVLHARRLGRLKQGLPVEDGDTGAFDAWAATAEDALQLRQRGMPYFGGAPTVDGGSL

SEQ ID NO: 137978 - protein, 214 aa, Triticum aestivum
  Clone ID: PAT_TA_32396.pep
SDVVCSLVGAQVLLQSGTLSLDLKEDLHSETDSHPSMVEPGDEEASEHLNNTHGWQNNEALNSTSDEQGKGNMTVGKLMEAYETCIAKLRKSQSSRRKISLKKVEEANFSKEARKLVPEAILKQIISLNSLDMELYDHAKKIFTQEHLMLKAQQSMAGQHRQLAEQEEGWIGTMCSDGTCSPWVVVLLGLGITTILVLATLAVTTRKRTSKLKV

SEQ ID NO: 137979 - protein, 89 aa, Triticum aestivum
  Clone ID: PAT_TA_32397.pep
MATRRSLEPSALVLLAVQLLLFYGAGNAYCSVVSDNTTDRLSLLDFRKAITDDPNGALRSWNDSIYHCMWRGVKCSKSHLGRTCYDSGC

SEQ ID NO: 137980 - protein, 119 aa, Triticum aestivum
  Clone ID: PAT_TA_32398.pep
SGHASIRGDVYSFGIVLLEMLIGKRPTDPMFENELNMVNFVERNYPDKILDIIDVCLRGECKGYIQANIGTENVTYGCLLSLMQVALSCTCQIPGERMNIREATNKLHSIRTSYIRATK

SEQ ID NO: 137981 - protein, 234 aa, Triticum aestivum
  unsure (1)..(234): unsure at all Xaa locations
  Clone ID: PAT_TA_32399.pep
SSIDLAGRLPTNNSKSPKLKRSSNNNDSRSSRSRLHIPIKGRIQLVVSNPEKTPLHTFFCNYDLSGMPAGTKAVNRGRTATXLMNQRREVTXQQNMLLEMECDISESNESSPIGSSESRTNANGCCCQIDSEKKSCCRPSKVNDSSAGGVLRYALHLRFLSPLSKKSSRSMQRTKPGMSSEPLNRSTATEEEKRFYLYNDIRVVFPQRHSDSDEGELRVEHDFPADPKYFDISN

SEQ ID NO: 137982 - protein, 71 aa, Triticum aestivum
  Clone ID: PAT_TA_32400.pep
MASRSCTFLEILLAIILPPLGVFLHYGCCSMEFCICLLLTILGYIPGIIYAVYVLVALGSEERDRDYDTLA

SEQ ID NO: 137983 - protein, 86 aa, Triticum aestivum
  unsure (1)..(86): unsure at all Xaa locations
  Clone ID: PAT_TA_32401.pep
MRTGRTRASERGCPPSDPSSASPMPSPSCPFLESLLAIILPPLGVFLXTGCCSMAFCICLMLTVLGHLPGIIDAVYVLVALGSEER

SEQ ID NO: 137984 - protein, 190 aa, Triticum aestivum
  Clone ID: PAT_TA_32402.pep
REPAMYTTKRCIATAIVVVLWLQAAADARRLSPGGVIRLPSDGRGDFVDQVGSSKVISIEDPFYTCPDGKVLKCKVIAFQWYCDCVREKGVGPTDQAMSATTSSPRKVGEEMLSRKNSGDKGGPTDQVQVTKVLNDLGEPWWPCPDGTVQKCELVAFKIYCKCVPKDGAGLADRSMSARAHSARKKDGAR

SEQ ID NO: 137985 - protein, 172 aa, Triticum aestivum
  Clone ID: PAT_TA_32403.pep
ALFSPPPPPPPRPRPRSLQQLQPVIVRPPTLQPLQLRRLDLARLTAPLWNAQAEDLDMLNLNLNLRAHITHLDMKLTRFRLAPPRIRRAQYPRAHAARLNLYRTIHSLDLAKTRGTEFLKTRRACAMPEKLRFFLCSSHPDIAIELSVNCNWLLHIMYSQIVSTRSLMHLIY

SEQ ID NO: 137986 - protein, 126 aa, Triticum aestivum
  Clone ID: PAT_TA_32404.pep
PRVRAFSAPPDEQLRKSYACYLSTSAGPVMGVMYLSTARVAFCSDTPLSYEAHAGDNTEWSYYKVAIPLHRLRAAIPSASKVKPAEKFIQLVSVENHEFWLMGFVNYSSAVVHLQEALSGFHNLQA

SEQ ID NO: 137987 - protein, 184 aa, Triticum aestivum
  unsure (1)..(184): unsure at all Xaa locations
  Clone ID: PAT_TA_32405.pep
FFFYXKSMNLKILIYIYVNLIYQNLHMNSHIQHNTNMQLQTTRCIKLLSIFLIAPHSCTNQNKLLHNTYYFRYIVCQLKLGCLFSCACHDVLVYVDPSSYRIVTLTPCQKVQGSHRSLVKAVIQYSSHRQPVLYSGQLVEDKFPLSCSGKSYKTVVEGRTWHGSLCPSRPCDRSQPYAQYNCVS

SEQ ID NO: 137988 - protein, 252 aa, Triticum aestivum
  Clone ID: PAT_TA_32406.pep
MATVAATMATPTRHRQFRVRAAWDMTAGAATVAVPKPSKDKPKPALGQSPAAATTPARAPPPTHADLFARSSEDQAKKSTYMGFEKWWLPPAPEVKKPRSLYNAASLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQMMFQLGFTSGASSQNIADELLSSFQKTTSTSVQSQQPAKR

SEQ ID NO: 137989 - protein, 114 aa, Triticum aestivum
  Clone ID: PAT_TA_32407.pep
MLASFTAVVSGYKERSLSRYARVGRALVLYEIGDRDESITEMEDVSVALKGYPEIHAALAAALYADKHAPLLAEFQFNIATLLDPHYSDLAYVRDTKHWPPSLVASLKNFITLT

SEQ ID NO: 137990 - protein, 96 aa, Triticum aestivum
  Clone ID: PAT_TA_32408.pep
MASMQSWRKAYGAIKDTTTVSLANINSDFKDLDVAIVKATNHVECPPKESHLRFKAPATSIARPPTDIAYCIHTLSRALSKIRSLIALKTLVGMWS

SEQ ID NO: 137991 - protein, 252 aa, Triticum aestivum
  unsure (1)..(252): unsure at all Xaa locations
  Clone ID: PAT_TA_32409.pep
MASMQSWRKAYGAIKDTTTVSLANINSDFKDLDVAIVKATNHVECPPKERHLRKIAAATSIARPRXADIACCTPPLSRXLSSDWQFLKRLLLGRRLLREGDPTFGEELFNFTRRGRILQLSNFKDDSSPIAWDCSAWVRTYGQFLEERLECFRILKYDVEAERLSKQGQGPEKGHSRTRDLDSQDLLEQLPALQQLLYRLVGCRPEGAANNNYLVQYALALVLKESFKIYCAINDGIINLVDKFFEMARHEA

SEQ ID NO: 137992 - protein, 57 aa, Triticum aestivum
  Clone ID: PAT_TA_32410.pep
QKCCTAFFTVNSETLRIKLIGWHSGCLTYKDVNREEDCNCRVSSPIRIGQESSDDRR

SEQ ID NO: 137993 - protein, 68 aa, Triticum aestivum
  Clone ID: PAT_TA_32411.pep
MAVVELKVGMHCDRCIKSIKKAIKTIDDMESYQLEKETNKVTVTGNITPEEVVKALQKIGKTVTYWGE

SEQ ID NO: 137994 - protein, 204 aa, Triticum aestivum
  Clone ID: PAT_TA_32412.pep
LTCSNASDVLKCAFDLTEAALNHQYEGCTATVLLICLGRYFAGPALCAIRGGSAAMMCVPGKPIAMTEDHRVVSTTERARIAKLGNPLKDGESRICGLNLCRMLGDKFLKEQDPRFSKEPYVSPVVQISKSCSAFALIASDGLWDVITAKKAAQLVLDYKERNMGQEISADGVADHVLSEARNLRTKDNTSVIFLDFDAMRMGR

SEQ ID NO: 137995 - protein, 138 aa, Triticum aestivum
  Clone ID: PAT_TA_32413.pep
SAAWAVTLRDDENVYMTVARPEKAWAGGGSGKKAPEALVVDITLDPCEYVKFDVLVNVPKGQEYKVGPRNAEFAGSFTHVPHGRSFGGGMAMIQVSYQFALRELLEDLKSGDDGQLDITIVPVNADEVVIDDARIELL

SEQ ID NO: 137996 - protein, 155 aa, Triticum aestivum
  unsure (1)..(155): unsure at all Xaa locations
  Clone ID: PAT_TA_32414.pep
FQEKSGGVVDVTQVKGGEARKVASEXTGQARQDRAVEAKDHDGDDSLGSEASGNDVGCGQSLQGRRSXGGEHTGNCVGDKSEAAEKTGTEPAETTQERPTAAAQQVQDTPAQXTKDTPIAPKGNVFQQAGGNMVGAATDTKDAVMNAPGMGGDKQ

SEQ ID NO: 137997 - protein, 430 aa, Triticum aestivum
  unsure (1)..(430): unsure at all Xaa locations
  Clone ID: PAT_TA_32415.pep
DSXAISESDGEDDFHSVQDDAFSPNGFENEAALGMRDANGGSFNGAEHPHRKPRSSELPKGHLENGARPSASHEDGRRVSGGASPSSGGILDNCGLLPNNCLPCMASAVGVNEKKRALSTSPTHSMKMPSLKLSFKKKSGEANPSSTLLSTKDFLERPIAGSQVQLCLLEKKVLNSWSHIDPGTFRVRGSNYLRDKKKELAQNCAAYYPFGVDVYFSPQKLHRSSRFVXSPDIQTSRKLPPLLVVNVQVPLYPASLFQNETDGEGMSFVLYFRLSEGYSKELSPLFIENIRRLVDDDVEKIKGFPMETSISFRERLKILGRVANLEDLPLSAAERKLMHAYNEKPVLSRPQHQFFLGDNYFEVDIDMHRFGYISRKGFETFLDRLKICMLDVGLTIQGNKPEELPEQVLCCVRLNGIDYAKYQPLMTNGA

SEQ ID NO: 137998 - protein, 115 aa, Triticum aestivum
  Clone ID: PAT_TA_32416.pep
EGAPVAWGSGGTYCAAAPTYPNVDTKLGDPSILRGIMRPVPVSDALRKFGGAAHISRSGVLKIVWDYIKAKDLQNPLNKREIICDEKLKTIFPGRDTVHMMEVTKLLSPHFVKTI

SEQ ID NO: 137999 - protein, 113 aa, Triticum aestivum
  Clone ID: PAT_TA_32417.pep
GPSYGRKKNDDDDDEDRQRRYKKRDDDDDDERKPRHKKHDDDDDDDGERKPRYKKRDDDDDDEDDRKPRYKKRDDDDDDDRKPRYKKHDDDDDDDDERKQRRGNNRRRHDYDD

SEQ ID NO: 138000 - protein, 217 aa, Triticum aestivum
  Clone ID: PAT_TA_32418.pep
RKFTPLTVQLRKESHMYDLSDTRLSSAEIQVSRTDQLHMEDETARTESLGGDDIFVNKNCNVDMVNAYKGLDSCENTQSLLGGCIEVDSINGIESQSMRKRASASSSSSNNISSDTYSSFHSYGTKETDSWVRPHLEHDGSGLLLQAYDDDIEKICAVMNELAGGGVDGSADRIMDETLYSNGVDDFMILPAGKNGEKKKQLTIDQEFEQYFSKLML

SEQ ID NO: 138001 - protein, 120 aa, Triticum aestivum
  Clone ID: PAT_TA_32419.pep
EVTRPEVPSQVHFQPQTRMEVRDEVASDDTAARYNGVQQQQQYTLHRHRVQGGIAPSTSEASSSWTGREGGVVPVWSPPAASGHSDPYAADETDISRSYLDRHPQQSHRLMNWNQLSQSS

SEQ ID NO: 138002 - protein, 124 aa, Triticum aestivum
  Clone ID: PAT_TA_32420.pep
MEEARGKETTEGVAADVSLKDLSRRLEDFAKERDWEKHHSPRNLLLAMVGEVGELSELFMWKGEVQKGLPGWEEREKEHLGEELSDVLLYLIRLSDMCGVDLGDAALKKIVKNAVKYPAPSKSA

SEQ ID NO: 138003 - protein, 169 aa, Triticum aestivum
  Clone ID: PAT_TA_32421.pep
EDEIVGLKEMFKMIDSDNSGQITYEELKVGLKKVGANLQESEIYALMQAADVDKSGTIDYGEFIAATLHLNKVEREDHLFAAFQYFDKDGSGYITPDELQLACEEFGLGSDDLSLDNMIREVDQDNDGRIDYNEFVAMMQKPALGLAKKAGAGLESSFSIGFREALRMA

SEQ ID NO: 138004 - protein, 85 aa, Triticum aestivum
  unsure (1)..(85): unsure at all Xaa locations
  Clone ID: PAT_TA_32422.pep
MAKCLAVALLXAGGARVLRREGAEXEGCSDAWRRCGRWRRRVXGVGLACARGSRYGNQHHYRPAGGGSWDPCYWPMIISSSCAGL

SEQ ID NO: 138005 - protein, 140 aa, Triticum aestivum
  unsure (1)..(140): unsure at all Xaa locations
  Clone ID: PAT_TA_32423.pep
QLAKCLAVALXAAGGARVMRREGAEXEGCSDAWRRCGRWRRRVXGVGLAFARGNRYGNQHHYRPAGGASWDPCYWPMIISGSCAGLQGAKARLVALDSVGSTAGKEKADVLLISMFSVMSACINCHLYLFPVHVLVFFVP

SEQ ID NO: 138006 - protein, 154 aa, Triticum aestivum
  unsure (1)..(154): unsure at all Xaa locations
  Clone ID: PAT_TA_32424.pep
RRRHQWALVSMNHDTQSCMXPNVMEAKVVVSSCGHDGPFGATGVKRLQDIGMIQAVPGMKALDMNTAEDAIVRLTREVVPGMIVTGMEVAEIDGAPRMGPTFGAMMISGQKAAHLALKALGRPNGIDGTLKNVTPALHPEMILAATNNGDIVDA

SEQ ID NO: 138007 - protein, 96 aa, Triticum aestivum
  unsure (1)..(96): unsure at all Xaa locations
  Clone ID: PAT_TA_32425.pep
HFRQVSSIKFGEADDADSVVKTAKKIPTKKFNDLTGNNIFXGDAAEAPGTAEKQLSDAKLKEMSGSNIFADGKAPARDFLGGIRKPPGGESSIALV

SEQ ID NO: 138008 - protein, 344 aa, Triticum aestivum
  Clone ID: PAT_TA_32426.pep
KESQRPVYPFPAIVGQDEMKLCLLLNVIDPKIGGVMIMGDRGTGKSTTVRSLVDLLPDISVVVGDPFNSDPFDPEVMGPEVRDRLLKGEDLPVTTTKITMVDLPLGATEDRVCGTIDIEKALTEGVKAFEPGLLAKANRGILYVDEVNLLDDHLVDVLLDSAASGWNTVEREGISISHPARFILIGSGNPEEGELRPQLLDRFGMHAQVGTVRDAELRVKIVEERARFDKDPKTFRQSYLEEQGKLQDQITSARSNLGSVQLDHDLRVKISQVCSELNVDGLRGDIVTNRAAKALAALKGRDIVTVEDIATVIPNCLRHRLRKDPLESIDSGLLVVEKFYEVFG

SEQ ID NO: 138009 - protein, 251 aa, Triticum aestivum
  Clone ID: PAT_TA_32427.pep
MADYHFVYKDVEGATTQWDDIQRKLGNLPEKPAPFKPPPFAPRADADEQPRSKEWLDARDPDELEELEDDLDDDRFLEQYRRMRLAELKEAAKTARFGTVQPITGSDFVREVSQAPPDVWVVVFLYKDAIPECGLLETCLEELATKYAETKFVKIISTDCIPNYPDRNVPTILVYNNSAVKGTYVGLQKFGGKKCTPESVALALCHSDPVLNDGQGGGDSSRNNVMEGVRRKFIEKVVSQLETREDEDDSD

SEQ ID NO: 138010 - protein, 329 aa, Triticum aestivum
  unsure (1)..(329): unsure at all Xaa locations
  Clone ID: PAT_TA_32428.pep
MEGREDDKKGGAAAPGSSAPGTRFKNLVSREYYSHKKKVHSVAWNCIGTKLASGSIDHTARVWSIDPHGHSKVKDIELKGHSDSVDQLCWDPKHPDTVATAAADKSIRLWDARSGKCQVVELSGENINITYKHDGTHIAVGNKXDELTIVDVRKLKPVHKQKFPYEINEIAWNKTGDLFFITTGLGFVEVVNYPSLDVVCKLNAHTAGCYCIAMDPLDRYFAVGSADSLVSLWNVKELLCIKTFTKLEWPVRTVSFNHTGEFIAYASEDPFIDIANIQTGRSIHQIPCKAAMNSVEWNPKYNLLAYAGDDKNKYQADDGVFRIFGFEST

SEQ ID NO: 138011 - protein, 342 aa, Triticum aestivum
  unsure (1)..(342): unsure at all Xaa locations
  Clone ID: PAT_TA_32429.pep
MATTASSLLKPSFSGVRLPAAARTPSCVATPRAGAICNYXSSSSTPPYDLNAFKFSPIKESIGVPDEMTRHYMTDMITYADTEVVIVGAGSAGLSCAYELSKDPSISIATIEQSVSPGGGAWLGGHXSFSAMVVRKPAQLFXDEPPTXYDAQDDFVLITARPAHHLSPRMSXLHARAVKAPLVKRQSPESDLHRDAGARIXGRVTNWAAVTMNYDTPGGAPDHKARGGESAASSGGRDRRLRAPSRSGRREDTGRLAGSGEGIKAPDMNTGXDAIVSFTREGXPAMAVAGMELAETEGAPSNGPXNFGAMMIAGQXKAAHRALKGPPGRSSNGHAIRHAQPA

SEQ ID NO: 138012 - protein, 231 aa, Triticum aestivum
  Clone ID: PAT_TA_32430.pep
MSMLEAFFGKGGGGAGGGFRAAKCKTLLKLSIPRIKLLRNRRELQLRQMRRDIAKLLEAGQEATARIRVEHIIREENMMAAQEILELFCELVAVRLPIIEAQKECPIDLKEAISSICFAAPRCSDLPELMQVQMMFATKYGKEFAAAAAELMPDSGVNRQIIELLSIRPPPVDIKMKLLKEIAEEHEIDWDPSATETEYLKPHEDLLNGPTYFRGSTLPLSREKHVEPVAA

SEQ ID NO: 138013 - protein, 510 aa, Triticum aestivum
  unsure (1)..(510): unsure at all Xaa locations
  Clone ID: PAT_TA_32431.pep
VSGTRASAPSLLIHIQLGRSLTISFETASAGVLVVGLSGASIYLCLYAHHTNLYQTNLSGAWRRRIIHDGFCFLWSPVEAPRPPQTTFLXGKKVKKQGGCVRXYQHGGNKINDRGGSRPMAGQKGPEGRSKADRMPDRMVRVTLYDVSRWQXDMTGKRDRVDPLIQXPMCAGAPEEPATTHLQISQGLREDEXSNTWTDCKSPRHACNKNIFHLAKNFMTLPTIKVPXSPLGIWGGKGQGKXRFQCELGASPKMGINPIMMSAGELESGNAGEPAKLIRQRYREAADIIKKGKMCCLFINDLDAGAGRMGGTTQYTVNNQMVNATLMNIADAPTNVQFPGMYNKEENPRVPIIVTGNDFSTLYAPLIRDGRMEKFYWAPTREDRIGVCKGIFRTDNVPDEAVVRLVDTFPGQSIDFFGALRARVYDDEVRKWVGEIGVENISKRLVNSREGPPTFDQPKMTIEKLMEYGHMLVQEQENVKRVKLADKYLSEAALGQDNDDAMATGAFYGK

SEQ ID NO: 138014 - protein, 174 aa, Triticum aestivum
  Clone ID: PAT_TA_32432.pep
SQTIPKAISFVPSRALRGTIGYIAPEMISRSFGVISSKSDVYSFGMMLLEMAGGRRNADPNTGNSSQAYYPAWVYDRLTQQDHVGEIYAHVDAQMHELERKLCIVGLWCIQMKSHDRPTMSEAIEMLEGSADTLQMPSRPFFCDEGHVHTDDTYRLSSELTEISEEDMSENIDV

SEQ ID NO: 138015 - protein, 212 aa, Triticum aestivum
  unsure (1)..(212): unsure at all Xaa locations
  Clone ID: PAT_TA_32433.pep
LFDLDGKEXMRRTIKVNDPLRYGGITIYQTDWGFSALQVKKXGEGPFNLAMAPLQLNGNKKLYGTFLPLQDSDSSGVKGISMLARDLQSIVLYDQDGKFVGVRRPSSKLPIEINGNEILIEDAIGSTGLDLKTDPGIPIVYAGFGALMLTTCISYLSHAQLWALQDGTTVVVGGKSNRAKIEFSDEMNRLLNKVPELVSVGEKTVDNKSSTA

SEQ ID NO: 138016 - protein, 119 aa, Triticum aestivum
  Clone ID: PAT_TA_32434.pep
RAVAGGTSLPLGRKKFKKLDFFCSRYLIIVGQRETRLPGGNRIYRPVPKTMTLATVAAAAAAAAGTSAVGTGMVAAAAAQAPTRSRSPCIGRRSATKCQMLHTDVATCLHVVTTRICGQ

SEQ ID NO: 138017 - protein, 323 aa, Triticum aestivum
  Clone ID: PAT_TA_32435.pep
LCEELQGNPNYCDTCKQCDYEIAPADRSSSAGVLARDNMRLVTADGERANMDFVFGCAHDQQGKLLDSPASTDGILGLSNGAMSLPTQLAKQGIISNVFGHCIATDPSSSGYMFLGDDYVPRWGMTWVPVRNGPEDVYSTVVQKVNYGGQELNVREQAGKLTQVIFDSGSSYTYFPHEIYTSLIASLEAASPGFARDESDQTLPFCMKPNFPVRSVDDVKQLFKPLLLHFSKTWFVIPRTFAIAPENYLIISDKGNVCLGVLDGTEIGHSSTIVIGDVSLRGKLVAYDNDGNQIGWAQSDCSRPQKASRVPFFLSRALLGQLL

SEQ ID NO: 138018 - protein, 206 aa, Triticum aestivum
  Clone ID: PAT_TA_32436.pep
VVRTFRVDRSLSLPSDWAVPSPIQQLSHLAQRVGAVNLAEGFPDFPAPAHVKAAAAAAIAADLNQYRHVQGICDVLAATMKRDHGLDVDPLTDFAICCGQSEAFAAAIFAVIDPWDEVLLFDPAYETYQTCIELARGVPVYVPLDPPSWTLHADAFLKSFTRHTGAVILLSQHAPTTYHSCIAQALIVPLACQLDPPSWTLDADKF

SEQ ID NO: 138019 - protein, 178 aa, Triticum aestivum
  unsure (1)..(178): unsure at all Xaa locations
  Clone ID: PAT_TA_32437.pep
FTNIDFELEIYFHRDWLEVLGCGXVTEQEILKSNGRTDHVAWAFGLGLERLAMVLFDIPDIRLFWPNDQRFTSQFSKGKLGVKFKPFSKFPPCYKDMSFWINDEFTENNLCEVVRGIAGDLVEEVKLIDNFTNKKGMTSHCYRIAYRSMERSLTDEEINDMQWNVREEVKSKLRVELR

SEQ ID NO: 138020 - protein, 61 aa, Triticum aestivum
  Clone ID: PAT_TA_32438.pep
SHGTHTSATFATKYKDHLLSFLKATQQNYSKLNAIVFLKPLCHQRLIHKLILYSVIPNQAS

SEQ ID NO: 138021 - protein, 114 aa, Triticum aestivum
  unsure (1)..(114): unsure at all Xaa locations
  Clone ID: PAT_TA_32439.pep
APPPPARXPPSPSPPSRSPASPTPRPTPPSPPPSTPPSSPTIPTPSSPSPTPPSSPTSTXPPPPPSPSPPSRPSRRGPGTPPRSPSASTSTGHTSGPTRPLRSRAATGAPWRSR

SEQ ID NO: 138022 - protein, 184 aa, Triticum aestivum
  Clone ID: PAT_TA_32440.pep
VRPRVRSIAGLEKADVLLLVGTQPRVEAAMVNARIQKTVRATQAKVGYIGPPADFNYDTWHLGTGPDTLVEIAEGRHPFCSILKSAKNPVIIAGAGLFEREDQGAVFSTIETVAKKFNVTRPDWNGLNVLLLHAAQARALDLGLVANSTESVKSAKFFYLMGAVDVNLDNLSADAFVVYQGHHG

SEQ ID NO: 138023 - protein, 636 aa, Triticum aestivum
  unsure (1)..(636): unsure at all Xaa locations
  Clone ID: PAT_TA_32441.pep
MSFLARALRHSKPYLPSRGPAAGASCRRTSSSTAAAAPEAATTAAAGVLELLLPRDPLDGPICDLGGDCELQXKCTAFGADCGRLTDTQSSVVAKYLGPLVKTVMTRSIPXSRSTRLASEVAAVHDLGMLRRAPCEQVRAXGGKLMLPSLTRNVSDIWPLCALTSNAFALTAKKWEMSGTPRITGTXVXASNIRRDSTGPGVMRIGPRLDEDINAEWISDKTRFCYDGLKRHRLNDPMIRGPDGRFKAVTWRDAIAVVAEVLXKSSQKEITGVAGKLSXAQSMMALERFXNKMGSRXTVLLPMGNGPNPASRYSIQTTSMNTSIAGLEKADVFLLNGTQPKDAKXTVFVLFNKTVAATQAKWGYIGPPADFNYDTWHLGTGPYTLVEIADGRHPFCSILKSAKNPVIIAGAGLFKQENQGAVFSTIETVAKNXCSYCLVQRQECPAAMVNARIQKTVRATQAKVGYIGPPADFNYDTWHLGTGPDTLVEIAEGRHPFCSILKSAKNPVIIAGAXIRNEKTKVPLRDATCXTVPAVPTVGDAKNDWKIVRALSEVAGAPLPYDSVTAVRSRISMVAPNLVRVDEREPSVISAEVKPPVKQQVSPAPFKAAVENFYMTDAITRASKIMAQCSATLLKK

SEQ ID NO: 138024 - protein, 105 aa, Triticum aestivum
  unsure (1)..(105): unsure at all Xaa locations
  Clone ID: PAT_TA_32442.pep
VCHIVSSRMIMLPQVKNFAPYNGCXPRCWPGEAPEMGALSTKGKQRRQEARRSTDDNKTNLAREKHQRWGHRRLRGSRGRKLGEAPSDTKTNLRGEVRQAKWVLE

SEQ ID NO: 138025 - protein, 167 aa, Triticum aestivum
  Clone ID: PAT_TA_32443.pep
MALTRRFIFLFPAAVLAELASASASPFLSDSLFQGSTGSTGRSLLQTKNDCPMSFETQNYTVLTNKCKRPQYPPTECCDAFKEFACPFAAYINNQSTNCADTMFSYIDFRGYPKGLFADECLKGKEGVSCEGIPAVDTGVPSGGRQVQGVSRPLVVLLCGLGALLFP

SEQ ID NO: 138026 - protein, 107 aa, Triticum aestivum
  Clone ID: PAT_TA_32444.pep
MSSSSLSSSENDTSRSQTLKIESLDSACSMTSDETSSSASSSDSSEVCTKHESAQAASSGESSTSFSFDLIDSKIAGKKSSDPEVTACSSSRFGSESRAEIPSQKSS

SEQ ID NO: 138027 - protein, 207 aa, Triticum aestivum
  Clone ID: PAT_TA_32445.pep
RPSVFAKLGVTIRTSFGTSSCSRGLQSQVLEADLVLWTVGSQSQILRLQPPDAPYVIPLNGRGQVETEETLQVKGHPRTFAIGDSAALRDPSGKFLPANAQVAFQQADFAGWNLWAAINDRPLLPFRFQNLGEMMTLGRNDAAITANFIEGLTLEGPVGHAARKLVYCLRMPTDEHRVKVGVSWLAKGAVDSLASLQTAVSNIIAGS

SEQ ID NO: 138028 - protein, 177 aa, Triticum aestivum
  unsure (1)..(177): unsure at all Xaa locations
  Clone ID: PAT_TA_32446.pep
KPFTGSISNKDDKTVDTKPITWSSTSTDDKSVDTKSSIGSVTNRDAKSIEGKRNIRSVVNSYMKNFDAKRNTGSIANSEVKDLDVKPSSRTXCQSFDTQQYSVASPNTGSVEPSDVTGTSVMANTGPANSGRXLQTNTDTSLIRMTQIRSPNVGRXVAASIQRLESSMSKVQIGRYR

SEQ ID NO: 138029 - protein, 280 aa, Triticum aestivum
  Clone ID: PAT_TA_32447.pep
MGRPYAVKGKKKRKLEGGEASRAPPVDAEAVEQEVKENEEVMEGEAAAEEAFAEEVGEGIPIVPRPVDSKRRPGAIFVLERACLEVGKVGKGMQILNSDDHANYLRKQNRNPADYRPDIIHQALLAIFDSPLTKAGRLQAVYVRTEKGVLFEIKPHVRMPRTFKRFCGLMSQLLQKLSITAVGKREKLLNVIKNPVTQYLPVGVRKIGLSYSAEKAVNLFDYVAKSNDDEPLVFVVGAMAHGKVDKEYSDDYIQISGYPLSAACCLNRICSALEQKWNIQ

SEQ ID NO: 138030 - protein, 315 aa, Triticum aestivum
  unsure (1)..(315): unsure at all Xaa locations
  Clone ID: PAT_TA_32448.pep
MGGAGAPMPSWLELWIEWEIQVVVLTSFSLQVILFFFAGIRRYSVSSVLKALLWMVYLVACDVVATYALGHMSSSLSRKSSGENQLVALWATFLVLHLGGQDTITAYTLEDNKLXQVATTVYLLYKYIIAGGATYVRATMLVLASGVVKYGERIWALKLASKGGAPSSRTPFLLAIYDTFLNSRQREEDRHGQNGGDCFTKNKQFGAYAFTVMMAHALRHVLVKPLIIDRNEASIDWTYKTIGLVKGLVQGFPWQDESEDASAKENRTIGELYKGVEVQLGLMYDMLYTKAEVIHKSRGHWICAISLVCCFAALV

SEQ ID NO: 138031 - protein, 551 aa, Triticum aestivum
  Clone ID: PAT_TA_32449.pep
MYRVKSESDCEMMHQEDQMDSPVGDDGSSGGSPHRGGGPPLKKGPWTSAEDAILVDYVKKHGEGNWNAVQKNTGLFRCGKSCRLRWANHLRPNLKKGAFTPEEERLIIQLHSKMGNKWARMAAHLPGRTDNEIKNYWNTRIKRCQRAGLPIYPASVCNQSSNEDQGSSDFNCGENLSSDLLNGNGLYLPDFTCDNFIANSEALSYAPQLSAVSISSLLGQSFASKNCGFMDQVNQAGMLKQSDHLLPGLSDTINGALSSVDQFPNDSEKLKKALGFDYLHEANSSSKTIAPFGGALTGSHAFLNGTFSTSRTINGPLKMELPSLQDTESDPNSWLKYTVAPAMQPTELVDPYLQSPTATPSVKSECVSPRNSGLLEELLHEAQGLKSGKNQQLSVRSSSSSVSTPCDTTVVSPEFDICQDYWEEPLNEYAPFSGNSLTGSTAPVSAAPPDVFQLSKISPAQSPSLGSGEQAMEPAYEPGAGDTSSHPENFRPDALFSGNTTDSSVFNNAIAMLLGNDMNTDCKPVFGDGIVFDTSPWSNMPHACQMSEEFK

SEQ ID NO: 138032 - protein, 101 aa, Triticum aestivum
  Clone ID: PAT_TA_32450.pep
AYISTVIMFYFEPREIEVRKDACCVKQHVTKLMSHVFLCKLCEAAMWKKGARISCNTALAVVSEHLYLVTCSFFLLLLTGFIIFWAAALRVSSLLQKANLT

SEQ ID NO: 138033 - protein, 137 aa, Triticum aestivum
  Clone ID: PAT_TA_32451.pep
GTRNMGYMHQQLIEILSYAMVITKNHIFTSGASGTNAAVIRGALRAEKPELLTVILPQSLKKQPPESQELLSKVQNLIEKPQYDHLPLIEASRLCNMDIISKVQQVICFAFHDSRLLMETCQEAKNMRKIVTLFYLD

SEQ ID NO: 138034 - protein, 96 aa, Triticum aestivum
  unsure (1)..(96): unsure at all Xaa locations
  Clone ID: PAT_TA_32452.pep
FARRVYSTXSNKTTMAKNRAQVISCHSYATRQHRAANESSTTAGAIFPVLHLDXPXVRVAVLGGGDGVAAXGVSERRRRRXRKTGNPXTAXHAPPP

SEQ ID NO: 138035 - protein, 130 aa, Triticum aestivum
  Clone ID: PAT_TA_32453.pep
EGRLRDLLTTKLPPETFPVKVAIPVVPTIRVLVTFTKFEELQPLEEFSTPPSSPDNCKSPGAQTSSSSWVQWIKAPYRQNFSTAQGPSNRVEDIQDPFVIPADYAWTTPGEKKKRTQENKNKSKKGRTAS

SEQ ID NO: 138036 - protein, 122 aa, Triticum aestivum
  Clone ID: PAT_TA_32454.pep
NGIRYTEMRVGGGDVPRPGDLVVIDLQGRVAGGGEAFVDTFGDGKRPLALVMGSRPYTRGMCEGIEYALRSMRNGGKRRVVVPASLGFGEDGADFGDDGAQVPPGATLEYVVQVDKVSIAPA

SEQ ID NO: 138037 - protein, 105 aa, Triticum aestivum
  Clone ID: PAT_TA_32455.pep
ALAGPYGYIAPVCSYTSLVTEKCDVYSFGVVVLEVLMGKHPGELQAFHSSLNDQFLLEALLDKRLPRPETEANDVKQCISVAFDCLTPSPKQRPTMQKVHRDLSI

SEQ ID NO: 138038 - protein, 75 aa, Triticum aestivum
  Clone ID: PAT_TA_32456.pep
RPMGSKYLLLCLCTLLVLSGAIARDIPASGATPVAHAAPKGDAGTHGVDVGEQQPRLPPRFRCPFPPFCRGATHP

SEQ ID NO: 138039 - protein, 98 aa, Triticum aestivum
  Clone ID: PAT_TA_32457.pep
RAGLRVAYDHLPPFARSFKPSIHHPMGSKYLLLCLCTLLVLSGAIARDIPASGAAPVAHAAPKGDAGTRGVDVGEQQPRLPPRFRCPFPPFCRGATHP

SEQ ID NO: 138040 - protein, 86 aa, Triticum aestivum
  Clone ID: PAT_TA_32458.pep
RSWVSGRAQELLLPWLFNPDHGANRYQQKDQENDDGVAHPLSGRSWVGAFWRASTPCCMWSAACETLEKHGANISLACFIKSVRSI

SEQ ID NO: 138041 - protein, 69 aa, Triticum aestivum
  Clone ID: PAT_TA_32459.pep
SLSQRFSLFFCRSFYLGQLAPTSRQHQHSTWAGQLRCWTIRLLTWATATISLSPLIRHVVPVSYNFLSL

SEQ ID NO: 138042 - protein, 176 aa, Triticum aestivum
  Clone ID: PAT_TA_32460.pep
HDAPQPLFSSRRRRRRTRNPRSARPATMAALRYSARRLGGSLLHRTQAAVEEEGRRLMRPRQISTEFFGEHARAPSARQVQQKKEELYEAVSKAEQKKQELLNLMANEQHFSAQSTQGQAAPLPWKVYSKRARGVLDVACKATFFVYAGAFLLGITGTGRMLGLTSQVASQDEIDD

SEQ ID NO: 138043 - protein, 160 aa, Triticum aestivum
  Clone ID: PAT_TA_32461.pep
STSGHFFMKYQGIGSSLGSGGTTLMNVGPANSCSVSRAASLSTGALGFLSHRSVEGARLASLLTALQLVRDSSRPARSPPPMPNATRPARSPPSVSDATRPARSPPPMSDATRLTRSPPLISDSTRPTRSPPLQVPTRRPESSYVVIYPVAAHRRTARCP

SEQ ID NO: 138044 - protein, 116 aa, Triticum aestivum
  Clone ID: PAT_TA_32462.pep
SGRVRAARREYRACRIPGRQDFLGQSLDAAPISWVATPLIASTPRAANLLGVARRRSPRLRVLPITQYRSGDMEPNLSGRYYVLPFPWFVRLTPVQQSSSCDVWNLWEAHSSSLIY

SEQ ID NO: 138045 - protein, 191 aa, Triticum aestivum
  unsure (1)..(191): unsure at all Xaa locations
  Clone ID: PAT_TA_32463.pep
AAPHAILLSRNYQSPQVSNGKVSRRRAPATGGARVLRRXEGTEREGCSDTRCRRRRVQGDGVAGLASCDAPHGPRRSXDAPHGPDAPHTPDAPDAPHTPDAPAGGNHYRYQXYNYRPGGGASGDPCSPLIISTCTHCPNGTNIGVALICYVPFLAERTVFIYQFIFLVFFVPCMCYMYHGRNKYYFVKKKK

SEQ ID NO: 138046 - protein, 154 aa, Triticum aestivum
  Clone ID: PAT_TA_32464.pep
DEPLLWSCAAVVPRVTGHLAGDEHRHGSGQNGTELSTHTRINASLCLSSSDAPHPARGSSKHRVAPLLHPQPALIPVLEAAAIGSLLLLERPSLWTYRPPPAEAVAGPAVTFVVRQPPMHATDAVVGGQSRVVAAGACGHAQRMRRGSGRGVDP

SEQ ID NO: 138047 - protein, 129 aa, Triticum aestivum
  Clone ID: PAT_TA_32465.pep
GRESKLLPSRTTRERQREIAAMATKEAKVVPAGDVDAAVDGEDLVPVLASLEPVYGAGSALDEARLRFAPTRPEVLQIKGRQGSDQAERPWPVCVCVEAVERRSHTEAVDRPPPAVVGRLYMHTYLLLE

SEQ ID NO: 138048 - protein, 502 aa, Triticum aestivum
  unsure (1)..(502): unsure at all Xaa locations
  Clone ID: PAT_TA_32466.pep
MATREAKATKEAKVVPAGDADADGEELVPALASLEPVYGAGPALDEARLRFARLADRFRALYSAGPALFARSPGRVNLIGEHIDYEGYSVPRMAIRQDMIVAIRRPDAAVDRLPPVDDSRATCVXPADPDKEIDIKNHTSGPYFMSRYKELTSYATSEAINLGTNMGELVPLDVVVDGTVPQGSGLPRSEAFVCSATIAIMGILGNNFPKKEVAXFTCYPARPIRALPGGMDLAPSIAADPGLPCGGTFLSAHCIAESKKAETAATNYNNRVVECRLAAIVLAIKLGMDTKKAVTSVXSLSDVEGLCVSFAGXNGSSDPGVAVKILLHEEPYTLEEIEKITGQSLATVFQSSQTSLDVLRAAKHFKLFQRASHVYSGARRVYAFRDTVLSKLSDEGMLKKLGDLMNDSHHSCSVLYECSCPELEELVKVCRDNGALGARLTGAGWGGCAVALVKEGIVPQFILNLKGKXYISRGDRGVIKQSDLGLYVFASKPSSGAAILRL

SEQ ID NO: 138049 - protein, 255 aa, Triticum aestivum
  Clone ID: PAT_TA_32467.pep
RLEDGTIVSKSEGVEFTVKARHLCPALAKAVKTMKKGEKVLLTVKPQYGFGEMGRPAAGDGGAVPPNAGLIIDLELVSWKTVTEIGDDKKILKKVLKEGEGYERPNEGAVVTVKITGKLQDGTVFLKKGHDEQEPFEFKTDEEAVIEGLDRAVLNMKKGEVALVTIPPEYAYGSTESKQDAVVPPNSTVIYEVELVSFVKDKESWDLNNSEKIEAAGTKKEEGNALFKSGKYARASKRYEKAAKFIDYDTSFSED

SEQ ID NO: 138050 - protein, 559 aa, Triticum aestivum
  unsure (1)..(559): unsure at all Xaa locations
  Clone ID: PAT_TA_32468.pep
MDDDFDIPAGDDMMMGDGMGDFGGAEGPGMKVGEEKEIGKQGLKKKLLKEGEGWDTPEVGDEVEVHYTGTLLDGKKFDSSRDRDDTFKFKLGQGQVIKGWDQGIKTMKKGENTQVTIPPGLAYGESGSLPIIRANANLQFDVELRPEARDRFIFKTDEEAVIEGLDRAVLNMKKGEVALVTIPPEYAYGSTESKQDAVVPPNSTVVYVGELVSFVKNKESWDLNNSEKIEAAGTKKEEGNALFKSGKYARASKRYEKAAKFIDYDTSFSEDEKKXVLATVDHEHEKYERPNEGAVVTVKITGKLQDGTVFLKKGHDEQEPFEFKTDEEAVIEGLDRAVLNMKKGEVALVTIPPEYAYGSTESKQDAIVPPNSTVIYEVELVSFVKDKESWDLNNSEKIEAAGTKKEEGNALFKSGKYARASKRYEKAAKFIEYDTSFSEDEKKQSKQLKITCNLNNAACKLKLKDYKQAEKLCTKVLELDSRNVKALYRRAQAYTQLADLELAEVDIKKALEIDPENRDVKLTYKTLKEKIKEINKKDAKFYSNMFSKMTKPSAEESKA

SEQ ID NO: 138051 - protein, 68 aa, Triticum aestivum
  Clone ID: PAT_TA_32469.pep
SDGHQIKSSLHVPSVSKLTSLSKQLFMVGVIGGPSLPKAEIPSVSSSRLQKYLFVFCTMSHCKVVSLR

SEQ ID NO: 138052 - protein, 162 aa, Triticum aestivum
  Clone ID: PAT_TA_32470.pep
LWLELRTSREGLRREVDDGEQYPEGVVPAPGRPELVPLPQEGGRLLRGRALAAANLRLRQGAPTTDAGEAGHHRRGRVQLYHYDERPRFPGRGLFFVVVNVGLNVGAIVNGRGRGPQGLPFRRYRHRRAADALLIDRRRRFLRRAWTVYFCEINLVYKLQGP

SEQ ID NO: 138053 - protein, 181 aa, Triticum aestivum
  Clone ID: PAT_TA_32471.pep
LHTGAIQFSVGVLTGHLHGITHIDSRGDGRCFISNGKDQAIKMWDIRKMTSNADGSENRVPAWDYRYSRYPQQYKQQKHPHDQSVATYRGHSVLRTLIRCYFSPTYSTGQKYIYTGSYDASVCIYDVVSGSQVAKLQGHHHLAVRDCSWHPSDPMLVSSSWDGQVARWSRTRSKQDTCELD

SEQ ID NO: 138054 - protein, 192 aa, Triticum aestivum
  Clone ID: PAT_TA_32472.pep
SSSPSGEPVYSLYRSLVLQYVDSNSNLYIDFRFCCLVFVVVIAGPPPSSEQERRRRERRHRRRRLDVPVFVAVRAGQDPGGHPAGPGRDDAPTRCGLAHVHRDTLIDVPKRRPPLRRAAQRPGPPPPPPCRRAGGRGSRPAAAADPQAARRRWVQHGSRRARTTRASSASCAPSRGLHCGPPPLYRSPLPRL

SEQ ID NO: 138055 - protein, 42 aa, Triticum aestivum
  Clone ID: PAT_TA_32473.pep
SVRGCPARKHVERCVDDPAMLIVTYEGDHNHNRAAAAQPQPA

SEQ ID NO: 138056 - protein, 220 aa, Triticum aestivum
  Clone ID: PAT_TA_32474.pep
GRGDAATGSGELLAIPGVGPRNQRKLVEKGFDGVAPLKQLYRDKFFGKSDEKMVEFLQSSVGIIHKNHAESITLFIKESIDEEVKDTDTSKPCRRKRLTFCVEGNISVGKSTFLQRIANETIELRDLVEIVPEPVAKWQDIGPDHFNILDAFYAEPQRYAYTFQNYVFVTRVMQERESSSGIKPLRLMERSVFSDRMVFVRAVHEAKWMNEMEISIYDSW

SEQ ID NO: 138057 - protein, 112 aa, Triticum aestivum
  unsure (1)..(112): unsure at all Xaa locations
  Clone ID: PAT_TA_32475.pep
HGPSYLLKKKKKNSRVLERPRAHRFSTRVGYQVSVPNSPYSEAYYNSLAAVLQRRDWENPGVTQLNRLAAHPPFASWRNNRKSPAPDRPFQQXLRSLNGRMGEPNFLRGLRG

SEQ ID NO: 138058 - protein, 251 aa, Triticum aestivum
  unsure (1)..(251): unsure at all Xaa locations
  Clone ID: PAT_TA_32476.pep
ARGACEWRAQWDNLPISERARLKARQGVSVLSLADADVVTDDDAMARVPRDGKTLGEIVLRGSSIMKGYLNNPEANAQAFRGGWFMTGDVGVVHPDGYIEIKDRSKDVIISGGENICSKEVEEALFRHPAVADAAVVAMPHAHWGETPCAFVVAKDKAAGVCEDDVMAFCRKRMSRFMVPKSXRSVWDVLPRNALGKVEKVKLREEARKLVPAVAVAPPAQKTKGKPTTKTVGGGRRDEHPVEQVMAMSRL

SEQ ID NO: 138059 - protein, 256 aa, Triticum aestivum
  unsure (1)..(256): unsure at all Xaa locations
  Clone ID: PAT_TA_32477.pep
MGIKGLTKLLAEHAPRAAVQRRVEDYRGRVIAIDASLSIYQFLVVVGRKGTEVLTNEAGEVTSHLPGMFHRTVRLLEAGIKPVFVFDGEPPDLKKKELAXRSLKRDDASKDLHSAIEVGDEDSVEKFSKRTVKITKEHNDGCKRLLRLMGVPIVEAPGEAEAQCASLCKNHKAHAVASEDMDTLTFGAPRFLRHVTDLSFKKSPVTEFEVPKVLEELGLTMGQFIDLCILSGCDYCENIKGIGGQRALKLIRQHGC

SEQ ID NO: 138060 - protein, 636 aa, Triticum aestivum
  unsure (1)..(636): unsure at all Xaa locations
  Clone ID: PAT_TA_32478.pep
MGACGARCTVADLPRQMFRRLELVGSLQMDQSSDGLQGNGALLAPRKNLAVNANYLLNCQYDLLARPRPHRPMTVTPSTQWKIKPYNXDLVLQANFKLVVFDTGNFQIDSMDPDKMLQWEDIICVRYCSPSEVRCPICLESPLCPQITSCGHIYCFPCILHYLLXGVKRITEVSGWKKCPLCFMMISAKELTTIFVTQLQHFHIGDNVTFALLGRPKNSLTPFLRNSSSEYSSLVDHPSDVFSKFILTSDVELSVRGAKSDLSNWLQMADLGLVDDLEKLPYVSAALEQLEERMKYWSEFRYYSSSPPLKNSSSPISSNKLKNSDNPKTSHTNSGHKLSPLSDGDIITGVSGLSVSPLYINSKKGVPQKMEERRAVAVDSNEQDSYTFYQVIDGQHLILHPLNMKCLLNHFGNSDMLPPRVTGKILELETITQSEASRKRYRFLSHFSLTTTFQFCEIDLSDMLPPISLAPFMDEIKRREKQRMQTAKKEEKDRVKAEVAAAAQESAMRFEYTNFSRTQSDVMFSLDDFEALGNNAAGPSTSPPAGERKLFSDVTRLGFASAQDSPPLRAETGDTNNEITRDQGPVSASSVSFASILSSTRAAADSSVETPKPNGVGKAGKKRTKVLLSTGGGRRY

SEQ ID NO: 138061 - protein, 242 aa, Triticum aestivum
  unsure (1)..(242): unsure at all Xaa locations
  Clone ID: PAT_TA_32479.pep
APRPASPPAPPSGAPPPPAFXPLRPPMGFPEMAPHVYYFAVPPWDGLQALPFAPPPPTPPAMLISPLEQLQRDLLVQIDYYFSDENLCKDIFLRRHMDDRGWVPLSLIAGFNQVQRLLYCIGTXKNLTNSLQFILEXTVMQSTVVEVQGDKIRRRARWEIWLLPRPNYSDGNSSGSRSPVTSNIDSLASQLQSVGLEGTYYPREALLTRSATSVSIGYQAPSYRVLHSNGSRLVFWKHTFVR

SEQ ID NO: 138062 - protein, 92 aa, Triticum aestivum
  Clone ID: PAT_TA_32480.pep
VNIYFVSWPKVQYRFNAIKIGHSHITFFSISINLFSCACQSYSDVSSNNQCSYHVHAPLLLLHSNSLVLDDLSFHFEVIYVIFIYEFNGYAI

SEQ ID NO: 138063 - protein, 169 aa, Triticum aestivum
  Clone ID: PAT_TA_32481.pep
KQFFPNKETARDQLEIWAERTGSEIVIDNDKKAQAPSVLSQAVKRGKREGFDIVLCDTSGRLHTNYGLMEELVSCKKVIAKALPGAPNEILLVLDGTTGLNMLQQAKEFNDVVGITGFILTKLDGTARGGCVVSVVDELGIPVKFVGVGEGVEDLQPFDAEAFVEAIFP

SEQ ID NO: 138064 - protein, 234 aa, Triticum aestivum
  Clone ID: PAT_TA_32482.pep
MDFEPHEILEVVPRAGDDPNGHANPQAAAAGAGAGAGAGHPAAGQEDPVAVAAAQRAKEDAEYLDKMRGWLMTVATLFVGFASQAAMHPPPWIPQDYLRLLIAAHGGAASDAKTKLANDEGLLAARDGGLTVPCFMALNMLTFATGLVLLVTLLVMKRGPSGSDMNRITFLVKGLAATVACTFAAGVSADPVAALLVLVFLTLYAILAFVRVMGWIRGVMYQRVWQLLQRRIGS

SEQ ID NO: 138065 - protein, 173 aa, Triticum aestivum
  unsure (1)..(173): unsure at all Xaa locations
  Clone ID: PAT_TA_32483.pep
RVLQHIDSNFERPKLSPDDPEKQGLAEELLAYSDTFNQAMMSALTAKGAVTADAGKSXEHSSKFNCKYIFMLITNMXIRCWSIEAALDKIETSLSKFDDGPFFLGQFSLVDIAYAPFVDGFQVFFANIKNYDTTAGRPNMQRFIKEMNGIAAYAQTKHDPQELLALTKKKLGI

SEQ ID NO: 138066 - protein, 81 aa, Triticum aestivum
  Clone ID: PAT_TA_32484.pep
MASAGRRPTVLMQIALFFVVAAVIMNSSVCLGAAAGDATAGSGAFDPNRPAVPSTGGAGKPYTGRRCLPKYRCYPPAGGQP

SEQ ID NO: 138067 - protein, 94 aa, Triticum aestivum
  Clone ID: PAT_TA_32485.pep
MALQAPIINMASLGSRATGRRPTVLQQIALFLVVAAVIMNSSVCVGAAGHDAALVGTDPNHPAFPSPPGKPYTGGRGCRTIYGCPDVPPAGGQP

SEQ ID NO: 138068 - protein, 506 aa, Triticum aestivum
  Clone ID: PAT_TA_32486.pep
MATTSRLLLLLLLAAVCLLAGAAVDALRLPPDASFPGAQAERLIRALNLLPGASSGRGGKVGAGAVDVAPGQLLERRVTLPGLPEGVGDLGHHAGYYRLPNTHDARMFYFFFESRGKKEDPVVIWLTGGPGCSSELAVFYENGPFTIANNMSLVWNKFGWDKISNIIFVDQPTGTGFSYSSDDRDTRHDEAGVSNDLYDFLQVFFKKHPEFVKNDFFITGESYAGHYIPAFASRVHQGNKKNEGTHINLKGFAIGNGLTDPAIQYKAYTDYALDMNLIQKADYERINKFIPPCEFAIKLCGTDGKASCMAAYMVCNSIFNSIMKLVGTKNYYDVRKECEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKESVPEEEPATTFYAAI

SEQ ID NO: 138069 - protein, 172 aa, Triticum aestivum
  Clone ID: PAT_TA_32487.pep
RNGGLDAYTICGINACLLCNVCNVSSQVVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKEAVPEEESSTTTFYAAM

SEQ ID NO: 138070 - protein, 95 aa, Triticum aestivum
  Clone ID: PAT_TA_32488.pep
MALQAPIINMASLGSRAAGRRRPTVLQQIALFVVIAAVIMNSSVCVGAAGHDAAVVGTDPNHPAFPSPPGKPYTGGRGCRTIYGCRDVPPAGGQP

SEQ ID NO: 138071 - protein, 158 aa, Triticum aestivum
  unsure (1)..(158): unsure at all Xaa locations
  Clone ID: PAT_TA_32489.pep
EKFFGDKAVRQAIGVGDIEFVSCAIGVGHIEFVSCSTSXVAGIPALLEEGINVLSXPGEYDLICNWLGNSRWVHSMEWSGQKDFAKTAESSFLVDDAQAGVLKSHGALSFLKVHNAGHMVPMDQPKAALEMLRRFTQGKLKEAVPEEESSTTTFYTAM

SEQ ID NO: 138072 - protein, 177 aa, Triticum aestivum
  unsure (1)..(177): unsure at all Xaa locations
  Clone ID: PAT_TA_32490.pep
TELADTCHKRMMVRKRSEEGGVSLDYLQGLHEKHESWLLPSKGQGSGLLSVSQLPIHMEGSLHPEIRDQVFFLEXDHMHSSIQKVPALILDCENDIDFNKDIEAKRQYARQVAEFFEFVKKKNEALPAETSDGDKSISPQVMLPGKGDLWFPGGSPLPKSALGSLEFRRAMSSFLPK

SEQ ID NO: 138073 - protein, 512 aa, Triticum aestivum
  Clone ID: PAT_TA_32491.pep
MAADSKLQSPLLPPPAGSEGGGEDEGHGAASKRLESILSDESVPWARRMCAATAVEMRMLVRLAAPAVLVYMINYLMSMSTQIFSGHLGTLELAAASLGNTGIQVFAYGLMLGMGSAVETLWGQAYGANKFDMLGIYMQRSTVLLMATGIPLAVLYAFSRPILILLGESPEIASAAAIFVYGLIPQIFAYAANFPIQKFMQAQSIMAPSAYISTATLAVHLVLSYLVVYKFGLGLLGASLMLSISWWIIVIGQFIYIVTSSRCRLTWTGFSLQAFSGLPEFFKLSLASAIMLCLETWYFQILVLIAGLLKDPEMALASLSVCMTISGWVFMISVGFNAAASVRVSNELGAGNPKSAAFSVVVVTVLSFILAAIISIVILFFRDYISYIYTGGDDVAAAVSKLTPLLALTLILNGIQPVLSGVAVGCGWQAFVAYVNVGCYYVVGIPLGCLLGFYFDLGAAGIWSGMIGGTFMQTVILVWVTVRTDWNKEVAEARKRLNKWEGNKMPLLAGQE

SEQ ID NO: 138074 - protein, 82 aa, Triticum aestivum
  Clone ID: PAT_TA_32492.pep
SKSSCSSAQPTRCVTQFTKETIMLKYRLRLQHTMQDLHLKHNDNTRYSLAARASTLLEHQHLKAFAGAKRINHRPDVGPAKK

SEQ ID NO: 138075 - protein, 132 aa, Triticum aestivum
  unsure (1)..(132): unsure at all Xaa locations
  Clone ID: PAT_TA_32493.pep
FISVFWSFGYIRLSXRLRKTSKEPAKAPPRADVVKSLKXGIVVNILGMGAAVLGMQATVGALVAKALTTSAVPYYQAAGQSPVLALDVFLVQASANTILSHFLGVASSLELLRSVSLPPAEAAVPAPAPARA

SEQ ID NO: 138076 - protein, 128 aa, Triticum aestivum
  unsure (1)..(128): unsure at all Xaa locations
  Clone ID: PAT_TA_32494.pep
PRLYSLPSPPPPPPTRTPFTPRRRRRDGGRAAPPPAAALEAAEQQPRMFXGGHNLRFRHXSASLGCPMTFSLFLPASPASKLPVLYWLSXGLTCTDEELHSSSPGAQRAAAXHGVALSRPRETSPLWF

SEQ ID NO: 138077 - protein, 118 aa, Triticum aestivum
  Clone ID: PAT_TA_32495.pep
MTATFATTVAASLSVAGGLGRLLGLGLGASLRPCSPRARTCVVHASGQQSVKEKAAAGLTAAAMAAALVLPEVAEAAGPGLPPSLKNFLLSIGSGGVVLLGIIGAVVAVSNFDPVKRG

SEQ ID NO: 138078 - protein, 170 aa, Triticum aestivum
  Clone ID: PAT_TA_32496.pep
MAPQPEEAPKPSPGESREWTLRFIQALGVDASLPASAERPDAYSALVRALLSSATVSSSPAPRVSCTLTVSSAATNAYNTLHGGAVAAVAEAVGMACARAAAGDKEMFLGELSTAYLSAARLDSEVEVEAQILRKGRSVVVTTVEFRLKDSKKLCYTSRATFYIMPVASL

SEQ ID NO: 138079 - protein, 85 aa, Triticum aestivum
  Clone ID: PAT_TA_32497.pep
LQGMRLSCRSVIEDTVYGRADGVSMEDEGCEDESQVQSRSSTVEEVGTYDPENQSYAGGDNQGRTHVMVSGGLGTHGLRGIPGTP

SEQ ID NO: 138080 - protein, 130 aa, Triticum aestivum
  unsure (1)..(130): unsure at all Xaa locations
  Clone ID: PAT_TA_32498.pep
EGLPLAVTLXLAFAGNKMMNDKALVRNLAACETMGSATTICSDKTGTLTTNHMTVVKTCICGNIREVNSPQNASKLCSELPENVVRTLLESIFNNTGGEVVINQDGKHQILGTPTEAAILEFAMSIGGNF

SEQ ID NO: 138081 - protein, 75 aa, Triticum aestivum; identical to SEQ ID NO: 106874
  Clone ID: PAT_TA_32499.pep

SEQ ID NO: 138082 - protein, 319 aa, Triticum aestivum
  Clone ID: PAT_TA_32500.pep
GMLPLLALQVILEYGRAGASRPPVTAALIAANALVYLRPGALDAFLPPLSRVAFNPHLIIQYGDLTRFFLSAFYHLSETHFFYNMTSLLWKGIQLETSMGSVEFASMVTALLGLSQGFTLLLSKGLLLLGNETAYYDQYAVGFSGVLFGMKIVLNAWSDDYVFLHGMVIPAKYAAWAELLLIQAFIPGTSFIGHLSGILAGLAYLWIKRSYSGPDPLALLISGIANVVSWPVKFAQRLLRPGRRQGGRVGRRAARESGRGMWRCSACTFDNSPSVDICEMCNSVREDRVFPNRQHLHDGGSSDLSVDEIRRRRLQRFDR

SEQ ID NO: 138083 - protein, 78 aa, Triticum aestivum
  Clone ID: PAT_TA_32501.pep
LRLADLAPCYSSSSRRSFLRHQPLVHLLDILLSGRVDAAQLRYGTGGRRRFLCAASIFSTLCTQISDMSDTKWCGLFS

SEQ ID NO: 138084 - protein, 203 aa, Triticum aestivum
  Clone ID: PAT_TA_32502.pep
MESDGEEEAAAATPGTAGAAPAAGRLKGCPELSVEGDMREMAKTAAWSVSSCKPGNGVASLRDDSLDTYWQSDGAQPHLVNIQFQKKVQLQLVVLYVDFKLDESYTPSKISIRAGDGFHNLKEIKTVDLLKPVGWVHISLSGTDPRETFIHTFMLQIAVLANHLNGRDTHVRQIKIYGPRPNPVPHQPFHFTSRECIMYSTIR

SEQ ID NO: 138085 - protein, 197 aa, Triticum aestivum
  unsure (1)..(197): unsure at all Xaa locations
  Clone ID: PAT_TA_32503.pep
MESDGEEEAAATPAAGRLKGCPELSVEGDMRERAQTAAWSVSSCKPGNGVASLRDDXLGTDWHADGAQPHRVHLQFQKKVQLQLVVLYVDFKLDESXYTPSKISIRAGDGFHNLKAIITVDLLRPVGWVQMPLSGTHPREPFPHTPLLLIAGLANHLYGSDSQVRHTKIXGPRPNPVPHQPFHFTSRXECIMYSTIR

SEQ ID NO: 138086 - protein, 239 aa, Triticum aestivum
  Clone ID: PAT_TA_32504.pep
PASGPPGSQAAAAARPPPRDFLAHLEDYLARRDGVDKLLKISRYAARLALAAGPLPPPASARLKSFESSLGLSRKAFRLGKFVQDVNALRAHPGPLPPPFVLLAYGGEGVYYFIEQFVWLAKAGLLPAHLLPRLQRLSAWAELLGYVGSITIKLEEVTKMESSIKMRLAEGCGEENEAVRTMRGKLLLKRLSVVQDVADAFMALGDVTNGKGLLGSSTLTASAGLLSALISTHKNWNSC

SEQ ID NO: 138087 - protein, 148 aa, Triticum aestivum
  unsure (1)..(148): unsure at all Xaa locations
  Clone ID: PAT_TA_32505.pep
XXNGAKFEEDLXAMLPXCDVIVINTXLTEKTRGMFNKERIAKMKKGVIVVNNARGAIMDAQAVADACSSGHIAGYGGDVWFPQPAPKDHPWRYMPNHAMTPHISGTTIDAQLRYADGVRDMLDRYFKGEDFPVQNYIVKEGQLASQYQ

SEQ ID NO: 138088 - protein, 64 aa, Triticum aestivum
  Clone ID: PAT_TA_32506.pep
DVYMMFLVFMAATKSCGARLSSDLQKHCKLGDSSAGDMWSCLNYAVSHDGGESVIHKTSNEVIQ

SEQ ID NO: 138089 - protein, 89 aa, Triticum aestivum
  Clone ID: PAT_TA_32507.pep
HDLACMFGIQGQLEDPYRMDWKLVYVDHENDILLVGDDPWEEFVSCVKSIKILSSVEVQQMSLDGDLGGIPSQTQACSASDDANAWRGS

SEQ ID NO: 138090 - protein, 152 aa, Triticum aestivum
  unsure (1)..(152): unsure at all Xaa locations
  Clone ID: PAT_TA_32508.pep
KSAGGLLMGAVLNMRPDLFKAAIVGVPFVDALTTMLYELPCVPIVSPSXMSNWTAKMNRCYALRVXYLLQVKAQEYPHILVTAGLNDPCVMYSEPAKFVAKLRELKRDDNLLLFKCEVGAGHNSKSGRFEKLREDAFSYTFLLKALGMTYTA

SEQ ID NO: 138091 - protein, 387 aa, Triticum aestivum
  unsure (1)..(387): unsure at all Xaa locations
  Clone ID: PAT_TA_32509.pep
SRRPDLAGGFRVLHLVRPFLGFLPEVQSADRRIPFREKLIYTVISLFIFLVCSQLPLYGIHSTTGADPFYWLRAILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRSDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGIWKESEYSGHSIPVGGLAYYVTAPSSMADILANPFHALFYVVFMLSACALFXKTWIE

SEQ ID NO: 138092 - protein, 105 aa, Triticum aestivum
  Clone ID: PAT_TA_32510.pep
GRGPRRWASSNDSYGGQGAYGSQTRDGPSFQSSFNNSSSGNQYGGAPSFHTSSSNNQTSGAASLPASGGSGEGLSFHDRFYSGNSRGGDRARSRSPPKAVGVSNW

SEQ ID NO: 138093 - protein, 191 aa, Triticum aestivum
  Clone ID: PAT_TA_32511.pep
RPRGPSNMPIILHSALITNLYFISQLLYRKYSGNFLVNLLGIWKESDYSGHSIPVGGLAYYVTAPSSMADILANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 138094 - protein, 339 aa, Triticum aestivum
  unsure (1)..(339): unsure at all Xaa locations
  Clone ID: PAT_TA_32512.pep
MAGGFRVLHLVRPFLAFLPEVQSADRKIPFREKVIYTVISSLSFSWLCSQXLPLYCIHSTTGXADPFYWSAVLFLHQTVVGVSGNWVLAPIADNLGMVMQLLRGNSKIIXKVDNTCENGDRAVLDGAHEVCWGNXELPVVVKVVAYVLCEMDGXVSQLGTLNXAVLILLCLLFSGKIAFCLPGRXSDMVKCIAMAINQWIIMNTLCPNSIVRSRXVDFNQRVSCWFGKISNRLADVLAYXYGLYRSNRANLAYSVSTALDYFFCNYFQVFRVVLSVRSKNSPWAERXYAIKLLYTSQLGHFSALCLPIPTYSSYTTHLYSGCWFVYTMYSPHLFCLTFS

SEQ ID NO: 138095 - protein, 162 aa, Triticum aestivum
  Clone ID: PAT_TA_32513.pep
MQLDRPLFRFVSVLNGLHQRWSSCSTVLLVWKATIWSIKTGILSKAHWSVDCQFDSSAIPEPPLPKLKVREGVTAQPTLSTLHIGLPKLSLQDDCILYLLAKIDYRDRQHTSWVLAVDMKNNTVQRVAEFSPKRAIGLARGYDSSTISKYLKVGPRERRARS

SEQ ID NO: 138096 - protein, 185 aa, Triticum aestivum
  Clone ID: PAT_TA_32514.pep
WRECSSLAGFDIQTVGRQLAYILRGETKIKNIKKNKTTGGFSVTFLGDIVATGLKVEDQLSLGKRLSLVASTGAMRAQGDTAYGANLEARLKDKDYPIAQSLSTLGLSLMKWRRDLALGANLQSQFSIGRGSKMAVRLGLNNKLSGQITVRTSTSEQVQIALLGLVPVAASIYRSFRPSEPSFAY

SEQ ID NO: 138097 - protein, 206 aa, Triticum aestivum
  Clone ID: PAT_TA_32515.pep
DPRVRCLVGVICGGMLYVANVGDSRAVLGKHVKATGEVLAVQLSAEHNVSIEPVRKELQSMHPEDRHVVVLKHNVWRVKGLIQVCRSIGDAYLKKQEFNREPLYAKFRLREPFNRPILSSEPSICVQPIQPHDEFIIFASDGLWEHLTNQEAVDIVQSSPRSGSARRLIKSALLEAAKKREMRYSDLKKIDRGVRRHFHDDITVII

SEQ ID NO: 138098 - protein, 40 aa, Triticum aestivum
  Clone ID: PAT_TA_32516.pep
LWRRARDAEIQGFRGVEIQGSNDCNLNMSICILLPPFQNR

SEQ ID NO: 138099 - protein, 102 aa, Triticum aestivum
  unsure (1)..(102): unsure at all Xaa locations
  Clone ID: PAT_TA_32517.pep
QFGGCKELWFANNGPSXTWREYSYLKDIHITGYKAARGQLQFLLHIVQHAPALEALTVDTTQLLPEECFPDKVDSSFLHHVTRHARDHLSQELSSKVKLCVL

SEQ ID NO: 138100 - protein, 79 aa, Triticum aestivum
  Clone ID: PAT_TA_32518.pep
TWTTVSGQFGLKRILWLCLGGIKGVCLGRKPSVVWGRSRLILFILKTADYRIGLLCICPRSHLLETGPATSHHSIFIMS

SEQ ID NO: 138101 - protein, 349 aa, Triticum aestivum
  Clone ID: PAT_TA_32519.pep
VARLGSPAPAAATAAASFLLSPRVTLPLRRGSRLLVSCSATSSSSSSDAAGGVGFQGRVGFLGLGIMGAPMASNLMKAGCDITVWNRTKSKCDPLLSLGAKFESSPARVASSCDVTFAMLADPESAFEVACGANGAAEGMAAGKGYVDVSTVDDATSKLTGKRITSTGASFLEGPLSAPIKPAEDGLLIFLTAGDESLYKRVAPLLDVMGKSRFYLGDVGNGAAMKLVVNMVMGSMMVSFAEGLLLSEKVGLDPNTVVEVISQGAINAPMFSLKGPSMVTAAYPTAFPLKHQQKDLRLALALAESVSQPIPTAAAANELYKVAKSLGLADQDFSAVIEALKAEMQSSQH

SEQ ID NO: 138102 - protein, 323 aa, Triticum aestivum
  Clone ID: PAT_TA_32520.pep
HLLNSTGRDCSTAYSAAETPDAINLFLGYFQPQVGKPALWDLDTDYYLHVTTAGDDSYHLSSPHGNNVPGGSGDAMSPRPTLSPVPACKEDFSRMKLTSFDKLIERTCSSIRNVRLHCDADLRPSGGVGTSAMAPDAAEIQLKSPNWLFGQRKHAETVPTAKVTPVENANEGNKDETNVSLCGELNWLSSSADSCEEDNFRRYLAFTTADVDNGWYSGALLYDQDENSGAYKHYSEFCQGPVMDPFEHDPEKEGHYREALSMDIELTDDAQVEAEMKAALDDYQVIGSDLSIIPSCGSLAEDPSQLTRWIIGDEKLRVVGAVQ

SEQ ID NO: 138103 - protein, 248 aa, Triticum aestivum
  unsure (1)..(248): unsure at all Xaa locations
  Clone ID: PAT_TA_32521.pep
MEVSLDFSWETPSFFELCDADSMHLPAEDSLSCLYEDSMSSPEGASSGLTRRWAGRNMLNERDRRMRLNEKLYAIRGVVPNITXMDKASIIQDAIAYIEELQXSRSARFSPAPRTDGGAAVVQADSTVDDGIGSPPRKIRRTTSASSMCSPPRKIRRTTPATHPVQILELEVTQVAEDLAVVNVRHRKVQEAMAKVYGVLESLCLNVITASVTVVADNIVHNMFIETDGIDCAQTIKEMVQSHSVISM

SEQ ID NO: 138104 - protein, 156 aa, Triticum aestivum
  Clone ID: PAT_TA_32522.pep
QATAPVAPVPLPGPPPTREFFHCAYRGAKGRNFEGLASSRHLQRGRRRRASCQAPAERAQSNKVRSVVGRLAVQAADRGLRVYLQDEHGTSVDALHYMISRGVKKSARDDKSDAYAAVMILDRYFSSSGQGAQIVLPRQQELQDKLIAKPRQDAEI

SEQ ID NO: 138105 - protein, 94 aa, Triticum aestivum
  Clone ID: PAT_TA_32523.pep
GRCESQDDDNPMTSSSRWTSKFTTGWRTVDGHPGETSGWSGCMEKRHDILRKASPSHEETDGYPIDRKLTCAAASHYGLWLVRPGALLWLEGAT

SEQ ID NO: 138106 - protein, 102 aa, Triticum aestivum
  Clone ID: PAT_TA_32524.pep
RESLCISTSAMSVKPEPIVTCGCTGELSGMKYSSVSLSLGEAFRKMSWRFSMHPGQPLVSPGCPSTILHPVVCIEFLSPVLNSRGPEDAVLVDAIMELLSLK

SEQ ID NO: 138107 - protein, 158 aa, Triticum aestivum
  Clone ID: PAT_TA_32525.pep
MAMTTTSSRLTTTQYSFLSSTPCSPTTMAALPRRRRAGARYPRIQAIEFDQNTVVAITVGVVSVAAGIGIPIFYENQIDNSAKRDNNQPCFPCSGSGAQVCRFCTGAGTVTVVIGNGESEVSKCVNCDGIGSLTCTTCQGSGIQPRYLDRREFKDDDD

SEQ ID NO: 138108 - protein, 130 aa, Triticum aestivum
  Clone ID: PAT_TA_32526.pep
MALLAFQGMAMSTAAAALPSHNHGAVSSYVSTSSYALAASAAFPRARAAFAVGAVLSATVTPVLDVYCGRGDKKTKRGKRFNHSYGNARPRNKKKGTGPARLFAPPAPPRKDQFDDGEIISIEIDEDILE

SEQ ID NO: 138109 - protein, 152 aa, Triticum aestivum
  Clone ID: PAT_TA_32527.pep
MAISATSSLALHAAPSAARRRMRSVVASATRFDRRSAVLLLLSAAGAGSSLAAVAPSANAAGSIGLFGIRKKLERAEEAAREVGEAAVEAVEAGGEAVAEAGKEVAGEGMQLAAEAGLAGDALVQAGVVAGAEALGVLVGLSVVNGILKPEA

SEQ ID NO: 138110 - protein, 132 aa, Triticum aestivum
  Clone ID: PAT_TA_32528.pep
KRGLLPKDIIQLSLAKFSRVVLPIAPSEVLILRDNSFCTRNKYGSIVRPGIQSINESEEIKKGVMEFYKAALVPELAKFLDASLPPWQEWVENLDHFTSIPDPQLDEVRTAYRAWKDDYDRVKMARKNTGSG

SEQ ID NO: 138111 - protein, 182 aa, Triticum aestivum
  unsure (1)..(182): unsure at all Xaa locations
  Clone ID: PAT_TA_32529.pep
NRHFIFLKHNIWHXKXLIQVFKSIGDSXXXKXXFNREPLYSKFXLXXPFNRPILNSXPSIFFQPIQPQDXFIIFSSDGLWEHLTNQEALDIFQNNPRIGGGGRLIKSALLEAAKKRERRYSDLKKIDRGVRRHFHDDITVIILYLDSSLVSRASTHRGPAVSLRGAGVSLRSSTLAPYGSQM

SEQ ID NO: 138112 - protein, 625 aa, Triticum aestivum
  unsure (1)..(625): unsure at all Xaa locations
  Clone ID: PAT_TA_32530.pep
MMGPVWWAVLVLLAMADAVAWRIVVEKYSVKVASSDMLKSKXQGTFGSFGLAGYGGYVVYWVLFRRDMDSGIRAFAVYYKRLESQDGANILLIXRRLVIFRNQVGKPQLRNAAAFRAVYRLEAAGVGCAAQRYCWYARIIDVCFXGSSRVENIHFMTHDNQHRMILXGLPYHFVSALXPSSDKTVVRTFQPHSNAELVPKXHMQKEFVKGFRGTAQVLEQKGYTQFTPHYITWYCPEAFTVSKQCKSQCINHGRYCAPDPEQDFSKGYDGKDVVVQNLHQVCVFKVANDTGKPWLWWDYVHDFAIRCPMKEKKYTHECASHVIKSLGLDMDKINKCVGDPEADEENPILKAEQDAQIGHGKRGDVTILPTLVVNNRQYRGKLDKGAVLKAICSGFEETTEPAICLSEDVQTNECLENHGGCWVDKANNVTACKDTFRGRVCECPIVKGVKFVGDGYTNCEASGVGRCEINNGGCWKETKNGKTISACSHEESEGCKCPQGFKGDGVKSCEDIDECKAKSACQCNGCSCENTWGSYECSCGGNNMLYMREQDTCISKQAASSVGWSFMWVIFFGLVFAGVGAYAVYKYRLRSYMDSEIRAIMAQYMPLDSQEGANQQQHVAHAGDI

SEQ ID NO: 138113 - protein, 93 aa, Triticum aestivum
  Clone ID: PAT_TA_32531.pep
DKEQNPLKRLLRNRVSAQQARERKKAYMTELEVKAKDLELRNAELEQKVSTLQNENNTLRQILKNTTAHAGKKPSGGKGGDSGKKHHHHFGKG

SEQ ID NO: 138114 - protein, 141 aa, Triticum aestivum
  Clone ID: PAT_TA_32532.pep
MASAWCLLAPAAAPVAAPGALGVSASESRGVFVARAAVPARMRRRWGSLVVCVAPDEEKITRRSPLDFPIEWEKPKPGRRPDIFPKFSPMKTPLPHPLPADDPLDDDEEEEEEEAQPQEEPQEDDPDKEDPEEDDPDKPTE

SEQ ID NO: 138115 - protein, 369 aa, Triticum aestivum
  unsure (1)..(369): unsure at all Xaa locations
  Clone ID: PAT_TA_32533.pep
QWRRRRWCWRCSWWPVGVAAAMAGGGKLRQGYYEQSCPRAXEQIVKHYVERHVPHCXSVAATLIRTHFHDCFVRGCDASVLLNATTGGGEAEKDATPNLTLRGFAFLDRVKALVEQECPGVVSCADILALASRDAVGVIGGPFWRVPTGRRDGRVSIKQEALDQLPAPTMNFTDLLPSFRAKGLALXTHTIGMAHCTSFSERLNNFTGRGRPGDADPSLDAQYAPKLRRTQCTTPTDNTTIXVEMDPGSXSPFDTSYYRGLPKACGDPSSPDAALIXDAAARADVESVAKGPSEVFFQVFARSMGTVGGEDGHDRSEDRWRGGIEPVLTRSEQRVGCVVGGSCTIVFVCLVAFYFIFRFCVWFLFILSL

SEQ ID NO: 138116 - protein, 337 aa, Triticum aestivum
  Clone ID: PAT_TA_32534.pep
IRFKEDCVSYCCKVPVPGPVEPKEEKKEVSKAPEPTATKTEESSQSGDRLFSSPVARKLAEDNNVPLSSLKGTGPDGRILKADIEDYLSSAAKGSKKEAAAAPGLGYVDLPNTQIRKVTANRLLQSKQTIPHYYLTVDSRVDKLIKLRSELNPMQDASGGKKISINDLVIKAAALALRKVPACNSSWMNDFIRQYHNVNINVAVQTEHGLFVPVVRDADKKGLATIADEVKQLALRAKDNSLKPEDYEGGTFTVSNLGGPFGIKQFCAIVNPPQSAILAIGSAEKRVVPGAAEGQYEIGSFMSATLSCDHRVIDGAMGAEWLKAFKGYLEDPTTMLL

SEQ ID NO: 138117 - protein, 330 aa, Triticum aestivum
  Clone ID: PAT_TA_32535.pep
RRPRGQGGRLRALQGRAGARRDARQHGGEGQLRVRRPGVLPDEAADGQVRRVLAGRRAAPLSWAQRLEACAGAARGLLYLHTAVDKPVIHRDVKSSNILLDGDLAGKVADFGLSKAGPVLDETHVSTAVKGSFGYVDPEYCRTRQLTAKSDVYSLGVVLLEAVCARPVVDPRLPKPMSNLVEWGLHWQGRGELEKIVDRRIAAVARPAALRKYGETVARCLAERGADRPAMEDVVWNLQFVMRLQEGDGLDFSDVSSLNMVTELTPPRRQRSAVDCDGLDFSDVSSLNMVTELTPPKTGSMEGDGVADDDDFTDASMRGTFWQMVNVRSR

SEQ ID NO: 138118 - protein, 57 aa, Triticum aestivum
  Clone ID: PAT_TA_32536.pep
LVQIGHELLRKNVSRVDLETGRNVEMPGQGTNAEQLARFAKQLSDERRRRKKALQVN

SEQ ID NO: 138119 - protein, 173 aa, Triticum aestivum
  Clone ID: PAT_TA_32537.pep
NKNMLHALGSKLYLILSWVMVSSLFLKTVSCQQITSSSGCDCDTIIKDTLTENPKFTGWQQCFSKAFLKALKVNGTCVNKCKKQFEETCKKIKGYCDETREKALDCGKYTGRQCVKCVDIVVQNESRLECQTGIYGVCLSKPGKCQNNGECPSGCVCNDDGCVRHNDFTNKCY

SEQ ID NO: 138120 - protein, 115 aa, Triticum aestivum
  Clone ID: PAT_TA_32538.pep
MPQLSLSTNVPVDAVAAADILRDCSRALARIIGKPESYVTVSIDGSVPTSFAGSEEPAAYGEIMSIGGLGPGVNGKLSAALADILEAKLSVSASRFYVKFDDVQGYNVGFNGTTF

SEQ ID NO: 138121 - protein, 289 aa, Triticum aestivum
  Clone ID: PAT_TA_32539.pep
MKTTPVKLVMDEPINKVFIGNLPFKIKKDSLVTFAETCGKILEVIVIKRYRRPFVFGFITFETEQEAKRAAKELNKKELEGHEVHVEIARSNSPHKVTRKRSTKKSAKKQKSTSTSSKEENTESNQESVLDVVEKKRRKRHSKKVEHSSVVIFIANLPFATNEQELKELFIDYKVVSVHVVRTKNGRSRGYGFVEFENEEETKKVLENVKDVVLEDRFIYIKPSLASQVKSKVASIKERGQKAEEKIKEDPVKNDSEKFKNVVKKDNTMKDDVEKDKMNQVEQEKEGKN

SEQ ID NO: 138122 - protein, 78 aa, Triticum aestivum
  Clone ID: PAT_TA_32540.pep
AKSKKEQQCLDQKGSMISTCFYFRNQPGESTEQLPKCVYPCRIFGGGGSNKNRSVVSSSGVAAWFFHFSNLDHRLSGV

SEQ ID NO: 138123 - protein, 223 aa, Triticum aestivum
  Clone ID: PAT_TA_32541.pep
ITLFIKAYQVSFNRSNVLYSLKANNNNELFYIPRQYYPKENNSTAVYENAPTMSDIYSSSIDFSSSTLSQRGIKAGFLSGQQSSTAMRKEETNNHSNNWRKSSHDTNNNTPDNNNDLNIVLSLASSSTGKRSSSVDSELKRVKKKRKTEDEEVVLFGPIPTMNTITIKTNDDDLIMNDETIFQELERIMNNNNTILSPPTSPILSYLTTHDELLLNDDFVLFP

SEQ ID NO: 138124 - protein, 37 aa, Triticum aestivum
  Clone ID: PAT_TA_32542.pep
KKTWRIAYFRFFDKVYDHVYVFVVVKWAGFAKKTDEE

SEQ ID NO: 138125 - protein, 172 aa, Triticum aestivum
  Clone ID: PAT_TA_32543.pep
MGNSLRCCLACVLPCGALDLIRIVHLSGRVEEYGRPVAAGEILSANPNHVLSKPCSQGVVRRILIVSPESELERGQIYFLIPASSVPAERKKKTGSTAGSQGAAAVAPSRMANPGHGGKTRNHVKSKPSSDHGSGRDVRSEKRSLHRRRVSTGGRTAVWRPHLECIVGGQLD

SEQ ID NO: 138126 - protein, 88 aa, Triticum aestivum
  Clone ID: PAT_TA_32544.pep
IASGFLFFFFFLFIFTMSSRKPEVVPLNLKIESSKPISISASTSLLDNFLHNGVAIHAANNTVAAQLHQLHQGLKEIKKKQRNDGKEF

SEQ ID NO: 138127 - protein, 250 aa, Triticum aestivum
  Clone ID: PAT_TA_32545.pep
PRPKKSIAAIGGALVIFVFIFAHYRSTIKELIQTVAVELRTTPYSSILLSCLIIFTSIPPLIGFTFSTTITGFIYGFPGGIFPAVSGAFLGAMVAFALIRKYNFARFIKLSPSKQEKYMAIQEAIEQGGFKMMVLIRLSPIPWPITNMLLSIISTANTQHYIMAALLASFKVSLDVWIGSQLADLSNPNLPPSAHRIAMITMGCGLLILIGVAWWLYRLTMEKVKEMANSKNNSTVTIDSVVIVPSKKAI

SEQ ID NO: 138128 - protein, 210 aa, Triticum aestivum
  Clone ID: PAT_TA_32546.pep
MANCFGEVVDNFKLNEMLRYVGKPKTREDRAREAVSLMNEDSKNIKASKYVEGVKDWYGDGVSTLCILYNATGDTLYYVGEHDWFGFIGRTPYPAEIGNGQYAAFLHTHNTGAASGSEGAVVYRGKNRDGQDRDYLVAWSTPFGPWYSNKAYCEIGGVNYFDDRWGHVSGKMENGGYSCNAKSDGCEIQATTATGGSPMFHAIIKTPFAP

SEQ ID NO: 138129 - protein, 315 aa, Triticum aestivum
  Clone ID: PAT_TA_32547.pep
MKFITIASSALLALALGTEMASAAECSKLYGQCGGKNWNGPTCCESGSTCKVSNDYYSQCLHSGNSDNKPSESGHKKTATAAHKKPTTAPTKKTGSSPSGKYSVVSGGASGTAATTQYWDCCKASCSWPGRAKVSSPVKSCSKDGVSVLSDSNVLSVCNGGNSYMCNDNQPWAVNDNLAYGFAAAVMGGSDESRLCCSCYELTFTSTAVAGKKMVVQVTNTGVYPEANHFDLQSPGGGVGIFNGCTNQWGAPKDGWGKRYGGISSASECASLPPQLQAGCHWRFNWFKNADNPSVTFKEVTCPKEITAKTGCVRK

SEQ ID NO: 138130 - protein, 209 aa, Triticum aestivum
  Clone ID: PAT_TA_32548.pep
AGRRPGRVWSSSWNGTCARRLWSYCGRWHTACPGYGSLLPATTSAKRPCMRRKLWKILARRLLLSLLSGGRKMLRYKRASSHCPRLTSRRMCSTLNSTPVSRFSSLKAPSKPWSRRKERRRRSRSRLTQGYCAVHEGLTASLPLPETMTEALPLQVPSPSPETTTEASPLRASSSLLTGTTTEFSPTQASSSPLSETTAKELITPRVGD

SEQ ID NO: 138131 - protein, 145 aa, Triticum aestivum
  Clone ID: PAT_TA_32549.pep
QITPVDQISIPTGEFMQVSGTPFDFLTEVAIGERIGQVPGGYDHNYVLDDSREVKSGLRHVAKVTDLSSFRVLNIWGDAPGVQFYTGNFLAGIVGKGGAVYGKHAGLCLETQGFPNAVNQPNFPSVIVRPGEKYMHTMLFEFSTK

SEQ ID NO: 138132 - protein, 213 aa, Triticum aestivum
  unsure (1)..(213): unsure at all Xaa locations
  Clone ID: PAT_TA_32550.pep
EIMFAIIDNPSNAVEWALAEMINRPEVMQKAIDELDTVVGKERLVQESDISQLNYLKSCIREAFRIHPYHAFNPPHVAMADTKFPSXSVXRGRGVILSRFGLGRNPKIWVEPLEFRPERHLNAANVLLTEPGLRFISFSTXGRRGCPRESHFGTLXTMMLIARMLQGFTWTKPPGVHSIDLQESKIGLALAEPFVLRAKPRLPAHLYGPIECM

SEQ ID NO: 138133 - protein, 380 aa, Triticum aestivum
  Clone ID: PAT_TA_32551.pep
MAMRNATQQVVRALEPSLTRSLHASPGSKKIVGVFYKGGEYAGQNPNFVGCVENALGIRSWLESQGHQYIVTDDKDGPNCELEKHIADAHVLITTPFHPAYVSADRIRRGKNLELLLTAGIGSDHIELPAAAAAGLTVAEVTGSNTVSVAEDQLMRILVLMRNFLPGHHQAISGEWDLAGIAHRAYDLEGKTVGTVGAGRIGKLLLQRLKPFGCNLLYHDRLRVDAALEEELGAAFEEDLDAMLPKCDVVVLNMPLTEKTKGMFNKEKIAKMKKGVIIVNNARGAIMDTQAVADACKSGHIAGKCRYGGDVWYPQPAPKEHPWRYMPNNAMTPHISGTTIDGQLRYAAGVKDMLERYFKGQDFPEPNYIVKEGKLASQYQ

SEQ ID NO: 138134 - protein, 194 aa, Triticum aestivum
  Clone ID: PAT_TA_32552.pep
MLFDALTVTALVACVNAAGRAIVTNHCTDPIYLWSVGSSMSDQNIIHPESSYSEPFSTDPKSGGIALKISPIEGGISKPNVSQTIFAYNLDVNQVWYDMSDIFGDGFSGKSLTLKPTDATCESIVWASGEPPAGSQIKVCGAETDLELTFCTPPPPSQCLPAWSPCGTNAPPGETRVCCTHCIGNHHCVQAPGS

SEQ ID NO: 138135 - protein, 339 aa, Triticum aestivum
  Clone ID: PAT_TA_32553.pep
EPLRTVQLDGLVVLKIIKHCRESYPNDVTGQLLGLDDKSVLEVTNCFPFPSDGDEDTSAQYQLDMMRCLRAVNVDNNTVGWYRSAHLGNFVDLSLIETQYSYQNSLSAQSVVLIHDVSKSAAQGNLSIRAFRLTDAFMKAYETKKFTTESLAQAKLSFSNIFEELPVQIHNSYYVTMMLHNIEMPKLNADRLGYLSTFTSTKKTQIELEEARPLAPNFDVLDLELDPFMQKNLQYLLDCTELQQQEQYSHQYWKKAVAREQAKMQSWLTARKQENAERAEKGQEPLPEDEVNTLFKLPPEPSRLDSMILNAQMHNFTKQLNQFAGPSLTRLYSIQELQK

SEQ ID NO: 138136 - protein, 60 aa, Triticum aestivum
  Clone ID: PAT_TA_32554.pep
GAASRGTASTPESTVTTSISRPLRRSCRRGTRALDEFASLSQYNILLPIKKNIRVFKLLL

SEQ ID NO: 138137 - protein, 204 aa, Triticum aestivum
  Clone ID: PAT_TA_32555.pep
SWDWNEQGFVTPAKNQQKCGACWAFAAVGAVESQLKRKTGELLDLSEQELLDCDTTQKPGGCKGGNPYRAFLWIKSKGGIMKEAEYSYEAQQGQCRTNKDATRRGLVYRAQLLRSGERFLQEAIYTMGPTVAGIDTHDRSLQHFKSGIYKGPCGTALDHAVLVVGYGVRDGEKYWVVKNSWGQTFGENGFFLMSRGGNGNAGLC

SEQ ID NO: 138138 - protein, 170 aa, Triticum aestivum
  Clone ID: PAT_TA_32556.pep
MGPNLKYRAGLVLIVAVVLIWVTSAEVTQGIFANYKQPFAITYLGASLMVIYIPLAFLKDFIYRLLRRNSGSSKASKIASKSSFGGSAPLKNGEFHKMLEMEPQKTVVIKITDVDLPVLEETKPLICGIGECEGDVLKEQQLSTKEIAIYGLYLCPIWFVTEYLSNAALA

SEQ ID NO: 138139 - protein, 261 aa, Triticum aestivum
  unsure (1)..(261): unsure at all Xaa locations
  Clone ID: PAT_TA_32557.pep
AEMKTLTQEVTALRTLKGSLGLPLRFGWNGDPCIPQQHPWSGVDCQFDNTKRQWVIDGLGLDNQGLRGVIPSDVSKLQHLQSINFSGNSIKGNIPLSLGTIPGLRVLDLSFNELNGSIPESLGQLTSLQTLNLNGNDLSGRVPASLGGRPLHRVRFNFTDNAGLCGIPGLRECGPHLSVAAKIGMAFGVLVAFLFLVVFAACWWKRRQNVIRGQKLAAAREAPYAKSRTQSTXDVQMGKHHPPHDGSPRGGNNESSPHLLS

SEQ ID NO: 138140 - protein, 209 aa, Triticum aestivum
  Clone ID: PAT_TA_32558.pep
MRKRFLLWPLLLAVSASSALLGVLAADLSKEPFTIRISCGSFDDVHTAPTNTLWYRDFGYTGGRFANATRPSFIVPPLKTLRYFPLSDGPENCYYINNVPNGHYQVRLFFALVADPNLDSEPIFDVSVEGTLFSSLLSGWSSDDEKTFAEALVFVQHSSLSICFHSTGHGDPSILSIEVLQIDDNAYKFGSLWGKGTVLRTTKRLTCGS

SEQ ID NO: 138141 - protein, 246 aa, Triticum aestivum
  Clone ID: PAT_TA_32559.pep
VKRVIDYAVKVRVNAAKTDVDRNVKHSMNPFDEIAVEEAVRIKEKSPSTEVVAVSCGSAKSQETLRTALAMGADRAVHVEVKDDSTLQPLAVAKLLKALADKEANKPDLFILGKQAIDDDASQTGQMLAGLLKWPQTTFASKLEINDKALKVVREIDGGLETVSTQLPAIVTTDLRLNEPRYASLPNIMKAKKKPLVKMTPEDLGVDISPRLQTLKVEEPPKRAGGRKVESVDDLLDKLRNEAKVL

SEQ ID NO: 138142 - protein, 116 aa, Triticum aestivum
  Clone ID: PAT_TA_32560.pep
LKPLPLRLVALVNSPPTPRARAASMAAGPAEALKSFEERASDAEARLAKLEALLLNKDGASEASSSAMRDLESKLDAATKECLAEKEQNRKLTVENEKLQYRVSHLIRTIKEAESR

SEQ ID NO: 138143 - protein, 99 aa, Triticum aestivum
  Clone ID: PAT_TA_32561.pep
GQHVLVSWALPRLTNRERLVQMVDPALKGQFAVKDLIQVAAIAAMCIQTKAEYRPLMTDVVQSLIPIVKKSPSMSCSSTPARPLQHVVYMSPAAGSNTS

SEQ ID NO: 138144 - protein, 166 aa, Triticum aestivum
  Clone ID: PAT_TA_32562.pep
MQRYGLQLRKKPATSSSSRPPPPARPLAAFADDSDDDVEADILRQSSKKRALEKVEELQKKAMEEDPSVFAYDEVYDDMKEKAARPKIQAKVVRESKYIEALKEKAEQRKREQDIVYERKLHKERSKEDHLFADKDKFVTSAYRKKLEEEKKWLALAAAQRPSTGS

SEQ ID NO: 138145 - protein, 82 aa, Triticum aestivum
  Clone ID: PAT_TA_32563.pep
MAQFMDLRAFILRARVLKFYRQALRMTRRAPAHARDELRQTVRAEIEKNRNCDDKQKIKFLISEGLQRLKGLDEMLDMTGNG

SEQ ID NO: 138146 - protein, 169 aa, Triticum aestivum
  Clone ID: PAT_TA_32564.pep
FSMFKHKDGGIELDGTKPSFVEKRRMLPDTTSHLNNTTPAATVQPRPVNEETTAVQHKVARAKTKSNKRMIRLGQSNIDPPSFATAAEPSKHVHRLADLENSVQQEAATTVRRASSVRSKRSKAPNLSEENTKSDGAFRKKIEAMRKEAGTEWLRVLQEMDIVKKENSQ

SEQ ID NO: 138147 - protein, 87 aa, Triticum aestivum
  Clone ID: PAT_TA_32565.pep
PLGSLFFSPKPEFSFWVLVKEGLNFVQYYSAHHKYKDISLYPSYIKRRPLEQIPCLRVILPAPAPLSSLPRPPQSSERKDVEHSRRW

SEQ ID NO: 138148 - protein, 178 aa, Triticum aestivum
  Clone ID: PAT_TA_32566.pep
MELNKTEDAVAAPTAVQEDEKTHTLGNGKLEEPNSAENVPADGEMVSRVTAEHNDSLTTLKRAAATAVSAAAAKAKLLAEQEEDQIRRLAALVVEKLLQKTEAKMSLFADVEHVALRTREYTEKTRKKLLMERNAIIAARMGALPSRPNQQGAAGNRLPPGYGAPAVRPPNAMPRPSS

SEQ ID NO: 138149 - protein, 277 aa, Triticum aestivum
  Clone ID: PAT_TA_32567.pep
MGTGTGTALGPAMAAAASSTAHRPRPLPAAATANRSASRPTASAPPGRTLVCSAPRQSRPPRRAVATTARAAEAGAPSSTSPDAVTYSSSIDTDMPLYEPLGVSFDEYLQDRPRVFRAMFPDESRSQQLSDEEWRIQMLPLEFLLITVRPVVVMQLRNRNAGGLDLRITEWELRGLDSGYTPASFDLGVRGSLYADRGQRRGSRLRGHLEISITVALPPPLRIVPEAILRGVAESVLSTLAERMKRDVDVGLVADFRRFRLEKAASRAAVARADSKA

SEQ ID NO: 138150 - protein, 105 aa, Triticum aestivum
  Clone ID: PAT_TA_32568.pep
RLPMGLFSWWRGSRRGSPEQAPSQQAAKGAGGAQAQVAVPGTHGAVEVLRQRQPDATVFEFGSAAESGTAVTLAGYCPVSDELEPCRWELVPATGEGAPQFRIVF

SEQ ID NO: 138151 - protein, 158 aa, Triticum aestivum
  unsure (1)..(158): unsure at all Xaa locations
  Clone ID: PAT_TA_32569.pep
KKKKPKKSIFRIFLFFGARKPPLPARDFRLRTTLSLSSPSLDEGAIFHPSGSPRLPFGRCSWWWASRRGSPDLAPGLRAPGGAGGPPAPVAAPGTLGPPAVLPSCRPRPAVFEFGSAAESGXAVTLAGYCPVSDELEPCRWELVPATGAGAAQFRIVF

SEQ ID NO: 138152 - protein, 78 aa, Triticum aestivum
  Clone ID: PAT_TA_32570.pep
MSYQQGYPPPGTAAAYPPPGHQQQAYVAPPPAMYQQDQQYPPAGADTTSRGGHGNGGDGFLKGCCAALCCCCLLDACF

SEQ ID NO: 138153 - protein, 78 aa, Triticum aestivum
  Clone ID: PAT_TA_32571.pep
MSYQQGYPPPGTAAAYPPPGQHQQAYIAPPPSTYPQDQQYPPAGADTTSRGGHGHGGDGFLKGCCAALCCCCLLDACF

SEQ ID NO: 138154 - protein, 78 aa, Triticum aestivum
  Clone ID: PAT_TA_32572.pep
MSYQQGYPPPGTAAAYPPPGHQQQAYVAPPPAMYQQDQQYPPAGADTTSRGGHGHGGDGFLKGCCAALCCCCLLDACF

SEQ ID NO: 138155 - protein, 80 aa, Triticum aestivum
  Clone ID: PAT_TA_32573.pep
MSYQQGYPPPGTAAAYPPPGQQQQAYVAPPPSTYPQDQQYPPAGAGADTTSRGGHGHGGDGFLKGCCAALCCCCLLDACF

SEQ ID NO: 138156 - protein, 194 aa, Triticum aestivum
  Clone ID: PAT_TA_32574.pep
MMPQPQPGVVPPQWGAIPPPMPPHHLYAPPPPQMWGQPLPPQQAAYGQQAAYYGRPAAPTQAPAGPNEVRTLWLGDLQYWMDENYVYNCFAGTGEVQSVKLIRDKQTGQLQGYGFIEFTSRAGAERALQTFNGAMMPNAEMAYRLNWATAGGKHDDGADYTIFVGDLAADVTDYVLQETFRVQYPSVKGAKVVG

SEQ ID NO: 138157 - protein, 124 aa, Triticum aestivum
  Clone ID: PAT_TA_32575.pep
FVMITERNKSLLGLLTVKDFQDFCKNVKSTRMQPEVDECLVSNVCGAVRCKIWSVTPQMPLTAAEKIMDSHGVDQVPVVSEHVNHQDGGILIGFVDRECITIARRALSAKEFFSFTSEIRREER

SEQ ID NO: 138158 - protein, 71 aa, Triticum aestivum
  Clone ID: PAT_TA_32576.pep
WIAQKVMYERFGEDFIVNFVAKALPEAHCPPELAEQYYQKLQGNDIKAFRSFYQSLIEKIRQQQNGSLVFR

SEQ ID NO: 138159 - protein, 329 aa, Triticum aestivum
  Clone ID: PAT_TA_32577.pep
MAFALKASASPALAAASSAASSPSFSAASAAPRGRAAAARRVSLRGAAHPVAAIRASATAVAGDKRTISGTFTNLKEQGKIAFIPFIVAGDPDLATTAKALKVLDACGSDVIELGVPYSDPLADGPVIQASATRALTKGTTFEDVISMVKEVVPELSCPLALFTYYNPILKRGVANFMSVVKEAGVHGLVVPDVPLEETDILRSEAAKNNLELVLLTTPTTPTERMERITKASEGFVYLVSTTGVTGTRANVSFKVEALLKEIKQVTDKAVAVGFGVSTPEQVKQIAGWGADGVIVGSAMVRQLGESGSPEEGLKKLEELAKSLKAAFP

SEQ ID NO: 138160 - protein, 281 aa, Triticum aestivum
  unsure (1)..(281): unsure at all Xaa locations
  Clone ID: PAT_TA_32578.pep
KLADLVTGCYGYKQVEPSCSCCTCEFSVTAPERIEKLRNLQVLGVVHIARGSKVAKNLGELTSLRRLGVDVDATEEVGKDLCSSVSRLVHLERLEVRSRSLEFLKEAKKAEEMPPKHLLSLXLCGRLGNLPGWMDRLKDLAKVKLIQTQLKQVDVEVMGKLRNLTLLALWEESFAEKMLCFGEGTFPKLKLLYIEGMENIESIQIKDGALAVLEKLEVKKCVNLDDSKEGLSLVLVLQNLNELVLTSCGDKPKLEKELQKQISGFKKRPKFITGKSIVSRS

SEQ ID NO: 138161 - protein, 96 aa, Triticum aestivum
  Clone ID: PAT_TA_32579.pep
EDGDGDGDGMDAAAPEIKTYEDGGTRITVVTCEITHGEEDDQKSVSRSYAKKSCGVVSAKKQPSLGVKKPPPKRQFSKSKKTKKVDTSRRKNKGKH

SEQ ID NO: 138162 - protein, 158 aa, Triticum aestivum
  unsure (1)..(158): unsure at all Xaa locations
  Clone ID: PAT_TA_32580.pep
RESWIYRDFVTGFHKRKKKRRKEAQRITXEKDRRKRIEARKKRKQEKEIALYDKVVSSENADGEDGDGDGMDAAAPEIKTYEDGGTRITVVTSEITHGEEDDQKSVSRSYAKKSCGVVSAKKQPSLGVKKKPPPKRQFSKSKKTKKVDTSRRKNKGKH

SEQ ID NO: 138163 - protein, 211 aa, Triticum aestivum
  Clone ID: PAT_TA_32581.pep
MAWEEEGLEEEHEEDMEASEEEGEDVVVGQMPTFMVPKHINKRALKNKALSVSLDKKALKDFVTGFHKRKKKRRKEAQRITQEKDRRKRIEARKKRKQEKEIALYGKVVSSENADGEDGDGDGMDAAAPEIKTYEDGGTRITVVTSEITHGEEDDQKSVSRSYAKETCGVVSAKKQPSLGVKKKPPPKRQFSKSKKTKKVDTSRRKNKGKH

SEQ ID NO: 138164 - protein, 155 aa, Triticum aestivum
  Clone ID: PAT_TA_32582.pep
SNSPIFVGGLDPNATEDVFKQVFTPYGDVVHVKIPVGKKCGFVQYASRSSAEEALLMLQGTMIGGQNVRLSWGRSPSNKQVQFQQDFNHWGGATANAGYYGYAQGYGAYGYAATQPQDPNMYGYGTYAGYPNYPQQVAQQPQQEPVKFSLNVDPV

SEQ ID NO: 138165 - protein, 229 aa, Triticum aestivum
  Clone ID: PAT_TA_32583.pep
MRRVLDELLSSCVSMGYVFQMVLIVKATREGEDVGRPEITFVVMIYGKPMYGDSGVLLRFKRLEHGLVTTYMQELKHASGEYVVIMDADLFYRPNCLPSFIRKKKATGAYIVTGTRYVSNGGVHGWNLMRKLTSRGANVLAQTLLQPGASDLTGSFRLYKRSVLEDVISSCVSKGYVFQMEMIVRATRKGYHIEEVPITFVDRVFGISKLGGSEIVGYLKGLVYLLLTT

SEQ ID NO: 138166 - protein, 312 aa, Triticum aestivum
  Clone ID: PAT_TA_32584.pep
IYRLVTPKVETTRATDAGRYSVCSAVGVLPLSLQYGFPIVQKFLEGASSIDNHFHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLQSEKVPENLISHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 138167 - protein, 123 aa, Triticum aestivum
  Clone ID: PAT_TA_32585.pep
VRKRHVQHVPEGKQETRKIKTNYSNESCSQATEGELETNYIAICSFGFTEPVDIIFLTLFIGAAPGDGDHTPISRTEIGLMMLCFPVFSLVGDAGPSSSDRLRPPKQACVSREVIHFLSSEAV

SEQ ID NO: 138168 - protein, 236 aa, Triticum aestivum
  Clone ID: PAT_TA_32586.pep
ESIELRLHPQAKHGLQLSCLHRRKGPLPFHPGSLSAATANSRMAITKPNSRCPAAVGEADGADQRTTEDQPNEHQAGSGSTEHGARAVERRRTPMEKTEEGITMHRAKPSRKSQEDQDVMLRSQATSRSTPKSTSRSPPSRRITAPRCRRRPDQGSADFRRSLGGRRMGEEPPQSLQEGDRRQRRRLWGGRRAGQGFPPDPRPTARSGQQSPRNVDRSRRGPTQARISPRVRPRVR

SEQ ID NO: 138169 - protein, 395 aa, Triticum aestivum
  unsure (1)..(395): unsure at all Xaa locations
  Clone ID: PAT_TA_32587.pep
MAAAMLLRRLPAARSPIMAATRAISDSTAPLTIETSMPFTAHIVDPPSRDVATTPAELVAFFHDMSLMRRMEIAADSLYKAKLIRGFCHLYDGQEAVCAGMEAAITRKDSIVTAYRXDHCIFLSRGGDLVTAFAEXLLGRQVACSRGKCGSAQFFTPLGANFXGGRRLVQRLGAPQAAGGAVRPRSPWKEDSGSLSLLGAGVAVXGQDWEALNVSGSRKVHAIVIXENIQYGLKTAGXGRCRSHAPSMSGSLXTDLNVDGMDVRAVQQAWKLAERLAIANGRIVLEIATYKYHGPLYVKIRENTYRARDKIXSGVRQEGDPIERVRKLLLAHDLATPAELKDMEKEIRKEVDAAIAKAKESPMPDASELFTNVYVKGFGVESFGADRKELRATLP

SEQ ID NO: 138170 - protein, 128 aa, Triticum aestivum
  unsure (1)..(128): unsure at all Xaa locations
  Clone ID: PAT_TA_32588.pep
SPSILSPSRPFPLPGKAESEVLSKYPSSAVVLRPGFIYGKRNVDPRVXKVDGYEIPLDIVGQPLEKLLSSVENFTKPLSALPGSDLVLAPPVNVDDVAYAVINAVIDDSFFGVFTIEQIKEAAASARV

SEQ ID NO: 138171 - protein, 405 aa, Triticum aestivum
  Clone ID: PAT_TA_32589.pep
DRWAGDGSAFGDGRGQWPPPAPEQVGGDVETHVADFVILCTGRFSGIPNIPTFPPDKGPEKFDGTVIHSMDYSDMGTAKATELIRGKFVTVVGYQKSALDIAAECANTNGAKYPCTIICRTKRWIIPDYYAWGVPIAFFYLNRFSELLVHKPGEGLLLSILATFLSPLRWLFSKFVESYYRWAVPMDKHGMVPDHSFFQAISSCLVAILPDKFYDMVDQGSIVLKKAKSFSFCKQGVIVEGDSAPIKSDVVIFATGYKGDQKLKEMFTSSLFRDIVTGPPSSIIPLYRQCVHPRIPQLAIIGYSESIANLHTFDMRSKWLAHFLDGVFQLPSIKSMEMDIKEWDEYMKRYSREYFRRSCVGALHIWYNDQLCQDMGCEPRRKKGFFADWLLPYLPSDYKDINLKK

SEQ ID NO: 138172 - protein, 88 aa, Triticum aestivum
  Clone ID: PAT_TA_32590.pep
GVVQQFVGHGVGKVFHAEPAVLHFRNNEKGRMILNQTFTIEPMLTIGSTNSTIWSDDWTAVTEDGSLSAQFEHTLLITEDGVEILTQC

SEQ ID NO: 138173 - protein, 56 aa, Triticum aestivum
  Clone ID: PAT_TA_32591.pep
STKHPKHNKHYMKVAGPRTTTVHTGAGPILSMTTEKSLCTRPWLSSLSVSVGPAEC

SEQ ID NO: 138174 - protein, 101 aa, Triticum aestivum
  Clone ID: PAT_TA_32592.pep
YSLCCCYTVGSVSMTCSKVWRMAMGIMPHVSSRTRAFLEVEAWSTCLGLAIGRRLLRRLLVHGLLVEVGAPAVITGRRLEIHRLLALLSSAPPPSPRAKCG

SEQ ID NO: 138175 - protein, 259 aa, Triticum aestivum
  Clone ID: PAT_TA_32593.pep
RCHFHEDRVSHPDPRIIAVSGNAIKSQICNCSELDHELGSLIVRRIGQMESHAHRASPDELYRLLLEPDFACHAFAGENTTRIMSIQRQVIENEVKCNIANCRMVTIPAVMQHGWCCFNWDMMAHVITIMDPMAYQTEDTTRKTCFMYAADKIHDALFDCIEEFFTEWHCSRHSWTKKSPLLSTTTFTRPESALCVVHLLRQFKGNSLAKPLTRAAIANERGSLLIELIHMKGNTAPLQLEGLDTIADALNETMKDLGV

SEQ ID NO: 138176 - protein, 378 aa, Triticum aestivum
  Clone ID: PAT_TA_32594.pep
MKLVHRNLARNGPGSAKLLPEEEDDLWHAYNLIAVGDSLQAVTVRKVLRDSASGGRDAERVKLKLEIVVESVDYDKEGNVLRVRGKNITENDHVKIGQFHTLELELKRPFVLRKEYWDWLALDTIQQACDPTASADLAVILMQEGLAHLFLIGRSITATRSRIETSIPRKHGPAIAGYESALKKFFEHVLQALLKHIDFEVVQCVVIASPGFTKDQFRDYMHLEAARRDLRVIIENKSRIILAHAPSGYKHSLKEVLDTPGVMSLIKDTKAAQEVQALKEFFAMLTNDSARACYGPKHVEVAHERLAIQTLLMTDTLFRNTDIASRRKYVNLVESVKKYGGTVHIFSSMHVSGDQLAQLTGIAAILRFPLPDLEDIEM

SEQ ID NO: 138177 - protein, 96 aa, Triticum aestivum
  Clone ID: PAT_TA_32595.pep
GTIPHKGNFIPYYYCFCETACFTTITIGLGKGTMNQGSHFSEGKVSSTLQPQFFFFHFPASSLLVASQDFTKHYTKDQSPLELHTACRVHVHRPCW

SEQ ID NO: 138178 - protein, 61 aa, Triticum aestivum
  Clone ID: PAT_TA_32596.pep
PGLQLYKPSNCALIYVLSLKNLVGYSTIYIGRNLARASLVYYRTIKLTPHRKDVQCCKLTQ

SEQ ID NO: 138179 - protein, 172 aa, Triticum aestivum
  Clone ID: PAT_TA_32597.pep
VAQLALATTGEVAGAGDGGMNDVVDLIKRAKDGVPELLRNMGGGGGAVQEMGEDEMAAAFGYNALMVTSWRNIGFDRADFGGGPPARVVGRWQQSTVPGCMAFLSCRATAGDGERLLTQCVREEHAAAFVAELDQLAHAHAPSYVRLSTQYAIDELNYWYVADGVCPSSGLF

SEQ ID NO: 138180 - protein, 207 aa, Triticum aestivum
  Clone ID: PAT_TA_32598.pep
DPAREELLAAGDAAGAAALTRYQGLTSLIWRCITRARRLAPDDETAFRGAANNRGRLRPALPAEYFGNSLYAVSTEPVRVSELLARGGHGRGAAAVGRAVAANTDASIRARVAAWTAEPVVTVRLTMMGGSPWFDAYGCDFGWGKPTAVRSGRANKNDGRTVLYPGREGGGSVDAEVSLSPEHMAALELDDELRAAVSSSRANFVSL

SEQ ID NO: 138181 - protein, 286 aa, Triticum aestivum
  unsure (1)..(286): unsure at all Xaa locations
  Clone ID: PAT_TA_32599.pep
MAPVSNETFLPTAAWGEATLRPSFVRDEDERPKVAHDRFSDAVPVISLDGIDGARRAEIRDRVAAACEGWGIFQVVDHGVDADLIADMTRLSREFFALPAEDKLRYDMSGGKKGGFIVSSHLQGEAVQDWREIVTYFSYPVKARDYGRWPEKPAGWRAVVERYSERLMGLSCKLLGVLSEAMGLESEALAKACVDMDQKVVVNFYPRCPQXPDLTLGLKRHTDPGTITLLLQDLVGGLQXATRDGGKTWITVQAHLRRNSSSNLGDHGHFLSNCKFQERGTNQAGG

SEQ ID NO: 138182 - protein, 207 aa, Triticum aestivum
  Clone ID: PAT_TA_32600.pep
FADVRGGGDPSWHLAGTKTNKINSIQDFAACGMHLIKEGFVHESRLCAMGCSAGGLLVGAVVNMLPNLFSAAVLKVPFLDICNTMLDPTLPLTILDYEEFGDPNIPVEFDAIRSYSPYDNLSPGKCYPSILVTASFNDTRVGVWEAAKWVSKVRDVTCPSCSKSVVLKTNMQSGHFGEGGRFMRCEETAFEYAFLMKALGMDDKSAK

SEQ ID NO: 138183 - protein, 117 aa, Triticum aestivum
  Clone ID: PAT_TA_32601.pep
PGGRGLAGGQHHHRINMDKYHPGYFGKVGMRHFHLKKNPYWRPVVNLDKIWTLAGEGAREQYKNTEKVPVIDALQNGYAKVLAKGTISQPVIVRTRFVSALAEKKIKAAGGVVELIA

SEQ ID NO: 138184 - protein, 284 aa, Triticum aestivum
  Clone ID: PAT_TA_32602.pep
YGRRCRAVRRANLVQFRLSPRICSSPASGLWSVQVERAAHYWFLHRCKSSTCCAVIHGVVHTARVCRSPHLQRVQLVARQCAVLATGVCKIGTCTSDGSMRDPHRQPCHLPRDPPAMLCGMNPSPLDLFLAAAAPRSCACGCCGCATRRCSPFGSGLVLVKSGKHHLFLSGRSTIAVQLGDARHAVRSSCVCSPASVVSSPAIRRPCHATQRCLTCGSELVRVQSGECPCMCSRASIRVCVFCWPSKAILPVYVCGCKTILLVYVCVCKTTNGCMCVYEHHRHP

SEQ ID NO: 138185 - protein, 83 aa, Triticum aestivum
  Clone ID: PAT_TA_32603.pep
MVHQITPKGSLYWAVPATMVAATTYTFMRLKAASIVSVSNPLTYIPSGEPTFDSANLDRIRDDWKHRNHGIGLRDVSRSGGGV

SEQ ID NO: 138186 - protein, 184 aa, Triticum aestivum
  Clone ID: PAT_TA_32604.pep
MERCGSWSESDAAAQAAAQKAVPAPFLTKTYQLVDDPATDHIVSWGDDRVSTFVVWRPPEFARDILPNYFKHNNFSSFVRQLNTYGFRKVVPERWEFANEFFRKGEKQLLCEIHRRKTSGSTTSSSPPPFFAPPHFPLFHPGVSVAHHHQQFVGEDGAMAAHAGMGVPFMQPHWRDQGAPRLLA

SEQ ID NO: 138187 - protein, 93 aa, Triticum aestivum
  Clone ID: PAT_TA_32605.pep
HANMTVPQTIHPHQHNHLATRYKTMPTVNIHTRRLTRAQHNQHKSSSPQGSSMENTATTASTKFYCCLHSVGCSAFPCAPPFAGPWRTMYHAL

SEQ ID NO: 138188 - protein, 138 aa, Triticum aestivum
  Clone ID: PAT_TA_32606.pep
KTEECESFFNFFSPPQVPDDDEDIDEEAADELQGQMEHDYDIGSTIRDKIIPHAVSWFTGEAVQAEDFDDMEDGDEDDDDEDDDDEEDDEEDEDEDEDDDEDEEELSKPTKKVAGKPKGPAKGGAQGNAEQPTECKQQ

SEQ ID NO: 138189 - protein, 384 aa, Triticum aestivum
  unsure (1)..(384): unsure at all Xaa locations
  Clone ID: PAT_TA_32607.pep
MGGEKENLDLSDLNSSLPAAAAALSAEDRVGLVNALKDKLQSLAGQHADVLESLSPNVRTRVEFLRGIQSQHDEIEAKFFEERAALEAKYQKLYEPLYAKRYDIVNGVVEVDGAAKEPTSENAAEGGDSDAKGIPDFWLTALKTNDVLTEEIQERDEPVLKYLKDIKWSRIDDPKGFKLEFFIDTNPFFKNSVLTKSYHMVDEDDPILEKAIGTEIEWYPGKNVTQKILKKKPKKGSKNTKPITKXTEECESFFNFFSPPQVPDDDEDIDEEAADELQGQMEHDYDIGSTIRDKIIPHAVSWFTGEAVQAEDFDDMEDGDEDDDDDDDDDDEEDDEDDEDEDEDDDEDEEELSKPTKKVAGKPKGPAKGGAQGNAEQPTECKQQ

SEQ ID NO: 138190 - protein, 443 aa, Triticum aestivum
  Clone ID: PAT_TA_32608.pep
RVSSVISNSPIIMNVDCDMYSNNNDAVRDALCFFLDEEMGHKIGFVQYPQNYNNLSKNDIYGNSLHVINEVEMGGMDSLGGPLYIGTGCFHRREILCGRKFTKDYQEDWNAGIKDKLQESIDETEEKAKSLAACTYEHGTQWGDEIGVKYGCAVEDVITGLAIHCRGWESVYNNPKKPAFMGVGPTTLAQTILQHKRWSEGNLSIFLSKYNVFLFGHGKTKLRHQMGYHIYGLWAPNSLATLYYVIIPSLALLKGTPLFPEITSPWIAPFVYVFCVKTMYSLYEALSSGDTLKGWWNGQRMWLVKRITSYLFGVLDNLRKLLGLSKMNFVVSPKVSDEDESKRYEQEIMEFGSSDPEYVIIGTITLLNLVCLLGGLSKVMKVGWNNIHLDALFPQLILCGMVVITSIPFYEAMFLRKDKGRIPFPVTLASIGFVMLALLPAIV

SEQ ID NO: 138191 - protein, 314 aa, Triticum aestivum
  Clone ID: PAT_TA_32609.pep
MAPPRGRLLAAALCLLFLAGADAGTVGVNWGRVANDLPSPAAVVQLLKQHGIAQVKLYDTEPAVLRALAGSGIKVVVALPNEQLAAAARRPSYALAWVRRNVAAYYPATQIQGIAVGNEVFATAANVTAQLVPAMINVHAALARLNMDKAVKVSSPVALSALANSYPPSAGVFKEELAQSVMKPMLDFLARTGSDLMVNCYPFFAYADNAGVISLDYALFRPNAGELDSGSGLKYYSLLDAQLDAVFAAVGKLGSYNGVHVVVSETGWPFKGDAQEVGAGAANAAAYNGNLVRRVLSKNAGTPRRPDADIDVYL

SEQ ID NO: 138192 - protein, 116 aa, Triticum aestivum
  Clone ID: PAT_TA_32610.pep
GLVYTNMFDAILNAAHAAVEKAGAQGLKLVVSETGWPSGGGGTGATVENAAAYNNNVIQHAASGAGTPRRPGKAVETYLFAMFNENQKPEGTEQHFGLFQPDMSAVYPVDFAAGAY

SEQ ID NO: 138193 - protein, 105 aa, Triticum aestivum
  Clone ID: PAT_TA_32611.pep
MAATMVVHVVLLAVPAVGGFMQAFKFSVLLWPFNITLPLLRHLPRVCLTVMVHVVHYDAELRAYLTGRRTVPLPEPGYSTLRGAQWRTREQLAAHAMIALVDISY

SEQ ID NO: 138194 - protein, 174 aa, Triticum aestivum
  Clone ID: PAT_TA_32612.pep
QNFLMLPQCLLPDASPCLAVADVDGDGACGTPGTRPSCVTMPSPRARTPVSSRWWPVSIPPTCSSFCRHGVCCPSYARDGGVRGGPWVVALHVRRQLLKKRIRRATVGKTAVGNTGRRHRCCMEKRMGEAVDHEASMGTMGAASSLGSGVASGGRIGDLVRIGAQGRTDGSDAW

SEQ ID NO: 138195 - protein, 140 aa, Triticum aestivum
  Clone ID: PAT_TA_32613.pep
RPSVRGRVGRATRPGIHGSLALPLDRCMGCPRAVRACRSACVATVAICLLPVLLPLVLLWLPLLSFAVAVVRFRRRRRRMMMTRGGCCFHGGDRSPPPESEPDGHRVARLHKYLEDQMELVEEEAGGAMAAVLARNPWAA

SEQ ID NO: 138196 - protein, 613 aa, Triticum aestivum
  unsure (1)..(613): unsure at all Xaa locations
  Clone ID: PAT_TA_32614.pep
MATRPGPLTEWPWQRMGNFKYLVMAPVVVHGAYRVMNKGWGDIDLAYXADPALILPSEALRMIHNQIWISLSRYQTARSKHRIVDRGIEFDQVDRERGWDDQIVFNGLLFYVGYLAMPSVRRFPLWRTDGAVATALLHAEATALLHAGPVEFLYYWFHRALHHHFLYSRYHSHHHASIVTEPITSVIHPFGEHIVYFTLFAIPMLSTVYMGNGSALVFVLYIVYIDFMNNMGHCNFELVPKWMFQVFPPLKYLMYTPSFHSLHHTQFRTNYSLFMPFYDYIYSTMDKASDELYENSLKGTEETPDLVHLTHMTNLQSAYHLTRGFASIASKPSDNSEWYMWTLWPLAWLSMVVAWIYGSSAFVVERIKLKKMKMQTWVVPRYNFQYGLTWDRESINDLIEKAILDADVPRVRVLSLGLLNQAKQLNGNGELFRQKYPKLGVRIVDGSGLSTGVVLKSIPSDAKRVVLHTGTCKIARAVAMALCGKGIHVIMNRKKEYDMLKSQMPENRASYLKCSSNDITKIWLVERIDDKEQRMAPKGTVFVPISQFPLKKVRKDCTYLSTPAMKIPDTMQNIHSCENWLPRRVMSAWHIAGILHVLEGWSEHECGEHMMDS

SEQ ID NO: 138197 - protein, 344 aa, Triticum aestivum
  Clone ID: PAT_TA_32615.pep
STDTQYENSLKGKEKEVDVVHLTHLTSLQSIYHIRTGFAQYASKPYTSMWQLRIMWPVSWLSMVLTWAYGSWFTVERNSMKKLRMQSWAIPGYTFHYGLNKDKEAINDLIEKAISEAGKKGAKVVSLGLLNQAHSLNGSGELYLQKYPKLGLKLVDGTSLAAAVVVNSIPHGADQVVLSGNISKVACAVAAALCKKNIKVIITNKQDYHFLQPKIPEDAADNLLLSKTGMAKVWIIGEGADATEQLRAPKGTRFIPYSQFPPRMARKDGCTYSTTPAMSVPKTLQNVHSCENWLPRRVMSAWRVAGIVHALEGWDEHECGDTVLDMDKVWSAALLHGFRPVAEA

SEQ ID NO: 138198 - protein, 217 aa, Triticum aestivum
  unsure (1)..(217): unsure at all Xaa locations
  Clone ID: PAT_TA_32616.pep
MATNPGLFSEWPWKMLGSFKYVVLAPWVAHGIQQVATKGWREADLGYLVILPSMILRGLHNQAWITVSRLQNARGKRQIVDRGIEFEQIDRERNWDDQIILSAILLFLGALHLPGGQNLPLWRTDGAVLLALLHAGPVEFLYYWFHRALHHHFLYTRYHSHHHAIVTEPITSVIHPFAELVXYELLFSIPMIACVLTGTASXVELYMLYIDXMNNMD

SEQ ID NO: 138199 - protein, 172 aa, Triticum aestivum
  Clone ID: PAT_TA_32617.pep
SPTLILVLAKVGAVVCAGLELLGVIQLPNCLYYGLGSDVWTLWWNGADAKLGECSAGTQVVPYSEFPVTAGGDARGDCVYHSTPALVAPESYENLHACENWLPRRVMSAWRAAGIVHALERWPGHECGDAVTGVDKAWRAALAHGFRPYDAAAVRHAANGAAKPGQARADAN

SEQ ID NO: 138200 - protein, 129 aa, Triticum aestivum
  Clone ID: PAT_TA_32618.pep
QIPRSQICVIISLPQQAQDGHAVSRVVERAVADAEASGAAVLTLGLLNQGYELNRNGELYVIRKPGLKTKIVDGTSLAVAAVLHMVPRGARDVLLLGKECKVVCVLAQALCERDIQVRVVDADLHEALG

SEQ ID NO: 138201 - protein, 184 aa, Triticum aestivum
  Clone ID: PAT_TA_32619.pep
ESARLIREMFNYAREHQPCIIFMDEIDAIGGRRFSEGTSADREIQRTLMELLNQLDGFDELGKVKMIMATNRPDVLDPALLRPGRLDRKIEIPLPNEQSRTEVLKIHAAGIAKHGEIDYEAVVKLAEGFNGADLRNVCTEAGMAAIRAERDYVIHEDFMKAVRKLNDAKKLESSAHYSADFGKD

SEQ ID NO: 138202 - protein, 142 aa, Triticum aestivum
  Clone ID: PAT_TA_32620.pep
MAGIGPIRQDWEPIVVRKKAQNAADKKDEKAVNAARRSGAEIDTTKKYNAGTNKAASSGTSLNTKRLDDDTENLSHERVSSDLKKNLMQARLDKKMTQAQLAQMINEKPQVIQEYESGKAIPNNQIIGKLERALGAKLRSKK

SEQ ID NO: 138203 - protein, 142 aa, Triticum aestivum; identical to SEQ ID NO: 138202
  Clone ID: PAT_TA_32621.pep

SEQ ID NO: 138204 - protein, 317 aa, Triticum aestivum
  unsure (1)..(317): unsure at all Xaa locations
  Clone ID: PAT_TA_32622.pep
FSGGSTTRPGSRSSPPQNARSKRYMRIMWPLSWLSMVLTWAYGSWFTVERNVMEKLKIQSWAIPRYNFHYGLNWEKEAINNLIVKAICEADKKGAKVVSLGLLNQAQSLNGSGELYLQKYPKLGLKLVDGTSLAAAVVVNSIPHGADQVVLSGNISKVACAVAAALCKKNIKVIITNKQDYHFLQPKIPASCARTCEXTKTGIGKVWIIGEGADATEQLRAPKGTRFIPYSQFPPRMARKDGCTYSTTPAMSVPKTLQNVHSCENWLPRWVMSAWRVAGIVHALEGWDEHECGDMVLDMDKVWSAALLHGFRPVAEA

SEQ ID NO: 138205 - protein, 111 aa, Triticum aestivum
  Clone ID: PAT_TA_32623.pep
SSQSTSRTLPRPREGLLLHFRLRSAAVPENLSSPLGHLRHQNIVSSRLVHHVVDPAPQFVNRSPLRRDPPPPDATVRRKRPRHHSGARQRQPPPPTDVGCHPEHIPAIATS

SEQ ID NO: 138206 - protein, 185 aa, Triticum aestivum
  Clone ID: PAT_TA_32624.pep
MSAAAGGSSSSSSTPAPRLEGKVALVTGGGCGIGEAIVRLFRQHGAKVGIADIQDEAGQQLRDSLGGDPDVLFVHCDVTVEEDISRAVDAAAGKFGTLDIMVNNAGITGDKVTDIRNLDFADVKKVFDINVHGMLLGMKHAARVMIPSKKGSIVSLASVASVIGGMGPDAYTGGKHAREGLTKSE

SEQ ID NO: 138207 - protein, 186 aa, Triticum aestivum
  unsure (1)..(186): unsure at all Xaa locations
  Clone ID: PAT_TA_32625.pep
MKAGTAIAALVHWCSFLRSSDRSMTLDGGMPATTDGAGVPPAAERGGSGCGARVAPEVVVERDGGSGAGATIPATERAAAVAIPAMERDGGGSAGVAPTEAESDGGGRSCGEHCVIQVVEESCCARCVCVGPNPMMARYVYALIFLVTNLLAWTVRDYGHSVLGEXPRLKGCQGARYCLGARGVLR

SEQ ID NO: 138208 - protein, 264 aa, Triticum aestivum
  unsure (1)..(264): unsure at all Xaa locations
  Clone ID: PAT_TA_32626.pep
MALCKERPTSPLLRLEPPPXPSPSWPWCKERPTSPLLRLEPPPEPPPWXYARHGNHPVHQAGPSATATTANGEIPAMHQAGPSAPAVANEYVGHATTPTVFSIPPMEWLLAGPSAPFLGEEEMFPCELAPPPLPPYCLQHEFGPCPARTGAQPRLPSPTPSDELPEHFFPPGYGPVPDLPSPTPAAGSSSTPPPPPSSPATPPLSPTPPPEARRILRQFAAAMAQNRAAVRGAWSPAALGLTGAPGACSSGGGRAEMRGTPRLP

SEQ ID NO: 138209 - protein, 95 aa, Triticum aestivum
  Clone ID: PAT_TA_32627.pep
MMGTEDSKDMLKNADWKTVSGPVITESSQPIVKKRLPKKIRQVPECYFLPRRSLPSALAIYGAVCAAGVGAGMLLEVWINKKIKEDGGVVWEMGK

SEQ ID NO: 138210 - protein, 303 aa, Triticum aestivum
  unsure (1)..(303): unsure at all Xaa locations
  Clone ID: PAT_TA_32628.pep
MVNTADNLYNSNLTLGSYSSGKENLPPKRLVRPSKYQCSPFDNDLRGPLTPSEKQLHSNIVALGKIEPDRRAVLVDKTSLSLGQLGNSFDTNGHVEAYVFNVFCRLLFRDNHPRQSKKHYFFTTIADYFLQAWTTEEGRILMRRRALISFSGAGTTLPLHESERLXFFPSVHHEHWILFIVDIVARKFIFLDSVYYGESPFHMEVKDLMINNFIKTWEESRLGRMGFRNFGIEYPNMPKQIGRDACGIFVLKWMQTFASRNPLQPQFRMKDVADARVRLAVDILFSNHNTDDDAKRLVKYFRQ

SEQ ID NO: 138211 - protein, 83 aa, Triticum aestivum
  Clone ID: PAT_TA_32629.pep
DVWASMGQKEEAEYRKKVFQGFMVDEALMEMAGPKAFLMHCLPAERGVEVTDGAIEAPNSIVFPQAENRMHAQNAIMLHMLGA

SEQ ID NO: 138212 - protein, 280 aa, Triticum aestivum
  Clone ID: PAT_TA_32630.pep
MTSPSLTTCRHAAARPRASRVTGRSGVRAAPLRSRSGNGFAPSVSWSSPSPSRAITSCALKPPPSYGGKATEKKKVNPRDLFTFSYRFNTDIPMGETPGASIDDYLMNRPRIVGAVFPDKRKRTKLNDEEWRVQLVPIQFLFLSACPVIAVRFVSRSGGVGYPPHVPVHATSLLLMEVTDYKLKGLQRDAMPSHLALTVRGSLYPQPEGRRSLRGHVEMSVGFNLPPVLALVPEPIIRGVGDTVLRQLAEQMKHDFDTGLAADFKKYRTEKLTEGRTPEH

SEQ ID NO: 138213 - protein, 175 aa, Triticum aestivum
  Clone ID: PAT_TA_32631.pep
RHASAHASAHASAKKLQSLKLYGNLVKLPDWMEALRNLVKMELRSSRILEVDAAMQVLGNLPNLAILRLLRHSFTGEELRFSLNRDAAFPSLTVLELSLLDKLESVEFQGGAAPKIELLQFRGWRYKANTVLFAGLPSLPSLKEVLLKGRYEDGFVDDLRARLAGNPNRPVLKLN

SEQ ID NO: 138214 - protein, 236 aa, Triticum aestivum
  Clone ID: PAT_TA_32632.pep
MRRFQESVKALEADIQHANALASEFMRDYDGSVIQMRMAYSAVAHVLVQWTDCRLASALGLLKIMIYKVYAEDGTTTLPSWEREASIREFYGVIFPSLLQLPSGITELDDRKQRRLCVDKFKRRDGDFSQLDLEREVECGICLEVNAKIVLPDCTHSLCLRCFEEWNAKSKSCPFCRACLQKVKPSSLWVYTDDRDVVDMDALTSENIRRLLMYINKLPLVVLHVVDLDIYEYHSK

SEQ ID NO: 138215 - protein, 214 aa, Triticum aestivum
  Clone ID: PAT_TA_32633.pep
GPGGGGRRRPGRQGPRSQQREGCASALEPPVRGGRRRAVVAAPRRVRLRGLRLPPPRPVDVCLMDITGSVVLQVLKKFRGAGGSRSSRSSRRWEGYRCGGWEEPERGDAPRGQRAPWFTVVSNKWGRGPRCEFRSDGQAVRYKMDGGRRRQQAARASWIVDDATGLAVAEVKRKLTATGVSLGEDVLTLVVEPNVDHSLIMGLLVVHGLINHSM

SEQ ID NO: 138216 - protein, 109 aa, Triticum aestivum
  unsure (1)..(109): unsure at all Xaa locations
  Clone ID: PAT_TA_32634.pep
MKMHRACKICGEIGHTDKEHQDGCPYCEASHLGEECPTXRKVTCFMCEGTNHNPAQCRLLTTTQVVQQQRKGMKEAIQEFMAAPMKKRKKRRYAKKCRTRGTVPTRVQN

SEQ ID NO: 138217 - protein, 263 aa, Triticum aestivum
  unsure (1)..(263): unsure at all Xaa locations
  Clone ID: PAT_TA_32635.pep
MDLVGDQPICACTAWACMMKSEIFEFLKDGFHEVSNTLDLSFDDDSVAVEQIPFLAXLASFLKENKSNSCEPPARCLNXFMKSYHHIPLTPDNVVVFPSRAVAIENALQLFSPALAIVDEHLTRHLPKQWLTSLAIEXEQSTVTVIEAPRQSDLLIELIRKPKPQVVVTGMAQFEAITSAAFENLLNATKDVVSXLFLDISEHLELSSLPSSNGVFKYLAGKTLPSHAAILCGLVKKPVYSDXEVSFAISEDAAVYKALSQTI

SEQ ID NO: 138218 - protein, 116 aa, Triticum aestivum
  Clone ID: PAT_TA_32636.pep
HASDDDDSSGQPQQEEPHRRLLQRALQQLVSPFGKTDTASVLQEASGYIKFLHQQLEVLSSPYMRPPPAPGAEPEDPEHYSLRNRGLCLVPVEQTLQLTQSNGADLWAPANTSRRT

SEQ ID NO: 138219 - protein, 165 aa, Triticum aestivum
  Clone ID: PAT_TA_32637.pep
MMMTQVANHSKRNHTDSYFSGKQQQQAVATTATSSGSEEFAGMGSKKPRNASPRGGGPISPREKKDKVGERVAALQQLVSPFGKTDTASVLQEASGYIKFLHQQLEVLSSPYMRPPPAPGAEPEDPDHYSLRNRGLCLVPVEQTLQLTQSNGADLWAPANTTRRC

SEQ ID NO: 138220 - protein, 183 aa, Triticum aestivum
  Clone ID: PAT_TA_32638.pep
MSLLSSPTPFGAATAARHRLPLLGRRAALHVALARRAGVSSRTQRRLEERGGKKRRGGVETPDADEDTGPAWEGVEWEGEPLGFEVSTEPMPYLPDPEKPDFWEGPNMEVLGFFVQYMWAFGVFFSLVACGVAVATYNDGASDFRDTPAFKESTQAQEFPEESESSGADVFEGNPTEVAPALE

SEQ ID NO: 138221 - protein, 430 aa, Triticum aestivum
  Clone ID: PAT_TA_32639.pep
QEKADEMVQPRLLDALSNRKIDAVQDLRGILTRIGRFKSLEVQYTKIHIKPLKKLWEDFDLKQRASRAEVEKRGGEITSVSFSSWLPSFYDETLLYLEQEWKWCLTAFPEEYRSLVPKVLVETMSELNSSFVSRVNVATGDAVPETRSVAKGVLDVISGDLPKSIKLQNKHLAALIELHNMTGTFARNIQHLFSESDLGVVLSTLKAIYSPYETFKMRYGQMERAVLSAAMAGIDIRGAISRGLGAQGIELSETVRRMEESIPQMIVLLEAAVERCISLTGGSEADELVLALDDVMLQYISNLQETLKSLHEVCGLDNTTHTDASKKDAGLEKKEAPRLVDVSEEEEWSIVQGALQVLTVADCLTSRTSVFEASLRATLARIGTNFSLSGFGSSMDKLSAGTADDNSGAPLGGRAALDIATIRLSKRTEK

SEQ ID NO: 138222 - protein, 57 aa, Triticum aestivum
  Clone ID: PAT_TA_32640.pep
LINALSDFILRWTIDVGWASTWVRVGNEWLAAITYIWMIVAPIVWKRRQVGSSSTCA

SEQ ID NO: 138223 - protein, 180 aa, Triticum aestivum
  unsure (1)..(180): unsure at all Xaa locations
  Clone ID: PAT_TA_32641.pep
MAPTVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQXCVSFIGFRPPGLEXSXKGLNYE

SEQ ID NO: 138224 - protein, 125 aa, Triticum aestivum
  Clone ID: PAT_TA_32642.pep
MAAHQQQQPQQAVGFEDYLPVMAERLGEEGLMEELAAGFRLLMDPASGLITFHSLRRNAPLLGLGAMSDDDLRGMLAEGDFDGDGALSQMEFCVLMVRLSPDLMDQPRRWLDDAVAQASHFLFTS

SEQ ID NO: 138225 - protein, 129 aa, Triticum aestivum
  Clone ID: PAT_TA_32643.pep
MAAHQQQPQSQSQQQAVGFEDYLPVMAERLGEEGLMEELAAGFRLLMDPASGLITFDSLRRNAPLLGLGGMSDDDLRGMLAEGDFDGDGALSQMEFCVLMVRLSPDLMDEPRRWLDDAVAQASHFLFTS

SEQ ID NO: 138226 - protein, 210 aa, Triticum aestivum
  unsure (1)..(210): unsure at all Xaa locations
  Clone ID: PAT_TA_32644.pep
VVGREDDAPGPGASRKRRREEDKGDDGEDIDSSRTVTSTPVLRVETIYVSAAILAAKSSFFYKLFSNGMKESGQRQATVRIADSEEKAFMELLRFMYSGKLTATTEPIPLVDILMAADKFEVVSCMKRCIQRLMVLPMTPESALMCLDLPCSISMAADLTEAAKKFLAERYMEFLSTQFQDELMRMPPAGIEAILSRNDFXVASEGACYD

SEQ ID NO: 138227 - protein, 278 aa, Triticum aestivum
  unsure (1)..(278): unsure at all Xaa locations
  Clone ID: PAT_TA_32645.pep
MAGAGAEEAVVGESFEFAFDKEAFSDKKLRVEVVGSDDAATRKRRREDDKSDEGECVDSSSIVMAAPILRVTTMNINSAILAVKSPFFFKLFSNGMKESDKGQATLRIADSEENAFMELXYFMYSGKLTPTTEPTHLVDILMGADKFEGVSCIKLCGQQLTSLPMTPGSAVLCLDLPYSISMAPGLAGLLKKFFAERYKDFLSTKLQAQLMRIPLAGILAILSRNALGVLPEKTVYDFVLRWADFQYPNPKEKRKILSSQLLPLVPLVRSRVRTIVLD

SEQ ID NO: 138228 - protein, 231 aa, Triticum aestivum
  unsure (1)..(231): unsure at all Xaa locations
  Clone ID: PAT_TA_32646.pep
MKEKCVDSSSINVMATNFTSHYHQFSVTSMHINSAILAAKSPFFFKLFXKESDKGQATLRIADSEENAFMELLYFMYSXSLTPTGNSTHLVDILMWPLTFEVVSCIKLCGQLLTSLPMTPESAVLCLDLPYSISMAPALAEAAKKFFAERYKDFLSTKLQDELMRIPLAGIVAILSRNDPGVLPEEAVYDFVLRWADSQYPNPEERRKILSSQLLPLVPLVRSRVRTIVLD

SEQ ID NO: 138229 - protein, 201 aa, Triticum aestivum
  Clone ID: PAT_TA_32647.pep
MECKDVGILAMDMYFPPTCVQQEALEVHDGASKGKYTIGLGQDCMAFCSEVEDVISMSLTVVKSLLEKYHIDPKLIGRLEVGSETVIDKSKSIKTWLMQIFEESGNTDIEGVDSSNACYGGTAALLNCVNWVESRCWDGRYGLVVCTDSAVYAEGPARPTGGAAAIAMLIGPNAPISFESKYRASHMAHVYDFYKPDLASE

SEQ ID NO: 138230 - protein, 632 aa, Triticum aestivum
  unsure (1)..(632): unsure at all Xaa locations
  Clone ID: PAT_TA_32648.pep
MVVRKRLDYGSRGHQVPAMPRVPSSARGKRSARRKKDEMSPFDLLATVAGTLLVDHENSSNNAPSINAAALTYARKRKSVKAEQCDDAPPLKSIAVENCIAGSGGVCASPRQSNICLAENSSTRNGTDPVLESLTVKPDMLVRDSVFSCTKSCNRAHGVGGIPECGSSRSLEATNQVQVQQPMDGDTTALYSLVSSVDLDGRPPALVSSDSSSGVPLCIHEKDRTTSPLCHAEARHAADRDDDENSSGCTHPCTTGNNKSYMPQYTGDSRIRKMFASKIRKAARNKMCGEMSNKGSKLNLCGKKISTTRQRVQRAMFKRQKPVRRHFTPSSAKGILTEVKLXIKSFTIPELFIEIPENATVGSLKRTVMDVVTSIIESGLRVGVLLQGKSIQDDNKTLRQARICHGENLENIDFTLECEAGQNSSPGVRIPEEMDFHGADGHEDHXAMGKCEEPXFLRARAGYNSQQRVQASPNRVQSEHGSVHSLFETTAHEASASSQAIVPVASPSSEALAIVPVCKSKRPAIGQRRIRRPFSLPEVEALVEAVEQLGTGRWRDVKMLAFDNTDHRTYVDLKDKWKTLVHTASISPQQRRGEPVPQGLLDRVLAAQAYWSQQQQQQLSGKASGQGCSSSC

SEQ ID NO: 138231 - protein, 223 aa, Triticum aestivum
  unsure (1)..(223): unsure at all Xaa locations
  Clone ID: PAT_TA_32649.pep
MILEDETASDQFQGHMEGSQSATATYYLLMLHGKEFHAFPAGSWYNFSKVAQYKQLTLEEAEEKMNKRKTSATGYERWMMKAATNGPAAFGSDMMKLEPANDGEKESARHKKGKDNEXGNNSDKGEENEEEEAARKDRLGLSKRGMDDDEEGGKDLDFDLDDDIEKGDDWEHEETFTDDDEAVDIDPEERADLAPEIPAPPEIKQDDEENEEEXGGLSKSGKE

SEQ ID NO: 138232 - protein, 177 aa, Triticum aestivum
  unsure (1)..(177): unsure at all Xaa locations
  Clone ID: PAT_TA_32650.pep
NEDADDDDEEDDQDDESSPVLAPKQTDQPKDEPVDNSPAKPTPSSGHARSTPPASKSKQKRKSGGDDAKASSGAASKKAKDXTKTSSIKEETPSSSKPTPKASASSRSANVSPVTEDEIRTVLLAVAPVTTQDLVSRFKSRLRGPEDKNAFAEILKKISKIQKTNGHNYVVLREDKK

SEQ ID NO: 138233 - protein, 45 aa, Triticum aestivum
  Clone ID: PAT_TA_32651.pep
KRGLNPRPLHHVMHTAIGMNLRCYLFRKMSNLDKKKKKKKKKKKP

SEQ ID NO: 138234 - protein, 285 aa, Triticum aestivum
  unsure (1)..(285): unsure at all Xaa locations
  Clone ID: PAT_TA_32652.pep
CAACLAGGIRSSAAYVAVRLRSSVPDVTGRNESEKDMDLEKNLRGVLRAVVDRLRGVFGIEVDDSVTRDGIIRYELRNLARASGIRYCVLFCDTEVDHCRDWNDTRQEKGEPSYDNNILEDLAXRFEKPDRRSRRDSPLFEMFPSREELMESSPVIAEAVSYLSTKVDSTTRDVKVLQPTIATQSVRTTEGNSLYEMDKATQEVVSAIVEAQSGGLGLAMNKISLGPDLPTINLRRSVGLPELRSLRRTFIKLAGQYSLSGRPPPTDADSAKRMFVDYLNREIGG

SEQ ID NO: 138235 - protein, 368 aa, Triticum aestivum
  Clone ID: PAT_TA_32653.pep
MIFLTTFYAWTMWRRSRRISHGKAARRPDTTTTKGITLVPILSKFNTVKMSQKGLVAMIEYPSLEAATGKFSESNVLGVGGFGCVYKAAFDGGATAAVKRLEGGGPDCEKEFENELDLLGRIRHPNIVSLLGFCVHGGNHYIVYELMEKGSLETQLHGPSHGSAMSWHVRMKIALDTARGLEYLHEHCNPSVIHRDLKSSNILLDSDINAKIADFGLAVTSGNLDKGNLKISGTLGYVAPEYLLDGKLTEKSDVYAFGVVLLELLMGRKPVEKMSPSQCQSIVSWAMPQLTDRSKLPNIIDPVIKDTMDPKHLYQVAAVAVLCVQPEPSYRPLITDVLHSLVPLVPADLGGTLRVTEPHSPHQMYHPS

SEQ ID NO: 138236 - protein, 206 aa, Triticum aestivum
  Clone ID: PAT_TA_32654.pep
SPTSPSFAALLLPLSEGRRGRWETAPISLGNLGLLPAPQTGGRRRQSSKWFCADTPYPEVCADMIARYDESKGADDKKLAGMAALTTATLLLQASGDASPGVQKQRYPDLTKADEECFETCYKELTNGGQKLDNLCTSKEGSDDIGMAQLPEIRSFIKENNGAHAQWNCDRCRPANDKKTPDDVSKKNDAEKAMAVLEVLVNKVTK

SEQ ID NO: 138237 - protein, 96 aa, Triticum aestivum
  Clone ID: PAT_TA_32655.pep
GGYSMEKLLNMSVAANINLIPKHTNDSTSLEQFCRDTVVTIWHYHGGCHVGKVVDQQYKVIGTSGLRVIDGSTLSRSPGTNPQATVMMMGRYNPEI

SEQ ID NO: 138238 - protein, 215 aa, Triticum aestivum
  unsure (1)..(215): unsure at all Xaa locations
  Clone ID: PAT_TA_32656.pep
HFGILMQIGQLSTIPPKERSLEAVHKYVRNKKSLPKEVFHGGFILSKIDGPLSTGNLVLVDTDPNSNPIVTFNYFKHPQDLRRCVYGIKTIEKXISTNTFSNFTPKEGGYSMEKLLNMSVAANINLIPKHTNDSTSLEQFCRDTVVTIWHYHGGCHVGKVVDQQYKVIGTSGLRVIDGSTLSRSPGTNPQATVMMMGRYMGVKILRERLGRAAGV

SEQ ID NO: 138239 - protein, 74 aa, Triticum aestivum
  Clone ID: PAT_TA_32657.pep
DNTKAYLSTSHPSIQTTKYGSTNPIQPNNQMWLSLTRWLGISPANQLRPRTKRPLSCHRARTRTRWPIAWIRPN

SEQ ID NO: 138240 - protein, 96 aa, Triticum aestivum
  Clone ID: PAT_TA_32658.pep
MGEQAVTERIQRKLEEANATVQQHLAGIQDHVNFTMQERLNRSLMVCQDKFEAAKLQKMKTDATQELESCVNRSIDDSIRALPYVVQQMKSTLNIN

SEQ ID NO: 138241 - protein, 167 aa, Triticum aestivum
  Clone ID: PAT_TA_32659.pep
PVVGSPGYYNTTRLLERIVLHLDCVNGKPSIWEELVSCLLRLFSDRTTDYEDCISCNVEGDASIDAFSSLSSVFFEQHTRESWKHRCKWWMNRHFSQNIYMSETAKGDCKLLASKASCASHMLGPGFPYVKAAKSYLSKQEAKHESGFLSSNMENSVKLLQSLEKLM

SEQ ID NO: 138242 - protein, 68 aa, Triticum aestivum
  Clone ID: PAT_TA_32660.pep
VISEMIRGSINGVQFFLQANSLYPNTILFSIILKPISQRFILYEFEPWQTTPITRFHKHAGLVCRYSN

SEQ ID NO: 138243 - protein, 150 aa, Triticum aestivum
  Clone ID: PAT_TA_32661.pep
SWRCRRGRGPKKQSRTRASPWSHGSTRSSSALAWATGRRRRHGWCRRSTSAWSTTASSGRGSPTRPPTRPREALKVILDVRNHPVLIHCKRGKHRTGCVVGCLRKLHKWRLSSVFDEYLHFAAAKARKTDQRFMELFDTSSLVHLLASQC

SEQ ID NO: 138244 - protein, 286 aa, Triticum aestivum
  Clone ID: PAT_TA_32662.pep
LVRAPPLLLHLQPPPTTAQAFFVRRLAPTPRRRPLSARVRVRASNSDPPQQVNLSVLRFTLGIPGLDESYLPRWIGLGFGALVLLNHLLSPSPTPAQLRSEALGLCLAAFSAALPYLGRFLEGAGASSRVPLPEGSRQVFVIPDDLSTAQKEDMAWATYVLLQNTNTTSGLIAIGNVLCIRGYWDPPADISKYAMINWFKSQMEQAGLNNLSSALYFPNFSDTQLGNILPQGILSVLAQPIVSNPDPANGESRAEGVVLLASNANYAYSEKDMVWIRTVANKFRLV

SEQ ID NO: 138245 - protein, 120 aa, Triticum aestivum
  unsure (1)..(120): unsure at all Xaa locations
  Clone ID: PAT_TA_32663.pep
WRRRKSAGGALEAEKPWACCNNTVCKESLPPVCRCLDKVKECAAACELCEPSGINHVCNDWYRGDPGPMCAXEEWPCTCCDRTVGTRTFPPTCRCLDEVEVSTTWCNTRWITRFNKMENV

SEQ ID NO: 138246 - protein, 141 aa, Triticum aestivum
  unsure (1)..(141): unsure at all Xaa locations
  Clone ID: PAT_TA_32664.pep
MSCPRSKYSYSTRGCPPTLAPQSTAPGLVNFSVSACGTNDPEXPREMAKQFVDLLNEELKLQQVVAEEHIHHMNATLVEAKRQATLYQREAEKCNAATETCEEAREKSEGAISKERKLTALWERRARELGWQDSRAATTAR

SEQ ID NO: 138247 - protein, 192 aa, Triticum aestivum
  Clone ID: PAT_TA_32665.pep
ELRAWWVWTTTLPRSILYWRDQDCRERKKPIWPPGTCDHSWRGRLPLVDGVWRRCSVRRLGRAGRRVSGGLGSDLKLVASPCLSSFVSWFAGFLRTSCSAGWRSNGDASSGSGETLDRWCRSRCWRRLRRRSPSGEQHRDPLLAFHPMVPGESLKSLDWAATVRRHRFLLEDAALGVQDGQGLRAVVVCLFF

SEQ ID NO: 138248 - protein, 122 aa, Triticum aestivum
  Clone ID: PAT_TA_32666.pep
DNTKHNEHTPGLYIVRMHIANTNTHTKTHQQIAKSNKTKAIRRRGKKKHKGSDPPLANYINDHICTQDITGMTRFFNNNAFKKEGAQASSSPDSTTQGQNLGFHPEELDRAYPSNAFKKVTM

SEQ ID NO: 138249 - protein, 39 aa, Triticum aestivum
  Clone ID: PAT_TA_32667.pep
KVILPLSFWVCLICLLFITHNSSSHQHLQPKNYLITDLP

SEQ ID NO: 138250 - protein, 311 aa, Triticum aestivum
  unsure (1)..(311): unsure at all Xaa locations
  Clone ID: PAT_TA_32668.pep
MDVVKAAQLSGRTLEMVVVHPLVLLSIVDDYNPVARDTRKRVVGVLLGASSRGLVDVTNSYAVPFEEDDKDPRIWXFLDHNYHESMFSMFKRINAKEHVVGWYSTGPKLKENDLDVHALFTNYVPNPVLVIIDVQPKELGIPTKAYYAVEEVKENATQKSQKVFVHVPSEIAAHEVEEIGVEHLLRDVKDTTISTLATEVSSKLAALKGLDARLTEIRGYLDLVIEGKLPLNHEILYHLQDVFNLLPNLNVNELIKAFAVKTNDMMLVIYLSSLIRSVIALHNLINNKMLNKEHEKAEDLKPAAVPTAAGS

SEQ ID NO: 138251 - protein, 205 aa, Triticum aestivum
  Clone ID: PAT_TA_32669.pep
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYGSRDDKYGGSNGSSRYGPDRGGDRYSGSRDGGSRSSGGGDRYSRDRSGPYDRRSRDEY

SEQ ID NO: 138252 - protein, 178 aa, Triticum aestivum
  unsure (1)..(178): unsure at all Xaa locations
  Clone ID: PAT_TA_32670.pep
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYXYGSRDDRYSSRDDRYSSRDDRXWWQGWWKG

SEQ ID NO: 138253 - protein, 129 aa, Triticum aestivum
  Clone ID: PAT_TA_32671.pep
HQQYQVSKKIEIRNIQYIQAYTKTCYLNTDIISCSCTATRSSKPGPCSRGCCLNYQHIHRVDDPRYVPQYGQQETDPELHAEFVAQEDADGRQDDGEDHLQDCCRAHGLLTSLEAFWLLSFSLLSLLKA

SEQ ID NO: 138254 - protein, 82 aa, Triticum aestivum
  unsure (1)..(82): unsure at all Xaa locations
  Clone ID: PAT_TA_32672.pep
ASQLEGNGASDEPSHPPAVLEVILAIILPPVGVFLRYKLGVEFWICLLLTILGYIPGXIYAVYVLAMHHRACRGVQQGWSSC

SEQ ID NO: 138255 - protein, 191 aa, Triticum aestivum
  unsure (1)..(191): unsure at all Xaa locations
  Clone ID: PAT_TA_32673.pep
SSLPSPPPPPSSALLPLPTRLSSSTTVTLPSMSSPFPSTAALPAPXPPSSLASDSLRTSAPLALPSRLPTPELSTSLSSLATPPTPTTSTTSSTLSTATPSPASTTSSTLVMAARSSTARLVTPSATAPPAARRTTAALTPSPSTPRSAPSKRLANKSRCSLRSIVNDWFFFIIPTFSIYIIRQHQSLPTR

SEQ ID NO: 138256 - protein, 150 aa, Triticum aestivum
  unsure (1)..(150): unsure at all Xaa locations
  Clone ID: PAT_TA_32674.pep
PPPASPPPPRRPRGPPAGPAPPGPGPPTPRPPRPGPAGRARGPRSRRPGPAXAARGGAAPPGGRQRRRAGPAAAPPAAPPAAPRRPPPGPPAPAARHPRPVPGLPVPAPGGRSLSPLLGQCRGPSFAAAAPKFFYVFLERTLYCTHYYIC

SEQ ID NO: 138257 - protein, 114 aa, Triticum aestivum
  unsure (1)..(114): unsure at all Xaa locations
  Clone ID: PAT_TA_32675.pep
VLLSLAATTGAAPGHRSGVVSTFSGPGIGLGFGVGCGFGVGWGFGGMPLNVFGLCMGXGIGGGCGVGLGLGWGFGNAYGCQYRSSRVQFQGIEFQKKSEGDEAPKLVEKSRPYG

SEQ ID NO: 138258 - protein, 1628 aa, Triticum aestivum
  Clone ID: PAT_TA_32676.pep
MEMSLWPRSPLCPRSRQPLVVVRPAGRGGLTQPFLMNGRFTRSRTLRCMVASSDPPNRKSRRMVPPQVKVISSRGYTTRLIVEPSNENTEHNNRDEETLDTYNALLSTETAEWTDNREAETAKADSSQNALSSSIIGEVDVADEDILAADLTVYSLSSVMKKEVDAADKARVKEDAFELDLPATTLRSVIVDVMDHNGTVQETLRSVIVDVMDHNGTVQETLRSVIVDVMDDAADKARVEEDVFELDLSGNISSSATTVELDAVDEVGPVQDKFEATSSGNVSNSATVREVDASDEAGNDQGIFRADLSGNVFSSSTTVEVGAVDEAGSIKDRFETDSSGNVSTSAPMWDAIDETVADQDTFEADLSGNASSCATYREVDDVVDETRSEEETFAMDLFASESGHEKHMAVDYVGEATDEEETYQQQYPVPSSFSMWDKAIAKTGVSLNPELRLVRVEEQGKVNFSDKKDLSIDDLPGQNQSIIGSYKQDKSIADVAGPTQSIFGSSKQHRSIVAFPKQNQSIVSVTEQKQSIVGFRSQDLSAVSLPKQNVPIVGTSREGQTKQVPVVDRQDALYVNGLEAKEGDHTSEKTDEDALHVKFNVDNVLRKHQADRTQAVEKKTWKKVDEEHLYMTEHQKRAAEGQMVVNEDELSITEIGMGRGDKIQHVLSEEELSWSEDEVQLIEDDGQYEVDETSVSVNVEQDIQGSPQDVVDPQALKVMLQELAEKNYSMRNKLFVFPEVVKADSVIDLYLNRDLTALANEPDVVIKGAFNGWKWRLFTERLHKSDLGGVWWSCKLYIPKEAYRLDFVFFNGRTVYENNGNNDFCIGIEGTMNEDLFEDFLVKEKQRELEKLAMEEAERRTQTEEQRRRKEARAADEAVRAQAKAEIEIKKKKLQSMLSLARTCVDNLWYIEASTDTRGDTIRLYYNRNSRPLAHSTEIWMHGGYNNWTDGLSIVESFVKCNDKDGDWWYADVIPPEKALVLDWVFADGPAGNARNYDNNARQDFHAILPNNNVTEEGFWAQEEQNIYTRLLQERREKEETMKRKAERSANIKAEMKAKTMRRFLLSQKHIVYTEPLEIRAGTTVDVLYNPSNTVLNGKSEGWFRCSFNLWMHSSGALPPQKMVKSGDGPLLKATVDVPPDAYMMDFVFSEWEEDGIYDNRNGMDYHIPVSDSIETENYMRIIHIAVEMAPVAKVGGLGDVVTSLSRAIQDLGHTVEVILPKYDCLNQSSVKDLHLYQSFSWGGTEIKVWVGRVEDLTVYFLEPQNGMFGVGCVYGRNDDRRFGFFCHSALEFILQNEFSPHIIHCHDWSSAPVAWLYKEHYSQSRMASTRVVFTIHNLEFGAHYIGKAMTYCDKATTVSPTYSRDVAGHGAIAPHREKFYGILNGIDPDIWDPYTDNFIPVPYTCENVVEGKRAAKRALQQKFGLQQTDVPIVGIITRLTAQKGIHLIKHAIHRTLESNGHVVLLGSAPDHRIQGDFCRLADALHGVYHGRVKLVLTYDEPLSHLIYAGSDFIIVPSIFEPCGLTQLVAMRYGSIPIVRKTGGLHDTVFDVDNDKDRARSLGLEPNGFSFDGADSNGVDYALNRAIGAWFDARDWFHSLCKRVMEQDWSWNRPALDYIELYHAARKF

SEQ ID NO: 138259 - protein, 204 aa, Triticum aestivum
  Clone ID: PAT_TA_32677.pep
GFTFPSDKLSPATSATMTAAELLRAQLGEHNIEEDDPILEDDEDADEMDDDDVEGGDASGRSRSEKKCRKAMEKLGMKAITGVSRVTIKQSKTVTFVLSKPDVFKSSHSETYVMFGVVKMEDMDAQLLTEAAGQFKAPGPSSVISKGEPSVAAAQDDKEVDETGVDNKDVEVVMMQASVSRSRAVKALKAADGDIVSAIMELTY

SEQ ID NO: 138260 - protein, 181 aa, Triticum aestivum
  Clone ID: PAT_TA_32678.pep
MAGRSSSRSMVSAHRLFAPAPARTLQHAADPALELDEADIIWGGAALASSPPADAYGRALSTSTPSRASKPRAAAPRDAAGGGGGVGGPASLPVNIPDWSKILGSEYGGGSAGAGRWPSDDRGDAYLDRGDRQWVPPHEQLMYRERAAASFSVREGAGRTLKGRDLRRVRNAIWEKTGFQD

SEQ ID NO: 138261 - protein, 173 aa, Triticum aestivum
  Clone ID: PAT_TA_32679.pep
DSATGGSKDSRVRTSSGTFLKRGQDKIVRTIEKRISDFTFIPVENGEGLQVLHYEVGQKYEPHFDYFHDDFNTKNGGQRIATVLMYLSDVEEGGETVFPSAKVNSSSIPFHNELSECAKRGISVKPKMGDALLFWSMRPDGTLDPPSLHGGCPVIKGDKWSFTKWICVHEYKV

SEQ ID NO: 138262 - protein, 300 aa, Triticum aestivum
  Clone ID: PAT_TA_32680.pep
MASRTAGRGGRPLLGGGAGGGRRGKPSKAILAALLLASVALLLLLALGALSLPAGSGRGAVLSLPRPRFRRSASESRLEKRGEKGEPWTEVLSWEPRAFIYHNFLSKEECQYLISLAKPHMKKSTVVDSATGGSKDSRVRTSSGTFLKRGQDKIVRTIEKRISDFTFIPVENGEGLQVLHYEVGQKYEPHFDYFHDDFNTKNGGQRIATVLMYLSDVEEGGETVFPSAKVNSSSIPFHNELSECAKRGISVKPKMGDALLFWSMRPDGTLDPTSLHGGCPVIKGDKWSSTKWIRVHEYKV

SEQ ID NO: 138263 - protein, 179 aa, Triticum aestivum
  unsure (1)..(179): unsure at all Xaa locations
  Clone ID: PAT_TA_32681.pep
RAILPEKPLKFIHLRHLRLEITFXSLTKRKSDVLDFASLLEAAPLMEKLEFHMWMDCECVRYRKLDGKLRSLPPKPHYHLKLVDITGFYGEKDQLELALYILRNSVALEAMTIDPKPTVAAEQCRLTWKKDGFSYVDGYRVAKKYLLRADHRGVVDVVKAGRKDIEALRNAPYKMPEAT

SEQ ID NO: 138264 - protein, 230 aa, Triticum aestivum
  Clone ID: PAT_TA_32682.pep
IERRHARRRRSHCTLHAPPTPREAIHRPSISQGPTAAVPAPAVGAHSPPFLEKLASGERAWRWDSGKAAPASCRARRVAVRPRRRLRRTATPRPTRSPTMTCRRCRSRWTGSRTAPRNLGNLSTCRRRRERQSRGSRQRRRRRRRRQAANRKRSRKRRRAACSRGCPAALDKHRQWIAGGKNRLGGTLIVSGPSPATLARAVGNGGQRQEKEVRNYGSIRRTKNTIKTSF

SEQ ID NO: 138265 - protein, 114 aa, Triticum aestivum
  unsure (1)..(114): unsure at all Xaa locations
  Clone ID: PAT_TA_32683.pep
MVVPPPDRAARIVGFLKPYLLRMHFSNKYVTAQVIHTPTATVACSASSQEKLLRPNLESTRDVSAAAKIGKLLGERLLLKGIPAVSIHMKREQKYHGKVKAVIDSVXESGVKLL

SEQ ID NO: 138266 - protein, 169 aa, Triticum aestivum
  unsure (1)..(169): unsure at all Xaa locations
  Clone ID: PAT_TA_32684.pep
CLFNVEQLYAVNIQYGFAASTRXHLLQGVLPSVDGYYGNCVYPVGITRSSKTIREAPLPEVVGVMREAKEALKVRFTDWMHGGAKDDHYNVPLDYGTVTVSDWSRVGFNEVDYGFGEPGYVFTLNDDVNIVASVIYLKPPAPKRGIRLMLRCVEEPHAAVFADELAKYA

SEQ ID NO: 138267 - protein, 56 aa, Triticum aestivum
  Clone ID: PAT_TA_32685.pep
EGTIFIFGYMLITDSVLVLSTELWSMSLSCSIDFSSSFCCITDLDIQPEVGGFIPP

SEQ ID NO: 138268 - protein, 442 aa, Triticum aestivum
  unsure (1)..(442): unsure at all Xaa locations
  Clone ID: PAT_TA_32686.pep
GVIPPQSCLPGRQKRCRLRACRPCSLSGASLATHASWSARSTGGRPYGGAGGLRSARPLAFLKVLLSKLSLDDSCFRNSLSSQAKDVHMWSLALAIVASLNHCMDDDVSRSSVANGTVSILSGQVPLMSSYLSAQSVNTHQXKKRAVLQQSQTSLSALSLTXENILSLLXVLAKYHFPRDTGMMQVDSELREIIIHLLAFISRGSARTGDSPNWNPSFCCPPIAKEEVVLHEDPPLIRSKHGWFRFAASSTHSTAAISAPSNAALSLVIRDKSSGDSGSVKQTRFTEMVAVQIYRVAFLIMKFPHASAHASAHASGELEFVDLAHFPELPMPDILHGLQDQVVSIVTEVLGANGSSALSGETDRVCRLLLVTLEASLYMELCVSQSCGIRPVLGRFEDFSKGIKAMLHALEKHSSLKPLVRSLAQITTLLYPGLAQSNFLSM

SEQ ID NO: 138269 - protein, 155 aa, Triticum aestivum
  Clone ID: PAT_TA_32687.pep
RVHPTKKEKVYVLHTIHNSHAVRNEQIEWKRVVSKHTARHVRPWLPKHDTNTRVPCMRASALHSPGRDARPPTHKRACISAAAAIFGVASARVGVGLLRHIRTRHLEHARRGGLRLGRLRRRRVGLLQARHQQAAAQQQGRQPHTHAHRLALHER

SEQ ID NO: 138270 - protein, 45 aa, Triticum aestivum
  Clone ID: PAT_TA_32688.pep
SSEIQQEPTRAGAARSDVMSAEAVALCMGISDSKQALLISSGDLH

SEQ ID NO: 138271 - protein, 132 aa, Triticum aestivum
  Clone ID: PAT_TA_32689.pep
NARVVQVAQAPSSNASATGFGTVLVIDDPLTEGPNLTSRLLGRAQGMYVSAGKDSLSLLMAMNFVFVDGAYNGSSIAIIGPNQADRAVREMPVVGGTGVFRFARGYCQLRTHWFDAKTGDATVEYKIHLRHD

SEQ ID NO: 138272 - protein, 177 aa, Triticum aestivum
  Clone ID: PAT_TA_32690.pep
MASSTALSCLAALLLLAAAAAPAFAAEKETRLRVYWHDVVSGGPNATVAQVAQAPSSNASATGFGSVSVIDDPLTEGPSLTGPRLLGRAQGLYVSSGKDSLSLLMAMNFVFVDGAYNGSSIAIVGPNPVNRAVREMAVVGGTGVFRFARGYCQLRTHWFDANTGDATVEYRVHLRHD

SEQ ID NO: 138273 - protein, 176 aa, Triticum aestivum
  Clone ID: PAT_TA_32691.pep
MASSTALSCLAALLLLAAAAAPASAAEKETRLRVYWHDVVSGGPNARVVQVAQAPSSNASATGFGTVLVIDDPLTEGPNLTSRLLGRAQGMYISAGKDSLSLLMAMNFVFVDGAYNGSSIAIIGPNQADRAVREMPVVGGTGVFRFARGYCQLRTHWFDAKTGDATVEYKIHLRHD

SEQ ID NO: 138274 - protein, 86 aa, Triticum aestivum
  Clone ID: PAT_TA_32692.pep
IAHLTKWLGVKSFGPSLVKRQISADSVGSGSNLNCSCLIVCYIFFPKIISRYISIYLIEKHQNFSKIQPLARNGQARRFDRILKRA

SEQ ID NO: 138275 - protein, 287 aa, Triticum aestivum
  unsure (1)..(287): unsure at all Xaa locations
  Clone ID: PAT_TA_32693.pep
HCTPRPTPAAGGSERTLQIYSMKIGGRDGELKWPLDVYGIVAARDAVEYNRNVLYFRRREDWQRLAPARPTLDLTGPSRAIVAVDDVDLEVQLKVKGTTRVSATEXLISRRLTYSGGYQGGLDSFVFTNCLCTVEFSLERLTETVQATILGVRVVEGGPWPFDHGGRVISSSTPQADKVMGTHSATDPLSRQVVLVDSDGGEMPRGSDGYLDLSRHVVSVELEEILKFVIQVYTESGDIQQYPVNFSPKHCNIEKGKCLIGASEVEITIAWSRLVQNKMDILFEGHV

SEQ ID NO: 138276 - protein, 557 aa, Triticum aestivum
  unsure (1)..(557): unsure at all Xaa locations
  Clone ID: PAT_TA_32694.pep
MTAGPKMRAGAATVVLALALLAVAVRAEDPYLFFDWKVAYGTKSPMGTPPKMILINGEFPGPTINCTSNNNIIVNXVFNEIDQALLFTWHGIHPGKALWHDGMPXENACMQPAVNTTYVKRHQQEEQESFYYPCIGMQRAAGTYGLISFHSRPLIPVPFDPRADDRHVRVGDRYNKDHAVRAKNLDTGKGIGRPAGLLINGKNEKDASNPPMFNVEEGKTYRFRVCNVGIKTTLNVRIQGHVLKLVEMEGSHTVQNEYDSMDVHIGQCLSFLSTANQKPGDYFFIASTRFIKGVSTITAVMRYKGSNTPPAAKLPDAPDGWAWSINQWRSFRWNLTASAARPNPQGSYHYGQINITRTIKLSPSRGKVDGKERYALNGVSHTDPETPLKLAEYFNATKGVFEYNLVTDTPPKEGTPIKVAPSVITTEHRTYIEIVFENPEKSIDTFHLDGYAFFAAGMGPGLWTVESRKTYNLLDTVSRHTIQVYPRSWTAVMLTFDNAGMWNLRSNLWERYYLGEQLYVSCTSPARSLRDEYNMPDNSLRCGKVVGMPLPPPYTIA

SEQ ID NO: 138277 - protein, 218 aa, Triticum aestivum
  Clone ID: PAT_TA_32695.pep
THPPPTQATAAPPRCRPHPRLPQAGPALKQTILLLGNPIPPATASSRSLHEIDSKSKPINGKVETGQQMEGGTRNITNVTENAASGWSIVKEELTFSAGSAPFSSCHASTIVEIGEDNFLVAYFGGSKEGAPDVKIWLQRYSDGHWHPPEVADEQDGLPMWNCVRFQLPAHELLLFYKIGQEVQKWTGAMKRLLDGGISWSEREQLPPGILGPIKNKP

SEQ ID NO: 138278 - protein, 140 aa, Triticum aestivum
  Clone ID: PAT_TA_32696.pep
MKIPKYKNRTRLGSYFRMSRRSQTQPPQPYKQVQPAAQSHTKQLEVDNHHDLNRLKSKELPQKSMLSRFTRRPMKSRQSTPDAQQSHTQLLQSMLEEVTPKHFWPCFSNLIAEPDISKSMASLLLRAAIFTPCRHYLVVV

SEQ ID NO: 138279 - protein, 80 aa, Triticum aestivum
  Clone ID: PAT_TA_32697.pep
MYMHVTAGVFLETTQEEKDKVRQLAMVALWCIQWNPRNRPSMTKVVNMLTGRLQSLQMPPKPFVSSLCCDAFSPLGLKMY

SEQ ID NO: 138280 - protein, 404 aa, Triticum aestivum
  Clone ID: PAT_TA_32698.pep
TPPPAPPRRVLLLSASARGAEPTDPVKLAFARAAAYKKERANPTPKPPPPPPSPPPPPQPSAKESSGSKEAFERALEYRNGSGGGLDGGSPLLNPSPVHHQSTSQGIDPFSKKPRPKKGGYAYDETDFLGLGFFEKKRYQGPPPGLSQGIDPFSNEDFPEVEIVVGDPSKFGKSRRSTENQPVDASESEETSRSKDGKQNEDSKLEETPLSTVTEPEDDENSESYKPRVTTWGMFPRPQNISKAYGGGRNISLGGETLSAEEKAAKDKRTRDATAPYIGGKNKTLDAKTMAECTKALKEGDELMNAGRLKQALPYYEKVMQAADFKTELHGLAALQWSICLDSLCRSKEAMGMYSKLKYHPNDRVSKKAKMFMFSFQAADFLKVDGVPMPRDTGYEGYLPGRPL

SEQ ID NO: 138281 - protein, 287 aa, Triticum aestivum
  unsure (1)..(287): unsure at all Xaa locations
  Clone ID: PAT_TA_32699.pep
PELRKALVVKKPSKDWAKRIQHEWKVLEKDLPDTIFVRAYEDRMDLLRAVIMGPAGTPYHDGLFFFDIYFTPQYPNTPPLVNYRSGGLRLNPNLYACGKVCLSLLNTWAGSGCEKWNPSNSTMLQVLVSIQALVLNAKPYFNEPGYANSANTPAGEKRSLTYXTRDTFLLSCKTMFYSFRNPPKHFEDFVAGHFRKHGRNVLVACKAYLDGAQVGCLAGNGVQDVDEGDESCSLEVRTSLXRLFEELLMEFTVKGADCSKFLSEKAKQSAASATTSRGPPADTTLRL

SEQ ID NO: 138282 - protein, 175 aa, Triticum aestivum
  Clone ID: PAT_TA_32700.pep
LLLPPPAAAAARPSWRRASATSLLHHHPRHPPPTPSSIHHSASHQCPPRATSPSSRRARPDTPPLLLLPFFPASLNLCLLLLLARAPAAARLQLSLLLSFSKLTSSLNPYCCCSSTFPYHAAVLLLLHLQTPSRCCYSIFLCPAAPSPSSQRPLLLLLLSQPPAVAFSLSLSEIL

SEQ ID NO: 138283 - protein, 287 aa, Triticum aestivum
  unsure (1)..(287): unsure at all Xaa locations
  Clone ID: PAT_TA_32701.pep
MADGLFSMAHPWASAFGILGNIISFLVFLAPTPTFLRVYRKNXTGGFSAVPYVVALFSCMLWIFYALVKTNSSPLLTINAFGCVVEGFYILLYVVYAPRAARHRALAFFLLLDVAAFALIVSVTVLLVPQPSRVKVLGSVCLAFSMAVFVAPLSVIFVVIKTKSAEYMPFSLSFFLTLSAVAWFFYGLFTKDIYVTLPNVGGFFFGVAQMTLYFCYRKPDTSALVLPTGIHDVSTEAAAQQEVELPEGTHPAVAMLTVSTLPMLAELQKMEQEISSPTPRKGYIKAF

SEQ ID NO: 138284 - protein, 392 aa, Triticum aestivum
  Clone ID: PAT_TA_32702.pep
ARRGTHRGPCAGPRRGAGRGGAPRRARTTAGRSAPPSPWPPPCAWAPAPPPTAPPTAPPPPPSPRRTRARAPSPWSPLRAGRGVSGRVRRAASLRVGLSLGPQAPRGPVPVLGDLAGVSGGRPPLPQSAAAAGTDENTLRKRLDHGIHCKNRMVTSNVRLVISIAREFEGPGLELYDLIQEGMQGLIRGAEKFDASKGFRFSTYSHWWIKQAMRKSVSEQTQIFRLPTTAHMVEASYRVKECTKRLRRKLKRRPSNEEIAVDTGMPVKRVEAAVNLPKYSVSLDSKIGSTDMTYQEVTADPSAETAEEMLNRMSMKKDVHQALDTPSPRERQVVKLRFGIDDGRIRTLQEIGNIMGVSRERIRQIESGAFRKLRGKKKVKCLMDYLVPVGNW

SEQ ID NO: 138285 - protein, 192 aa, Triticum aestivum
  unsure (1)..(192): unsure at all Xaa locations
  Clone ID: PAT_TA_32703.pep
PTRPVGFSYGGFVAFEMAAACPGLVRSVVVSGCTVTYTDAMKDALLGRHAGARSITELMLPETVEQLRLLFSSAMHMKMWFPRRLVKDFLKVMCNNRKERAEMLDDMVNMRGKEASAPVFQQNILLLWGENDNFFPVRMGRXLKEELGEKATLQTISKAGHLAQLERPCVYNRYLKKFLAAHSPFELVNTSS

SEQ ID NO: 138286 - protein, 111 aa, Triticum aestivum
  Clone ID: PAT_TA_32704.pep
SHPSPSTAATALHFPHLRCVLLACEVQDQDKGMASNNTRGNGERATSRCTDADLYGGVNVLAGDGFESQVYSKEIHADAVKLSVRRVRTSFAHTKMPCPGLMSLRMGAMVA

SEQ ID NO: 138287 - protein, 112 aa, Triticum aestivum
  Clone ID: PAT_TA_32705.pep
MISQGHASYIREQGSKLRCMHAHTHAKKEDELILSKVHACVHGVGGQTLTRHRHGGDQRKKKMARQQQHESKDGLHLPALHRYRHLHHNENAEQGRGAPCYEPPPSSSSLPS

SEQ ID NO: 138288 - protein, 178 aa, Triticum aestivum
  Clone ID: PAT_TA_32706.pep
VIPGAMLYYLTGLTKGPDRFAYFVVNLCMCPLLVESMMMIIAVIVPDFLMGIIFGAGVQGVMMLNGGFFRLPNELPKPVWKYPCYYISFPKYAVQGFYKNEFIGQTFPSDQLVEKNVPISGLRVLQEKLQVEMGYSKWVNIAFLCGMVVVYRVLFFAIVKIAEEVRPKLRGMRCKLCK

SEQ ID NO: 138289 - protein, 191 aa, Triticum aestivum
  Clone ID: PAT_TA_32707.pep
LALLRTPFLLEDGRLLCGSSVESWNSWGAWLEVTKDGGRTWRKHGPIYIEGETLGVIQPVPYQTANGTIRMLLRSFETIGRVCLADSADGGVTWSYAHKTELPNPNSGIDGVKMKDGRVLVAYNTFSRGTLKIAVSMDDGDSWNEVMTLEDTKGMEFSYPAVIQTMDELVHITYTYNRTQIKHVVLRHSET

SEQ ID NO: 138290 - protein, 77 aa, Triticum aestivum
  Clone ID: PAT_TA_32708.pep
RRIHGLLIARRCRQRFAYVFAQLITVVGSSVARPSTGGGCDTPANCHFLGPKPLYHADAIVLINDCQIGEMNSYCRF

SEQ ID NO: 138291 - protein, 201 aa, Triticum aestivum
  unsure (1)..(201): unsure at all Xaa locations
  Clone ID: PAT_TA_32709.pep
DIFFLCSTSSGNANTXHDQRFFLYASVVAYPASTSYPWSPCSRFVAIVRICSTTLGSSMPIRLLRGLCLLPSGISARSAAPGVAGERTRSGSLLEGPRQRPAGRMPPGRFHPAGCMACAVRAASGSVGRPCKSPPACPLDHSPLISVASPDRSQAPGCASARSSQPFRASQAPLDYSGRLVYGFRLPPRGTSETATGCRYS

SEQ ID NO: 138292 - protein, 147 aa, Triticum aestivum
  Clone ID: PAT_TA_32710.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTTAKSPKKKTAATKE

SEQ ID NO: 138293 - protein, 143 aa, Triticum aestivum
  unsure (1)..(143): unsure at all Xaa locations
  Clone ID: PAT_TA_32711.pep
RRKSRTVSXYLVKSRGKLLMVLRLARRGKHGFRIFEMNLAVAPAGGSEASWVELHSLPGRVLLLGRGCSRAVEVSQFNRLQLGSIYYLDDTSFDISLALSSGSKYSSTDMGVYGRKTLNRARSVRRFPRKFTSEGSPPIWFMP

SEQ ID NO: 138294 - protein, 135 aa, Triticum aestivum
  Clone ID: PAT_TA_32712.pep
NTALKYPWVGCRTRTYNLKRFGDSPTSMLPHLKALVTTGIRIWLFSGDFDAMVPVTATRRSVEKLQLGVEKDWRAWSPGPGKDVAGYVIAYKGLVLATVRGAGHMVTVDQPERGFALFTSFLRGEPLPSAAPQTD

SEQ ID NO: 138295 - protein, 110 aa, Triticum aestivum
  Clone ID: PAT_TA_32713.pep
STGSPHHRIVHVLCLRYLKNNLILRSSYITTLEIQKQKTKEFTKLTPHRPHLLHRPTTSNSCGGSMLWDPGRGQSLWLLKYPSSRSSKILSRNNKKVCSLKLLVFMPHVM

SEQ ID NO: 138296 - protein, 129 aa, Triticum aestivum
  Clone ID: PAT_TA_32714.pep
LRKYHKNYQRETWGRVLNVLRDDGGITVKGHVQKPVLKERFKQFNAAMDEIQRTQGAWVVSDEQLQSELRVSITAVVVPAYRSFLGRFAQHFTAGRQTEKYIKLSADDLEGIIEELFEGSAGSMSRRRN

SEQ ID NO: 138297 - protein, 126 aa, Triticum aestivum
  unsure (1)..(126): unsure at all Xaa locations
  Clone ID: PAT_TA_32715.pep
LNGGGSSVRERQQEVGGFPGEGEAAGLVHAIFLCLGPLRWSPVQTKFHFGLTEPKFIGRHLHARATSQPPSLSNREWIRYLLLGRAGPLTGILLQVVGFKAFVATFLTXMSSLMPYLGXVFCVLCM

SEQ ID NO: 138298 - protein, 246 aa, Triticum aestivum
  unsure (1)..(246): unsure at all Xaa locations
  Clone ID: PAT_TA_32716.pep
TARCYKAATLDNYVPNDDEXKXNYLAAATNELDRFFSKDNFGEMKVVGQFNLGFIIGKLEQDLFIVDQHAADEKYNFESLSQSTTLNIQPLLQPLRLELSPEEEVIVSMHMNTIRKNGFVLAEDLHASPGSHYLLKAVPFSKNITFGVQDVKELICMLSDSQGDCSIISSYKMDKTDSVCPSRVRAMFASRACRMSTMIGDPLTKTEMKKILKNLTGLRSPWNCPHGRPTMRHLADLTSIRSKEAN

SEQ ID NO: 138299 - protein, 98 aa, Triticum aestivum
  Clone ID: PAT_TA_32717.pep
MDKGAWSEESRKGYNLVDAVTRCTVQVYPRGWTAIFIALDNVGMWNVRSEDWVRRYLGQQFYLRVYTPAHSVRDELTVPTNAILCGRAANKSRLPFSQ

SEQ ID NO: 138300 - protein, 339 aa, Triticum aestivum
  unsure (1)..(339): unsure at all Xaa locations
  Clone ID: PAT_TA_32718.pep
SDDADTPFTLAADHGLSGLGTNKDPGPVLAPGRGGAIAHHGKDTDSSLDIHLGHSDSFLVLAVPPAHIYTTVDTRRLAHSVLLVDAVGQHTMPNAVPAALPPPPGPTVDIVWSHQPARAFTFIVSASVPRPNLTGSDLLRHGNSKGVPAPVTPPPPPTRELRSALNNATFIRCDPTPSGPGLYHQRGVFTRGSMPDAPSGGPAYRLTAVMASNMRDYVEXVFENAEGSVQSWHIDGYAFWVVGMDGGEWTPASRQNYNLRDAITRYTLQVYPRGWTAIFIALDNVGMWNVRSEDWVRRYLGQQFYLRVYTPAHSVRDELTVPTNAILCGRASGRRTRPL

SEQ ID NO: 138301 - protein, 85 aa, Triticum aestivum
  unsure (1)..(85): unsure at all Xaa locations
  Clone ID: PAT_TA_32719.pep
MENRNTFSWVKEQITRSISVSIMIYVITRTSISNAYPIFAQQGYENPREATGRIVCANCHLFSKPVXIEVPQAVPPEXVFEAFSS

SEQ ID NO: 138302 - protein, 268 aa, Triticum aestivum
  unsure (1)..(268): unsure at all Xaa locations
  Clone ID: PAT_TA_32720.pep
GGQARVELFVASNEFKELNVGLVLDEGLASPXGREYRVFYAERSPWWLTIKAKGAPGHGAKLYDGSAMENLMKSVEALRRFRTAQFDLVKSGEKAEGDVVSVNFAYLKAGTPTPTGFVMNLQPSEAEAGIDIRIPPSSEEWAPSSRNLTFEFKQKGSVLDKLGKPAMTIANSSNPWWPVFEESVKRAGGKLGKPEIFPASTDARYFREVGIPAFGFSPMANTPILLHDHNEFLSKDEYLKGIGIYESIIKALATHKDDGIDEESRAEL

SEQ ID NO: 138303 - protein, 141 aa, Triticum aestivum
  Clone ID: PAT_TA_32721.pep
MENLAMLWGIIGPGVAGALFGAGWWFWVDAVVCSAVQVSFIHYLPGIFASLAALMFNCVDKDAIGNDYYSSYGDDSEWRVKLWLFVAYVVSFVCLAGSVGLLVQDALTDKGPSVWTGVAGVLQCVFVLISGLTYWTCHTED

SEQ ID NO: 138304 - protein, 363 aa, Triticum aestivum
  unsure (1)..(363): unsure at all Xaa locations
  Clone ID: PAT_TA_32722.pep
MGGAGGAKAYGAVVLIRVMYSGMHIMSKIALDQGMNPFVFVFYRHTTAALVLIPIAFALERQKTKPVTLKIAGKMFVHALYGVTACGVLFNLGLNYASATSSSALYNVQPVVTFILAVIIGMESMKLKKLHGNLKVAGILCCVAGVTVLAFYEGPMFRSFNHHRLFQHGSSSSSSGAGTYSKNQWVFGIFLMTLSNILAGLWTVLQGPLIEDTSKLMNTTLQISCASVQAFVXVAAERDFSKWKIGWNISLAAIIYSGVIVTALSYYMQMWTIAKRGPVFLAMSMPLTLIFTIIISSFVLGEAVSLGSIIAGILLIGGLYNVLWGKSMERKDDDTNKMGGGKPAQELQDKEQARVPDDAAAKV

SEQ ID NO: 138305 - protein, 121 aa, Triticum aestivum
  Clone ID: PAT_TA_32723.pep
GPMLIYPMLKSKWDPNTSVALPEGEVRHLRCLRARCPTWCGCWVYALVAAAGAIVDACRSSGYDFKTYFPHYRTEADWARHFGPKWARFVDRKARYDPLAILAPGQKSFARTPSSSRTDRS

SEQ ID NO: 138306 - protein, 107 aa, Triticum aestivum
  Clone ID: PAT_TA_32724.pep
PAGPAKRTHRALTLSQKSTFHLFSLLDLLAGEEKGPAMDGGKKSRDPYKLPQERRDRKSGSGMSGDAKKGGRGGKFTWEGTDGYTDEDLDLIGNKGRGTGASDNKKS

SEQ ID NO: 138307 - protein, 118 aa, Triticum aestivum
  Clone ID: PAT_TA_32725.pep
MASSSRMLTVVVLAALFAGAMAVKVKLTVQKGSDKKKLALKIDYTRPNDSLSEVELRQHGSEEWQPLTKKGDVWEVSCSKPLVGPFNFRFLSKNGMKNVFDEVFSTDFKIGKTYQPEY

SEQ ID NO: 138308 - protein, 80 aa, Triticum aestivum
  Clone ID: PAT_TA_32726.pep
MTEEREKQELLGRASASEIFQHAPTDKPAFTLAQIKEAIPPHYFQCSLIKSFSYVVYDLVISASLLYAGLVWIPALSSMQ

SEQ ID NO: 138309 - protein, 387 aa, Triticum aestivum
  Clone ID: PAT_TA_32727.pep
MGAGGRMTEKEREKQELLGRAGAGEIFQRAPTDKPAFTLAQIKKAIPPHCFQRSVIKSFSYVVYDLVIIASLLYAALVWIPALPAMQQLGAWPLYWAAQGCVMTGVWVLAHECGHHAFSDYLLLDNILGLVLHSWLFVPYFSWKYSHRRHHANTGSLERDEVFVPKQKEALAWYTPYIYNNPVGRLVHIVVQLTLGWPLYLALNASGRPYPRFACHFDPYGPIYNDRERAQIFISDVGVLAVSLALLKLVSSFGFWWVVRVYGVPLLIVNAWLVLITYLQHTHPALPHYDSTEWDWLRGALATMDRDYGILNRVFHNITDTHVAHHLFSTMPHYHAMEATKAIKPILGEYYQFDPTPVAKATWREAKECIYVEPEDRKGVFWYSNKF

SEQ ID NO: 138310 - protein, 214 aa, Triticum aestivum
  Clone ID: PAT_TA_32728.pep
EHRGGGYRDSITVRSALPDCLQKDKNGQLGGQGTRGHRGGGHCGGGGLVLDDGVQRGGGVIERSSQPTWMQEWEGIAGSGQPWHGERRSQRPDHPWRPLHRPPPLCSGDDQPPCGPCFSGNPKLLLASRILTRSSNPLLCAPRGAPLHGSKASPGGTAPRHKQRSCRRPGTEPPRSGPGVAAPASVDSRPGTTASQLDAAIGASPLPLLLSRCG

SEQ ID NO: 138311 - protein, 184 aa, Triticum aestivum
  Clone ID: PAT_TA_32729.pep
PPFLRSSGRYPSSIRPPSSAAATATAPPSTDSVHAGGQFPSARPSPPSPQFTPIPCCPRCSSSQVVRKPREDVSTVIGEPPWCAAGGSLRSTQGASPGAQRRGCGGVRPEGVWDRWRSTARTGAGHRQSRGEEVDAGDAMYGRGAGSAFPHATAVLRQRCRHAFSPLTSFHEFLPSTLRSRDGL

SEQ ID NO: 138312 - protein, 67 aa, Triticum aestivum
  Clone ID: PAT_TA_32730.pep
SSLFHISFSSKMSPSGYQRKYNCFDTTTVREVSNHQRNKTFKLVFSNHGGELHVNFIKEGQHQGTSC

SEQ ID NO: 138313 - protein, 119 aa, Triticum aestivum
  Clone ID: PAT_TA_32731.pep
MASSSRMLTVVVLAALVAGAMCAVRVKLTVEKGSDKKKLALKIDYTRPGDSLSEVELRQHGSEEWQPLTKKGDVWEVSCSKPLVGPFNFRFLSKNGMKNVFDEVFSTDFKIGKTYQPEY

SEQ ID NO: 138314 - protein, 118 aa, Triticum aestivum
  Clone ID: PAT_TA_32732.pep
MASASRMLTVAVLAALFAGAMAVKVKLTVQKGSDKKKLALKIDYTRPNDSLSEVELRQHGSEEWQPLTKKGDVWEVSCSKPLVGPFNFRFLSKNGMKNVFDEVFSTDFKIGKTYEPEY

SEQ ID NO: 138315 - protein, 185 aa, Triticum aestivum
  Clone ID: PAT_TA_32733.pep
MGAGGRMTEKEREKQEQLGRANGGAAYQRSPTDKPPFTLGQIKKAIPPHCFQRSIIKSFSYVVHDLVIVAALLYAALVWIPTLPTVLQLGAWPLYWIVQGCVMTGVWVIAHECGHHAFSDYSLLDDTVGLVLHSWLLVPYFSWKYSHRRHHSNTGSLERDEVFVPKQKQAQAWYAPYLYNRPVRL

SEQ ID NO: 138316 - protein, 99 aa, Triticum aestivum
  Clone ID: PAT_TA_32734.pep
WFLVDTICLREMVANMWIPGYRVEDESYAPLRIKHVGDYAECIFLEMGRCALQLDVKCMQLRKVYIMAEEEVCLGDIHPLKMIWPPIFPALKDNPASSK

SEQ ID NO: 138317 - protein, 39 aa, Triticum aestivum
  Clone ID: PAT_TA_32735.pep
LSILELTIYRSFWRSDIPDIVQFSLFFSFSFLSLMRQER

SEQ ID NO: 138318 - protein, 263 aa, Triticum aestivum
  unsure (1)..(263): unsure at all Xaa locations
  Clone ID: PAT_TA_32736.pep
MADAYWRYADLQRQQQQQQQQHMPPPSAGAPQSSLAAAAGXQPLKRPRPGDYSADGPGAPEMAGYYPRDEERPGYAAVRDTQALNASYERFLRTGQIQSYGAGPAGGSVRPTAGASAGGYQADDRPGMAAGGMNGRNVGFGGGMPEPPLPPDASNTLFIEGIPPDCERREVSHIFRPFVGFQEVRLVNKEPRHPGGDPIVLCFVDFTNASQAAIAMEALQGYKFDEHDRSSPRLRLQFARFKGPRGQAGGAGGGGGVVGGIRR

SEQ ID NO: 138319 - protein, 81 aa, Triticum aestivum
  Clone ID: PAT_TA_32737.pep
MTGLRWWMISPSHPIPVICSTYARINLILKQSIVLQRLPEDHVFVMGDNRNNSCDSRAWGPLPISNIVGRHIMSFTRSSLQ

SEQ ID NO: 138320 - protein, 127 aa, Triticum aestivum
  Clone ID: PAT_TA_32738.pep
MDSAWQSIVRSGAARPVAVRKSETWGGEELPRMRRAADKAVVARREMRKSATMVPPSPPHPAAASSPVAERQGWRTRDVLGMAQDELLRRAESFIRRQHEHLRMQRQESEQRQAMERDRRRPAPIRV

SEQ ID NO: 138321 - protein, 268 aa, Triticum aestivum
  unsure (1)..(268): unsure at all Xaa locations
  Clone ID: PAT_TA_32739.pep
MGATSPDSGDLILVEPASPGSKVAVVTINRPDALNALTRSMMISLASAFRRLDADDGVAAVVLAGRGRSFCAGVDLTAAEEVFKGDVNDPAANPVAQMELCRKPIVGAVAGFAVTAGFEIALACDLLVAGRSAKFLDTHAKFGIFPSWGLSQKLSRLIGPNRAREVSLACMPVTAEMAEKWGLANHIVDDSQVLSKAIEVAEAIARNNRNLVVLYKSVINDGLQLDMKHARALEKERSXNYYNGMTKEQFANMQKFIQGRSSKAPSKL

SEQ ID NO: 138322 - protein, 48 aa, Triticum aestivum
  Clone ID: PAT_TA_32740.pep
HASGEAILFGEYKPGDTILVDTDSKGKPCLSRLNQPPIVQVSDSTRTF

SEQ ID NO: 138323 - protein, 388 aa, Triticum aestivum
  unsure (1)..(388): unsure at all Xaa locations
  Clone ID: PAT_TA_32741.pep
MSSPVGNTPLSASVNTEGPHQDKAESTIEEPIVVGTEEIARVASLWSGIPVQQLTADDKKILVGLDDELRKRVIGQDDAVAAISRAVKRSRVGLSDPXTEPIATMLFCGPTGVGKTELTKALAASYFGSESAMLRLDMSEYMERHTVSKLIGSPPGYIGYGETGTLTEAVRRKPFTVVLLDEIEKAHPDIFNILLQIFEDGHLADSQGRRVSFKNTLIVMTSNVGSTSISNGRRSMGFSTDDTESSRYVAVKSLVMEELKGFFRPELLNRIDETVVFRPLEQTQMLAILDILLEELKGKLLAVGIGLEVSDAMKELICREGYDKNYGARPLRRAITQLMEDVISEAILFGEYLPGRPLQRAAVSKGKPCLSRLNQPPIVQVSDSTRTF

SEQ ID NO: 138324 - protein, 207 aa, Triticum aestivum
  unsure (1)..(207): unsure at all Xaa locations
  Clone ID: PAT_TA_32742.pep
DAWVLVHLFSDGREGVTVRREPASAEAWPDVRRRWGPGGQRRPDGIILVEQVAAAAVEDGAEAARQVWGLVVQARGMECAACYVLDTCRVRSAEGRRRTSPRHHXATPSGFCTHFCLARAQCFGEPLEXPAPQRLAQPPLRQPPTIAAASATDVPLLASRNLPPRRRCTPPGRQEPPPPTIDATASGSAGKNGPKIHREASKNPIDR

SEQ ID NO: 138325 - protein, 147 aa, Triticum aestivum
  unsure (1)..(147): unsure at all Xaa locations
  Clone ID: PAT_TA_32743.pep
FGTRGGGGRGSGRRAGGRRGASQARRVSGRARPCGGRGGELCLRHRGWRVGRACCWRRGAPYAAPRPPARQDYISTTRNYHTIFISHNPPMSMKIRDKARAIMXLICLSISSIDDLFQGTEGLLVHLERINLLILVLNKLNLEHWRR

SEQ ID NO: 138326 - protein, 613 aa, Triticum aestivum
  Clone ID: PAT_TA_32744.pep
MPGAPSAQPAPASGYAPGAHREALDFIEHVTANAGKVQQRVLAEILAQNATAEYLRRYGVSASSSPLDPVDAFRRCVPLVTYEDLQPDILRIANGDSSPILSGKPISEFLTSSGTSGGERKLMPTIADELDRRSLLYSLLMPVMSQSLPGLDKGKAMYLLFVKAESRTPGGLAARPVLTSYYRSRQFLDRPHDPSSAYTSPNKAILCVDSYQSMYAQLLCGLVHRTDVLRVGAVFASGLLRAIRFLEKHWPLLCHDIRTGELDPEITDHAVRDAVGRLLHANPALASEIEAECSKPSWEGIIRRLWPRTKYIDVIVTGAMSQYIQTLEFYGGGLPLICTMYASSECYFGLNLNPMCKPGDVAYTLIPTMCHFEFLPVHCSNANAEPSHRDLVDLVDVKLGHDYELVVTTFSGLCRYRVGDVLRVAGFKNEAPMFSFVRRRNVALSIDSDKTDETELHTAVSSAVQHLAPFGASLVEYTSYADTAAIPGHYVLFWELREGSTAVPASVFEECCLSVEEALNSVYRQCRACDRSIGPLEIRVVSEGTFEKLMDYALSQGASINQYKAPRCVRPGPVVELLDARMQASYFSPKCPKWSPGNKQWNTSKELLSIGDA

SEQ ID NO: 138327 - protein, 98 aa, Triticum aestivum
  Clone ID: PAT_TA_32745.pep
PAGLAKSGSPSRRLRRRRRLRRWWRLRRPARRWRRRLRRPVEELSLESPSYRSIYRVVVVVVVFVSKLSSVSSCSCVSLSRRVCGVFDRELECRSVRG

SEQ ID NO: 138328 - protein, 105 aa, Triticum aestivum
  Clone ID: PAT_TA_32746.pep
MARTGATTTAAAAVLLLALVATSAAAVDAAAGGYEMNAAAAGGGRRSVRAQPAGLTQCMGGCGTKVASCLLDCYNTSTGGTMPICYLGCTNNAVFCATDCSTKGL

SEQ ID NO: 138329 - protein, 87 aa, Triticum aestivum
  Clone ID: PAT_TA_32747.pep
LNSRIPLVRTSSESTVSCSGKAPEGAIPHQAVTICLNIQKEHGKLLKDFSKGLVNNKDIENLKVEVEKFALSFDMPGFSLESMKYKE

SEQ ID NO: 138330 - protein, 221 aa, Triticum aestivum
  Clone ID: PAT_TA_32748.pep
MAETEYRCFVGGLAWATDDHNLQQAFSQYGEILDAKIINDRETGRSRGFGFVTFGSEESMRQAIEEMNGKELDGRNITVNEAQSRRSGGGGGGGGYCGQRGGSGGYGGGGGGYCGQGGGGYGQGGGGFGGQRGGGGYGGGRRGYGGSGGVFRFPPCVCHLPRSLEELGGGALSAIPPILSLSLRLPHARLSANSLVYCLYLGSALFRVYRRSFWCASVLLL

SEQ ID NO: 138331 - protein, 142 aa, Triticum aestivum
  unsure (1)..(142): unsure at all Xaa locations
  Clone ID: PAT_TA_32749.pep
MDPWVSSQPSLSLDLHVGLPPMGHPHSHHQAAPMVALAKPKILVEENFMQLKKDPEVAVLESELQRVSEENRRLGEMLREVASKYETLQGQFTDMVTAGAHAGGNNHYNNQPSSASEXXSVSPSRKRKSXXSNGTPXXSHQQ

SEQ ID NO: 138332 - protein, 159 aa, Triticum aestivum
  Clone ID: PAT_TA_32750.pep
PVRMAAFVGLRSVHSFSAMRSSNFRSTVASYRFSRQGRRASFVTRAMFERFTEKAIKVIMLAQEEARRLGHNFVGTEQVLLGLVGEGTGIAAKVLKSMGINLKDARVEVEKIIGRGNGFVAVEIPFTPRAKRVLELSLEEARQLGMSVKRSFYSLVHFI

SEQ ID NO: 138333 - protein, 158 aa, Triticum aestivum
  unsure (1)..(158): unsure at all Xaa locations
  Clone ID: PAT_TA_32751.pep
MTLLRYTVRSFGIRRNEKIACYVTIRGEKAMQLLESGLKVKEYELLRRNFSDTGCFGFGIQEHIDLGMKYDPSTGIYGMDFLCGCSERAGYRVSRXRRKCKARVGIHQRVTKEDAMKWFQVKYEGVILNNPNASLRRTYSPLDLELMKFTWLLDMYVT

SEQ ID NO: 138334 - protein, 132 aa, Triticum aestivum
  unsure (1)..(132): unsure at all Xaa locations
  Clone ID: PAT_TA_32752.pep
RFEKKGFYLKGLKLQNVEKSFAEQHYSDLSSKPFFAGLVEYIVSGPVVAMVWEGKSVLATGTQDHLGATNPLASEPRHHPVGDFAVXDIGRNVIXMGSDQVXSAKKEIALWSPXKECRWRSXQHNWMKPKLS

SEQ ID NO: 138335 - protein, 94 aa, Triticum aestivum
  Clone ID: PAT_TA_32753.pep
MASHIVGYPRMGPKRELKFALESFWDGKSSAEDLEKVATDLRASIWKQMADAGIKYIPSNTFSYYDQVLDTTAMLGAVPDRYSWTGWGNQFEHL

SEQ ID NO: 138336 - protein, 119 aa, Triticum aestivum
  unsure (1)..(119): unsure at all Xaa locations
  Clone ID: PAT_TA_32754.pep
MSTEKKQLNPMRDIKVQKLVLNISVGESGDRLTRASKVLEQLSGQSPVFSKARYTVRSXSGIRRNEKIACYVTIKGEKAMQLLGEVAXGERSTKLLRRNFSDTXGCFGFRYPRSNISRQ

SEQ ID NO: 138337 - protein, 173 aa, Triticum aestivum
  unsure (1)..(173): unsure at all Xaa locations
  Clone ID: PAT_TA_32755.pep
PLRKAEHAFYLDWAVHSFRITNCEIQDTTQIHTHMCYSNFNDIIHSXIIDMDADVITIGESAADEKLLSVFREGVXKYGAGIRPGVYDIHSPRIPSAEEIRPTASDKMLXAVLGTTSSWGEXPDCGSKTRKYTEVKPALDQHGSAAKSSAPVANASEFFLPFRSEEASMQLVQ

SEQ ID NO: 138338 - protein, 113 aa, Triticum aestivum
  Clone ID: PAT_TA_32756.pep
MDPVATWGLTPLAGADPEIYDLLEREKRRQRRGIELIASENFTSFAVMEALGSALTNKYSEGMPGARYYGGNDVIDEIENSAGHAALAAFHLDAASWGVNVQPYSGPRQLRRL

SEQ ID NO: 138339 - protein, 151 aa, Triticum aestivum
  unsure (1)..(151): unsure at all Xaa locations
  Clone ID: PAT_TA_32757.pep
MAEQTFIMIKPDGVQRGLIGEVISRFEKKGFYLKGLKLQNVEKSFAEQHYADLSSKPFFAGLVEYIVSGPVVAMVWEGKSVVSTXGRKIIGATNPLAXEPGTIRGDFAVDIGRNVIHGSDSVESARKEIALWFPEGIAEWRSNQHNWIYEG

SEQ ID NO: 138340 - protein, 123 aa, Triticum aestivum
  unsure (1)..(123): unsure at all Xaa locations
  Clone ID: PAT_TA_32758.pep
MAEQTFIMIKPDGVQRGLIGEVISRFEKKGFYLKGLKLQNVEKXSFAEQHYADLSSKPFFAGVVGVHPSPAGPSAMAWEGQERPSPLGRKIIGXATNPWALEPGTSVGDFASDIGRTHPWRSI

SEQ ID NO: 138341 - protein, 141 aa, Triticum aestivum
  unsure (1)..(141): unsure at all Xaa locations
  Clone ID: PAT_TA_32759.pep
FETCYQIALAIKKEVEDLEAGGIQVIQIDEAALREGLPLRKSEHAFYLDWAVHSFRITNCGVQDTTQIHTHMCYSNFNDIIQXSSSTWDADVITNGEPRSDQEALSVFRXGVXYGASIGPGVYDIHSPKIPSRRKCRPCHK

SEQ ID NO: 138342 - protein, 101 aa, Triticum aestivum
  Clone ID: PAT_TA_32760.pep
SPGSPDAVLARAASACWLPHRPSQPAVTLVYTCAGLCCVLACWVCASASFCACRRVVVNCARVRPSRGRSVSSMHPQFTSVRGATPSGFNFVYFTACQMGL

SEQ ID NO: 138343 - protein, 127 aa, Triticum aestivum
  unsure (1)..(127): unsure at all Xaa locations
  Clone ID: PAT_TA_32761.pep
GSSVCIRTASQINPGQPIFTLHAHEXAVSSISFAPSTPNFLATGSTDKMVKLWDLSNNQPSCVSSLNPKLGAIFSVSFSNDNPFLLACGGSKGKLKVWNTLSEPAVANKFGKGRQNAPALRNDPPTE

SEQ ID NO: 138344 - protein, 140 aa, Triticum aestivum
  Clone ID: PAT_TA_32762.pep
TGTHDANNMQSYKLGDSMFDDYHIFCPPSFDENICYDESMPPIYDDFVDESGFARVSTLGSNDPTILKGVESCCDNYGSGFGEVMTLFSDESTISEEVPIDYENKVPIYDDYCDDMYAIKNNYNHETCHHDFNFQLDHAS

SEQ ID NO: 138345 - protein, 93 aa, Triticum aestivum
  Clone ID: PAT_TA_32763.pep
PPEEKSWARRVPGCPRGWGARPLPRGQPGDPPDLFSVPKPLTYTETSRKKPRSGVPPPQTSVATKNQSGPCSGTLPGEGNPHRWPSSSSRRSP

SEQ ID NO: 138346 - protein, 110 aa, Triticum aestivum
  unsure (1)..(110): unsure at all Xaa locations
  Clone ID: PAT_TA_32764.pep
KNVGTTLSNGGSSSFXLSLLSLTGLPSNSNTLYQRIIRSLCQRIAPYIVQLTGQPIHMLPCQLMFCIFVCWPMWQWVKISKLEAHLTRGEGNKVETTRGSTPHASKLRAH

SEQ ID NO: 138347 - protein, 145 aa, Triticum aestivum
  Clone ID: PAT_TA_32765.pep
MACLMAIVMLVRSIKDLATMRLSSKGGSEESYCTLYPDSVQKEEFRPPSPFPGFAEADLFAVVLQRLGELEEKVQMLQEKPSEMPCEKEELLNAAVRRVDALEAELIVTKKALHEALIRQEELLANIDSKEIARAQRKKKTMFCY

SEQ ID NO: 138348 - protein, 106 aa, Triticum aestivum
  Clone ID: PAT_TA_32766.pep
MARTGATTTTGAAAVLLLLALVATGAAAVDAAAGGYEMTAAAAGGRRGGRAQPAGLTQCMGGCGTKVASCLLDCYNTSTGGTVPICYLGCTNNAVFCATDCTTQGL

SEQ ID NO: 138349 - protein, 67 aa, Triticum aestivum
  unsure (1)..(67): unsure at all Xaa locations
  Clone ID: PAT_TA_32767.pep
PWRPQQTLPRPSRRRPRPPTPPPPPTAPPPPPRPRTXRPLRPPQIAPAPHGVLSRSRSEYVKDEART

SEQ ID NO: 138350 - protein, 116 aa, Triticum aestivum
  Clone ID: PAT_TA_32768.pep
MGRVRTKTVKKTSRQVIEKYYSRMTLDFHTNKKVLEEVSILPSKRLRNKVAGFTTHLMRRIQRGPVRGISLKLQEEERERRMDFVPEKSALEVEEIRVDKETMEMLAALGMADLPG

SEQ ID NO: 138351 - protein, 192 aa, Triticum aestivum
  unsure (1)..(192): unsure at all Xaa locations
  Clone ID: PAT_TA_32769.pep
RPIFSKWFPLQVIQIDEAALREGLPLRKSEHAFYLDWAVHSFRITNCGVQDTTQIHTHMCYSNFNDIIQSIINMDADVITIENSRSDEKLLSVFREGVVYGAGIGPGVYDIHSPRIPSKEEIADRVNKMLRGPGTPTPVGEPDCGSRPASTPEVKLXFTNMVEAAKQFVADPRRSKPCSYSKAPFNCEDVTT

SEQ ID NO: 138352 - protein, 180 aa, Triticum aestivum
  Clone ID: PAT_TA_32770.pep
MSTEKKQLNPMREIKVQKLVLNISVGESGDRLTRAAKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 138353 - protein, 304 aa, Triticum aestivum
  Clone ID: PAT_TA_32771.pep
MASTPSLTLLLALVLPLIPLAVAAPEKHLVTHLPGFDGALPSKHYAGYITVDESNGRRLFYYLVLSERDPAADPVVLWLNGGPGCSSFDGFVYENGPFNFERGSTPGGLPKLHLNPYSWSKVSSMIYLDSPAGVGMSYSLNKSDYTTGDLKTAADGHTFLLKWFELYPEFQSNPFYISGESYAGIYIPTLADEVVKGAQKALKPRINLKGYLIGNGVTDLDYDLNSFVPFAHGMGLISTDLFEDVSAACHGTFWGKVNDVCQEKIDRVRWELKDLNKYNILAPCYHHPEVQETAFVNSSLPSSF

SEQ ID NO: 138354 - protein, 165 aa, Triticum aestivum
  Clone ID: PAT_TA_32772.pep
MFVQVTHALLEEIQEINQQLIDTELHVCEDDAESFAGTCEGAEGTVIKCTFTAVAVSPSLKSIFASAQMSPIMPLRLLVPASYPKCSPVLLDKSPDEQRNSEDLSMKAKSKFSILLRGLAEPMSLREIARTWDACARKTIAEYAQKTGGGSFSSSYGCWESCVGA

SEQ ID NO: 138355 - protein, 110 aa, Triticum aestivum
  Clone ID: PAT_TA_32773.pep
LDANIINDRESGRSRGFGFVTFGSEESMRQAIEEMNGKELDGRNITVNEAQSRRSGGGGGGGGYGGQRGGGGGYGGGGGGYGGQGGGGYGQGGGGGYGQRGGDSGGQWRN

SEQ ID NO: 138356 - protein, 149 aa, Triticum aestivum
  unsure (1)..(149): unsure at all Xaa locations
  Clone ID: PAT_TA_32774.pep
MASHIVGYPRMGPKRELKFALESFWDGKSTAEDLEKVATDLRASIWKQMXADAGIKYIPSNTFSYYDQVLDTTAMLGAVPERYSWTGGEIGFDTYFSMARGNATVPAMEMTKWVDTNYHXIVPELGPNTSLLMLXSQAVNEYKELRARC

SEQ ID NO: 138357 - protein, 86 aa, Triticum aestivum
  Clone ID: PAT_TA_32775.pep
QHNACIALPQPRFHGLGCSHFARRYYGNRFCFLFLWLLRCFSSPGCLLPAHGFSRQFKRLTYLGISGSMLIFNSPKHFVACYALPR

SEQ ID NO: 138358 - protein, 192 aa, Triticum aestivum
  unsure (1)..(192): unsure at all Xaa locations
  Clone ID: PAT_TA_32776.pep
LHKGRDHADDSLHGYKVFVNPSISDVLCTATAEALAMGKFVVCADHPFXDSFKSFPNCLTYTTSEDFVAKVKEAMTRDPQPLTPEQRYNLSWEAATQRFMEHSELDKVLSSNGDSASTSGSSVDRRMKKSASLPNMSDIVDGGLAFAHYCFTGSELLRLSTGAVPGTLNYNKQHSVDMHLLPPQVQNPVYGW

SEQ ID NO: 138359 - protein, 173 aa, Triticum aestivum
  unsure (1)..(173): unsure at all Xaa locations
  Clone ID: PAT_TA_32777.pep
LDLIQSKSVDFKTMEESPLDRFXALFNREIEGPLDFKILRNSDFREVTLEVEGSPVLKFALCYGFRNLQNIVRKVKMGKCEYQFIEVMACPSGCLNGGGQIKPAKGQSPKDLIQQLEGVYMQDVSISNPFDNPIAKRLYDDWLVQPGSDSAKRYLHTQYHPVVKSVTSQLQNW

SEQ ID NO: 138360 - protein, 114 aa, Triticum aestivum
  unsure (1)..(114): unsure at all Xaa locations
  Clone ID: PAT_TA_32778.pep
SSDVSGNLXLAILGCGIQPLRLAAQRLYCSSHKPVFNGLAAPHFGSPLLTGSLLLSFPLGYLRCFSSPGCLLPAHGFSRQFKRLTYLGISGSMLIFNSPKHFVACYALPRLWVP

SEQ ID NO: 138361 - protein, 97 aa, Triticum aestivum
  Clone ID: PAT_TA_32779.pep
MAETEYRCFVGGLAWATDDHNLQQAFSQYGEILDAKIINDRETGRSRGFGFVTFGSEESMRQAIEEMNGKELDGRNITSAAAPYRQPFNGPRGGNRA

SEQ ID NO: 138362 - protein, 114 aa, Triticum aestivum
  Clone ID: PAT_TA_32780.pep
STSLAPPASPRRVQSGPRRRRSRRHRPPHASRPCSEDASPYATSSTPRNASWGALRRPVEELSLESPSYRSIYRVVVVVFVSKLSSVSSCSCVSLSRRVCGVFDRELECRSVRG

SEQ ID NO: 138363 - protein, 143 aa, Triticum aestivum
  Clone ID: PAT_TA_32781.pep
MGRVRTKTVKKTSRQVIEKYYSRMTLDFHTNKKVLEEVSILQSKRLRNKVAGFTTHLMRRIQRGPVRGISLKLQEEERERRMDFVPEKSALEVDEIRVDKETMDMLAFLGMADLPGVERAPETTSAGDPYRQPFNGPRGGNRA

SEQ ID NO: 138364 - protein, 212 aa, Triticum aestivum
  unsure (1)..(212): unsure at all Xaa locations
  Clone ID: PAT_TA_32782.pep
KPTKKGQPEGALYDYEDKINFAVFPSLQGGPHNHQIAALAVGLKQAMSPGFKAYIQQVKANAVALGNQLMRKGYKLGYGXGQENHLVLWDLRPLGLSGNKVEKVCDLSSITLNKNAVFGDSSALAPGGVRIGTPAMTSRGLVEKDFVKIAEYLHQAVVICLNVQKQRGKRYNDFTVDLEKNEDIAELRAEVEKFAISFEMPGFRVSDMKYKD

SEQ ID NO: 138365 - protein, 137 aa, Triticum aestivum
  unsure (1)..(137): unsure at all Xaa locations
  Clone ID: PAT_TA_32783.pep
MARTKQTARKSTGGXKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 138366 - protein, 126 aa, Triticum aestivum
  Clone ID: PAT_TA_32784.pep
KKKVQRSAEDKTILVATYEGEHNHSQPPSSQPQQQNDGSGAGKNAGKPPQAPATPHHPQQHQQQHKQEAPAVAVSGESAAAESEMIRRNLAEQMAMTLTRDPSFKAALVTALSGRILELSPTRDIN

SEQ ID NO: 138367 - protein, 198 aa, Triticum aestivum
  Clone ID: PAT_TA_32785.pep
TVHGQIPANSGQSLPCRPLSPPPPSLTSVQPVYPPIRSPQQTLGTVDTHKCQLSRRGLHRGRRKCDFCGGAATRGGDARRTAADVAVQEAEVLADDGEQAAGPRTTDAGGLLSPSTASTLARSASGCSIWSAWRRPHPWSPCRGEVATASSLVAAPGGGGGGTVTRAPLPRPSPRARCLVYPQASSCSCVSLGRASCR

SEQ ID NO: 138368 - protein, 108 aa, Triticum aestivum
  Clone ID: PAT_TA_32786.pep
IVFPSWLSQEKHRNHASHRPSSSSSRSLPQPRFHGLGCSHFARRYYGNRFCFLFLWLLRCFSSPGCLLPAHGFSRQFKRLTYLGISGSMLIFNSPKHFVALLRPSSSL

SEQ ID NO: 138369 - protein, 183 aa, Triticum aestivum
  Clone ID: PAT_TA_32787.pep
MGRSGHACSVLGSLLLLLLLLPGPAAAQKGSTWKTLSGDAPAVIAKGGFSGLFPDSSDPAYSFAASNQDSAQWCDVRLTKDGVGICLPDIKMDNCTTISDLFPKGKKTYLVNGVSTTGWFSVDYNSIDLTNVTLLRAILSRTNRFDGSFTLVQVEVALSQYKAPAWLNVQHDSFYSQFNLSMR

SEQ ID NO: 138370 - protein, 138 aa, Triticum aestivum
  Clone ID: PAT_TA_32788.pep
MPLRLLVPASYPKCSPVLLDKFPDEQRNSEDLSMKAKSKRLRNKVAGFTTHLMRRIQRGPVRGISLKLQEEERERRMDFVPEKSALEVDEIRVDKETMDMLAFLGMADLPGVERAPETTSAAAPYRQPFNGPRGGNRA

SEQ ID NO: 138371 - protein, 180 aa, Triticum aestivum
  unsure (1)..(180): unsure at all Xaa locations
  Clone ID: PAT_TA_32789.pep
MDPWVSSQPSLSLDLHVGLPPMGHHQAAPMVALAKPKVLVEENFMQLKKDPEVAVLESELQRVSEENRRLGEMLREVASKYEALQGQFTDMVTAGAHAGGNNSHYNNQPSSASEGGSVSPSRKRKSEESLGTPPRPSQHQQQHYXGGLAYAAAPDQAECTSGEPCKRIREECKPVVSKRY

SEQ ID NO: 138372 - protein, 215 aa, Triticum aestivum
  Clone ID: PAT_TA_32790.pep
FIKENYQKMELSLSHTLRLFNIFREYDGKENCAQVLEEECIKMLDTKYLNDEHDCNVVSMNSLNIQDANDDCTSYDENISHKHVNFCGVHWVCKYTPNREDRYCKRHKYLETKLLQEELDECAERFNIYSTPCELCNEHGHLKLQCYLFHDQVVSKYCDNLITLEHHKELSLLLCYEEMKHITEGIPNFNLDRFLDFDLEKMYCAVNCRTRGSTR

SEQ ID NO: 138373 - protein, 138 aa, Triticum aestivum
  Clone ID: PAT_TA_32791.pep
KNHHIQSYDANMIMYHGTTTTPTHHIYRGDFRILSLSSPQPNIQTDIQLAFFSHTQITCIYTHDIYINMYEGLALRTESMIVATNQFQYLRTNSSADEVPPSPHRRLSSSEAEFLLAELEHVLLVDECEQLVLTHQRL

SEQ ID NO: 138374 - protein, 222 aa, Triticum aestivum
  Clone ID: PAT_TA_32792.pep
RAGMIFYRKGPKPAKKGQPEGAVYDYEDKINFAVFPSLQGGPHNHQIAALAVALKQTLTPGFKAYAKQVKANAVAVGKYLMSKGYKMVTDGTDNHLVLWDLRPLGLTGNKVEKMCDLCSITLNKNAVFGDSSALSPGGVRIGAPAMTSRGLVEKDFEQIAEFLHQAVTICLNIQKEHGKLLKDFSKGLVSNKDIENLKVEVEKFALSFDMPGFSLESMKYKE

SEQ ID NO: 138375 - protein, 285 aa, Triticum aestivum
  Clone ID: PAT_TA_32793.pep
KASGSLTLKSLRTTQRESLNAAVSDIRSVVSMIDRIAGSAPGNGSRAAVGEDLVAMTKCRLQARNFITNDGSGASKKMKRDTSAMPLNVSSAGSVNDSFKQTFSVDTPDLQSTATSQAKWQKIEVNHALLEEIQEINQQLIDTELHVCEDDAESFAGTCEGAEGTVIKCTFTAVAVSPSLKSIFASAQMSPIMPLRLLVPASYPKCSPVLLDKFPDEQRNSEDLSMKAKSKFSILLRGLAEPMSLREIARTWDACARKTIAEYAQKTGGGSFSSSYGCWENCVGA

SEQ ID NO: 138376 - protein, 137 aa, Triticum aestivum
  Clone ID: PAT_TA_32794.pep
LLRSVKDVATKRLADKNESDEQSSAVYQDCIPKEEFRPPSPGPGFAESDLFSLVLQRLAELEAKVHALEEKPSEMPCEKEELLNAAVRRVDALEAELIVTKKALHEALIRQEELLAYVDRKTIAKAQKKKKKPMSCY

SEQ ID NO: 138377 - protein, 119 aa, Triticum aestivum
  Clone ID: PAT_TA_32795.pep
MARTKQTARKSTGGKAPRKQLATKAARKSAPATGGVKKPHRFRPGTVALREIRKYQKSTELLIRKLRFQSSAVSALQEAAEAYLVGLFEDTNLCAIHAKRVTIMPKDIQLARRIRGERA

SEQ ID NO: 138378 - protein, 151 aa, Triticum aestivum
  Clone ID: PAT_TA_32796.pep
RTLAVAWLTVFIVTLFAMLRSIPSRMAKRLSNQSNDHDHYYVDCPQEQEYKEEFRPPSPAPAYTEKDILSTLVRRLGELEEKVQALEKKPSEMPFEKEELLNASARRVDALEADLISTKKALYEALMRQDELLAFIDKQDMLKFRKKKFCF

SEQ ID NO: 138379 - protein, 493 aa, Triticum aestivum
  unsure (1)..(493): unsure at all Xaa locations
  Clone ID: PAT_TA_32797.pep
MASTPSLTLLLALLLPLIPLAVAAPEKHLVTHLPGFGGALPSKHYAGYITVDESNGRSLFYYLVLSERDPAIDPVVLWLNGGPGCSSFDGFVYENGPFNFERGSTPGGLPKLQLNPYSWSKVSSMMYLDSPAGVGMSYSLNKSDYKTGDLKTAADAHIFLLKWFELYPEFQLNPFYISGESYAGIYIPTLADEVVKGIQMALKPRINLKGYLIGNGATDADYDLNSFVPFAHGMGLISTDLFEDVSAACHGTFWGKVNDVCQENIDRVRWELKDLNTYNILAPCYHHPEVQETAFVNSSLPSSFRKLGETERPFPVRKRMAGLSWPLGLPVSSGHVTLWPELGGRSLPCTSDELATIWLDDEDVRAAIHAKAKSLIGSWELNTARIDYTHDTGSMVEYHKKFTAMGYRVLIYSGDHDLCIPFTGTEXWVRSLGYRVVDSWRPWHFGGQVAGYTQGYDHNLTFLTIKGSGHTVPEYKPKESLAFYTHWLFGEKI

SEQ ID NO: 138380 - protein, 383 aa, Triticum aestivum
  unsure (1)..(383): unsure at all Xaa locations
  Clone ID: PAT_TA_32798.pep
LKLSKPXMNGHEXVDSNVFCMXTNEDIXXXXSAMLKVLRAVQXERWVSWRALRGAASKAVDSQELXDYSLRGLRGKLMDDGHFIAVRCNTETSAIEYRLETYSNQSPVDATVFGPSVEHLAHDLRFLYDALLNPERMLSSQPEVVGASAHNAAAXILDCKQFIKHYDESAPESPPNPILLAVRCSIELLDHPKDYTAPPVELVLLPATATLGELKMLAARVFQETYLMFHSFQAEQLPEFPNLSDTTPVKHVLGPSQLVRVRGRCTGDHRRIVQFRMERGLENWTVDCTCGAKDDDGERMMACDACGVWQHTRCSGISDFEEVPEKFICRKCASPRKGKGGRGGGGGSGGGRMEMASAGRCKDEIGSCCXGRAGKIGRLATVG

SEQ ID NO: 138381 - protein, 189 aa, Triticum aestivum
  Clone ID: PAT_TA_32799.pep
GVPIAPGGPHNHQIAALAVALKQTLTPGFKAYAKQVKANAVAVGKYLMSKGYKMVTDGTDNHLVLWDLRPLGLTGNKVEKMCDLCSITLNKNAVFGDSSALSPGGVRIGAPAMTSRGLVEKDFEQIAEFLHQAVTICLNIQKEHGKLLKDFSKGLVNNKDIENLKVEVEKFALSFDMPGFSLESMKYKE

SEQ ID NO: 138382 - protein, 249 aa, Triticum aestivum
  Clone ID: PAT_TA_32800.pep
MDRIAGSAPGNGSRTAVGEDLVAMTKCRLQARNFITNDGSGASKKMKRDISAMPLNVSSAGSVDDSFKQTFSVDTPDLQSTATSRAKRRKIEVNHALLEEIEEINQGLIDTTLRVCEDDDESLAVTSEGTVIKCTYTAVAVSPSLKSMLASAQTSPIMPLRLLVPAGYPKCSPVLLDKFLDEQRNSDDLSSKAKSKFGVLLRGLDEPMSLREIARTWDACARGAIAEYAQKSGGGSFSSSYGRWETCVV

SEQ ID NO: 138383 - protein, 93 aa, Triticum aestivum
  unsure (1)..(93): unsure at all Xaa locations
  Clone ID: PAT_TA_32801.pep
HIPSRASPALRVGARVYAPARGGGGXAACGGGYGGQGGGGYGQGGGGGYGQGGGGYGGQRGGGSYGGGGGGYGGGGGGYGGQRGGDSGGQWRN

SEQ ID NO: 138384 - protein, 176 aa, Triticum aestivum
  Clone ID: PAT_TA_32802.pep
YFCYFLNVDSSLATATKASNRSLDQIIPALMAFVIAIVTLLRSVKDVATKRLADKNESDEQSSAVYQDCIPKEEFRPPSPGPGFAESDLFSLVLQRLAELEAKVHALEEKPSEMPCEKEELLNAAVRRVDALEAELIVTKKALHEALIRQEELLAYVDRKTIAKAQKKKKKPMSCY

SEQ ID NO: 138385 - protein, 144 aa, Triticum aestivum
  Clone ID: PAT_TA_32803.pep
PRWTSTLQRTILTATPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 138386 - protein, 194 aa, Triticum aestivum
  Clone ID: PAT_TA_32804.pep
AAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTAKMNLSDEVDLEDYVSRPDKISAADITAICQEAGMHAVRKNRYVILPKDFEKGYRTNVKKPESDFDFYK

SEQ ID NO: 138387 - protein, 356 aa, Triticum aestivum
  unsure (1)..(356): unsure at all Xaa locations
  Clone ID: PAT_TA_32805.pep
MTIKSTDIVIVCAHNKDEFNSLQVSIVEELEDGDPNMFVHHEVPLSDFPLCTAWMDFNRQDGEQKGNFIAVGTMDPTIEIWNLDVVDEVEPHYVLGGVSKKKKKVKGKKGKTYKKGSHRSSVLGLAWNTVVRNALASASADKTVKVWDLSAGKCLVTLQHHDDKVQSVAWRSPEVLLSGSFDRTIAMTDMKDSGQCCHKWPVEADVESLVCDPHNEHSFVVSLENGMVQAFDIRTASSNSNPGQPIFTLHAHEKAVSSISFXPSTPNFLPTGSTGQNGXALGSYRTNQLSCVSSLNPKLGAIFSVSFSIDNPFLLACGGSKGKLKVWNTLSEPAVANKFGKGRQNAPALRNDPPAE

SEQ ID NO: 138388 - protein, 124 aa, Triticum aestivum
  Clone ID: PAT_TA_32806.pep
ESKASTTEDMGRQALAFGERKPVEQLLKAVDGITLADVSSVAEKIISSPLTMASHGNGERVIYNVMCMNALFLIQPPVLCSYQCTSLRDSAWQVQLEMRRLLNKLTVHIFFSQDHLWSHFSQGK

SEQ ID NO: 138389 - protein, 168 aa, Triticum aestivum
  unsure (1)..(168): unsure at all Xaa locations
  Clone ID: PAT_TA_32807.pep
MARTGATTTTAAAAALLLLALVATGAAAVDAAAGGHEMTAAGGRRGVRAQPAGLTQCMGGCGTKVASCLLDCYNTATGGXTMPICYLGCTNHAVFCANRLHQPRGSDSQSIHPASDELYMASKCMTSYGVSTHTHRMYNPFTAHIPPRTLSRMNKIGCKYFVSVDLCD

SEQ ID NO: 138390 - protein, 248 aa, Triticum aestivum
  unsure (1)..(248): unsure at all Xaa locations
  Clone ID: PAT_TA_32808.pep
KMREVVELPMLHPEXFVKLGIDPPKGVLCYGPPGTGKTLLARAVANRTDACFIRVIGSELVQKYVGEGARMVRELFQMARSKKACIIFFDEVDAIGGARFDDGAGGDNEVQRTMLEIVNQLDGFDARGNIKVLMATNRPDTLDPALLRPGRLDRKVEFGLPDLEGRTQIFKIHTRTMNCERDIRFELLARLCPNATGADIRSVCTEAGMYAIRARRKTVTEKDFLDSVNKVIKGYQKFSATPKYMVYN

SEQ ID NO: 138391 - protein, 146 aa, Triticum aestivum
  Clone ID: PAT_TA_32809.pep
GRVGGRVGVQFIILTGTPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 138392 - protein, 442 aa, Triticum aestivum
  Clone ID: PAT_TA_32810.pep
VRGTAVKPGIYQQHLGQRSNYYHPQLKQGGAFPISSPQNLQQSSPQISHHSPQVDQHNLLPSQVKTGTPLNSANSPYVPSPSPSVAPSPIPVDSDKQHSNISSLTNTGQTGHQQTSLAPQTQSIAVNTPGISASPLLAEFTSGDGSQANMPTQVPTKSNAAERPMDRLLNALRTTQRESLNAAVGDIRSVVSMMDRIAGSAPGNGSRTAVGEDLVAMTKCRLQARNFITNDGSGASKKMKRDISAMPLNVSSAGSVDDSFKQTFGVDTPDLQSTATSRAKRRKTEVNHALLEEIEEINQGLIDTELRVCEDDDESLAATSEGTVIKCTYTAVAVSPSLKSMLASAQTSPIMPLRLLVPAGYPKCSPVLLDKFLDEQRNSDDLSSKAKSKFGVLLRGLDEPMSLREIARTWDACARGAIAEYAQKSGGGSFSSSYGRWETCVV

SEQ ID NO: 138393 - protein, 184 aa, Triticum aestivum
  Clone ID: PAT_TA_32811.pep
PPGQVLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTSKMNLSDEVDLEDYVSRPDKISAADITAICQEAGMHAVRKNRYVILPKDFEKGYRTNVKKPDTDFDFYK

SEQ ID NO: 138394 - protein, 222 aa, Triticum aestivum
  unsure (1)..(222): unsure at all Xaa locations
  Clone ID: PAT_TA_32812.pep
LCXGPPGTXKTLLARAVANRTDACFIRVIGSELVQXYVGEGARMVRELFQMARSKKACIVFFDEVDAIGGARFDDGAGGDNEVQRTMLEIVNQLDGFDARGNIKVLMATNRPDTLDPALLRPGRLDRKVEFGLPDLEGRTXQIFKIHTRAMNCERDIRFELLARLCPNSTGADIRSVCTEAGMYAIRARRKTVTEKDFLDAVNKVIKGYQKFSATPKYMVYN

SEQ ID NO: 138395 - protein, 68 aa, Triticum aestivum
  unsure (1)..(68): unsure at all Xaa locations
  Clone ID: PAT_TA_32813.pep
HHPQQQHKQEAAAAAVSGESAVAAXELIRRNLAEQMAMTLTRDPSFKAALVSALSGRILELSPTRDIN

SEQ ID NO: 138396 - protein, 43 aa, Triticum aestivum
  Clone ID: PAT_TA_32814.pep
TSLEFFFFFFFDHKRAMVTRNLDRQVAYNIREIEHARPLYFSN

SEQ ID NO: 138397 - protein, 72 aa, Triticum aestivum
  Clone ID: PAT_TA_32815.pep
SNCLCLKGCSYQCWWLQIPGKIYSGSVLVTCPTIMLVGFEDGEINFDCCWSRNIVNARHPGWNTLRVIFDSF

SEQ ID NO: 138398 - protein, 217 aa, Triticum aestivum
  unsure (1)..(217): unsure at all Xaa locations
  Clone ID: PAT_TA_32816.pep
MRPLSMLTHSATTAAPRQCDENVAEHRHPAQPKIRSPSSSSRTARSRSSRSSTAIGTAKDRRTTCSSQTHPLQAASGSNTAVAAKGLPQIQKCHQEATNHHGWAPPPGGRRRTPGRVPPPPXDPRCRRTPGRAPPPPWPSRAATTMAEPRRHHSPTPAPPERKHPPAPPVQDPAVXPRRCAPRRGPPHRRNPPTPPADAAPSREGGPSGRARHARRL

SEQ ID NO: 138399 - protein, 206 aa, Triticum aestivum
  unsure (1)..(206): unsure at all Xaa locations
  Clone ID: PAT_TA_32817.pep
GQPEGAVYDYEDKINFAVFPSLQGGPHNHQIAALAVALKQTLTPGFKAYAKQVKANAVAVGKYLMSKGYKMVTDGTXNHLVLWDLRPLGLTGNKVEKMCDLCSITLNKNAVFGDSSALSPGGVRIGAPAMTSRGLVEKDFEQIAEFLHQAVTICLNIQKEHGKLLKDFSKGLVNNKDIENLKVEVEKFALSFDMPGFSLESMKYKE

SEQ ID NO: 138400 - protein, 354 aa, Triticum aestivum
  Clone ID: PAT_TA_32818.pep
SADFFRPDNQEGIEARNEVAALAMEDMIDWMHGGGQVGIFDATNSTRKRRYMLMKMAEGNCKIIFLETICNDRNIIERNVRLKIQQSPDYADQPDYEAGLQDFLERLTNYEKVYEPVQEGSYIKMIDMVKGEGGQLQVNNISGYLPGRIVFFLVNSHLAPRPILLTRHGESLHNVRGRVGGDTVLSEDGELYSKKLANFIEKRLKNEKTATIWTSTLQRTILTATPIVGFPKIQWRALDEINSGVCDGMTYEEIKKIMPEEYESRKKDKLRYRYPRGESYLDVIQRLEPVIIELERQRAPVVVISHQAVLRALYSYFADRPLREVPDMEMPLHTIIEIQMGVTGVEEKRYKLMD

SEQ ID NO: 138401 - protein, 193 aa, Triticum aestivum
  Clone ID: PAT_TA_32819.pep
MDPWVSSQPSLSLDLHVGLPPMGHPHSHHQAAPMVALAKPKILVEENFMQLKKDPEVAVLESELQRVSEENRRLGEMLREVASKYETLQGQFTDMVTAGAHAGGNNHYNNQPSSASEGGSVSPSRKRKSEESNGTPPPSHQQQQQHYAGGLAYAAAPDQAECTSGEPCKRIREECKPVISKRYVHADPPTKLW

SEQ ID NO: 138402 - protein, 212 aa, Triticum aestivum
  Clone ID: PAT_TA_32820.pep
DPRVRKTMLAKAVAHHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTSKMNLSDEVDLEDYVSRPDKISAADITAICQEAGMHAVRKNRYVILPKDFEKGYRTNVKKPDTDFDFYK

SEQ ID NO: 138403 - protein, 118 aa, Triticum aestivum
  unsure (1)..(118): unsure at all Xaa locations
  Clone ID: PAT_TA_32821.pep
MGRVRTKTVKKTSRQVIEKYYSRMTLDFHTNKKVLEEVSILQSKRLRNKVAGFTTHLMRRIQRGPVRGISLKLQEEERERRMDFXVPEKSALEVDEIRVDKETMDMLXSSGMADLPGR

SEQ ID NO: 138404 - protein, 350 aa, Triticum aestivum
  Clone ID: PAT_TA_32822.pep
SSWTGIPVEKVSTDESDKLLKMEETLHKRVIGQDEAVKAISRSVRRARVGLKSPNRPIASFIFAGPTGVGKSELAKTLASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFTRLKTKDINLQVTEKFKERVVDEGYNPSYGARPLRRAIMRLLEDSLAEKILGGEVKEGDSVIVDVDPEGKVIVLNGESGLPELPTPGGRCLVVGTV

SEQ ID NO: 138405 - protein, 117 aa, Triticum aestivum
  Clone ID: PAT_TA_32823.pep
MSTEKKQLNTMREIKVQKLVLNISVGESGDRLTRAARVLEQLSGQSPVFSKARYTVRSFGIRRNEKIACYVTIRGEKAMQLLESGLKVKEYELLRRNFSDTGCFGFGIQEHIDLGMK

SEQ ID NO: 138406 - protein, 224 aa, Triticum aestivum
  unsure (1)..(224): unsure at all Xaa locations
  Clone ID: PAT_TA_32824.pep
EAVRRRPYSVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIADIMLQEVFARLKTKDINLQVTEKFKERVVDEGYNPSYGARPLRRAIMRLLEDSLAEKILGGEVKXEGDSVIXVDVDXEGKVIVLNGQNGPAGTSSPRRSAV

SEQ ID NO: 138407 - protein, 225 aa, Triticum aestivum
  unsure (1)..(225): unsure at all Xaa locations
  Clone ID: PAT_TA_32825.pep
TATGTGKPKSVYVGGEYRRAADSSNTDLALAFELPGGWLKEKEFATASVLQALLGGGGVFTWGXRPGKGLHSRLNPLVNEFDQIKSISAFKNVHSNTGIFGIHTSTEAAFVPKVIDLAARELTSLATPGQVDQTQLERAKAFAKSAILKNLESKASTTEDMGRQALAFGERKPVEQLLKAVDAITLADVSTVAEKIISSPLTMASHGNVLNVPAYETVRGKFSSK

SEQ ID NO: 138408 - protein, 191 aa, Triticum aestivum
  unsure (1)..(191): unsure at all Xaa locations
  Clone ID: PAT_TA_32826.pep
MSTEKKQLNPMRDIKVQKLVLNISVGESGDRLTRASKVLEQLSGQSPVFSKARYTVRSFGIRRNEKIACYVTIRGEKAMQLLESGLKVKEYELXLKRNFSDTGLLWASVSKKHIRSRHESYDSSNRHPTVWDFFVVLERAGYRVSRPPQVQGRVGINKRSQGGRMKWXQVKYXGVILNNPSTKKYSVDLSY

SEQ ID NO: 138409 - protein, 259 aa, Triticum aestivum
  unsure (1)..(259): unsure at all Xaa locations
  Clone ID: PAT_TA_32827.pep
FTFTANGWVQSYGSRCVKPPIIYGDVSRPXPMTVFWSKMAQSMTARPMKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIQSIINMDADVITIENSRSDEKLLSVFREGVVYGAGIGPGVYDIHSPRIPSKEEIADRVNKMLAVLDTNILWVNPDCGLKTRKYAEVKPALTNMVEAAKQIRAELAKAQ

SEQ ID NO: 138410 - protein, 426 aa, Triticum aestivum
  Clone ID: PAT_TA_32828.pep
MAPEPEDDIMAEKNPRPLDEDDIALLKTYGLGPYSTSIKTAEKEIKELAKRINDLCGIKESDTGLAPPSQWDLVSDKQMMQEEQPLQVARCTKIINPNTDDAKYMINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIIFFDEVDAIGGARFDDGAGGDNEVQRTMLEIVNQLDGFDARGNIKVLMATNRPDTLDPALLRPGRLDRKVEFGLPDLEGRTQIFKIHTRTMNCERDIRFELLARLCPNATGADIRSVCTEAGMYAIRARRKTVTEKDFLDSVNKVIKGYQKFSATPKYMVYN

SEQ ID NO: 138411 - protein, 104 aa, Triticum aestivum
  Clone ID: PAT_TA_32829.pep
PSRVRHSTASPSSTTLVLLFPQPRFHGLGCSHFARRYYGNRFCFLFLWLLRCFSSPGCLLPAHGFSRQFKRLTYLGISGSMLIFNSPKHFVACYALPRLWVPRY

SEQ ID NO: 138412 - protein, 92 aa, Triticum aestivum
  Clone ID: PAT_TA_32830.pep
ALFQSIAIPFSLTFIISYLAVFIFSDYKNLYLPSILHLYHHLLAELVNLYNLPLYWVCWGHKRLFAIWLQGCLRETIFILRLPQIDNLRTST

SEQ ID NO: 138413 - protein, 154 aa, Triticum aestivum
  Clone ID: PAT_TA_32831.pep
PSCRIRHEASNDFFRSFPNCLVYTTSEDFVAKVKEAMTRDPQPLTPEQRYNLSWEAATQRFMEHSELDKVLSSNGDCASTSGNSVDRRMKKSASLPNMSDIVDGGLAFAHYCFTGSELLRLSTGAVPGTLNYNKQHSVDMHLLPPQVQNPVYGW

SEQ ID NO: 138414 - protein, 162 aa, Triticum aestivum
  unsure (1)..(162): unsure at all Xaa locations
  Clone ID: PAT_TA_32832.pep
GLPTYPTPLKSFHKVGLESSSTGSSFPADSAKPVPLAVVSLDSRQXDSGNLVNPFMRVTNXMTRHLATLRESXVTPAVYPRLVEFLHFDIQSTGQKSHCVSIREDHRNALFXLNSRIPDITAICQEAGMHAVRKNRYVILPKDFEKGYRTNVKKPETGRRGR

SEQ ID NO: 138415 - protein, 133 aa, Triticum aestivum
  Clone ID: PAT_TA_32833.pep
ILQSSLFVSCFITSLVYKRKLQKMELSLSHTLHLFNIFRENDGKENCAQVVEEELHRMLGIKYVNDEHDCNVVSINSLNIHDANDMQSHKLGEAMFDEYDIFCPPSFDEQIYYDESMPPIYDDYIEKVDLERS

SEQ ID NO: 138416 - protein, 136 aa, Triticum aestivum; identical to SEQ ID NO: 106789
  Clone ID: PAT_TA_32834.pep

SEQ ID NO: 138417 - protein, 426 aa, Triticum aestivum; identical to SEQ ID NO: 138410
  Clone ID: PAT_TA_32835.pep

SEQ ID NO: 138418 - protein, 348 aa, Triticum aestivum
  Clone ID: PAT_TA_32836.pep
MDPWVSSQPSLSLDLHVGLPPMGHPHHHQAAPMVALAKPKVLVEENFMQLKKDPEVAVLESELQRVSEENRRLGEMLREVASKYEALQGQFTDMVTAGAHAGGNNNNYNNQPSSASEGGSVSPSRKRKSEESLGTPPPSHQQHYAAGLAYAAAPDQAECTSGEPCKRIREECKPVVSKRYVHADPADLSLVVKDGYQWRKYGQKVTKDNPCPRAYFRCSFAPGCPVKKKVQRSAEDKTILVATYEGEHNHSQPPPSQPQQQNDGSGAGKNSGKPPQAPTTPHHPQQHKQEAAAAAVSGESAAAASELIRRNLAEQMAMTLTRDPSFKAALVSALSGRILELSPTRDIN

SEQ ID NO: 138419 - protein, 536 aa, Triticum aestivum
  unsure (1)..(536): unsure at all Xaa locations
  Clone ID: PAT_TA_32837.pep
MAMAAPHVSHSQPPVGRAALFAHPTTAQSSSPLRLPLHRAAVRPVRLYAVSTDAAPAPATAAAAMDAVADWGLTPLAEADPEVYDLIEREKLRQRTGIELIASENFTSLAVMEALGSPLTNKYSEGMPGARYYGGNEVIDEXEELCRARALKAFHLDPASWGVNVQPYSGSPANFAAYTGLLQPHERIMGLDLPSGGHLTHGYYTAGGKKISATSIYFSSLPYKVSSDTGYVDYDRLEEKAMDFRPKLIICGGSAYPRDWDYARLRAIADKCGAMLLCDMAHISGLVAAQEATNPFEYSDVVTTTTHKSLRGPRSGMIFYRKGPKPPKKXGQPEGALYDYEDKINFAVFPSLQGGPHNHQIAALAVGLKQAMSPGFKAYIQQVKANAVALGNHLMSKGYKMVTDGTENHLVLWDLRPLGLSGNKVEKVCDLSSITLNKNAVFGDSSALAPGGVRIGTPAMTSRGLVEKDFVKIAEYLHQAVVICLNVQKQRGKRYNDFIVDLEKNEDIAELRAEVEKFAIAFEMPGFRVSDMKYKD

SEQ ID NO: 138420 - protein, 612 aa, Triticum aestivum
  unsure (1)..(612): unsure at all Xaa locations
  Clone ID: PAT_TA_32838.pep
MSGHLDRLARPVSGFEGCSSHDDRRSYERRSDFEISEDEKKTRMGSLKKKAIDASSKLRHSLKKKNRRKSGSRVLSVSIEDVRDLWELEEVEAFRQALILDELLPSRHDDYHMLLRFLKARKFDIEKAKQMWTDMLQWRKEYGTDTIVEDFDYTELDTVLEYYPHGYHGVDKEGRPVYIERLGKVDPNKLINVTTMDRYVRYHVKEFERSFLIKFPACSLAAKRHINSSTTILDVQGVGLKNFSKTARELIMRLQKVDNDNYPETLHQMFIVNAGPGFRMLWSTVKSFLDPKTTSKIHVLLCFCQSKLLEIIDASELPEFLGGTCTCPEYGGCLRLXKGPWKDPNILKIVQSGGVHCARQIVTISNGTEKFITYAKPKRHAMRGSDTSTAESGSEADDAVSPKALRSYISHPKLTPVREEVKMVRATSFSTRVPEYDVPVVDKAVDATWKRELPRKAPVPPKDSSLATTTKASNRSLDQIIPALMAFVIAIVTLLRSVKDVATKRLPDKNESDEQSPGFAESDLFSLVLQRLAELEAKVHALEAKPSEMPCEKEELLNAAVRRVDALEAELIVTKKAXLHEALIRQEELLAYVDRKTIAKAQKKKKKPMSCY

SEQ ID NO: 138421 - protein, 494 aa, Triticum aestivum
  Clone ID: PAT_TA_32839.pep
MAGGRRSGFAAAALLLLVFTAGCGAAPQGAEVTGLPGFDGALPSKHYAGYVTVDEKHGRNLFYYAVESERDPAKDPVVLWLNGGPGCSSFDGFVYEHGPFNFESGGSVKSLPKLHLNPYSWSKVSTMIYLDSPAGVGLSYSNNVSDYETGDLKTAADSHTFLLKWFQLHPEFLSNPFYIAGESYAGVYVPTLSHEVVKGIQGGAKPTINFKGYMVGNGVCDTVFDGNALVPFAHGMGLISEEIYQQAFTTCDGNYWNASEGKCESALVKIDSLISELNIYDILEPCYHGRSIKEANPQNSKLPKSFKDLGTTNKPFPVRTRMLGRAWPLRAPVKAGRVPLWQEVASGVPCMSDEVATAWLDNDGVRSAIHAQSVSSIGPWLLCTDKIDFNHDAGSMISYHKNLTSQGYRAIIFSGDHDMCVPYTGSEAWTKSMGYGVVDSWRPWFTNDQVSGYTEGYEHGLTFATIKGAGHTVPEYKPQEALAFYSRWLNGSKL

SEQ ID NO: 138422 - protein, 147 aa, Triticum aestivum
  unsure (1)..(147): unsure at all Xaa locations
  Clone ID: PAT_TA_32840.pep
CSLASVVQLQALYKDNANLLILQLCQVEQQQPRPTLPKVAELLSHYKSVYEEPIGLPPKRACDHCNPLLLGVKPFAIRPYRYPPALKTEIEKQVADLLRRGIIXLSHSPFSSPVVLVRKKDLTWRLCVDYRHLNALTCDVYYTTFFV

SEQ ID NO: 138423 - protein, 136 aa, Triticum aestivum; identical to SEQ ID NO: 106789
  Clone ID: PAT_TA_32841.pep

SEQ ID NO: 138424 - protein, 116 aa, Triticum aestivum
  unsure (1)..(116): unsure at all Xaa locations
  Clone ID: PAT_TA_32842.pep
MASEQTFIMIKPDGVQRGLIGEVISRFEKKGFYLKGLKLQNVEKSFAEQHYXKIIGATNPLASEPGTIRGDFAVDIGRNVIHGSDSVESARKEIALWFPEGIAEWRSSQHNWIYEA

SEQ ID NO: 138425 - protein, 429 aa, Triticum aestivum
  unsure (1)..(429): unsure at all Xaa locations
  Clone ID: PAT_TA_32843.pep
MAPEPEDDIMAEKNPRPLDEDDIALLKTYGLGPYSTSIKTAEKEIKELAKRINDLCGIKESDTGLAPPSQWDLVSDKQMMQEEQPLQVARCTKIINPNTDDAKYMINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIIFFDEVDAIGGARFDDGAGGDNEVQRTMLEIVNQLDGFDARGNIKVLMATNRPDTLDPALLRPGRLDRKVEFGLPDLEGRTQIFKIHTRTMNCERDIRFELLXARLCPNATGXADIRSVCTEAGMYAIRARRKTVTEKDFLDSVNKVIKGYQXKFSATPKYMVYN

SEQ ID NO: 138426 - protein, 143 aa, Triticum aestivum
  Clone ID: PAT_TA_32844.pep
MGRVRTKTVKKTSRQVIEKYYSRMTLDFHTNKKVLEEVSILQSKRLRNKVAGFTTHLMRRIQRGPVRGISLKLQEEERERRMDFVPEKSALEVDEIRVDKETMDMLAFLGMADLPGVERAPEVTSSAAPYRQPFNGPRGGNRA

SEQ ID NO: 138427 - protein, 418 aa, Triticum aestivum
  Clone ID: PAT_TA_32845.pep
MAAVTNPPAALPSAPPPSYPATAAHCASSSSAAAEDDDDLYGRLKSLQRHMEFVEIQEEYVKDEQKNLKRELLRAQEEVKRIQSVPLVIGQFMEMVDGNNGIVGSTTGSNYYVRILSTINRELLKPSASVALHRHSNALVDVLPPEADSSISLLASSEKPNVLYSDIGGCDIQKQEIREAVELPLTHHELYKQIGIDPPRGVLLYGPPGTGKTMLAKAVAHHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTSKMNLSDEVDLEDYVSRPDKISAADITAICQEAGMHAVRKNRYVILPKDFEKGYRTNVKKPDTDFDFYK

SEQ ID NO: 138428 - protein, 106 aa, Triticum aestivum
  Clone ID: PAT_TA_32846.pep
NGKELDGRNITVNEAQSRRSGGGGGGGGYGGQRGGGGGYGGGGGGYGGQGGGGYGQGGGGGYGQGGGGYGGQRGGGGYGGYGGGYGGGGGGYGGQRGGDSGGQWRN

SEQ ID NO: 138429 - protein, 621 aa, Triticum aestivum
  Clone ID: PAT_TA_32847.pep
MSGPLDRLARPSFEGFTHNDGKKESRSDADNSEGEKKTKIASFKKKAINAGNKFRHSLRRRSKKKNDNQISIEDIRHVQDLQAVEAFRQCLLDEDLLPQQHDDYHMMLRFLKARKFDVEKAKLMWSDMLTWRKEFGTDNIEEFDYAELNEVMKYYPQFYHGVDKDGRPVYVELIGKVDANKVLQVTTIDRYVKYHVKEFEKCFQMRFPACSIAAKRHLDSCTTILDVQGVGLKNFSKCARELITRLQKIDSDNYPETLCRMYIINAGQGFKMLWGTIKSFLDPKTASKIHVLGTKYQNKLLEIIDASELPEFLGGKCKCEEHGGCQRSDKGPWKDPTTIKRVLNGEANYDRQIVTISGTDGKIIGYARPQRPNQGKGSDASAESGSEVEDVTSPIAPKTLITNPSLTPVHEESKFAAHASTSAARPTIEESIPVVDKVVDDGWSSPRASPVSSSSGSLSLRNLPTTFEGIRTLVVAWLTVFIVTLFAMLRSIPSRMAKRLSNQSNDHDHYYVDCPQEQEYKEEFRPPSPAPAYTEKEILSTLVRRLGELEEKVQALEKKPSEMPFEKEELLNASARRVDALEADLISTKKALYEALMRQDELLAFIDKQDMLKFRKKKFCF

SEQ ID NO: 138430 - protein, 415 aa, Triticum aestivum
  Clone ID: PAT_TA_32848.pep
MSAAAVAPSPPAPLPSAPPPSYPAAPPAPSAEDDDDLYGRLKSLQRHMEFVEIQEEYVKDEQKNLKRELLRAQEEVKRIQSVPLVIGQFMEMVDGNNGIVGSTTGSNYYVRILSTINRELLKPSASVALHRHSNALVDVLPPEADSSISLLASSEKPNVLYSDIGGYDIQKQEIREAVELPLTHHELYKQIGIDPPRGVLLYGPPGTGKTMLAKAVAHHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPLPDRRQKRLVFQVCTAKMNLSDEVDLEDYVSRPDKISAADITAICQEAGMHAVRKNRYVILPKDFEKGYRTNVKKPETDFDFYK

SEQ ID NO: 138431 - protein, 123 aa, Triticum aestivum
  Clone ID: PAT_TA_32849.pep
SRGFGFVTFGSEESMRQAIEEMNGKELDGRNITVNEAQSRRSGGGGGGGGGGYGGQRGGGGGYGGGGGYGGGGGGYGGQGGGGYGGQRGGGGGYGGGGGYGGGGGYGGQRGGGGGDSGGQWRN

SEQ ID NO: 138432 - protein, 143 aa, Triticum aestivum; identical to SEQ ID NO: 138426
  Clone ID: PAT_TA_32850.pep

SEQ ID NO: 138433 - protein, 124 aa, Triticum aestivum
  Clone ID: PAT_TA_32851.pep
ASDAFGLLDFSHLRVRHSTASPSSTTLVLLFPQPRFHGLGCSHFARRYYGNRFCFLFLWLLRCFSSPGCLLPAHGFSRQFKRLTYLGISGSMLIFNSPKHFVACYALPRLWVPRYPPPRAEFGT

SEQ ID NO: 138434 - protein, 987 aa, Triticum aestivum
  unsure (1)..(987): unsure at all Xaa locations
  Clone ID: PAT_TA_32852.pep
MAGTLVLPVALEITFAGRTGGRHCKSHGTRRTPSMLAMSLNRPVRMAAFVGLRSVHSFSAMRSSNFRSTVASYRFSRQGRRASFVTRAMFERFTEKAIKVIMLAQEEARRLGHNFVGTEQVLLGLVGEGTGIAAKVLKSMGINLKDARVEVEKIIGRGNGFVAVEIPFTPRAKRVLELSLEEARQLGHNYIGSEHLLLGLLREGEGVAARVLESLGADPSNIRTQVVRMIGETTEAVGAGVGGGNSGNKMPTLEEYGTNLTKLAEEGKLDPVVGREPQIERVVQILGRRTKNNPCLIGEPGVGKTAIAEGLAQRISSGDVPETIEGKKVITLDMGLLVAGTKYRGEFEERLKKLMEEIKQSDEIILFIDEVHTLIGAGAAEGAIDAANILKPALARGELQCIGATTLDEYRKHVEKDPALEXRRFQPVKVPEPSVDETIEILRGLRERYEIHHKLRYTDDSLIAAAKLSYQYISDRFLPDKAIDLIDEAGSRVRLRHAQVPEEARELDKELKQITKDKNEAVRGQDFEKAGELRDREMELKAQITALIDKSKEMNKAETESGETGPMVHESDIQHVVSSWTGIPVEKVSTDESDKLLKMEETLHKRVIGQDEAVKAISRSVRRARVGLKSPNRPIASFIFAGPTGVGKSELAKTLASYYFGSEEAMIRLDMSEFMERHTVSKLIGSPPGYVGYTEGGQLTEAVRRRPYSVVLFDEIEKAHPDVFNMMLQILEDGRLTDSKGRTVDFKNTLLIMTSNVGSSVIEKGGRKIGFDLDSDEKDSSYGRIKSLVIEEMKQYFRPEFLNRLDEMIVFRQLTKLEVKEIANIMLQEVFTRLKTKDINLQVTEKFKERVVDEGYNPSYGARPLRRAIMRLLEDSLAEKILGGEVKEGDSVIVDVDPEGKVIVLNGESGLPELPTPAVRCIVVGYLYRIRRRLLSIYTIQRFHFLPAHIIGAAVRSGVYNSITVCIKYTVICIYNLRGKKKKKTRD

SEQ ID NO: 138435 - protein, 510 aa, Triticum aestivum
  unsure (1)..(510): unsure at all Xaa locations
  Clone ID: PAT_TA_32853.pep
MYRAASGLGALKQHGADTQLLNIAVRSASTSVAQRSSGGFLGWLTGARSNALPPPDFALPGVTIPPPLADHVEPGKTKITTLSNVVKIASETSPGSACSVGVYVHCGSVYETPETLGATQLLKKLAFTTTRNRSQLRVVREIGAIGGSAKASANRELMSYSYGALKTYMPEMVEVLVDCVRNPALLDWEVKEEIMKLKAELAEASSNPEAFLLDALHSSGYSGALANPLIASEASISRLNTDVLEEFLALNYTSPRIVLAASGVDHNELVSIAEPLLSDIPTATGNRKAKICLCWWGEYRRAADSSNTDLALAFELPGGWLKEKEFATASVLQALLGGGGVFTWGRPGKGLHSRLNPLVNEFDQIKSISAFKNVHSNTGIFGIHTSTEAAFVPKVIDLAAXRELTSLATPGXQVDQAQLXDRAKASAKSAILKNLESKASTTEDIGRQALXAFGERKPVEQLLKAVDGITLADVSTVAEKIISSPLTMASHGNVLNVPAYETVRGKFSSK

SEQ ID NO: 138436 - protein, 143 aa, Triticum aestivum
  Clone ID: PAT_TA_32854.pep
MGRVRTKTVKKTSRQVIEKYYSRMTLDFHTNKKVLEEVSILQSKRLRNKVAGFTTHLMRRIQRGPVRGISLKLQEEERERRMDFVPEKSALEVDEIRVDKETMDMLAFLGMADLPGVERAPEATSAAAPYRQPFNGPRGGNRA

SEQ ID NO: 138437 - protein, 167 aa, Triticum aestivum
  Clone ID: PAT_TA_32855.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGGYGGQRGGGYGGQRGGGGYGQGGGGYGGQRGGGGGGGGGGGQRGGGGGDSGGQWRN

SEQ ID NO: 138438 - protein, 214 aa, Triticum aestivum
  Clone ID: PAT_TA_32856.pep
VDPPGCRQPHPEPAKPYHLRIPLHRRPPPSDHHGESTEKKQLNPMREIKVQKLVLNISVGESGDRLTRAAKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 138439 - protein, 180 aa, Triticum aestivum
  Clone ID: PAT_TA_32857.pep
MSTEKKQLNPMRDIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 138440 - protein, 180 aa, Triticum aestivum
  Clone ID: PAT_TA_32858.pep
MSTGKKQLNPMRDIKVQKLVLNISVGESGDRLTRASKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 138441 - protein, 180 aa, Triticum aestivum
  Clone ID: PAT_TA_32859.pep
MSTEKKQLNTMREIKVQKLVLNISVGESGDRLTRAAKVLEQLSGQSPVFSKARYTVRSFGIRRNEKIACYVTIRGEKAMQLLESGLKVKEYELLRRNFSDTGCFGFGIQEHIDLGMKYDPSTGIYGMDFFVVLERAGYRVSRRRRCKARVGIHQRVTKEDAMKWFQVKYEGVILNKSHAS

SEQ ID NO: 138442 - protein, 143 aa, Triticum aestivum
  Clone ID: PAT_TA_32860.pep
MGRVRTKTVKKTSRQVIEKYYSRMTLDFHTNKKVLEEVSILQSKRLRNKVAGFTTHLMRRIQRGPVRGISLKLQEEERERRMDFVPEKSALEVDEIRVDKETMDMLAFLGMADLPGVERAPETTSAAAPYRQPFNGPRGGNRA

SEQ ID NO: 138443 - protein, 769 aa, Triticum aestivum
  unsure (1)..(769): unsure at all Xaa locations
  Clone ID: PAT_TA_32861.pep
MASHIVGYPRMGPKRELKFALESFWDGKSSAEDLEKVAADLRASIWKQMSEAGIKYIPSNTFSYYDQVLDTTAMLGAVPDRYSWTGGEIGHSTYFSMARGNATVPAMEMTKWFDTNYHFIVPELSPATKFSYASHKAVSEYKEAKALGVDTVPVLVGPVSYLLLSKAAKGVEKSFSLLSLLDSILPIYKEVVAELKAAGASWIQFDEPTLVKDLAVHELAAFSSAYAELESALSGLNVLIETYFADVPAESYKTLTSLSGVTAYGFDLVRGTKTLELIKSAGIPSGKYLFAGVVDGRNIWADDLAASLSTLQSLEAVVGKDKLVVSTSCSLMHTAVDLVNETKLDSEIKSWLAFAAQKVVEVNALGKALAGLKDEAYFAANAAAQASRRSSPRVNNEEVQKAAAALKGSDHRRATPVSARLDAQQKKLNLPILPTTTIGSFPQTMDLRRVRREYKAKKISEEEYVSAIKEEISKVVKIQEELDIDVLVHGXEPERNDMVEYFGEQLSGFAFTAXMGWVQSYGSRCXVKPPIIYGDVSRPNPMTVFWSKMAQDMTPRPMKGMLTGPVTILNWSFVRNDQPRFETCYQIALAIKKEVEDLEAGGIQVIQIDEAALREGLPLRKSEHAFYLDWAVHSFRITNCXVQDTTQIHTHMCYSNFNDIIHSIINMDADVITIENSRSDEKLLSVFREGVTYGAGIGPGVYDIHSPRIPSTEEIADRVNKMLAVLDTNILWVNPDCGLKTRKYTEVKPALTNMVAAAKLIRTQLASTK

SEQ ID NO: 138444 - protein, 180 aa, Triticum aestivum; identical to SEQ ID NO: 138439
  Clone ID: PAT_TA_32862.pep

SEQ ID NO: 138445 - protein, 174 aa, Triticum aestivum
  Clone ID: PAT_TA_32863.pep
MAETEYRCFVGGLAWATDDHNLQQAFSQYGEILDAKIINDRETGRSRGFGFVTFGSEESMRQAIEEMNGKELDGRNITVNEAQSRRSGGGGGGGGYGGQRGGSGGYGGGGGGYGGQGGGGYGQGGGGGYGQGGGGYGGQRGGGGYGGGGGGYGGGGGGYGGQRGGGDSGGQWRN

SEQ ID NO: 138446 - protein, 151 aa, Triticum aestivum
  Clone ID: PAT_TA_32864.pep
MASEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 138447 - protein, 765 aa, Triticum aestivum
  Clone ID: PAT_TA_32865.pep
MASHIVGYPRMGPKRELKFALESFWDGKSSAEDLEKVATDLRASIWKQMADAGIKYIPSNTFSYYDQVLDTTAMLGAVPDRYSWTGGEINLSTYFSMARGNATVPAMEMTKWFDTNYHFIVPELAPSTKFSYSSHKAINEYKEAKALGVDTVPVLVGPVSYLLLSKAAKGVEKSFSPLSLLSSILPVYKEVIAELKAAGASWIQFDEPTLVKDLESHQLSAFSAAYAELESALSGLNVLVETYFADVPADSYKTLTSLSSVTAYGFDLERGTKTLELVKSGFPAGKYLFAGVVDGRNIWADDLAASLATLQSLEAVVGKDKLVVSTSCSLMHTAVDLVNETKLDDEIKSWLAFAAQKVVEVNALAKALAGQKDEAYFAANAAALASRRSSPRVTNEEVQKAATALKGSDHRRATTVSARLDAQQKKLNLPVLPTTTIGSFPQTVELRRVRREYKAKKISEEEYTNAIKEEISKVVKIQEELDIDVLVHGEPERNDMVEYFGEQLSGFTFTANGWVQSYGSRCVKPPIIYGDVSRPNPMTVFWSKMAQSMTARPMKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIQSIINMDADVITIENSRSDEKLLSVFREGVVYGAGIGPGVYDIHSPRIPSKEEIADRVNKMLAVLDTNILWVNPDCGLKTRKYAEVKPALTNMVEAAKQIRAELAKAQ

SEQ ID NO: 138448 - protein, 150 aa, Triticum aestivum
  Clone ID: PAT_TA_32866.pep
MAEQTFIMIKPDGVQRGLIGEVISRFEKKGFYLKGLKLQNVEKSFAEQHYSDLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 138449 - protein, 765 aa, Triticum aestivum
  Clone ID: PAT_TA_32867.pep
MASHIVGYPRMGPKRELKFALESFWDGKSSAEDLEKVATDLRASIWKQMADAGIKYIPSNTFSYYDQVLDTTAMLGAVPDRYSWTGGEINLSTYFSMARGNATVPAMEMTKWFDTNYHFIVPELAPSTKFSYSSHKAINEYKEAKALGVDTVPVLVGPVSYLLLSKAAKGVEKSFSPLSLLSSILPVYKEVIAQLKAAGASWIQFDEPTLVKDLESHQLSAFSAAYSELESALSGLNVLVETYFADVPADSYKILTSLSSVTAYGFDLERGTKTLELVKSGFPAGKYLFAGVVDGRNIWADDLAASLATLQSLEAVVGKDKLVISTSCSLMHTAVDLVNETKLDDEIKSWLAFAAQKVVEVNALAKALAGQKDEAYFSANAAALASRRSSPRVTNEEVQKAATALKGSDHRRATTVSARLDAQQKKLNLPILPTTTIGSFPQTVELRRVRREYKAKKISEEEYTNAIKEEISKVVKIQEELDIDVLVHGEPERNDMVEYFGEQLSGFTFTANGWVQSYGSRCVKPPIIYGDVSRPNPMTVFWSKMAQSMTARPMKGMLTGPVTILNWSFVRNDQPRFETCYQIALAIKKEVEDLEAGGIQVIQIDEAALREGLPLRKSEHAFYLDWAVHSFRITNCGVQDTTQIHTHMCYSNFNDIIQSIINMDADVITIENSRSDEKLLSVFREGVVYGAGIGPGVYDIHSPRIPSKEEIADRVNKMLAVLDTNILWVNPDCGLKTRKYAEVKPALTNMVEAAKQIRAELAKAQ

SEQ ID NO: 138450 - protein, 765 aa, Triticum aestivum; identical to SEQ ID NO: 138447
  Clone ID: PAT_TA_32868.pep

SEQ ID NO: 138451 - protein, 471 aa, Triticum aestivum
  unsure (1)..(471): unsure at all Xaa locations
  Clone ID: PAT_TA_32869.pep
MDSVASWGLTPLADADPDVFYLIEREKRRQRSGIELIASENFTSFAVIEALGSALTNKYSEGMPGARYYGGNDVIDEIENLCRDRALAAFRLDAASWGVNVQPYSGSPANFAAYTALLNPHNWIMGLDLPSGGHLTHGYYTXGGKKISATSIYFESLPYKVSAANGYIDYDKLEEKAMDFRPKLIICGGSAYPRDWDYARLRAVADKVGAMLLCDMAHISGLVAAQEAANPFEFCDVVTTTTHKSLRGPRAGMIFYRKGPKPAKKGQPEGAVYDYEDKINFAVFPSLQGGPHNHQIAALAVALKQTLTPGFKAYAKQVKANAVAVGKYLMSKGYKMVTDGTDNHLVLWDLRPLGLTGNKVEKMCDLCSITLNKNAVFGDSSALSPGGVRIGAPAMTSRGLVEKDFEQIAEFLHQAVTICLNIQKEHGKLLKDFSKGLVNNKDIENLKVEVEKFALSFDMPGFSLESMKYKE

SEQ ID NO: 138452 - protein, 386 aa, Triticum aestivum
  Clone ID: PAT_TA_32870.pep
KKLGHTFSRFVSSKHPFNLVRGCPFVTVATAEAAGPVDVSVASVHAFLEAAPCDDARTKWRLRMNSGQTFLLYASAPISLSQSSVTQLAAPGFSGVIRIAYLPDPAMEAVLDQYSRCYPTAGEAALNRPFCIDYTWRKQGWGDLLMLANPLHLRLLSDDCSVRVLDDFKYRSIDGDLVGVVGDSWVLKTDPLSPTWHSTRGVNDDGVDEVVAALRKDVDSLASSPITTTSSYFYGKAIARAARLALIAEEVGCPDVIPAVHRFLKATVTPWLDGSFQGNGFLYDPKWGGLVTKQGLQDSGADFGFGIYNDHHYHLGYFLYAIAVLAKIEGSWGRKFMSQAYSMVADFMTLSRKCGASYTRLRTFDLWKLHSWAGGLTEFGDGRNQE

SEQ ID NO: 138453 - protein, 207 aa, Triticum aestivum
  unsure (1)..(207): unsure at all Xaa locations
  Clone ID: PAT_TA_32871.pep
MQSAAAPTRAGSRLCTRCGERKAALKRPKTLEQICRECFYIVFEDEIHQTIVDNNLFKAGERVAIGASGGKDSTVLAYVLSELNKRHKYGLDLFLLSIDEGITGYRDDSLETVKRNELQYGLPLKIVSYKDLYDWTMDDIVKAIGLKNNCTFCGXVFRRQALDRGAALLKVDKIVTGHNADDIAETVLLNXLRGDIAGVSRCTFITT

SEQ ID NO: 138454 - protein, 310 aa, Triticum aestivum
  unsure (1)..(310): unsure at all Xaa locations
  Clone ID: PAT_TA_32872.pep
MQNISKLYNISSQSFDHLNSTVKALNSEAVEIQAKAGEDMRLVSKGINTLELVIILTVTLNLVVVLVLLVGRPLRLQKLYYMCIALCWVLTVLFWMYFGLYYFLDKFAGDTCAALEEYQLNPKNSTLGAIIPCSEKMSGSVILHDVGAGIHDIIDQVNSNIYMIKSEYTVKQLDYICNPFAGPPGYRYRPENCASGAATIGDIPQILRRLTCSELGGGANCAPADLSSAIDYDKVQTYTSSIQNVLDIFPGTERLVSCELVKAGFADIVGNQCAPLRRGARATWAALAXLSMAMALLVLXSAACGGVGRS

SEQ ID NO: 138455 - protein, 266 aa, Triticum aestivum
  Clone ID: PAT_TA_32873.pep
MSPAEQTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYLKMKGDYHRYLAEFKSGEERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPVPKESGDGQ

SEQ ID NO: 138456 - protein, 256 aa, Triticum aestivum
  unsure (1)..(256): unsure at all Xaa locations
  Clone ID: PAT_TA_32874.pep
SSRPTRGPTNAYCLLRPATRCSAPPPSCHAPLHNPANNDVHTTAAERREPSSCPGVRTRAERVDKAELVEQAERYEEMRGRAGRGAKRPGGAAPLGGLPVYDRNLVPVPDKNVLRPRRAAWXRGIASNAHTEDARGNDTQAETVRSYRSNIDLELAKIFHGTLAVVAYHLXCPSAGAATSKTFYLKSEGRVAEGTWRSLSATRKRSKPAXSTMNVDKAAPDHALADLAPNPPFQYWILNSTFLCCNSCNISSLDGR

SEQ ID NO: 138457 - protein, 180 aa, Triticum aestivum
  unsure (1)..(180): unsure at all Xaa locations
  Clone ID: PAT_TA_32875.pep
LPPPLAPASPPTASSYLPPSTAAPPASSSSPRPFPLLASAHASSLGARPETSSHRPTCRHSTASSSRSSTSACSAAPAAAGGSIARPRSPGCTPSSAPCPTXSMSXPPSSSPSAAAAPPPSPPCSSAWTTPHPLPPCCSTTAWAAAPSPARGGRCRSPARRRSPSSGSGAGRASTGPTAP

SEQ ID NO: 138458 - protein, 324 aa, Triticum aestivum
  unsure (1)..(324): unsure at all Xaa locations
  Clone ID: PAT_TA_32876.pep
MGGEKLHEQPSGHLIESLKMERVRTILTHGYPYPHEHSRHFMVRKTIETNYSNFSRWYFAWIFLAALYHLPXFSSPVFLIVFHIIFLGLWYLDPVSRMAXERLEMLTIXQNCAVISIACCVFYSHFGNRTLSRDKSIDHRTASWVAFSLWRKQIEDNTLISKLLRMHKFKXQICSSWFAPVGSASDYPLLSKWAIYGELXNGSEHSNIISPVYSLWATFIGLYMANYVVERSTGWALTHPLTISEYENLKKLLKPDFEDMVPWYSGSAPDLFITAFDPLVPVTLADYLSIYLLKTVFNLMISVTLFVGRLDMRMMQVHACDFKA

SEQ ID NO: 138459 - protein, 326 aa, Triticum aestivum
  unsure (1)..(326): unsure at all Xaa locations
  Clone ID: PAT_TA_32877.pep
MAMATHTGVAASKVLILVGAGLTGSIVLRNGRLSDVLAXSLQELMKGVNQGGSALAQYDMALIQAQDSAFRGQEVRDLTLVXRPITILSGKSDSGRQFKRPYILPAQCSWSIRYIVYMWWKGWSLSDVMFVTKRNMASAVDSMSKQLEQVSSALAATKRHLTKRLENLDGKMDEQVEVSKQIRNEVTDVKTDLSQIGFDVEAIQQMVAGLEEKIELLDNKQDAANAGIWYLCRMAGGIKEGINAKFFQEADEKLKLLDLAHTEKKPVKGLELFLESTKEAKALDSKPKTIVQNDAKKPMKAFDVPVKSAAVHRSNRFLIRKEGLAL

SEQ ID NO: 138460 - protein, 67 aa, Triticum aestivum
  Clone ID: PAT_TA_32878.pep
YPALTAAFLIHLLNLYSQVQDSHTPTNPTHTRMHGQAHGCLIRLVLHGLATHAWVTAKSPESLDTHV

SEQ ID NO: 138461 - protein, 241 aa, Triticum aestivum
  unsure (1)..(241): unsure at all Xaa locations
  Clone ID: PAT_TA_32879.pep
PANRGHFPLPLGGQNAVLDNSCPPTGCSWVVPPAPSCHRARAPCRLHPCRPPPARRPQSSGPGAACPRPGRGPLRRRRRRRVVVHLWIWGGRGCSRGGRRSRSHSARASSKSGNWGSGSSTPGARPNRNPGLQERATPIKSEPRRRSSRRRRNAASRPPPRTPQASSSLWPDPEQRRTAGPDRSGSRTAARGGGGRRICGARRSGXEQIESCTKRGAPRERGPEGGRGGEVGLSRSQPDAW

SEQ ID NO: 138462 - protein, 211 aa, Triticum aestivum
  unsure (1)..(211): unsure at all Xaa locations
  Clone ID: PAT_TA_32880.pep
MEGADRLYPSVEPYDLEPPQLDDAAAAAVGTGEARVCDPPVRWDEEPKEGTHVCEQGAKDNPDRDDMEDHLSVVNIYESDDEMATFKGSGENIHSDCPLRQQTGIWVPPSVPPMTKHDHEEWQKGFVSNAGYFIEDEYKWDMDEDIREMTMXXDVFAEMAVAGKDKLLSVASYDFGRHSMSLVSHFLLQAALEDNSQTLQRASVGSEHALL

SEQ ID NO: 138463 - protein, 422 aa, Triticum aestivum
  Clone ID: PAT_TA_32881.pep
MDKLKGSARLMIVSDLDHTMVDHHDEENLSLLRFGALWESVYCQDSLLVFSTGRSPTLYKELRKEKPMLTPDITILSVGSEITYGEAMVPDHGWEEYLNNKWDRNIVLEETAKFSELKLQVETEQRPHKVSFLVDKKNAQGVIKSLSETFEKRGVDAKIIYSGGQDLDILAQGAGKGQALAYLLKKLGSCGKTPNNTLACGDSGNDAELFSIPGVHGVMVSNAQEELLQWHAENAKDNPKIIHATERCAAGIIQAIGHFKLGPNVSPRDVEFPYIKEDPFKPTVAIVKFYVLYEKWRRADVPKADSVIQYFKNITDANGVIIHPSGVELSIHSSIDELASCYGDKQGKKYRSWVDRLVILQTASDSWLVRFDLWEAEGAAWVCCFTTLALNVKPETPGGFVVTHIHKTWRKEYPGVEQSSKL

SEQ ID NO: 138464 - protein, 422 aa, Triticum aestivum
  Clone ID: PAT_TA_32882.pep
MDKLKGSARLMIVSDLDHTMVDHHDEENLSLLRFGALWESVYCQDSLLVFSTGRSPTLYKELRKEKPMLTPDITILSVGSEITYGEAMVPDHGWEEYLNNKWDRNIVLEETAKFSELKLQVETEQRPHKVSFLVDKKNAQGVIKSLSEKFEKRGVDAKIIYSGGQDLDILAQGAGKGQALAYLLKKLGSCGKTPNNTLACGDSGNDAELFSIPGVHGVMVSNAQEELLQWHAENAKDNPKIIHATERCAAGIIQAIGHFKLGPNVSPRDVEFPYIKEDPFKPTAAIVKFYVLYEKWRRADVPKADSVIEYFKNTTDANGVIIHPSGVELSIHSSIDELASCYGDKQGKKYRSWVDRLVILQTAPDSWLVRFDLWEAEGNAWACCFTTLALNVKPETPGGFVVTHIHKTWRKEYPGVEQSSKL

SEQ ID NO: 138465 - protein, 357 aa, Triticum aestivum
  unsure (1)..(357): unsure at all Xaa locations
  Clone ID: PAT_TA_32883.pep
MDCFRYSITQLVDHHDCGEAMVSDHGWEEYLNNKWDRNIALEGTAKFSELKLLVESEQXRPHKVSFLVHKKNAQGLIKSLFREGSRNLGRDAKIIYXGGIDLDILAQGAGKGQALAYLLKKLGSCGKTPNNTLACGDSGNDAELFSIPGVHGVMVSNAQEELLQWHAENAKDNPKIIHATERCAAGIIQAIGHFKLGPNVSPRDVEFPYIKEDPFKPTAAIVKFYVLYEKWRRADVPKADSVIQYFKNITDANGVIIHPSGVELSIHSAIDELASCYGDKQGKKYRSWVDRLVILQTASDSWLVRFDLWEAEGAAWACCFTTLALNVKPETPGGFVVTHIHKTWRKEYPGVEQSCKL

SEQ ID NO: 138466 - protein, 72 aa, Triticum aestivum
  unsure (1)..(72): unsure at all Xaa locations
  Clone ID: PAT_TA_32884.pep
MATNENLPPNVIRQLAKELKNLDESPPEGIXVIVNDDDFSTIFADIEGPAGTPYENGVFRMKXLLXRDFPHS

SEQ ID NO: 138467 - protein, 104 aa, Triticum aestivum
  Clone ID: PAT_TA_32885.pep
LGTNRREAILPSQTTITSFFSLFLGLWHRQTTKYRTNMRSIDSLVCLYIIISSNSSSSHPSSSYRRGLSRQVARPSWALPMLHLRQQKEQRSGPANLGQMLLCR

SEQ ID NO: 138468 - protein, 68 aa, Triticum aestivum
  Clone ID: PAT_TA_32886.pep
CFSFAQSLSLQKMYTCLTNIFISRYDFGSELFPVCSSHCGMVIVQQKERMFKLFLGVIHEKYLYFHRA

SEQ ID NO: 138469 - protein, 98 aa, Triticum aestivum
  Clone ID: PAT_TA_32887.pep
CQTYFFIARINASRLFCRVTQRKMPQPIEICSRFHLCLLLHPVVKSISFGTFVETCFSAAQSANLHCSAWKSVRWIQPSLDRDAPKYNLTALFHPRAE

SEQ ID NO: 138470 - protein, 123 aa, Triticum aestivum
  Clone ID: PAT_TA_32888.pep
MATNENLPPNVIRQLAKELKNLDQSPQEGIRVIVNDDDFTSICADIDGPGGTPYENGVFRMKLVLSRDFPQSPPKGFFVTKIFHPNISSSGEICVNTLKKDWNPTHGLRHVLLVSTYYNNVWP

SEQ ID NO: 138471 - protein, 67 aa, Triticum aestivum
  Clone ID: PAT_TA_32889.pep
NCSKHNGYTTLFRYLIANLGYAADGTKKYIKNLFSSTPWNQKIYKESIFKYSLCKRSSPSYEDITHQ

SEQ ID NO: 138472 - protein, 72 aa, Triticum aestivum
  Clone ID: PAT_TA_32890.pep
QKIKLGTNASCISLLCVCVYISWFLHSNISHPCMRDTLPVRRESTDLHQGRLCLAPSSYTSQSVIRKCPRAE

SEQ ID NO: 138473 - protein, 101 aa, Triticum aestivum
  Clone ID: PAT_TA_32891.pep
TKLNISLVPPSTPCVGGSSPSATTSYCRSFVSRTVRGRHQGPATAVGADVRVISINVSYVAKQQHAPVNAISLWVWHFSFFLRRCSNIISSIELHVHVLLS

SEQ ID NO: 138474 - protein, 118 aa, Triticum aestivum
  Clone ID: PAT_TA_32892.pep
APVVFCYLIGINGSLHVYWLISNPYSAVVLWEQEEHACFLSTSRVHTARLTGLNSGSKVSFKNQERTFKEWIVWKLKPSDFLEVRLLSNYNYSFTWIYVNISVRCLVAMLQNHCRRDS

SEQ ID NO: 138475 - protein, 241 aa, Triticum aestivum
  Clone ID: PAT_TA_32893.pep
LSLACALLRRAKILVLDEATAAVDVQTDALIQKTIREEFKSCTMLIIAHRLNTIIDCDRLLILSSGKISEFDTPENLVSNEGSAFSKMVQSTGPSNAEYLKSLVLGNGEERLRKEESKLQDIQREWAASNRWAVAAQFALAASLASSHSDLLSLEAADGNNILRKTRDAVITLHSVLEGKHNTEIEESLAEYEVPLPPDRWWSSLYKVIEGLATMSKLGRNRLRQPGYSFENHGSIDWDQI

SEQ ID NO: 138476 - protein, 129 aa, Triticum aestivum
  Clone ID: PAT_TA_32894.pep
QESRCWGTALHRRVQDGGSVRVPVEDVQVDVDVVDQAGTRESAGKKLATFSLGYSENGDTRRSGSAAGMARQLEGGHDHLAEMVQAAKNQGARALHFTAGCKMVEVCEYLLRISRWTWMSLTKQILPIL

SEQ ID NO: 138477 - protein, 159 aa, Triticum aestivum
  Clone ID: PAT_TA_32895.pep
ISLGWQGSLKVVTAISQRWCKLSRITVLGHCTFTRRVQDGGSVRVPVEDVQVDVDVVDQAGLFCCPKGTRESAGKKLATFSLGYSENGDTRRSGSAAGMARQLEGGHDHLAEMVQAAKNQGARALHFTAGCKMVEVCEYLLRISRWTWMSLTKQILPIL

SEQ ID NO: 138478 - protein, 86 aa, Triticum aestivum
  Clone ID: PAT_TA_32896.pep
VFSFLRGSIFIRITSVSFLKQQQQQQQQSLYSQTSWGRLEVKPIRSNENLLGFISIREARVFTLACQAYHNPPPLPGLGTGYVETT

SEQ ID NO: 138479 - protein, 83 aa, Triticum aestivum
  Clone ID: PAT_TA_32897.pep
IFGLHRSSSSILENRQNLLGQRHPRPPGNPQQVLTHFHHLAPGGEVQCPGTVILGSLHHLCEMVVTTFKLPCHPLYLVGQMAT

SEQ ID NO: 138480 - protein, 193 aa, Triticum aestivum
  Clone ID: PAT_TA_32898.pep
YREYACDFLGASIFLISLKWWLCSFVVASADLWLRRAEVEEKRDKVHKESKALLDYTRKAITKLTELKRMLEKFKNDVEKQQVEQMADWQTKLVMMDSKERQYILQVSNYKAMLNRVGYTPEINHCVLMEMAEHKKDLERKTKPIADTLRSYQDLPPDKALAALAIEDKKRQYAAAEKYLEDVLQSALTTPGL

SEQ ID NO: 138481 - protein, 84 aa, Triticum aestivum
  Clone ID: PAT_TA_32899.pep
MSSSGGKVFTLEEVAKHTSKDDCWLVIGGKVYNVTKFLDDRPSSRTTTRDKTPEFVIKILQFLVPLAILGLAVAVRIYTKAESV

SEQ ID NO: 138482 - protein, 177 aa, Triticum aestivum
  unsure (1)..(177): unsure at all Xaa locations
  Clone ID: PAT_TA_32900.pep
RAAXNSVRGPNPQSPRPSLLPPSSAAALPPSSLLFLLLPRLHGLCPRSPTADCYSTTTPLPPPRLPIARAQVAAVADQGQCWVVKMGWLQRLPSPTAPSWEEAHHRRVAAGAQHPKRCSREEVRISRLIDKSRAADWIEGACMSTPPRVTLTAVSSRNRESTAPLPPGIPSPAREVQ

SEQ ID NO: 138483 - protein, 340 aa, Triticum aestivum
  Clone ID: PAT_TA_32901.pep
FGTRFRIVELERGRILIDDCDTSKFGIWDLRKVLGIIPQAPVLFSGTIRFNLDPFSEHNDADLWEALERAHLKDVIRRNALGLDAEVSEAGENFSVGQRQLLSLARALLRRAKILVLDEATAAVDVRTDALIQKTIREEFKSCTMLIIAHRLNTVIDCDRLLILSSGKISEFDTPENLLSNEDGAFSKMVQSTGPSNAEYLKSLVLGNGEERLRKEESKMQDIQRKWAASNRWAVAAQFALAASLASSHSDLLSLEVAEGNNILRKTKDAVITLQGVLEGKHNAEIEESLTEYQVPSDRWWSSLYKVIEGLATMSKLGRNRLRQPGYSFENHGSIDWDQI

SEQ ID NO: 138484 - protein, 247 aa, Triticum aestivum
  Clone ID: PAT_TA_32902.pep
MASMATNENLPPTVIRQLAKELKNLDDSPPEGIKVIVNDDDFATIFADIEGPAGTPYENGIFRMKLILSRDFPQSPPKGFFTTKIFHPNIATSGEICVNTLKKDWNPSLGLRHVLLVVRCLLIEPFPESALNEQAGKLLLENYEEYARHARLYTSIHALRPKNKSKSGAISESTAALNKGQPHTVLAPISTSTGTKAFGPNSQDRNAAPSAVSGGASAAPRKDGPLAVKVPVDKKKMDARKKSLKRL

SEQ ID NO: 138485 - protein, 143 aa, Triticum aestivum
  Clone ID: PAT_TA_32903.pep
CERGINETADLEYCGTTSYFIKLFLDKKYALPYRVLDAVFAHFMRFLDDERSMPVIWHQSLLAFVERYKNELEKKDKEQLSRLLDNQKHYLVTPEIRRELRSSANRGEKPTDMSIYILYLLTKPKWPIEEDRWDVPEVPMEED

SEQ ID NO: 138486 - protein, 138 aa, Triticum aestivum
  unsure (1)..(138): unsure at all Xaa locations
  Clone ID: PAT_TA_32904.pep
MSSSGGKVFTLEEVAKHTSKDDCWLVIGGKVYNVTKFLDDHPGGDDVLLSSTAKDATDDFEDVGHSTTARAMMDEYYVGEIDATTIPTKVKYTPXPKQPHYNQDKTPEFVIKILQFLVPLAILGLAVAVRIYTKAESV

SEQ ID NO: 138487 - protein, 252 aa, Triticum aestivum
  unsure (1)..(252): unsure at all Xaa locations
  Clone ID: PAT_TA_32905.pep
MATNENLPPNVIRQLAKELKNLDESPPEGIKVIVNDDDFSTIFADIEGPAGTPYENGVFRMKLLLSRDFPHSPPKGFFSTKIFHPNIATSGEICVNTLKKDWNPSLGLRHVLLVVRCLLIEPFPESALNEQAGKMLLENYEEYARLARLYTGXIHAHKHKNKSKSGAICESTTALNVGQSNNTVPSKNIPSAPALVSTSTSTKVLGIQDQNAAPSDPSVGSSTAHKKDGPLAAKIPAEKRKMDARKKSLKRL

SEQ ID NO: 138488 - protein, 251 aa, Triticum aestivum
  unsure (1)..(251): unsure at all Xaa locations
  Clone ID: PAT_TA_32906.pep
MATNENLPPNVIRQLAKELKNLDESPPEGIKVIVNDDDFSTIFADIEGPAGTPYENGVFRMKLLLSRDFPHSPPKGXFSTKIFHPNIATSGEXCVNTLKKDWNPSLGLRHVLLVVRCLLIEPFPESALNEQAGKMLLENYEEYARLARLYTGIHAHKHKNKSKSGAICESTTTLNVGQSNNTVPSKNIPSAPALVSTSTSTKVLGIQDQNAAPSDPAVGPSTANKKDGPLATKIPAEKRKMDARKKSLKRL

SEQ ID NO: 138489 - protein, 205 aa, Triticum aestivum
  Clone ID: PAT_TA_32907.pep
PRVRLIIAHRFNTVIDCDRLVILSSGKVSEFDTPENLVSNEESAFSKMVQSTGPSNAEYLKSLVLGNGEERLRKEENELQDTQRKWAASNRWAVAAQFALAASLASSHSDLLSLEAAEGNNILRKTKDAVITLHSVLEGKHNTEIEESLTEYEVPLPPDRWWSSLYKVIQGLATMSKLGRNRLRQRQPGYSFENHGSSSIDWDQI

SEQ ID NO: 138490 - protein, 183 aa, Triticum aestivum
  Clone ID: PAT_TA_32908.pep
SSPGPDRHLAQEARGGRRFGRHLLPSRTLGSNSPRPGGAGLDLEADGPGSWSWARRSSRSTTPASSSSSDVATLLRPGRWQALTCARRCNRHTSTLPTHAIISGAKMIWCLQGSLLLHFLREKPSQAVLLFMFIFHVCMCCSGGVLLVDWHIWISPCLLVDLQPLLCCGVVGARRACMLSLYI

SEQ ID NO: 138491 - protein, 254 aa, Triticum aestivum
  unsure (1)..(254): unsure at all Xaa locations
  Clone ID: PAT_TA_32909.pep
MATNENLPPNVIRQLXAKELKNLDQSPPEGIRVIVNDDDFTSICADIDGPGGTPYENGFSRMKLVLSRDFPQSPPKGFFVTKIFHPNISSSGEICVNTLKKDWNPTHGLRHVLLVVRCLLIEPFPESALNEQAGKMLLENYADYARXHARLYTSIHALKPKAKPKSGTISESTSVNVDQSSTTNLCETAPSAPMALCATAATKVPGSNSLDQNAPAEPTVGPSTTLPKKEGPVATKAPADKKKIDARKKSLKRL

SEQ ID NO: 138492 - protein, 92 aa, Triticum aestivum
  Clone ID: PAT_TA_32910.pep
YVVMHAHLKMNEAKLQLQLQVYLLKIPMVSDVFYSTTTKKINVAAEPIVPAEEHPKVDSDTADGASLTAIEDTVVHFNQPIWKKRRRSHKQK

SEQ ID NO: 138493 - protein, 105 aa, Triticum aestivum
  Clone ID: PAT_TA_32911.pep
GTCRPSSTSPSCLHQHRVLEGRHRPRRRATAAALPSRTVRGRHQGPATAPGADVRVISINVSYVAKQQHAPVNAISLWAWHFSSSGDIPIYNKFHQELHVHVLLS

SEQ ID NO: 138494 - protein, 132 aa, Triticum aestivum
  Clone ID: PAT_TA_32912.pep
ARVKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 138495 - protein, 259 aa, Triticum aestivum
  Clone ID: PAT_TA_32913.pep
MAKAAATREEMVYLAKLAEQAERYEEMVEFMEKVVAAAGTVELTIEERNLLSVAYKNVIGARRASWRIVSSIEQKEEGRGAAGHAAAARGYRALVEAELSNICAGILRLLDERLVPAAAAVDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 138496 - protein, 158 aa, Triticum aestivum
  unsure (1)..(158): unsure at all Xaa locations
  Clone ID: PAT_TA_32914.pep
PTPTCLGLKALLLLLLLLLLLLYSALPFGGSLYVVXEXWGLEPSRILRINPPEDSNLSSWSVIPPQMVTQCPVKLSRMLQLVECNSELLLVGCDSGHSRIVLFRVADLLHGVTTMQLTSIGDQAVFIGGWNMAVNSKSLPSVQGNXIAGVNEIGGGSC

SEQ ID NO: 138497 - protein, 228 aa, Triticum aestivum
  Clone ID: PAT_TA_32915.pep
MDARPRRASSSPAAATATAAAALSLLLLFPMFLGGQASGYGDDSGAGGMTALQKHAAFFDRDKDGVVTFSETYAAFRALGFGFASSTLSATFINGVLGPQTRPENDTARMSIYIENIHKGIHGSDSGAYDSQGRFVPDKFDAAFAKHGKTVPDALTSAEVDELIAANRQPGDYAGWAGASAEWKLLYSIGKDEDGLLRKDAARGVYDGSLFARVVQERRASSLEETQA

SEQ ID NO: 138498 - protein, 223 aa, Triticum aestivum
  Clone ID: PAT_TA_32916.pep
MDARPRRASSSPAAATAALSLLLLFPMFLGGQASAYGDDSGAGSMTALQKHAAFFDGDKDGVVTFSETYAAFRALGFGYAASTLSATFINGVLGPQTRPENDTARMSIYIENIHKGIHGSDSGAYDSQGRFVPEKFEAAFAKHAKTVPDALTSAEVDELITANREPSDYAGWAGASAEWKLLYSIGKDKDGLLRKDAARGVYDGSLFARVVQERRTSIGETQA

SEQ ID NO: 138499 - protein, 528 aa, Triticum aestivum
  unsure (1)..(528): unsure at all Xaa locations
  Clone ID: PAT_TA_32917.pep
MRLSIDGGSTSTSCSMGRMRVLTIELDNSFDETSMRFVRRIQESEVKEALKRMKGGKAMGPDCIPIEVWKGLGDIAIVWLTKLFNLIFRANKMPEEWRRSILVPIFKNKGDVQSCTNYRGIKLMSHTMKLWERVIEHRLRRMTSVTKNQFGFMPGRSTMEAIFLVRQLMERYREQKKDLHMVFIDLEKAYGKIXRNVMWWALEKHKIPAKYITLIKDMYDNVVTSVRTSDVDTDDFPIKIGLHQGSSLTPYLFALVMDEVTRGIQGDIPWCMLFADDVVLVDDXSDGVNRKLELWRQTLESKGFSLSRTKTEYMMCGFSTTRCEEEVSLDAQVVPQKEDTFRYLGSMLQEDGGIDEDVNHRIKAGWMKWRQASGILCDKRVPQKLKDKFYRTAVRPAMLYGAECWPTKRRHVQQLGVAEMRMLRWMCGHTRKDRVRNDDIRDRVGVAPIEEKLVQHRLRWFGHIQRRPPEAPVYSGRLKRAENVKRGRGRPILTWEESVKRDLKDWSIDKELAMDRGAWKLAIHVPEP

SEQ ID NO: 138500 - protein, 630 aa, Triticum aestivum
  Clone ID: PAT_TA_32918.pep
MLRSILRAPMVFFHTNPLGRIINRFSKDLGDIDRNLAVFVNMFMAQISQLLSTFVLIGVVSTMSLWAIMPLLILFYAAYLYYQATSREVKRMDSITRSPVYAQFSEALNGLSTIRAYKAYDRMSNINGKSMDNNIRFTLVNMSSNRWLAIRLETLGGIMIWFTATFAVMQNQRAENQKAFASTMGLLLTYTLNITNLLTAVLRLASLAENSMNAVERVGTYIELPSEAPPVIEDNRPPPGWPSSGIIKFEDVVLRYRPELPPVLHGISFIINGSEKVGIVGRTGAGKSSMLNALFRIVELERGRILIDDCDTSKFGIWDLRKVLGIIPQAPVLFSGTIRFNLDPFSEHNDADLWEALERAHLKDVIRRNALGLDAEVSEAGENFSVGQRQLLSLARALLRRAKILVLDEATAAVDVRTDALIQKTIREEFKSCTMLIIAHRLNTVIDCDRLLILSSGKISEFDTPENLLSNEDGAFSKMVQSTGPSNAEYLKSLVLGNGEERLRKEESKLQDIQRKWAASNRWAVAAQFALAASLASSHSDLLSLEVAEGNNILRKTKDAVLTLQGVLEGKHNTEIEESLTEYQVPSDRWWSSLYKVIEGLATMSKLGRNRLRQPGYSFENHGSIDWDQI

SEQ ID NO: 138501 - protein, 261 aa, Triticum aestivum
  Clone ID: PAT_TA_32919.pep
MAKAAAAGTREEMVYMAKLAEQAERYEEMVEFMEKVVAAAGTGELTVEERNLLSVAYKNVIGARRASWRIVSSIEQKEEGRGAAGHAAAARGYRALVEAELSNICAGILRLLYERLVPAAVAVDAKVFYLKMKGDYHRYLAEFKSAAERKDAADSTLGAYQAAQDIAMKELPPTHPIRLGLALNFSVFYYEILNSPDRACSLAKQAFDEAIAELDSLGEDSYKDSTLIMQLLRDNLTLWTSDMQDDAGDEMRDSSKPEDEQ

SEQ ID NO: 138502 - protein, 137 aa, Triticum aestivum
  Clone ID: PAT_TA_32920.pep
MSSSGGKVFTLEEVAKHTSKDDCWLVIGGKVYNVTKFLDDHPGGDDVLLSSTAKDATDDFEDAGHSTTARAMMDEYYVGEIDATTIPTKVKYTPPKQPHYNQDKTPEFVIKILQFLVPLAILGLAVAVRIYTKAESV

SEQ ID NO: 138503 - protein, 137 aa, Triticum aestivum
  Clone ID: PAT_TA_32921.pep
MSSSGGKLFTLEEVAKHSSKDDCWLVIGGKVYNVTKFLDDHPGGDDVLLSSTAKDATDDFEDVGHSTTARAMMDEYYVGEIDATTIPTKVKYTPPKQPHYNQDKTPEFVIKILQFLVPLAILGLAVAVRIYTKADSV

SEQ ID NO: 138504 - protein, 137 aa, Triticum aestivum
  Clone ID: PAT_TA_32922.pep
MASSGGKLFTLEEVAKHSSKDDCWLVIGGKVYNVTKFLDDHPGGDDVLLSSTAKDATDDFEDVGHSTTARAMMDEYYVGEIDATTIPTKVKYTPPKQPHYNQDKTPEFVIKILQFLVPLAILGLAVAVRIYTKAESV

SEQ ID NO: 138505 - protein, 149 aa, Triticum aestivum
  Clone ID: PAT_TA_32923.pep
YVLACTSRPHGVVCIAALNNESKYYEPDHWKFGTAGNNYFRHATRQLYAITRDLATYVSANKHILHKYTNEDVSFGSWLIGLDVEHVDQRSLCCGIPPDCEWKAQAGNPCGASFDWNCSGVCNPAERMEEVHRRCWEHREAALPQARES

SEQ ID NO: 138506 - protein, 193 aa, Triticum aestivum
  Clone ID: PAT_TA_32924.pep
SPTRPSASGRLHPHSRPPARSHNNALVGRPVTCACRRWLVPARRKQVVVVARARSPPCSRLSLELPTAPWLQHGGTQSHPYHQPPLQLRRHRRPPSQQINSMAFPCSSDLPHLLPWFQQNCLSVAAPGGSLRSSSVANGCHSRSPLVEAPHSAPQAGLPHGCGGGWADARRSSAGRVDGGHSPEQHRAGGRRL

SEQ ID NO: 138507 - protein, 78 aa, Triticum aestivum
  Clone ID: PAT_TA_32925.pep
VHLCQQRDHFTDMRRTCANSAEFSNRDTFYCQLASCSFFFIILKLCCPVSDQLNEAPLFSMSENIGTLDGASFTGTSS

SEQ ID NO: 138508 - protein, 129 aa, Triticum aestivum
  Clone ID: PAT_TA_32926.pep
MAARAACTGRLLRATTAKDSRLPSSSPAASRPACRIPSLKFPFLWDTKARQGKISRAAEQRAALITLGAASASTTEEKQLLPGEARLDFPLLPLVGNRKAGVRNFRGWPAGPGQLPRLINKSQIHKLGP

SEQ ID NO: 138509 - protein, 92 aa, Triticum aestivum
  Clone ID: PAT_TA_32927.pep
GKEYSLVDSQNFVFSGAHNHAAFILPKTEHTLSHKLVPLGSGSQQLPRITVASVRYSAALTPPTSATSVFVYPSEPKFNLEKSHPMSDECVS

SEQ ID NO: 138510 - protein, 228 aa, Triticum aestivum
  unsure (1)..(228): unsure at all Xaa locations
  Clone ID: PAT_TA_32928.pep
VEKRKDLDWGRRFKIISGVARGLQYLHEDSQLKIVHRDLKASNILLDFDYNPKISDFGLAKIFGGDQSEDVTRRIAXGTYGYMSPEYAMHGQYSAKSDAFSFGVLVLEIVTGRRNNGSCNSEQYVYLVNLVWEHWTRGNVVELIDPSLSGHPSHVDQVLKCIRTGLLCVQNRPEDRPAMSSVNAMLTSQSVRLPSVSMPAFCDRLSGCSDNSESESSNGMTITKLEPR

SEQ ID NO: 138511 - protein, 75 aa, Triticum aestivum
  Clone ID: PAT_TA_32929.pep
PREKRASLALSHLPKQLQEHHCSYLALVIMRRPRRAAVGVLSPRRALKLGKFRQRACLRLIPLPGTGDVLLAPNM

SEQ ID NO: 138512 - protein, 186 aa, Triticum aestivum
  unsure (1)..(186): unsure at all Xaa locations
  Clone ID: PAT_TA_32930.pep
MTSVWKTKVLPGLNKIFDKDGKKAAAAEFLKSFNKEEIDKEIEDKKTELEPKVVETIEASPPEIKGLMKDKKTSKIKKNSVAVTKFLDDLAKIDFPGAKLVSDAVAKSGTTPLSPAIVFILDKVAPFVPAPKEEPKAEPEDAAPAEETTTREVAVEEKKEEAEPSAAPAEAPAAXEAAAPAAEEVE

SEQ ID NO: 138513 - protein, 184 aa, Triticum aestivum
  Clone ID: PAT_TA_32931.pep
QGRYEDKKTELRAQACGRRLKHLLHEIKGLIKDKKTSKITRRTQLAVTKFLDDLATELIFPRKPSLRERRGGPSPAPRPSPRAIVFTLGTNGCAFRTRAQRTEPKDGARRPSPPPRHGADQPPARAPWRERREEEAGALRRTGRSRAGGRLRQPPPAEVVEEKKEGRRNPPKPPHLPPRSQRKK

SEQ ID NO: 138514 - protein, 331 aa, Triticum aestivum
  Clone ID: PAT_TA_32932.pep
PATPVDMVLDYFRYDYEFAEPPRVTSLQGTEPTATFADFGDDANFVADQRGFETLIYHIAGQYLRSDKSGNIVDPRVKLNKVVREISYDQRGVVVTTEDNSAYSADYVIVSASIGVLQSDLIQFKPQLPAWKILAIYRFDMGVYTKIFLKFPRKFWPTGPGKQFFVYASSRRGYYGMWQSFEQEYPGANVLMVTVTDVESRRIEQQPDNVTMAEAVGVLRNMFPDRDVPDATDIYVPRWWSNRFFKGSYSNWPVGVNRYEYDQLRAPVGGRVYFTGEHTSEHYNGYVHGAYLAGIDSADILMNKVLNNVEFKVRPKYDEEQKAESGFLTPV

SEQ ID NO: 138515 - protein, 76 aa, Triticum aestivum
  Clone ID: PAT_TA_32933.pep
MRVESMPMGTSRYFVRKTTIPPPKRPRRIHVSPCHDTPILLGDEVKRCPWGHLGNIMRASYIPPPLGLEESVSAHA

SEQ ID NO: 138516 - protein, 78 aa, Triticum aestivum
  Clone ID: PAT_TA_32934.pep
LRRNGFSDQEVRSLRKAYRKVFMPASSSQSNFEDRLAELEREIELLESPSVSYMVESIRTSFDQGRRGICKFRSWNIS

SEQ ID NO: 138517 - protein, 262 aa, Triticum aestivum
  unsure (1)..(262): unsure at all Xaa locations
  Clone ID: PAT_TA_32935.pep
LGADLPGRTIIGENNVIGNYAVVGVKCQDLKYKPGDECFLRIGNNNEIREYCSIHRSSKLSHCTVTFYALVTTMRSHGTALFTDLLXPCDCTVIGDNNLIMGSCHVAHDCKIGSNNIFANNTLFGGHVIVEDCTHTAGAVVVHQFCHIGSFSFLGGGSVVAQDVPRYTMVAGDRAELRGLNLEGLRRNGFSDQEVRSLRKAYRKVFMPASSSQSNFEDRLAELEREIELLESPSVSYMVESIRTSFDQGRRGICKFRSWNIS

SEQ ID NO: 138518 - protein, 59 aa, Triticum aestivum
  Clone ID: PAT_TA_32936.pep
KAGYVPSSHQTEKQTQLESAVQTIPSTAWLIQPVNRPVTPTVGHTMPHPSRPLCRVRNH

SEQ ID NO: 138519 - protein, 134 aa, Triticum aestivum
  Clone ID: PAT_TA_32937.pep
RVGEKAGRFRVMIEDVSLVEVPANGCADDVLDFWHYCVTLLFEMNCLRVVLIHEVIYSSEDCVELLGHLRYILDLVIKAAPLSSGLTGDVHGHLSVVNKGMLIEQRPAKGRKVWSFHFKVKENGADFFYPGSRH

SEQ ID NO: 138520 - protein, 111 aa, Triticum aestivum
  Clone ID: PAT_TA_32938.pep
MRSSVPSLSSSGPRTAPATQAPSPGLGHDTSQCMQEQLIIKLATHMHACMPCQCLHGYSINLCKNKLLSCHSNSLHVMYVRTCVFLHDMYAAPHHVLHLSLDIYVVLYFRF

SEQ ID NO: 138521 - protein, 168 aa, Triticum aestivum
  Clone ID: PAT_TA_32939.pep
MHSNNIPAEVLNIFANMPHLVDITLYKFDVLDKLPAEFPHSVRRLFLHADVIEQDLMPILEKLPRLVVLLLGGYKGQTMCFSSQGFPRLQVLELDRFSIEEWRMEEGTMPKLSHLTLWEWEKMSKLPVGWLHLPSLGHLKLNFMYKISEDDITLKKLRRKGCEVEVKR

SEQ ID NO: 138522 - protein, 92 aa, Triticum aestivum
  Clone ID: PAT_TA_32940.pep
RDLELVLKSISITGALSRYSCGYCSFASILPNCANQGAEDLPTQPSFPSGAGRLSNPVADEEDQDFLDIGGAAGNASHMTESCLTTRRCLSA

SEQ ID NO: 138523 - protein, 275 aa, Triticum aestivum
  Clone ID: PAT_TA_32941.pep
LRVKDDELHQLLQDIRARDSTIREITDKLQETAEAAETAASAAHAIDEARRFLSSELERLKQDQENQVELSLLRLRESEEKSKLLAEEREHLLKERDSALQEAQMWRSELGKARGNAVILEAAVVRAEEKARVSAADADMRIKEAVSKLESAAKEKEELLALLDALKSQIQRQETSTKQICEERSELCSTSKHMDMDDDNVDKACLSDTDLIPIAENIVELDDEGVDIRTIGDTEWENPHSSEVSDVREVTTEAEENSLDIPVDSQPVADDTFQG

SEQ ID NO: 138524 - protein, 92 aa, Triticum aestivum
  Clone ID: PAT_TA_32942.pep
HPRASCYSSFPRIPIAVRSVVVSLARSPFHAHHVVVAALGRSQPNQGFHVDVLAVNRRQWRAPARKTKTTRGQRSSRSIQCLPNSATPVISQ

SEQ ID NO: 138525 - protein, 197 aa, Triticum aestivum
  Clone ID: PAT_TA_32943.pep
EARVHIDWAVCRVFDKDLAAKNAPPQTASAGDGVVEDPYAFLDVDDFFNNPDLPMLMDSPSGADDFAGASSSTSSAAVPLEPDMEHLSIKTEPPVPQQQMQSPNYFFMPATTANGNHGGGAYSPYQAMGEQQSAIRRHCKPEAASTSALLSPSLGFDTGALAGGDTLFVIPSSRSYLDLEELCRGEPPMDYSNMWKI

SEQ ID NO: 138526 - protein, 60 aa, Triticum aestivum
  Clone ID: PAT_TA_32944.pep
GRVGARRRPFLCRVRLIRTARVGGAGDIVVITERREKGEVFLEFPMTLHHHFISIVLLLL

SEQ ID NO: 138527 - protein, 233 aa, Triticum aestivum
  Clone ID: PAT_TA_32945.pep
MGMRCKRHPFQAGGGICATCLRDRLLVLAAAQNDASSTPSTPPATAPPPPAEAAPAPAFPRSVSPYVSRRKSDSSGGALRHHPSLLFFRTPQVGPAYGGSAPLEEGDIGYHKPRAGKFSVLATLFGSHHHRRHGPEDKDKAKERKKSRSWLAGIIPRRRRKQVPADAVLPASPPPRRSCRVVSNRGLSPERCSQGSGEESSSPADPPWRPSPSPMRRTPCRRRQTSSMPSGFA

SEQ ID NO: 138528 - protein, 118 aa, Triticum aestivum
  Clone ID: PAT_TA_32946.pep
LIRRTSRGGGGGGHGQRSLFVKVYMEGVPTHPKLDLLLVDWYDRLLAVLGRMFKASIIHPDTVGRDHRVVLGEKQARHVVTYQDQEGDWLMAGDVPWELFLAGVKKLKIARVDSSTSD

SEQ ID NO: 138529 - protein, 234 aa, Triticum aestivum
  Clone ID: PAT_TA_32947.pep
MRGSERAAVSASTSGMSCNGCRVLRKGCNDACVLRPCLLWIEAADAQGHATLFAAKFFGRAGLMSFLTAVPEQQRPAVFQSLLYEAAGRTINPVSGAVGLLWAGSWHLCEAAVQTVLRGGAIRPLPELAGGVPEGGVGGSDLFASSSRRAVVGCSTYSAAKRVTPRKTWAPEAASQHQEPPCDLGLFLTPGSAAAAEGERRVRRAGTPSMSSDGSVTTSAGAGEKEPELLNLFV

SEQ ID NO: 138530 - protein, 311 aa, Triticum aestivum
  unsure (1)..(311): unsure at all Xaa locations
  Clone ID: PAT_TA_32948.pep
PPRGASRATLALLLLALSAALAPARAAATGVFEVRRKFPRHHGGGAGGGKHLADLREHDARRHGRSLAAAVDLPLGGNGLPTETGLYFTQIGIGTPAKSYYVQVDTGSDILWVNCVSCDTCPRKSGLGIELTLYDPSGSSSGTGVTCGQEFCVATHGGVLPSCVPAAPCQYSISYGDGSSTTGFFVTDFLQYNQVSGNSQTTLANTSITFGCGAKIGGDLGSSSQALDGXILGFGQSNSSMLSQLAAAGKVRKVFAHCLDTISGGGIFAIGDVGQPGNXXXPQSXTKTPLVPGNXQIKMTLEKFGGFNLNQ

SEQ ID NO: 138531 - protein, 532 aa, Triticum aestivum
  unsure (1)..(532): unsure at all Xaa locations
  Clone ID: PAT_TA_32949.pep
YRIRHEIVEYAYQRTKNFERLTFLYLITGYMDKVGFMCKIAGQNNNLMGQFHNALYLGDARKRAEILENAGQLPLAYVTAATHGLTEIAERLAAELGENVPSLPEGKTRSLLIPPAPLISSVDWPLLRVMRGIFEGGLDATGRAEVEEDDEAAGADWGDEDLDIVDASDAVANGGDGFDPEEGEANEEDGEEGGWDLEDLELPEAETPKAAGNARSTVFVAPTPGMPVSQIWTQKSSLAGEHAAAGNFDTAMRLLSRQVGHXKNFDPLKPIFLDLAYGQSFXLRALATAPVISIAVEKGWSESSSPNVRGPPSLVFTFSQMEDRLKAAYKATTEGKFPEALRQFLNILHTIPLIVVDSRREVDEVKELIEIVREYVLGLRMELKRKELKDNVNRQQELAAYFTNCKLQRVHMRLVLSNAMALCYKQKNFATAEHFARLLLENSPNEVQAKKARQVQQQCNGKQDSHELNYDYRNPFVVCGSTYVPIYRGQKDISCPYCGSRFVPNIEGQLCTICELAVVGADASGLLCSPTQ

SEQ ID NO: 138532 - protein, 162 aa, Triticum aestivum
  Clone ID: PAT_TA_32950.pep
YNSEPVSVSTGNVSHSKGGNINQLHSKGCSKLVGRVEVPSKGFCDVISAELPTIGCPCVCSISAELPTVGCSCVGSISAELPTKGCSCVGAISAELPTKVCSCVGAISAELPTKGYSCFGSISAKLPTKGCSCAGSIPARRPTKGCSCAGAISPELHTKGCS

SEQ ID NO: 138533 - protein, 157 aa, Triticum aestivum
  Clone ID: PAT_TA_32951.pep
GFISGFLARYRGSLQGGSSLQDGAEDSSGYWRFDVEGSEELENYFMLSDRHRAMRMDIDGMSYEELLALGDRIGTVNTGLSEDALYKCLKRGLYTPTAPETHQDCDRKCSICQEEYSGGEEVGNMACKHYYHITCIQHWLRQKNWCPICKSVAAKTV

SEQ ID NO: 138534 - protein, 286 aa, Triticum aestivum
  unsure (1)..(286): unsure at all Xaa locations
  Clone ID: PAT_TA_32952.pep
CASPTRQRRKRYLAAAAHPMGVRREATIIRSTTSRRSGTSTQALLIQRFEATRGTGHGAGSRPQYNGGSTGRHGSKATHALSSQQAVKPTKPPPVQSTGGSLARRRPARPNLAFPPPGGSTSSRAAATAVELQLLFPLVRVKFXLGXXKFELGVIRXXXXLAIKLRMQRFSKGNFIGTSVQRCRTVLSCTKRATFLFPEPHSAVGSEFHLRRTGDRDSDDVATEGQRFSGGDIGGTSLRLFTVGRIVYATGYFPVSRATFGCWVRISHETYTGPGQHLRDGITTGR

SEQ ID NO: 138535 - protein, 135 aa, Triticum aestivum
  Clone ID: PAT_TA_32953.pep
IGEFRPPLARMHPRTGAHDGAALRLMLRGHIWTAPPCVSATLWHQHRRCSLRIPRQDSDDDDEPDYLLQSEHLKKFLFYGDNVRRKAVVETCADEHVQKRMVLHGCCCVIGMNPRALKLSRYFCLCCVHLSNVYV

SEQ ID NO: 138536 - protein, 181 aa, Triticum aestivum
  Clone ID: PAT_TA_32954.pep
IRPPDRSSGLVDSSLACRRVLVAVAGKDTLRERGLDLAARMRDHDAPWPWMTKGRREVTVEESEGEDHGFHLYSPLRPTSKRLMGSIVEFINQQPNSSPGNRMVLGVPTTPFKDVFGYGMAMKSWGTRSSMPRNGATYMKIGRVGPSNKISVRLPMPAGNAHHKHPLSAAVPWGCVINKFF

SEQ ID NO: 138537 - protein, 154 aa, Triticum aestivum
  Clone ID: PAT_TA_32955.pep
MSGYYKDITATKESMAGGWLHTGDLAVRHPHGYIQLKDRAKDIIISGGENISSIEVESVIFSHPAVLEAAVVARPDDHWGETPCAFVKLKDGAIATEAEIIGFCRERLPHYMAPKTVVFGDLPKTSTGKTQKFVLREKARAMGSLTKTGNSSKL

SEQ ID NO: 138538 - protein, 149 aa, Triticum aestivum
  unsure (1)..(149): unsure at all Xaa locations
  Clone ID: PAT_TA_32956.pep
MVVHDHIQRQLPRYRGSVPGRAPNLNRNRERGHALLYADCFSNKLFFKPDKFXRRFRMGRHVFNRIRKGVVAHDPYFECKMDSLGELGFSSCQKCTAAVRMLAYGIPGNLVDEYVRMSETTCLMSMYKFCQVMIEVFGPEYLRQPTAAD

SEQ ID NO: 138539 - protein, 128 aa, Triticum aestivum
  unsure (1)..(128): unsure at all Xaa locations
  Clone ID: PAT_TA_32957.pep
FMDVRGITHSSPSLLRHVAKLKWICENSSYFVFPVLFHKAIFVIEVDFMVAQSSGASWMDFELVPFHHTWLVVQVLRCYVLHGLAASPSELFSPGGGEDARANGRAELAACGHASTCNRAVXEPAVTV

SEQ ID NO: 138540 - protein, 158 aa, Triticum aestivum
  unsure (1)..(158): unsure at all Xaa locations
  Clone ID: PAT_TA_32958.pep
REINSVNDNPLIDVSRGKAMHGGNFQGTPIGVSMDNTRLAIAAIGKLMFAQFSELVNDFYNNGLSSNLSGGRNPSLDYGFKGAEIAMASYCSELQFLGNPVTNHVQSAEQHNQDVNSLGLISSRKTAEAIDILKIMAFTFLVALCQAIDLXHIEENMK

SEQ ID NO: 138541 - protein, 542 aa, Triticum aestivum
  unsure (1)..(542): unsure at all Xaa locations
  Clone ID: PAT_TA_32959.pep
GIRFEILEAITKLLNANVTPCLPLRGTITASGDLVPLSYIAGLITGRQNSVAVAPDGSKVTAAEAFKIAGIEHGFFELQPKEGLAMVNGTAVGSGLASTVLFEANVLSVLAEVLSAVFCEVMNGKPEFTDHLTHKLKHHPGQIEAAAIMEHILEGSSYMKQAKKLGELDPLMKPKQDRYALRTSPQWLGPQIEVIRFATKSIEREINSPPSPGQDVSAEADISPEVKSSRPASRLAIDAIGKLMFAQVLRRLVNDFYNNGLPSNLSGGTQPELXYGFKGAEIAMASYCSELQFLGNPVTNHVQXSAEQHNQXVNSLGLISSSGETAEAIDILKIMSSTFLVALCQAIDLRHIEENMKTAVRNCVMQVAKKTLSMXNMGGLHIRPLLREPDLLTXAIDREAVFAYADDPCSPNYPLMQKLRAVLVEHALANGDGERALETSIFAKVAEFEQNIRAALRXEAMNARASVENGTPLAPNRIKDCRSYPLYQFVREVCGTEYLTGEKTRSPGEELNKVLVAMNERKHIDPLLECLKEWNGEPLPLC

SEQ ID NO: 138542 - protein, 163 aa, Triticum aestivum
  Clone ID: PAT_TA_32960.pep
GGLHREVLGEQEQHMAVNYYPRCPEPDLTYGLPKHTDPNALTILLMDPHVSGLQVLKDGAQWIAVDPRPNALVVNLGDQLQAVSNGAYKSVWHRAVVNAARERLSVASFLCPCNSAVIGPADKLVGDGDEPVYRSYTYDEYYKKFWSRNLDQDHCLELFTGQK

SEQ ID NO: 138543 - protein, 336 aa, Triticum aestivum
  Clone ID: PAT_TA_32961.pep
MAEQLISTAVHHTLPDSYVRSEADRPRLDEVVPDADIPVVDLANPDRAAVVAQIGAACSSHGFFQVLNHGLPLEVMLAAMAVAHDFFRLSPEEKAKLYSDDPAKKMRLSTSFNVRKETVHNWRDYLRLHCHPLEQFAPEWPANPPPFRDVMSTYCKEVRQLGFRLYAMISESLGLEQDYIKKVLGEQEQHMAVNFYPKCPSPELTYGLPAHTDPNALTILMMDEQVAGLQVLKEGRWIAVNPRPNALVINLGDQLQALSNGRYKSVWHRAVVNSDRPRMSIASFLCPCNSVKLGPAEKLIGEKSPAVYRNYTYDEYYKKFWSRNLDQEHCLELFRT

SEQ ID NO: 138544 - protein, 269 aa, Triticum aestivum
  unsure (1)..(269): unsure at all Xaa locations
  Clone ID: PAT_TA_32962.pep
STARCSTTGCRSVAHDFFRLSPEEKAKLYSDDPAKKMRLSTSFNVRKETVHNWRDYLRLHCHPLEQFVPEWPANPPPFRDVMSTYCKEVRQLGFRLYAMISESLGLEQDYIKKVLGEQEQHMAVNFYPKCPSPELTYGLPAHTDPNALTILMMDEQVAGLQVLKEGRWIAVNPRPNALVINLGDQLQALSNGRYKSVWHRAVVNSDRPRMSIAXFLCPCXSVKLRPAEKLIGEKSPGVYRSYSYDEYYKKFWSRNLDQDHCLELFTGQK

SEQ ID NO: 138545 - protein, 128 aa, Triticum aestivum
  Clone ID: PAT_TA_32963.pep
TETTLTTSTTRSSGAGTWTRSTAWSSSEPSFFFFDIKEAHSLFFPRKMVSHSTRVHPPAPYQTPSQKKKRNQNLARHGEKIWTFFCPSCFQPSPCFVGHLGVVLAISSIDLCEPIVALAVCVHRDANL

SEQ ID NO: 138546 - protein, 256 aa, Triticum aestivum
  Clone ID: PAT_TA_32964.pep
PSSMYSTGGKARHTYVQVQQPPGSKQQSFIGVLQIDTMELHTYTHTRTYEVWIGASIIPSRLPHVLEGGVEAGEDEEEDDDHGDAPGGAALGGRGRVPPPAALGGVEPEVALEGVDYAPNRETASPRRRIARHPSGPLPASGKPPRGVPAGGERTGRTPRWCSRLEPTPHHPWPRGRSTRSRPIPAHISAPTRTCYGKENRSFHQEFLHVGGRWSGIWFGRGAAGRNDGDALMGELPSKVGRVQGEPRPRSCHRSG

SEQ ID NO: 138547 - protein, 56 aa, Triticum aestivum
  Clone ID: PAT_TA_32965.pep
FYDNTTIIISIQNYLQSMNNTALFIQSFILLKSKVAPWAFSTLHTAQARQLCRWKS

SEQ ID NO: 138548 - protein, 310 aa, Triticum aestivum
  Clone ID: PAT_TA_32966.pep
RGSNEGYEEEDEYRKKPTSGGGRYEQDDEYKKKPSGGGRYEEDDEYRKKPTSGGGGYGGGRYEGEDEYKKKPTSGGYGGGRYEQEDDYKRPPSGGYGGGRYEEDDEYKKKPSAGGYGGGGGRYEDEYKKPTGGHAGGRYEEDDEYKRPSGGSHGGRYEEEDYKKKPSGGGRYEEDDYKKKPSGGGRYEEDDYKKKPSGGSHGGKDESEGGGIGDYIKLAQGFMKKQDGEGGHKKTSGHGGGGYGKEENEEDSGKKKHGGRPESGKDESEGSGMADYLKLAQGFMKKDGEGGSGAGMGDYLKLAEGFMKKR

SEQ ID NO: 138549 - protein, 193 aa, Triticum aestivum
  unsure (1)..(193): unsure at all Xaa locations
  Clone ID: PAT_TA_32967.pep
FFLLFGRPLLGLAFFPPLSHTQITATLAYNVIEIPHQRAQTRQLPFSLPNQLFFPILFFFSRWLFDMLAHYYRFVRPPSACPEAPSVQCSSHHSSQVTAGQSGSNAYGPRGSQLPLAVRSLPAARIGSCALSSRVRNKAPMDGAEGWGSAXAXXRQXRAXGGXLARRSXPLPXRSSKKSGXSKGALTPGXXTP

SEQ ID NO: 138550 - protein, 70 aa, Triticum aestivum
  Clone ID: PAT_TA_32968.pep
MRISEMDVDRVVGYFKDKSILITGSTGFLGKGREAYIVLVEKILRVQPDVKKLFLLIRASDVESVCEIID

SEQ ID NO: 138551 - protein, 301 aa, Triticum aestivum
  unsure (1)..(301): unsure at all Xaa locations
  Clone ID: PAT_TA_32969.pep
AEFWMAANVQNPHVSTLKLISVYVGIGVCTMIFVLSRSLFVVVLGIQTSRSLFSQLLNSLFRAPMSFFDSTPQGRILSRVSSDLSIVDLDIPFAFMFSLSSSLNAYSNVGVLAVVVWQVLFVALPMIVLVIQLQRYYLASAKELMRINGTTKSALANHLGESISGAITIRAFEEEDRFFAKNLELVDKNAGPYFFNFAATEWLIERLEIMGAVVLSSSAFVMALLPAGTFSPGFIGMALSYGLSLNNSFVNTIQKGSDRANKIISVERVNQYMDISSEAPEVFEENRPAPDWPXQVGSVEL

SEQ ID NO: 138552 - protein, 343 aa, Triticum aestivum
  Clone ID: PAT_TA_32970.pep
MIWPARQRRNSGSGSGSQPQQNYSDPGLDGFQSNSSSGEDDVDDDEYTPHKRGTGRPRKILRGRGRPRKDEQQSQSQAKHPPTPTATASSTGGMQQSEAEAAAAEPRKVALSANGDAASPSTKSGRGRPRKIPGGRGRPRKDEQQSLAKHSPTAAASTGKAAAAAEHPPTPLSTDGIKRGRGRPRKEADKGGSTKAGPPAPAASAGVKRSRGRPRVYRPMPVKTGDELENPVSVDVALENPRMHRPSSADIVSMVMKRGIPAKARDARPAEAGDAIPAKARYARPAEAGDATPAEETGGAASTGIKRPRGRPRKEKPAAAMSAQAGDAVSAGIKRGRGRPRKK

SEQ ID NO: 138553 - protein, 202 aa, Triticum aestivum
  Clone ID: PAT_TA_32971.pep
MADAEAPAAKRLARAGSFSGVWWKLGDPAGDPAAVERRLRAVADEEAAVRARISRRHAGACGVRRGIAVASLAIEVVALVHAYWTARRRRVAGWSRKLLLLLAPPLLAVPASAAVVVAAFARLHNMFEARDEQRLRALVAERKAKIGQFRGSHHNMHKLIEVSTKYDPDAAAAATSDQPVTAAAARRIKRSHSRLSFHIGDD

SEQ ID NO: 138554 - protein, 231 aa, Triticum aestivum
  Clone ID: PAT_TA_32972.pep
PRVRFSVPSLSIPIRSTPPAPHRGTAVPSSSAPPYPILVSSPSRAFAAVPRHRRPRRRDSAWSTLVGRWWRVRTYRGEVVVGAQPFVSSRSCRGGQGRIVAGEKSAAPRRRRRRRQGAEAHLDSGDARAGCRLSGESRRRRRRRARCRMRRGRDAPSPSRLLESQRVELEMVATLLARQGCRVVQSRERAGLAIDFADLALQAVSWAPGRDNSSLTPDSRPLAFFPSQCFL

SEQ ID NO: 138555 - protein, 261 aa, Triticum aestivum
  Clone ID: PAT_TA_32973.pep
GVDFPSSPASKQMEEIQRKLAVLAYPRASAPAQSLLFAGVERYRLLEWLFFRLLGDRSPFTQQNWQGDSLDRDEENSRIQHLAEIANFLGITPSVDTEAIQGRGSYDERVELLRLIVDLVEASCYADNPEWSVDEQLAKDVQLVDSIAEKQAQIFSEECKLFPADVQIQSIYPLPDIAELELKLSEYTKKMSNLQQMVQELASKYDYNPNEDYAETELKLREHLQSFLETVKSFNMIYTKEIHPWTHMMEVPQLHGFGPAA

SEQ ID NO: 138556 - protein, 310 aa, Triticum aestivum
  unsure (1)..(310): unsure at all Xaa locations
  Clone ID: PAT_TA_32974.pep
SPPPPRRARRPPPLPPARASTRPGWLFFRLLGDRSPFTQQNWQVDSLDRDEENSRIQHLAEIANFLGITPSVDTEAIQGRGSYDERVEFLRLIVDLVEASCYADNPEWSVDEQLAKDVQLVDSIAEKQAQIFSEECKLFPADVQIQSIYPLPDIPELVKLSEXKKMSNLQQMVQELASKYDYNPNEDYAETELKLREHLQSFLETVKSFNMIYTKEIHPWTHMMEVPQLHGFGPAANRLLEAYNTLLKFLGNLRSLRDSYTAMAAGSLSNSSEPSSVTKIISDCESALTFLNNSLAILSTSVAREQGETL

SEQ ID NO: 138557 - protein, 377 aa, Triticum aestivum
  Clone ID: PAT_TA_32975.pep
MASALGAQVAAVAPIGSDGRHYRSCSSLKGNNSRNKSWTGKLAWENKTLQPRHTKVFCMSVQQASKSKCKVAIKPLELENTKEPPLNLYKPKGPYTASIVSVERIVGPKAPGETCHIVIDHGGNVPYWEGQSYGVIPPGENPKKPGAPNTVRLYSIASTRYGDSFDGRTASLCVRRAVYYDPETGKEDPSKKGICSNFLCDSKPGDKIQITGPSGKIMLLPEDDPNATHIMIGTGTGVAPFRGYLRRMFMEDVPSFKFGGLAWLFLGVANTDSLLYDEEFTNYLQQYPENFRYDKALSREQKNKSGGKMYVQDRIEEYSDEIFKLLDDGAHIYFCGLKGMMLGIQDTLKRVAEQRGESWDQKLSQLKKNKQWHVEVY

SEQ ID NO: 138558 - protein, 171 aa, Triticum aestivum
  Clone ID: PAT_TA_32976.pep
GVNEAYRGTLSSYAYVLMCINFLQLREPKILPCLQAMEPTYTLTVDGTECAYFDRVDQLQGFGAGNKASIGELLWGFFHYWASQHRYKRDVISVRLGKTIRKQEKGWTTRVGGDRHLMCIEDPFETGHDLGRVVDRQTIWIIREEMERAATVLQNDDDPCATLFEPYGYDL

SEQ ID NO: 138559 - protein, 44 aa, Triticum aestivum
  Clone ID: PAT_TA_32977.pep
VLNEKVRMYLSSMRRPSSIISEARSFTSNIFDSKICLRKWSFCY

SEQ ID NO: 138560 - protein, 220 aa, Triticum aestivum
  Clone ID: PAT_TA_32978.pep
ARSLWHRAKSILQTQLKAARRGRSTRVEAVNRSTYIRWKLAPTRREQEQWDRATRATTGGIDVILRESQQKVQLKGDPKVVAAEAREQYLKLKERLQLLTLGIGGVGVVSAYVSYTPEIAASFSAGLIGSLVYLRMLGTSVDSLAGGTKAAAKGAAAQPRLLIPMVLVMMYNRWNAILVPEYGFMHLELIPMLVGFFTYKIAMFTQAIQESVPDVGNHEV

SEQ ID NO: 138561 - protein, 278 aa, Triticum aestivum
  unsure (1)..(278): unsure at all Xaa locations
  Clone ID: PAT_TA_32979.pep
ESELRYSTSYHPQTDGQTERVNQCVETYLRCMTTTQPKKWCSWLPLAEFWYNTTYHTALKMSPFQALYGFPPPMISELAIPGPEDEEAQNFLAAKQDMLEQLKENLQQAQNRMKKYADLKRSERVFEVGDMVYLKMAPYRLAAFGFRGALKLQNKYYCPFLITQNIGKWAYKLQFPAHVQIHPVFHVSQLKKHIGAKSIPSPNLPMVAADGTIKTGPAAVLQVRQVPRHNLPVVQWFIQXKNLSPEEATWEDADFIKYTFPAFFRAVTEEWRANQQAP

SEQ ID NO: 138562 - protein, 196 aa, Triticum aestivum
  unsure (1)..(196): unsure at all Xaa locations
  Clone ID: PAT_TA_32980.pep
AGRIEKLQKEIENENQAAVQLQYELEVERKALSXARAWAEDEAKKAREHARALEEARNQWERQGIKVVVEAGLEEDASAGVTWANAGKEHPVDEAINRAESLLEKLKSFGGEMKVRSSHALERVMQYVRSLISSLKERAAEARQGCADLGAAAASKAKNVSSEAKAFGSSVADRSKKVVEECKDGLEKFVHRFKTD

SEQ ID NO: 138563 - protein, 90 aa, Triticum aestivum
  Clone ID: PAT_TA_32981.pep
LLKLMCPKESRSITTYFKGIFIQFFYILYYPVRMHGLTTSESNSSTHTLFNSPSCLSKDEWYDDCYDHVDSFEISLFDDACYACGQDANM

SEQ ID NO: 138564 - protein, 147 aa, Triticum aestivum
  unsure (1)..(147): unsure at all Xaa locations
  Clone ID: PAT_TA_32982.pep
SPADGPNNAGRSGDPTPTRAQEPVESRVDHISDLSDSVLGEIISLLPTKDCCRTQVLSIRWRPLWRAVPVNLDCRHLALFNDFEIPRAIISSHQGSVQSLYIPXFYLSKHSMPCMVDAWLESPEFTELQLLEFNYSPWKSHTTYRMP

SEQ ID NO: 138565 - protein, 161 aa, Triticum aestivum
  Clone ID: PAT_TA_32983.pep
EYFLASMAKMITANDDVPASPRGLKELLACYVLPRPRCRKSTTAASLLLHLRAASFLLCLAPPPRTRRTRRCCVPREPSKRELAARMIHASNNTSALRPQSGAPSPPLGARTGQDLPRADAAAALRSENRRSLCRLITRTSCRPWRRRTPPAVRLRNMIRG

SEQ ID NO: 138566 - protein, 153 aa, Triticum aestivum
  Clone ID: PAT_TA_32984.pep
SGSNYQTEEDETDTAIDFGNLLPRAPRKHRSRSAHPREGGGHDDEERMMDKLLRHYSKKGMEREEEHKTRSKSRTPRPRADRPADGNNRDGAPSHPERTASLPTESGSPVGRTKAPAPVRSTSLQQDTSRGNVHPKMPDFDELAARISAMKRA

SEQ ID NO: 138567 - protein, 183 aa, Triticum aestivum
  Clone ID: PAT_TA_32985.pep
MAGAARKKLVGRYEVGRTIGQGSFAKVKFAVDADTGAPVAMKVLDKATILNHRMLQQIKKEISIMKIVRHPNIIRLNEVLAGQTKIYIIMELITGGELFDKIARQGKLRENEARKYFQQLIDAINYCHSKGVYHRDLKPENLLLDSRGNLKVSDFGLSSLSQNGFLHTTCGTPNYVAPEVLSD

SEQ ID NO: 138568 - protein, 327 aa, Triticum aestivum
  unsure (1)..(327): unsure at all Xaa locations
  Clone ID: PAT_TA_32986.pep
THASAIFFSGSNATRPTHKLASERKLKKPKQERKAAAAAMAGGDRERDVEEETRNQMMQNLFGDQSEDEEEDDPIEVADDDDQGPPQQMQRHRQVLDQEEDEEEEDEGRSHGPAHDAYHSEEGEGEAENGGEGEAEGEGESEGQLGMEEESETEAHPADLDQGESDPEKVQSSPERELSDGVMQTDARGMDSEEDGYEQQAVPSRRREVVASESEGSEDNYYAGQAPEDEEAPQRKPRSFPMEEERDHEVVRDVFGDSDEDEPAPYHAPHEIDEDSNPMEDELQYEKDLQSDDDAADDDIRYDSDDNREPKTKXKPVVPPLNLVGPR

SEQ ID NO: 138569 - protein, 307 aa, Triticum aestivum
  Clone ID: PAT_TA_32987.pep
MALSRRLLLFLSLVAITAVTGTSEIIVTRCYPPPTPTVNGSTSAFRRDLLSLLDAVPSATARTGFASMRTGGAFARGLCFGDPAPDPCFRCLSDAGGKITDLCGHANRRAGFLTDGCFLGYSDANASSAGADDDDISGVTFSGDAVPRIDNVDVLKLVAVARSLVPRSANGQVAAADATATASNGYTVRMLAQCATDSAPAECARCLRDSSLQMAKSWSLTLTAGVDVQGSVAAVLGPNCYLRFEISAPPLPVREKIRRIVKDNLVLTVCIGFIVAGVIILLLVHVCRLVTRKLGNAAAAPAAEGKP

SEQ ID NO: 138570 - protein, 87 aa, Triticum aestivum
  Clone ID: PAT_TA_32988.pep
GERRTSCCLAMWTERIYHGTLPLPCCCLPLRPEFMAMIPATRPARPCMCIQDFCIVVGQSNLLPLLSGVNLTVLWLGQSSLDFGLCP

SEQ ID NO: 138571 - protein, 114 aa, Triticum aestivum
  unsure (1)..(114): unsure at all Xaa locations
  Clone ID: PAT_TA_32989.pep
NTLCIGKREDDAKAIKRFQRXKGKRTGAWFKGIFGLASSSNVCCELXGVYVESLKHTREDNVEFDHKRSKTIVIEGDDDMQMDSRLVLCIKHSEHSLAECEQLLSCSSCNMFLL

SEQ ID NO: 138572 - protein, 156 aa, Triticum aestivum
  Clone ID: PAT_TA_32990.pep
TLAQLFFTPPPFPRFDSRLPRRTGARRCGPPHPPATSSCATVSRRLVGFVFISHGHGFGQHGTTSSGSSRSPPLHHRRATASIYSSPTVPGNLEPSPSITVRSASIPFSSRRCSCSLAALPRDPLRPPHQLVVVVVLVCLSSHPRRGSMRRLALVS

SEQ ID NO: 138573 - protein, 195 aa, Triticum aestivum
  Clone ID: PAT_TA_32991.pep
MSSTNPPSATSHVVLTRHPLEHGCGLSEWQSRCRGTDSMSFKKGLLQASASPSIPFCRRCPMSTTAQEPPHVLAVDDSLVDRVVISRLLRSSKYRVTTVDSGKKALEVLSLGHESVQLIITDYCMPEMTGYDLLKRVKESAELRGIPVVIMSSENSPARIRRCLDEGAEEFLIKPVRPSDVSRLCTRAIAAMPMR

SEQ ID NO: 138574 - protein, 124 aa, Triticum aestivum
  Clone ID: PAT_TA_32992.pep
DDGDHKQSSGVSISSTLSSTDTIWRPTQTHGPSFGASNHCQLPPYPGGLPQPMGGDQNPMRCCCTFPSVSNIPNQMPEYWNGGANSYMAPGGYDTFYQNWTNGSADPGLNSAQVDLSYSMYTLF

SEQ ID NO: 138575 - protein, 239 aa, Triticum aestivum
  Clone ID: PAT_TA_32993.pep
QEGARTTPTPHRAAAPAPPPKEGANSDRVHGRIPNPHLPGRRGGHLQHAGAQGEPPARPALPRRRLDRRPGGPPPRRARLPRPPRAALAAGRRGHRPRRPAHGGHPGGPQPGGADREQAPPRAVRPGRGRGGLADARLPASALFASRADAVVNPPWPVSTSSPAPASRSSLALPPRHLPAPRLPPPPGRDRDRPWAGAGPNPDGLDLEKTSGGTGKERFAPSRRPRLCASSVCGLSVCA

SEQ ID NO: 138576 - protein, 136 aa, Triticum aestivum
  Clone ID: PAT_TA_32994.pep
NAFEMITLSQGLNLSSLFDRQQEYVKRQTRFVSRKPAKTIAATIEVVADSMGLKVHSQNYKLRLEGVSSNKMSPFAVVLEIFEVAPALFMVDVRKVAGDSLEYHRFYKSLCSKLESIIWRPIEVSAKSALLRTTTC

SEQ ID NO: 138577 - protein, 251 aa, Triticum aestivum
  Clone ID: PAT_TA_32995.pep
MPADDDVKAETRVDFAFIGFHLLSSDENPLSFRVACICKDGSRVRAAIFSPETWDWVIHPWAELEIGGDSSLKFKAGSVVDGSIYWPCHGQRCMVRINTATMDITTMDLPAQVKVDGYNFKAAETKDGALCIVYASDDFVLHVWIDGMDGDGIQTWIPHKTISLRPEMRRVTRGLLGDLKVVQVRDGYAYLSTTSMSHVGLLCCWFFSLSLETMKLDLLIQGRYDGRGYPYFMAWPPSLVGDGGPQLESSY

SEQ ID NO: 138578 - protein, 157 aa, Triticum aestivum
  Clone ID: PAT_TA_32996.pep
MSTYGEKVGMFGGSNGDVYDITELTNSAPSSLRSLEIWSTSGHEGIINAISFTFVDSKNNMNKAGPWGTPLPGQKSKTIHLTNVRITELSGYSYGGYITSLTFRTTDAQKHHGPFGKVRPKAGVDTHFRIPLMNGSIVAFCAQADDYLSAIGAYLKI

SEQ ID NO: 138579 - protein, 349 aa, Triticum aestivum
  unsure (1)..(349): unsure at all Xaa locations
  Clone ID: PAT_TA_32997.pep
KQIDDAECYLXSGSFDQAVLTALSVSDQIRAANRERVCEDDELLEMLELVGIVLVQALKELRRTTEMFVQLKAMYGSVASIPVKVFLTGATMLMAEGSGPDLRPIFEDFLAKWRYTDDQVYVLNGEQERSSNGLIVTSTMATEEYLEVVEFYTVTFLSIASGEPENAISWVEKAELIEQDRQELLEKLYALQAAANEKSSTARGAKQSAERNFPASDKGPTPATHEDGPTSATRAPNVKTNGLPKSIEPSLQRVANNFDPMFWWFHSVRVKFGRMHIVLPSGKLMLLFSLLFSTVYVLRRKGAGLKRVVLQHASSLRRAFLDALQLAFSVQMNPLAAVQQTPQAPRGSW

SEQ ID NO: 138580 - protein, 343 aa, Triticum aestivum
  unsure (1)..(343): unsure at all Xaa locations
  Clone ID: PAT_TA_32998.pep
KRKGSVPSKSGSAAAGHASYEYEEESVHTPRALKLFTCTCLPPKAQDXKARPFPCHGFAAGCSATMRGTGXRLAHAGYAVYGVDYEGXHGNEPEGLPGLISPSFDLLVSDTDAFFTAVVASTANTDLRFILGESMGGAVALLFSSMRPAYWTGAVLVAPMCKIADEMRPHPVVVSVLKLMTNIIPTWKIVPTTDVIDAAYRMQEKRDEIRNNPHCYQGKPRLKTAYELLKVSLNLENNVLSKVSLPFLIVHGGDDKVTDPSVSDLLYRSAVSQDKKLNLYPGMWXHALTSGESPENIHTVFQDIIAWLDQRSSPKSSSSAAALDLSSEMEQKAKHDEQNIDKQ

SEQ ID NO: 138581 - protein, 109 aa, Triticum aestivum
  Clone ID: PAT_TA_32999.pep
MRGARRQRRRPRERDVAAWPFFLACCLLALAVSRAEEPRASPVRGRGGGGEDQRLSRVGSSPPCCVCERRCGGCAPCTPVQVRAGVRPLCANYEPVRWKCKCGDAVFDP

SEQ ID NO: 138582 - protein, 207 aa, Triticum aestivum
  Clone ID: PAT_TA_33000.pep
PRTDGAIHHPMATDTFVTDVTFGADVIVTTVTNSGAAVEGWLQEIRSVLGDLVVGVDVEWRPSYSPSQNPVALLQLCVGRRCLIFQLLHADFVPQALSGFLADPNLRFVGVGVQEDVERLSDDHSLDVANAVDLRGLAAEGMQMPELRQAGLQAVARTVMGANLQKPQRVRMGPWDAYCLSYDQIKYACIDAFVSFEVGRKLLTGDL

SEQ ID NO: 138583 - protein, 126 aa, Triticum aestivum
  Clone ID: PAT_TA_33001.pep
PAGSGARKASRSFTWPPPLESSGNPDAGAKIFKTKCAQCHTVDAGAGHKQGPNLHGLFGRQSGTTAGYSYSAANKNKAVEWEENTLYDYLLNPKKYIPGTKMIFPGLKKPQDRADLIAYLKKATSS

SEQ ID NO: 138584 - protein, 113 aa, Triticum aestivum
  Clone ID: PAT_TA_33002.pep
MASFSEAPPGNPDAGAKIFKTKCAQCHTVDAGAGHKQGPNLHGLFGRQSGTTAGYSYSAANKNKAVEWEENTLYDYLLNPKKYIPGTKMVFPGLKKPQDRADLIAYLKKATSS

SEQ ID NO: 138585 - protein, 354 aa, Triticum aestivum
  Clone ID: PAT_TA_33003.pep
LLTPDITIMSVGTVIAYGQEMTPDVGWEEFLNNKWDRDIVVQETAKFPQLKPQPERNQGPREVSFFVDKQGAQEVINYLPQKLEQLGLYVKIIYSSGEALDVLPRGAGKGQALIYLLEKFSSSGKPPSNVLVCGDSGNDADLFSVPSAYGVMVSNAQEELLQWYEENGKDNLKLLHATERCASGIMQAIGHFKLGPSFSVRDLEFPYLKVDTIKPADVVVKFYVLYEKWRRGEVQKSPSVVQYLKSITNGTLIHPCGMERSLHASIDALSSCYGDKQGQKFRAWVDRLFTSPISTSNWLVRFDNWEMESDVQYCCRTTLLLNTKPETPEGLELTHIHKTWLERYSAGNDHTFIL

SEQ ID NO: 138586 - protein, 156 aa, Triticum aestivum
  Clone ID: PAT_TA_33004.pep
MSGATETATWEEMLRRMLPPGTAIPEGAAGNLDYSIALEYDGPPVAYEVPRIAPVDMADVPTAEPVSASYGLLGNGGATVPVAPVFRPPASRARAEPTNPRRGAGPADSAPRDEALKPGSRARPQPPTIGWILPSSIKGLDKAIPISGFKKKGGLK

SEQ ID NO: 138587 - protein, 285 aa, Triticum aestivum
  Clone ID: PAT_TA_33005.pep
FSHCFVPFFLFLLVLHDNGIDDKQQHVKELQDTLHPLDIARQKYFFTDDATPSCRILPDHDDCGNQIIEPELWRPLEMNSEEYNSQIEEAKKKYPCNASKDEQEVQGDSSIQCAQRQPVSTGICKYRDFLPQFEEKDGIIDLTSPVARMSHTWGRATTYYSRMGKWNNENAESPTQKHKKRYSTTAILGKRLFSDEFDENDEQESTKHQPIPVSPDVQVLGERSFNGSCSSMVNTADNLYNTKLSLGTSSSGKENLPPKRITHPSKWLSSPYDHNERGPLQATWR

SEQ ID NO: 138588 - protein, 142 aa, Triticum aestivum
  Clone ID: PAT_TA_33006.pep
FTKQTVGNACETVGVIHAIGNAASDIKLVEGSYFDRFYKQTADMDPVQRAVFLEEDDEMEGAHAVAATAGDTDVNVEVNEHFVCFSCVDGELYELDGRKSKPISHGPSSPETLLQDAAKVIKARIATNPNSLNFNVMVLSKQ

SEQ ID NO: 138589 - protein, 412 aa, Triticum aestivum
  unsure (1)..(412): unsure at all Xaa locations
  Clone ID: PAT_TA_33007.pep
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAVVTGKPIDLGGSLGRDAATGRGVMYATEALLAEYGKSISGSTFVIQGFGNVGSWAAQLIHEKGGKVIALGDVSCTIRNKAGIDVPALMNHHSNEGGQLXDFHGAEVMDASELLVHECDVLLPCALGGVLNRENAPEIKAKFIIEAANHPTDPEADEILTKKGVVVLPDIYANAGXVIVSYFEWVQNIQGFMWEEEKVNMELHKYMNSAFQNIKAMCKSQDCNLRMGAFTLGVNRVARATILRGWEA

SEQ ID NO: 138590 - protein, 428 aa, Triticum aestivum
  Clone ID: PAT_TA_33008.pep
RTRRSFLTECLQWNSYMRGCGPVEASMLFFSGYIAFWSNFATLDERTGVIVSRRADRHFEEEGPILCAALDGMKLPSFPEYEVRVRYATEHRCGVVVKGPRLSGNISGTDRLKDNRLHLKAEPFDDSEEAKNTAALVNELSNEITCILVSQPINAKRAVEGKNIANVVLLRGCGIRIEVPPFETKHGLTPCMVAPTKIIAGLGLSLGIDILEAPGATGDYRTLLTSKAKAIAKALSAPLDTPPRVFVPGEDEYKAGRENGYDFGFLHIKAIDDAGHDKAVKLKVRGLEAVDRAIGQLARLLWEAEKSGHYQYFLCVTGDHSTPVEYGDHSFEPVPFAICRLRDFVGAIGEGNVMNTPLDDFPLPLVKSGEDLTDDSEPAEHKPGERKAFSGDTVCEYTEIAAARGCLGRFPGSEMMGIIKKFMKAKND

SEQ ID NO: 138591 - protein, 116 aa, Triticum aestivum
  Clone ID: PAT_TA_33009.pep
GYQVNQGSEFCNNSTGFSSNSIGSKEANPQQDLNQYTSFYNIVTVHMNLTSASSFTYTSSKMAGTRDERQCTVVNCDSKECQKPIELSTLTKLPVHSSYFHLPKKIGCSLLSELTT

SEQ ID NO: 138592 - protein, 666 aa, Triticum aestivum
  unsure (1)..(666): unsure at all Xaa locations
  Clone ID: PAT_TA_33010.pep
CDKRYXGYCLLRAMGSMPEGRKCITCIGRPIYEGRRSKLGKSSRILSRLLSSLEVRQILKAEKECQANQLRPEQLIVNGFPLCQEEMSDLLSCPRPPQNLKPGRYWYDKESGLWGKEGEKPNRVVSTNLNFNGKIQPNASNGNTQVYMNGREITSIERKILRFAQVQCPRDTHFWVYHDGGYEEEGQNNIKGKIWESPLTRFVCTLVSLPVPPANSVEPRDDAPYSARTVPEYLDQKRIQKLLILGSPGAGTSTIFKQAKLLYGSRFTPEELDNIKLMIQSNMFKYLGILLEGRERFEEEALAISNNPNSEDEDTQQDGNESNGLNSCIYSINAKLKKFSDWLLDIIAMGDLDAFFPAATREYAPVVDELWKHPAIQATYKRKDELYFLPDVAEYFLSRAIEVSSNEYEPSEKDVLYAEGVSQGNGLAFIDFTLDERNPMSELYGDSHDPSSQAQNKYQLIRVNAKGLNEGCKWVEMFEDVRAVIFSVALSDYDQLGAPASGTSRRLENKMIQSKDLFEATIRHPSFRDTPFVLVLNKFDIFEEKIGRSPLTACEWFSDFDPLRTHNNQSMAQQAFFYVAMKFKNLYAAHTGDRKLFVWQARARDGPTVDEAFRYIREVLRWEDEKEYGGFCPDESFYSTTELSSSRLVEQDWQQHPAADQRQGST

SEQ ID NO: 138593 - protein, 198 aa, Triticum aestivum
  Clone ID: PAT_TA_33011.pep
MALMLSPAATFLPVAGKPAAAMRNLLFGTSSKGRSVRKVVAMADILGDFGARDPFPEEIASNFGEKTLGNVDTLHRILIPTLSVLSLSRVPLDADPAPLSEEDARKLLFKVVGWRLLFPSKGDSDVLKLECVWKVRDQACGDELIARINKTLDGAGHAPAALQFEAPNQVRAQLYPPSVGGLRANDFIVARTIAHNRT

SEQ ID NO: 138594 - protein, 207 aa, Triticum aestivum
  unsure (1)..(207): unsure at all Xaa locations
  Clone ID: PAT_TA_33012.pep
VLPWRTRMRIAHDAAQGLEFLHETANPPVIYRDLKSSNILLDEGYNAKLSDFGLAKLATPHHPXGKGGDAEEEKDGSSRVMGTYGYCAPEYVRKGHLTVKSDVYSFGVVLLELITGRRVIDDSRPSGEQNLVAWAAPMFSEQRRMHELVDPLLVEGPTGRELKQAVAVAAICLQEEDTVRPIMSDVVMALSFAADDDLPSAPRYTSL

SEQ ID NO: 138595 - protein, 139 aa, Triticum aestivum
  unsure (1)..(139): unsure at all Xaa locations
  Clone ID: PAT_TA_33013.pep
SFFFPSVHDEHWFLFVVDIXQESFVFLDSYYEXSLSFRNGIRDLKFVNFIKTWEDSNLRGMSFRKFGVEYPNMPKQIGSDACGIFALNWMQTWASRNPMQRQFTMNDVANARVRFAVDILFSIHNTEDQGKILVKNFAW

SEQ ID NO: 138596 - protein, 133 aa, Triticum aestivum
  Clone ID: PAT_TA_33014.pep
LQPTGEQVVGYSWAAWRCSCCHCHTHPHSCWGCLAVQQRGGGGGRPAIHGTAELLWRSRRHPRLSDGSRDRDGRCIPIRPQLPSSYCSGGLPNLILLDACGSGFTTLFGLHQLAISAIGILRNGAAAIQMRRH

SEQ ID NO: 138597 - protein, 296 aa, Triticum aestivum
  unsure (1)..(296): unsure at all Xaa locations
  Clone ID: PAT_TA_33015.pep
DGQTTVRPLPPSCRLLPLISSPPPPHSLHVAKTLIPRQTHAWARARPVAPTMSAQLDAALSAGFVRLLNAGQEDADCGGGHYDPKSGDYAVGIVVSGTEARLDVAVGADRLATLLTKELLPLCRAKLRTGGAKPAPPRPGSVGVLEASPVDEETQNQKRGARTLVPPGTVVFAEVLGRTLSGRPLLSAXRRLFRRLXWHRASWARPGEPPGRVCAPRGPAPRAPPGVRGPRLGLPPVCRSAARGGRGSAVLCPRCSPRRGGASCGRACFRWAPGCSVSCLGARRVGAAPGAGRCGG

SEQ ID NO: 138598 - protein, 258 aa, Triticum aestivum
  Clone ID: PAT_TA_33016.pep
VIKPTLDSKQTAEPKPAPKKKKKKKKQPAEVQAQPAAPPPTQKEQTSQTPSVGGTVEAAKKDPPPVRPYAHVAEDSDTKKPPPPELTGRRVVKENPFLLRDREAKNADGTAAAPKWRRRDPFEGYPERRPPGASGGGVVLYTTTLRGVRRTFEDCERARAAVEMCAEAAGLTVDERDVALHGEYLRELRELLAADEEQGAGVSPPPGLFVMGRYLGGAGWSRESGQGARARSRTSPPTSAAALQILIIPNTKQHFPPH

SEQ ID NO: 138599 - protein, 149 aa, Triticum aestivum
  Clone ID: PAT_TA_33017.pep
PTRPAHLGRPTYMGPPGSGQSSKIANQIAVAGAVVGLGESLAFAGAAGLDERLFLGAVSKGAAGSRVMDIFGERALSRDFTSGGAVRYIIKDLGMALEVGDGQEEDEVNVLPGSALYRQMFSAMAANGDGELCLQGLITVVERLNGIRK

SEQ ID NO: 138600 - protein, 182 aa, Triticum aestivum
  unsure (1)..(182): unsure at all Xaa locations
  Clone ID: PAT_TA_33018.pep
PRCSNSPFFLLETLLLDTPSIKSTPDRSSGSGEGEHRPPPPRPRPRGGPPPAAGAWSSPRTRPSPTPSGTASAAKEHDAAATPPPPHDHLPLPPHFHILKLGTCNGDTSARCRWDRACDALVEXLSSQSASNQHLLNSNSGTLSSKSVTNEKHVQRIQETLHQLKQRMELIKNYKSAVEEPH

SEQ ID NO: 138601 - protein, 131 aa, Triticum aestivum
  Clone ID: PAT_TA_33019.pep
DAAHHRSPPNPSDPICPLAAPRKEAASTMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 138602 - protein, 449 aa, Triticum aestivum
  Clone ID: PAT_TA_33020.pep
MGRNMALPLLLALAALVASLPSGSVATAGTAGAFDSWLSANQKDFAINQALYAKKAVGDTGSTIDESLSKAEDNKTTYVVDPKGGGDYKTITAAIDAIPEGNTGRVILDLKPGEYREKIFLNLSKPYVTFKSDPKNPAIIAWSDTAATLGKDGKPVGTVGSTTCAIESDYFVAYGVVFKNDAPLAKPGAKGGQAVALRTFGTKQAFYNCTIDGGQDTLYDHKGLHYFKDCVIKGSVDFIFGFGRSLYENCRIVSIVKEIAVLTAQQRTKTIEGAIESGFSFKNCSIMSEGGGDIYLGRAWGDSSRVIYAYTEMSKEVVPVGWDGWNIKQPESSGIYYGEFKCSGPGSDARKRVGWAVDLTEAQAKPFIGTHYIFGDSWILPPPTGNSPPSKKGYSGGAPATSPASSPESADSASSPESADSAASPKSASKASSPKSAYSAGSKTKKKEL

SEQ ID NO: 138603 - protein, 95 aa, Triticum aestivum
  Clone ID: PAT_TA_33021.pep
TPQSPSPDRSPLASVTALDNSPDPPLSWSSSSKRRFPKEEDDPIVVLHPSHATVSATLWISGGRSRCPQPADELAPNSPRNTCRVIVLEASVPSD

SEQ ID NO: 138604 - protein, 242 aa, Triticum aestivum
  Clone ID: PAT_TA_33022.pep
PELRPEHHLAAAGLGVAVLPEHVGEAAGAGRLRTQSGRLHVSLPEASLREEGRQGGAAELLGLENGGGAHGGGRPLLRAVQEPGLRQRHVRPRGRRRLSSGSGEGLRLRHETSAPASGTNRSPRSVPQHRLRRTDGRTENHKATSPDGRIEPEPLQLQWPPPLPTHLPRSRLCQGPESRSEIERGARWKTSRAVVGKGMLAEVGGRGEAGEESTNSAGNRPRMSTRPPRKPPESPRAGPSCR

SEQ ID NO: 138605 - protein, 113 aa, Triticum aestivum
  Clone ID: PAT_TA_33023.pep
GAGEVDGPASPNKEINQQTLVPQRKKARFVLPKSAQVDAEARSELQDLMDAREAGMSFILGHSHMKAKSGSSFVKRIVINFFYEFLRRNSRGPSYAANIPHASTLEVGMVYQV

SEQ ID NO: 138606 - protein, 140 aa, Triticum aestivum
  Clone ID: PAT_TA_33024.pep
GARLAFNIWDVAGDSQSADHVPIACKDAVAILFMFDLTSRCTLNNVTDWYERARKWNKTAIPILIGTKFDDFAQLPLEMQWTIVDEARAYARAMKATLFFSSATHNINVNKIFKFITAKLFNLPWTVERNLTVGEPIIDF

SEQ ID NO: 138607 - protein, 140 aa, Triticum aestivum
  Clone ID: PAT_TA_33025.pep
STRATPGSGELAIIAILYKLGAPDSFYYQLKRKLAELAADRCSYGEQDARVATGLVHLRSLEKRTGSYFRYMGSLTAPPCAENVYWNVLGKVRQMTKEQIDLVTAPLPAAAKQNARPVQPLNGRVVTFYNPPNSTISFDM

SEQ ID NO: 138608 - protein, 110 aa, Triticum aestivum
  unsure (1)..(110): unsure at all Xaa locations
  Clone ID: PAT_TA_33026.pep
PQDLTFVIDNQPHDTXTLTEGNNLLVSQEIPLVDALAGTTINLRTLDGRSLPVRVEEVVRPGQEIVIENEGWPIRKEPGKKGSLRIRFDVAFPARLSSSQRAAIRRIMGS

SEQ ID NO: 138609 - protein, 110 aa, Triticum aestivum
  unsure (1)..(110): unsure at all Xaa locations
  Clone ID: PAT_TA_33027.pep
TGKESSGKCTTGGKCHCSKRRKLRIKRSIKVPAISNXISDIPPAEXSGRKYGQKPIKGSPHPRGYYKCSTVRGCPARKHVERCVDEPVMLIVTYEGEHSHNRLPTQSAQT

SEQ ID NO: 138610 - protein, 82 aa, Triticum aestivum
  Clone ID: PAT_TA_33028.pep
SSSLWTNSADAVFFKETVPSKVCKPRVLKPRAGAAGADGPTRAGRWRWRVAERTRGWILAAAAARTVPETGGEWSAGGRISR

SEQ ID NO: 138611 - protein, 212 aa, Triticum aestivum
  unsure (1)..(212): unsure at all Xaa locations
  Clone ID: PAT_TA_33029.pep
HNLIADVATKDEIRXIAQLKRELSXTDSTYDSEKLAERIAKLSGGVAVIKVGAATETELEDRKLRIEDAKNATFAAIEEGIVPGGGAAYVHLSTLVPAIKEKLDDPEERLGADIIQKALVAPASLIAHNAGVEGEVIVEKIKDSEWEFGYNAMTDKHENLVEAGVIDPAKVTRCALQNAASVAGMVLTTQAIVVEKPSKKAPAPAGMPQGMM

SEQ ID NO: 138612 - protein, 427 aa, Triticum aestivum
  Clone ID: PAT_TA_33030.pep
LARPTPSMDIKAIAAISAGNDDFIGTMIVEAINKVGPDGVLSIESSSSFETTVEVEDLPIPSSWPVRARLGAPPGMEIDRGYISPQFVTNSEKSVVEFENARVLVTDQKISSIKEILPLLEQTTQLRAPLLIIAEDVSGEALATLVVNKLRGILNVAAIKAPGFGERRKALLQDIAIVTGAEFQAKDLGQLIEQTTVEQLGIARKVTISGSSTTIIADVATKDEIQARIAQLKRELSQTDSTYDSEKLAERIAKLSGGVAVIKVGAATETELEDRKLRIEDAKNATFAAIEEGIVPGGGAAYVHLSTFVPAIKEKLDDPEERLGADIIQKALALVAPASLIAHNAGVEGEVIVDKIKDSEWEFGYNAMTDKHENLVEAGVIDPAKVTRCALQNAASVAGMVLTTQAIVVEKPSKKAPAPAGMPQGMM

SEQ ID NO: 138613 - protein, 151 aa, Triticum aestivum
  unsure (1)..(151): unsure at all Xaa locations
  Clone ID: PAT_TA_33031.pep
RGKKKNKQQNGXGDGDAATEKPQQQQQQQQPKTKQPQPQQAMPPVPAPGTGPERAHGHGGPFPYYAPQPVMSYNMAQPSASVSYYAPTPVASMQPMPPPPPYGGYSPYPPMMMPPPPPEYMYGPPGMRSSPPQEPYNSMFNEENPSSCSVM

SEQ ID NO: 138614 - protein, 511 aa, Triticum aestivum
  unsure (1)..(511): unsure at all Xaa locations
  Clone ID: PAT_TA_33032.pep
IRPRVRKEKPLSLKDLKALVLILKQALWQLLWIIPSHTSPSQKALPNPLGLKIMVIDSLRSQARNGLSELLTQAQDWNSRLPFTAESDFYSXSNSENFVSQAILGNTRASEIIKLAPFLAPFTIRVKIFTSQLANSKQSTASHSALTRHRFKIRRSRLLEDAFDQLSLLSEEDLKGPIRVSFVNEHGVEEAGIDGGGIFKDFMENITRAAFDVQYGLFKETVDHVLYPNPGSGLVDEQHLFLKYCSQIRLSVFVGYGIPHSSCVFGPARCKLKEKSNFLNDLPSLDPELYRHLLFLKHYKGDLSDLELYFVIVNNEYGEQAEEELLPGGREMRVTNQNVITFIHLVANHRLNYQIRGQGRHFLRGFQKLIPKEWIDMFNEHEIQLLISGSLESLDIDDLRLNTNYSGGYHPDHEIIDMLWEVLKSFSSDNQKKFLKFVTGCSRGPLLGFEYLDPKFCIQRAGVPGLEEHGDRLPTSATCMNLLKLPPYRTKEQLQTKLLYAINSEAGFDLS

SEQ ID NO: 138615 - protein, 148 aa, Triticum aestivum
  unsure (1)..(148): unsure at all Xaa locations
  Clone ID: PAT_TA_33033.pep
FTNMGAVAQAAAMLGYEVIVGEAEQHSDLPAFARLVNSCDVLVXVHGAGLTNLVFLPPGAVVVQVVPLGGLEAMARDDFGEPAGDMGLGYVQYGRSDGESXLAELYPRDHRVLRDLALRSEYLVGQNVTLDVARFSGALSRALELLHH

SEQ ID NO: 138616 - protein, 355 aa, Triticum aestivum
  unsure (1)..(355): unsure at all Xaa locations
  Clone ID: PAT_TA_33034.pep
DPRVRPRVPKAGVFVAQAAGNGGPFPKTLVSFSPWITTVAAGVDDRRYKNHLILGNGKRIAGLGVSPATHGNKSFGLISATDALLGSSSTKYSALDCQRPELLNKRKVQGKILLCGYSFNYISGTASIKKVSQTAKSLGAAGFVVAVEDSYPGTKFDPVPVNIPGILITDVSKTKDLIDYYNSSTTRDWAGRATAFQATVGIADGLAPTLFNSAPQVALFSSRGPDVKDFSFQDADVLKPDILAPGNLIWSAWAPNGTDEANYAGEGFAMMSGTSMAAPHIAGIAALIKQKYPKWSPSAIKSALMTTANTIDKGSHPLRAQQYSTSEMMTLARATPFDYGSGAVNPKVPWDPGLX

SEQ ID NO: 138617 - protein, 310 aa, Triticum aestivum
  unsure (1)..(310): unsure at all Xaa locations
  Clone ID: PAT_TA_33035.pep
GLARRPHVVVATPGRIATLIKNDPDLAKVFARTKFLVLDEADRVVDSNFEEDLKVIFDCLPKKRQTFLFSATMSDNLRSLLELSGSKSYFFEAYEGFKTVENLKQQYIHIPPDGKELHLLYLLSKMKEDNIRSAIVFVSTCRTCQYLDFVLQELGRPAVSLHSHKAQSQRLSALHRFKSGQVPVLIATDVASRGLDIQTVDLVINYDIPRFPRDYIHRVGRTARATRGGLSICFVTQRDICLLHEIEDDVGNRFSAYECDDKEVTKDITKVFKARRLANMRMADEGHEDKVQDRKDQKKRDQXRKRKHDE

SEQ ID NO: 138618 - protein, 282 aa, Triticum aestivum
  Clone ID: PAT_TA_33036.pep
MAPPPNPNLPLQERLMALAQTLQFGWFVGHLTLILATIRYGFSWLRMNYYTGMAKFSYRTAFIAAAVTYGIVVYKTMRARAKSGQRAAPTPLAMLADENIQYLAMSLVWLFCPQYPLALIPYTIYSVFHVATYTRANLIPAVVAPRPAPEADGATPSRRTSVDHPIANKIGAFVKEYYDASMAIVASLEISLWGRIFLSAILFQRRSWILIVLYTAFLRARYTQSTHVQHSFFQLSARVDSFVSAQGTPPAARSIWQSVKEGARQFHDATALGNAGPAKKSS

SEQ ID NO: 138619 - protein, 198 aa, Triticum aestivum
  Clone ID: PAT_TA_33037.pep
MAAAGKFNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKKEDRRALAIKSRETPPKFGSPERQSVIDEIHEQMLSKAPPVPQLLTIGSEDETNKTAPDTSW

SEQ ID NO: 138620 - protein, 222 aa, Triticum aestivum
  Clone ID: PAT_TA_33038.pep
MAARRLAGAGRAVLSLPSVRRRATNSWSAVRDTFFSTKEVFESHRVVFTVGTSIASVLTAWAGYSLRHMQQTKIDKRLHSIEESLRNTHKVEHDEIKKIVTSYNISTSACIATALTTTVVGYALGWRGGAWYTRRIVRREQQKLMGQIKSQNRWHWRPFSKLRTRFRSNRHASKSSDAVPLPGKDAEASINKGQGAEALSNNAASANVGSGSQPAAAAAGCR

SEQ ID NO: 138621 - protein, 213 aa, Triticum aestivum
  Clone ID: PAT_TA_33039.pep
CPICLCEIEDPFRLESCGHMFCLACLVDQCESAMKSHDGFPICCLKTGCKEPLLVVDLKHLLSNEKLEDLFRASLRAFVASRAGMYRFCPTPDCQSIYQVAAPDAETKPFSCGACYVEICTKCHFEYHPFISCEAYKEYKEDPDLTLLEWRKGKANVKSCPSCGYTIEKSDGCNHVECRCGSHICWVCLENFRSSEECYGHLRSVHQSFVDIV

SEQ ID NO: 138622 - protein, 85 aa, Triticum aestivum
  Clone ID: PAT_TA_33040.pep
FFWNENLNGPKAHRLSAVTRIFRTCRTVGVAHSVCRSRTWTRQRSRRRHGDEQNDLEYNKQKNHVHVAPPSHGKMNIVALTALAR

SEQ ID NO: 138623 - protein, 110 aa, Triticum aestivum
  Clone ID: PAT_TA_33041.pep
MAPQKKSKKDANSINSKLALVMKSGKVTLGYKSTLKSLRSGKAKLIIIAGNTPPLRKSELEYYSMLSKAPIHHFSGNNIELGTACGKLFRCSTMAILDAGDSDILSDQQA

SEQ ID NO: 138624 - protein, 388 aa, Triticum aestivum
  Clone ID: PAT_TA_33042.pep
SGAFAIIAQSQVLGCFPRVRVTHTSKKYHGQVYIPEINYALMILCVAVTAIFQTTDKIGNAYGIAVVFVMFITTLLVTLVMAMIWKTSLLWIALFPIIFGGAELVYLSSAFYKFVEGGYLPLGFAAILMLIMGTWHYVHVHRYKYELKNKVSNNYVAELATRRNLARLPGIGVLYSELVQGIPPILPHLVEKVPSIHSVLVITSIKYLPISNIETNERFLFRYVEPREYRVFRCVVRYGYNNKVEDPREFENLLIGNLKQFIHQESLYSESSHSLEGEDNAFEESGDAMEPSVEVQDARLPKRFLDGITASPVNGLMDEIEFIQRGMDDGVVHLLGETNVVAEQNAGLVKKIIVDYAYNFMRKNFRQPEKITCVPHNRLLRVGMTYEI

SEQ ID NO: 138625 - protein, 69 aa, Triticum aestivum
  Clone ID: PAT_TA_33043.pep
FTLKCLNQTVLYSNYHYTWQRWNLSLPLRDTSRDYNPRECFIPSLHQPFIGLNSFTMCHRYSDNAWLRR

SEQ ID NO: 138626 - protein, 219 aa, Triticum aestivum
  Clone ID: PAT_TA_33044.pep
PTRPPAAAAEEHLRATGGETPGMVMVNAEPFEKMELALVSMEKLVQRAGNYAPSEDMFSAATASASAAPSTDDPAHAGLQEAPVETGVDLQPTSPELAEPPGYAVQSPMLLFPEIQEDKRNTTAEVDMSSEASTTDTSQDETNAEAETPHEQAVANDLFWERFLTDTPKPLAVEDSHESKDGVKMGLDCYWFGHRNNVDQITQQMGPLAFAQYAHVCRQ

SEQ ID NO: 138627 - protein, 285 aa, Triticum aestivum
  Clone ID: PAT_TA_33045.pep
AHSAASKILAQDSNLQAWVGLNGEDFFPAGAHTLEALRADPKATSLTRTGFNHAWGTVDKEPMFATFGKDPPRGKRFAVAMASLTGGEGYEVGHFVDSYDFSDVNANEGTFVDVGGSHGFVCVDLARKWSKMKFVVQDLPKTVSSAPNPICEDEGVVQRISLQAHDFFTEQPVRGADVFYFRWIFHNLASHYAVTILKNLIPALKPGARILINDHCLREPGVENNWDEKLMRSMDLLMLTLLNSQERTEKEFEELFKAADERFVFKGVTRSEGCRMSIIEAVWQP

SEQ ID NO: 138628 - protein, 258 aa, Triticum aestivum
  unsure (1)..(258): unsure at all Xaa locations
  Clone ID: PAT_TA_33046.pep
PRVRIYSLPFATICWNIVAALFILIGILLIVSSASKDTCQAMDEWADHPRAETALSNILPCVDASTTNRTLYQSKQVVVQLVKLVNRAISALSNRKERHLHPGQLMPYLCSPYDENLNDRQCLSKEVTFDNATTAWQDYTCNAPDADACSGPSTVTXPEIYSQLVTAANVSYALHHYAPPMLNFQDCKFVRDTFSSIASQYCPPLEHDLSLVSAGLALLASGLVLGLLLMLFADRPRKREEVSEQTSGFRVAPVDCSP

SEQ ID NO: 138629 - protein, 146 aa, Triticum aestivum
  Clone ID: PAT_TA_33047.pep
HDKQQLGSLTTGNIQGIRNCILEQFRQCWMPRPWLESHHLISRVWRRLGKAQPIAWPHSWSASGTSQRHPRTHDSSCVSHVLPPECVNTVLEDCVHQHLVHHSDCHPAGSGSIMADIRLFPSSGRLSRSPSMLLVPWLPPPHEEGN

SEQ ID NO: 138630 - protein, 474 aa, Triticum aestivum
  unsure (1)..(474): unsure at all Xaa locations
  Clone ID: PAT_TA_33048.pep
TRPVASTNRGCKAIAESGGASSVVFRDGMSRAPVARFPTARRAAELMRFLENPDNFDTLSVVFSRSTRFGRLQGVKCALAGRNLYMRFTCSTGDAMGMNMISKGVQHVLDYLEEDFPDMDVVSISGNFCSDKKSAAVNWIEGRGKSVVCEAIIREEVVEKVLKTNVQSLVELNVIKNLAGSAVAGALGGFNAHASNIVSAIFIATGQDPAQNVESSQCITMLEAVNGGRDLHISVTMPSIEVGHIGWEARSWPRQSAXCLDLTWASKRANKEPRESNARVHARVVAGAVPAGDLSVTSAQAAGHPGPNPHQIHTNDDGCGPGRRVVPHICTGNRRSGPEKQEKQQIQGGYDPYPPLSEADASQIGALPDAHLRNEVFAGYINPHVTFVGVDSQGMEVGSVLAMEEQSSAAVITDLFFHPGCLLIYFVLCCRAQRPPRVRPVFPAWIEPTDPFFLFHRIQYLPFRYGSGQLVVTL

SEQ ID NO: 138631 - protein, 283 aa, Triticum aestivum
  Clone ID: PAT_TA_33049.pep
MEEKATQKAAAEGNPSPELCLRIPGDYAVGSVPTVLYVPDFISQTEQSQLLHHIYQAPAPKWKILKNRRLQNWGGVVHEKGLLPQALPPWLTKITDRICQWTGLFPSAINHVLINEYHPNQGIMPHQDGPAYFPVVAIISLASRVRLDFTPHGKLRELEHTYLQNTQSDELQESNGSYKVEGTKEAGPASSSLLLMPCSLLIFKDQAYTDFLHGIQDNELHNLDKVANISQCPQFKHLSHDYSPGKADSSASSEPSGTFRRTTTRVSLTCRLVLNVHSKLFKF

SEQ ID NO: 138632 - protein, 94 aa, Triticum aestivum
  unsure (1)..(94): unsure at all Xaa locations
  Clone ID: PAT_TA_33050.pep
IVNIGRSLTADLPTTGFRSVEHRVVAKNAXPRFSIACFFSTHFHPASTRMYGPIKELLSDENPPLYRETLVRDYIKHYYSIGLDAKTAISDFRL

SEQ ID NO: 138633 - protein, 145 aa, Triticum aestivum
  Clone ID: PAT_TA_33051.pep
LHARLPSGGAGFYGNCYYIMRVSYTSQAAGSTTQSVTVNRVAALQEGLPSEFARWGAGEMASVDPYQITSDYRTLFVSDWTRLGFAEVDYGWGPPAHVVPLTNLDYIGTCILVKPWVHKPGARLITQCVTPDRVAAFHDALVDTN

SEQ ID NO: 138634 - protein, 225 aa, Triticum aestivum
  unsure (1)..(225): unsure at all Xaa locations
  Clone ID: PAT_TA_33052.pep
HASGVFCAKMTNTQCSESANHMLKSYVPPGCLMHMFVKXYMRLQFDREAEENYEEKRTRIVSQRLVIATSFVVLTSTFQGRTLYKANLAIERHAGKIXTRAMFEQFGHILYECGAYQVEELEKGKLYLVIHTEAARREKWCRVSYKVNVLEGGEEFDCECGQFAHMGLLCSHVLKVMDFIRITETPPKHIVKRWTRDACDVLPAHLTQYQRDHAHKKYNHQQQLL

SEQ ID NO: 138635 - protein, 184 aa, Triticum aestivum
  Clone ID: PAT_TA_33053.pep
TRPRTRGYDGNVSLASETLPNLPPPFANIMMLEALFANKGLSLDDMVTLSGAHSVGISHCSSFRDRLPPNPSSDPTAMNSTLANLVTSKCSRGDNPTVDQDIYTPGYLDNQYYKNVINHEVLLKSDAALESPKTIESVKQNAKFSVDWEQKFGEAMVKMGNIDVKTSKNGEIRHKCRSINKNYS

SEQ ID NO: 138636 - protein, 97 aa, Triticum aestivum
  Clone ID: PAT_TA_33054.pep
LLAICRHLLVSLVCSIIVAMDNFWPVRCILQLRQWSTFGQSGVFYSCGNGVVIIHNTRYLLLQCIYVNINREHWIIVVIIYTQCIFCSSLCYDIVSR

SEQ ID NO: 138637 - protein, 140 aa, Triticum aestivum
  Clone ID: PAT_TA_33055.pep
PRVRFCLCPLGWAPWSPRLVEAVVFGCIPVIIADDIVLPFADAIPWEEIGVFVPEEDVPRLDSILTSIPTEDILRKQRLLANPSMKQAMLFPQPAQAGDAFHQILNGLARKLPHGEDVFLKPGQARLNWTAGPVGDLKPW

SEQ ID NO: 138638 - protein, 424 aa, Triticum aestivum
  unsure (1)..(424): unsure at all Xaa locations
  Clone ID: PAT_TA_33056.pep
MMARRVLVAIAVLAAAAALFVAAEAQQAPAQQGHQTERISGSAGDVLDDDPVGRLKVFIYDLPGKYNKKLLKKDPRCLNHMFAAEIFMHRFLLSSAVRTTNPEEADWFYTPVYPTCDLTPSGLPLPFKSPRMMRSAIELIATKWPYWNRSEGADHFFVTPHDFGACFHYQEEKAIGRGILPLLQRAVLVQTLGNHVRVKERSVTIPPLAPPQQMQNHLNPGETPRPISVFVRGLGYDTGPMIPRGGYYSRGAAGASVWENFKNNPLFDISTDHPPTYYEDMQRSVFCLCPLGWAPWSPGLVEAVVFGCIPVIIADDIVLPFADAIPWEEIGVVVPEEDVPRLGSILTSHPAQGKTEGTKASRQTPSMKQAMLFPQAGPTGGGIHPEXLNGLARKLPQGXEDVFLXPARSALSTTAAPAGDLKPW

SEQ ID NO: 138639 - protein, 168 aa, Triticum aestivum
  Clone ID: PAT_TA_33057.pep
KKGRIRFHLLSPLTMPAGPSLLWPVELELAGMQASSNSPVPAGPRASPCPTPSSTPGAWPPAPLLAPTRGWRDYCCLRPRAACVAAATLAAADAARGRRHCSRPRAACAAAAARVRRRCCLRPTPVLHMAGGQGGARQSFVAARCHAPHRAPPPRPGAGAGERFTGRV

SEQ ID NO: 138640 - protein, 155 aa, Triticum aestivum
  Clone ID: PAT_TA_33058.pep
GPTQWKQRTKLQRGNNVQSPIWVNISVNPPRRRELARPWPDCLGADRRPRLNLGLRQSEPSHVTTQEAFLVLDATVVVKENGHSSAKLVVEILKITGIEDPGATTPNEYELGLKEKLMVRLGAGIGLMPVETGLHGRREVHASGDGAPGRVGGRV

SEQ ID NO: 138641 - protein, 300 aa, Triticum aestivum
  Clone ID: PAT_TA_33059.pep
SHGWVGVSILQALFVKEHNAVCDAIKEDHPNLSDEELYRYAKLVTSAVIAKIHTIDWTVELLKTKTMRAAMRANWYGLLGKKFKDTFGHIGGTALGGLVGLKKPINHGVPYSLTEEFTSVYRMHSLIPTTLKLRDPTGQPAANNSPPYLEDIDIGELVGLKGEDQLSKIGFEKQTLSMGYQACGALELWNYPSFFRDLIPQNLDGTNRSDRIDLAALEVYRDRERSVPRYNEFRRRLFLIPIKSWEDLTSDKDAIEAIRAIYGDDVEKLDLLVGLMAEKKIKGFAISETAFNIFILMASR

SEQ ID NO: 138642 - protein, 562 aa, Triticum aestivum
  unsure (1)..(562): unsure at all Xaa locations
  Clone ID: PAT_TA_33060.pep
MGSGLFKPRVHPDLRDVFSKMSLGDKIGFLFIHAFDKRNLWHKMPVLIGLLYLNTRRTLLEKYNLLAVGSSHGTLFDPKEFPYRTGDGKYNDPHNAEAGSQYTFFGRNMKPVDQQDELMSPDPFVVATKLLARREYKDTGKQFNILAAAWIQFMVHDWMDHMEDTKQIEITAPKEVANECPLKSFKFYATKEQPTNSDGIKTGYNNVRTAWWDGSAVYGNNEKQVEKTRTYVDGKLVIGDDGLLLHEENGVPLSGDVRNGWVGVSILQALFVKEHNAVCDAIKEEHPKLSDEELYRYAKLVTSAVIAKIHTIDWXTVRTSSKTKTMIAAIRAXWEWMIGIEKIXDTFGHNKEEPYKGGGVGVSRSGQPWRNIVFELQXSLGYQACGALEQWNYPSFFRDLIPQNLDGTNRSDRIDLAALEVYRDRERSVPRYNEFRRRLFLIPIKSWEDLTSDKDAIEAIRAIYGDDVEKLDLLVGLMAEKKIKGFAISETAFNIFILMASRRLEADRFITSNFNEKTYTKKGMQWVKTTEGLRDVINRHYPEITANWMRSSSAFSVWDADY

SEQ ID NO: 138643 - protein, 98 aa, Triticum aestivum
  Clone ID: PAT_TA_33061.pep
MEGLIPFVYKAIKERRTRSYSRCGSARGAAVADEDDVWEQQKQQWAAADGAGREAGHRRHRSLEELAGEVGSAAPEWPARGAMRRGRSARIFSCIGGM

SEQ ID NO: 138644 - protein, 122 aa, Triticum aestivum
  Clone ID: PAT_TA_33062.pep
RVDRGRVVQPNPNCRPSYTINLQPEVISYDQWKDLKADTKGGLSTWIKGAFHGNKSDIQDSLLQNLYSILSTSPMWDRLQLTGDKNVLGEFMEFKSKNEDIPILKKVKKLKVNPIVNQKSTP

SEQ ID NO: 138645 - protein, 202 aa, Triticum aestivum
  Clone ID: PAT_TA_33063.pep
VPKEMQPREALQPGEISSSSAASSSLSSPAPDPIPPRNTSSPKKMEHSETPNSEEKGFPQLFMRQYDYDSVKAWIKKMEDEREEMDGIKELPPLEIIEFEDLMAEAWSPDRLLPWTCGIVHFRDYIAYLKKFFNSNVALHFDLHAAAKRCLKMEKSYMENGNIHQGNLILEIQNVAENIMKERKSEGQFAVAAAGLVVHVYL

SEQ ID NO: 138646 - protein, 157 aa, Triticum aestivum
  Clone ID: PAT_TA_33064.pep
MAPKAAEKKPAAKKPAEEEATTEKAEKAPAGKKPRAEKRLPAAGKSKTSGKEGGGDKKSKKKSKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 138647 - protein, 187 aa, Triticum aestivum
  Clone ID: PAT_TA_33065.pep
ARGQNGVPDHNNSTGPPSGGGYTPNGFSEAKPPNPSEPVSGMPPMPPSQNQFSARGRAGVRSRYVDTFNKGGGGGNSFGGPSYNRPAMPSVNKLPAASFFVPTPAADASMQPTETAADAHSETANQDGPSSSPAVESSFYASPPPPMQIQPGMQRHPSMDNIMTPPAKRPRTRGHGQHHGAGHTRSR

SEQ ID NO: 138648 - protein, 79 aa, Triticum aestivum
  Clone ID: PAT_TA_33066.pep
QPKLGRHSSLSYTCSSDGQQHFASNDCCPVKSKKDLAVTCLFNSSSVWKALCSHSNTTSETWKKEKVTLLILRKQFQRS

SEQ ID NO: 138649 - protein, 242 aa, Triticum aestivum
  Clone ID: PAT_TA_33067.pep
TRPPTRPATTSKALRILDSCGSDVIELGVPYSDPLADGPVIQAAASRALKKGTTLGSVLAMLTEVIPELSCPIVLFTYYNPILKNGVRNFMAKIKQAGVHGLVVPDLPLEETTLLRSEATMHNIELVLLTTPTTPTERMKEITKASEGFVYLVSAVGVTGARSNVNLRVEHLLKEIKQVTDKPVAVGFGISTPEHAKQIAGWGADGVIIGSAIVRQLGEAASPEEGLRRIEEYAKSIKAAIP

SEQ ID NO: 138650 - protein, 382 aa, Triticum aestivum
  Clone ID: PAT_TA_33068.pep
MSKMPNPEKKLFRMPSADAEMAALHKEWDDARCPICMDHPHNAVLLLCSSHDKGCRSYICDTSYRHSNCLDRFRKMKVNRMDSSSQPSSSLPGDTSNQNASQRSHLGPSRGSPRLLIDVPEFRENLSHEHVIRSPAAVSGQQEGTNYNQGPVTLEALMGQVTGQVESAEASNSNELMCPLCRGAVKGWEIIKDARQYLDEKPRSCSREACAFSGTYGALRRPAGRADATPGGGAADPGRRRAGPRRGRARERGENQRANGAAMRGTGAAGAGAVEGGPSADEREAGGAGGGGGGPSERSLSLLTTFFLFHMMNSGPLRSGDEPRGSSRALRRQRRRYLWGENLLGLQYDDDSDDEDEDSLDEEVQRPRTRRRFVRSRSEERR

SEQ ID NO: 138651 - protein, 79 aa, Triticum aestivum
  Clone ID: PAT_TA_33069.pep
IQLEFIYSTIAPRRRTFPYQITRWREGGTSWGGLQSAKFKVEPCTDIGPMPAIFGLVSVSTCLNASNFLDMSLQLRLAP

SEQ ID NO: 138652 - protein, 317 aa, Triticum aestivum
  Clone ID: PAT_TA_33070.pep
PLPLVYPGADGSDTSRDCSVLRGAEVSDKVVLCESRGLNGRIEAGQTVSAYGGLGMIVMNRAAEGYTTFADPHVLPATHLRRPAGTKIAAYINSTANPTASIAFKGTVMGALPAPAVTFFSSRGPSKASPGILKPDITGPGMNILAAWAPSESHTEFSDGGVGLSFFVESGTSMSTPHLSGIAALIKSLHPDWSPAAIKSAIMTTSDAVDRTGVPLKDEQYRHATFYAMGAGYVNPALAFDPGLVYDLHADDYLPYLCGLGLGDEGVTEIAHRTVTCANLKTTTEAELNYPSLVVILLAQPITVKRTVTHVGKPNSV

SEQ ID NO: 138653 - protein, 121 aa, Triticum aestivum
  Clone ID: PAT_TA_33071.pep
WPGLVWQPCSPPFPEGDERILVYFYTSNNIMYLCIFCTCICMIFFPMIRIWITIHHRYSSTIVGYCCAGLQYIKYNSLLHRLELGKCDKLHVHKFWMIEQQSGQYFEEKLICLAMSNLMDE

SEQ ID NO: 138654 - protein, 280 aa, Triticum aestivum
  unsure (1)..(280): unsure at all Xaa locations
  Clone ID: PAT_TA_33072.pep
MQDLKSIPALAGRLVGAAARREIRRGQGRACRPGVAWPGGPGPPGAGGQCPRCRCTTTKSCYYNYNNFKLPRHLHKSSRRHWTKTGARGLRPVRGGGGGGKRNRPSPSAPPPPAATATDGERRAAAFVLRPLQPAKRERDPTRPTEKDTPTTTTHPPPATPSSNSNSNAVSFANRMTNYPFAAXLPPPAPIFADQAAALASLFAPPPPPPLPVFSFSAEPKMEEAIGSLLLPGQEPAQEPEEPTCTSTVADMAPFMSLEAGMSEXPGDASPADYWNGGAR

SEQ ID NO: 138655 - protein, 112 aa, Triticum aestivum
  unsure (1)..(112): unsure at all Xaa locations
  Clone ID: PAT_TA_33073.pep
TLKNGKNYMRNQDLDKAVVEFKTALELAESIGDRFEEKKVARGLGASLQRLGQYREAMSWYQXVLALSKETGEDXGCTEAYGAIADCCADLGDLEGAAKLYDEYISRLQPRD

SEQ ID NO: 138656 - protein, 163 aa, Triticum aestivum
  unsure (1)..(163): unsure at all Xaa locations
  Clone ID: PAT_TA_33074.pep
KLAKLLKGKDGVRFENXLATTRPIKISTDGMRSSKFCLHPAGDTPSSCRLFDAIVSHCIPVIISSRIELPFEDEIDYSEFSLFFSVEEALEPDYLLNQLRQMPKEKWVEMWSKLKNVSSHYEFQYPPRKDDAVDLIWRQVRHKIPAVNLAIHRSRRLKVPDWW

SEQ ID NO: 138657 - protein, 190 aa, Triticum aestivum
  unsure (1)..(190): unsure at all Xaa locations
  Clone ID: PAT_TA_33075.pep
MAGSRNWADLPDGPTALIADRVLAYDVADYVRFRAVCLPWRRCSADPRAHGSLDRRFHPRRWXVRREELAAPNRRSFLNTSTGECVQVDLPELHDHCVLALTSEGLLVLVHHKPQRNTVRLLNPFTGHLTELPPLTTLLSPHDQHMRMDLIGAVRGGRTVRRPVLGLCRRTVLRCGRRWSRTWRPSVVWA

SEQ ID NO: 138658 - protein, 132 aa, Triticum aestivum
  unsure (1)..(132): unsure at all Xaa locations
  Clone ID: PAT_TA_33076.pep
TVCLPKLQSSLETTSSRSLKFWQETGPIECVQSHLETLVFLXTTRDNNEFDFLLFIVENAPKLERLFIKMKQDVTYAEKQVVTAKLSGLSSANWANTDCKMRFEISSYPIGGSSWSLKEGSDLSSDDPFSCL

SEQ ID NO: 138659 - protein, 387 aa, Triticum aestivum
  unsure (1)..(387): unsure at all Xaa locations
  Clone ID: PAT_TA_33077.pep
HASAHACGAGPQDSFWVPLPXWVLEEMEKMPDLSYTDRYKKRNKEYISLGCDILPLLKGRSPMQAYADFMRSFRDNFKEYLGAIVTEVQVGMGPGGELRYPSCPTEKLNQPDSSSELGEFQCYDKFMQASLGAHARILGIQEWGSGGPAGIDSTWQNPEETNFFRADGGCWNTPYGRFFLEWYSGMLLLHGERLCAVADAVFSGTGVTISGKVSGIHWHYYTCSHPSELTAGYYNTLLRDGYLPVAQMFSRHRAALCCGCFDLRDEERSGPQSSPEGTLRQLMAAAKVWNLPLNGENSVERLDDASLSQVVRSSRRYSGGTSGASFSFNYVRMNKSLFESHNWNRLTKFVRKMSDARTFLARLNFRRRQCLPSMSVVWVASQAYAYT

SEQ ID NO: 138660 - protein, 87 aa, Triticum aestivum
  Clone ID: PAT_TA_33078.pep
LKDKGLLDDIEPVLDVISASGEFGDLDIFWYCGLTTIQLRTMFTESSGIRKMHSFLPHDAGIFHLLLLCYIFGCPKEGVTQLRSSCC

SEQ ID NO: 138661 - protein, 207 aa, Triticum aestivum
  unsure (1)..(207): unsure at all Xaa locations
  Clone ID: PAT_TA_33079.pep
EVLESFWYSGCTPXPTPYDPSVLIRKAQRXAKDPLRYSPIIGSLMYLRSATVADIAFAVSKLSRFVSKPGDVHWHAVERKGTMNYGLHYTGYPSVLEGYSDANWISDADEMKATTGYMFTLGGGAVSWKSCKQAILTRSTMEAELTALDTSGVEARWLRDLLMDLPLVDKPVPAILMNCDNQTVITKVKSSKDNMKSTKHIRMRLKA

SEQ ID NO: 138662 - protein, 122 aa, Triticum aestivum
  Clone ID: PAT_TA_33080.pep
MIVVGWHDKATGDWLVHCGFGSKPKLIGRFPKTLFATLADKADEIQARGFVLTQASPLAPMGSGFRPSNVKAASFSNIMFLDQDGKRFGVPQDFTPYMTNDKVYAVSQISPNGGFMYGGPSE

SEQ ID NO: 138663 - protein, 191 aa, Triticum aestivum
  Clone ID: PAT_TA_33081.pep
MTGLRFLPTRSNREAWRLNRRVRRLILDVVRESGEADGGNNLLNAMLRSGQAEAGVGVAAAEDFVVDNCKNIYFAGYETTAVTAAWCMMLLALHPEWQRRVRDEAREALAGGGALDLSSLQRMKQLTMVIQETLRLYPAGSVVSRQALRELTLGGVRVPKGVNIYVPVSTVHLDAELWGSHAREFDPERFA

SEQ ID NO: 138664 - protein, 435 aa, Triticum aestivum
  unsure (1)..(435): unsure at all Xaa locations
  Clone ID: PAT_TA_33082.pep
MTDVRPGWVMLDGFVFIRGANTSLPEKGYRPLRAQGTTSQGVNFDIALCLADPPDTSRLYVLSPSDASPDTACDILAAHGNHFLFVITYFLRSHETSNLRCYQDPFICSVISRDLPPLLKRLPAHTEPLIARKVDGAEITLQRLFFPGDAGLLCRDEQVFAVAQLDQLIPISDSNRSEAEIVVLNTDGKDDDAMWEVKRLPILHPNREKLDISPWSTDTVISFKNYICWVDYCMGGILFFDAFKGRPDISYLGFTTCSGPXPDHPPVGRGYLQMYRGVSVTDEGRLLKFVHVDRIDGELVGPSDSGYTITSHTLEITEDGDMGWVQDDIMHSDPVLPSVRTRYDFSILKFPLVSMDDAHVVHFLYSEATNDGHYKISVVTVDMKTKALLSTHPYIKAEDRLGEDTDMYEFKYCKLKSFLPIKFPMSVTRKRKLLD

SEQ ID NO: 138665 - protein, 326 aa, Triticum aestivum
  unsure (1)..(326): unsure at all Xaa locations
  Clone ID: PAT_TA_33083.pep
TRPPTRPEFSPVEQCVITSSGDKTVKIWHVADGSCLKTFEGHTSSVLRASFLSRGTQFVSCGSDGLVKLWTIKTNECIATYDKHDGKVWALAVGKKTEMLATGGTDSDLNLWHDCTMEDKQEDFLKKEEEVLRGQELENAVSDSDYTRAIQLAFELRRPRRLLELFSQLCRKADPEDPIEKALLGLPKKXFRVLLEYXREWNTKPKFCHVAQFXCFFRVLRSLPPTDILEIKGISELLEGLIPYSQGHSSRGERLERRAKLGEKSKSRRKSRARSKKRSKKVKASSNGARRRGPVVAATVNPYRSSCNPRRLAGAVIAAGRCLLRL

SEQ ID NO: 138666 - protein, 302 aa, Triticum aestivum
  unsure (1)..(302): unsure at all Xaa locations
  Clone ID: PAT_TA_33084.pep
MEQGTPPRLLNLIPDDKGWQAREAQAGHRGTRPPFDAEHEHEREEDKELDLKLGLPGVQHQGEGSGAGESXRAVSLHLARFATHSCLTSTTTGAKRGFFDAVGAKPQGYDRRQQEDREGRAPVHSSRDPPGRAAVVPVVGWPPVRSFRRNLTNGTSSKQQSPERQNVEATDRAKPVCKKNPLIKLNMDGIPIGRKVDLASCDNYHKLSTAVEELFRGFFEAQKDLSCDESGVRGAEEKIFSGLLDGTGEYALVYEDDEGDRMLVGDIPWSVFVSTAKRLRVMRRSELPQRMTGANSTKVADC

SEQ ID NO: 138667 - protein, 178 aa, Triticum aestivum
  Clone ID: PAT_TA_33085.pep
MKMVIVLVVCLALSAASASAMQMPCPCAGLQGLYGAGAGLTTMMGAGGLYPYAEYLRQPQCSPLAAAPYYAGCGQPSAMFQPLRQQCCQQQMRMMDVQSVAQQLQMMMQLERAAAASSSLYEPALMQQQQQLLAAQGLNPMAMMMAQNMPAMGGLYQYQLPSYRTNPCGVSAAIPPYY

SEQ ID NO: 138668 - protein, 87 aa, Triticum aestivum
  Clone ID: PAT_TA_33086.pep
MLSQRNVESVLFRGRRLSERTNAEKVDALAAELVKEQERRMRSPLPNVVIKQVASPRLSSATTASSVTATVRTASTMPSPASWDSRQ

SEQ ID NO: 138669 - protein, 284 aa, Triticum aestivum
  unsure (1)..(284): unsure at all Xaa locations
  Clone ID: PAT_TA_33087.pep
RVRREYVIQKFFEHGTPEQRRDLAAKLAGXVVPLSLQMYGCRVIQKALEVMELDQKIDLVRELDGNIMRCVRDQNGNHVIQKCIECVPTEHIGFVVSAFRGQVASLSMHPYXXCRVIQRVLEHCGXDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHIASRVEQLCGEGDAECDS

SEQ ID NO: 138670 - protein, 80 aa, Triticum aestivum
  Clone ID: PAT_TA_33088.pep
RSGSVKTTTLEHSKPIPIRLESAQLSRVIGTRTLTQNYCDAKPLSKFVLLVFLSVDLKLKSLGEGLLKSIFSDPRVRGRV

SEQ ID NO: 138671 - protein, 52 aa, Triticum aestivum
  Clone ID: PAT_TA_33089.pep
QEERTMLRRINSFHSCVSALILLVNCVCVCVRARYSCVQSYKSESIRQYSSD

SEQ ID NO: 138672 - protein, 142 aa, Triticum aestivum
  unsure (1)..(142): unsure at all Xaa locations
  Clone ID: PAT_TA_33090.pep
FKGDAADSVYMEVEHRRLSFILSSFSTTSAGGKLNTAIASSLKNMKRERDMXYKQMLKKLANGDKEGIYTRWGIDLGSKQRRLQLSRLVWARADMEHVRESASLVARLIDLVEPGQALKEMFGLNFTLAPRTERRSFSLLGA

SEQ ID NO: 138673 - protein, 128 aa, Triticum aestivum
  Clone ID: PAT_TA_33091.pep
MAGACAVAAPSRATVSGPGAAPPPGRGSRVSCRRSARRRAGGRARVSRDTNGAEAEPDSKGPIPQDDSGYLLTLGLGSIGGAAAVKYGSVLLPDITRPNIVEALLMVSLPMAAAVLVLLKLSSTSTHD

SEQ ID NO: 138674 - protein, 119 aa, Triticum aestivum
  Clone ID: PAT_TA_33092.pep
MALRGVWQLQKLVVNYCDWGGSSRGIRAFMESHLPALKEKNPQLEVVTQLVRGQHPNLKGIYKNHNERVVCVRNLAPEDIMLQASRLRCSLGRKVVKLRTRHVAKRPSVQGTWTTELKM

SEQ ID NO: 138675 - protein, 119 aa, Triticum aestivum
  Clone ID: PAT_TA_33093.pep
MALRGVWQLQKLVVNFCDWGGSSKGIRAFMESHLPAIKEKNPQLEVVTQLVRGQHPNLKGIYKNHNERVVCVRNLAPEDIMLQASRLRCSLGRKVVKLRTRHVTKRPSVQGTWTTELKM

SEQ ID NO: 138676 - protein, 178 aa, Triticum aestivum
  Clone ID: PAT_TA_33094.pep
SVRAERSKWTLTSFHKVSFSEHDILDCLDEDNVIGSGASGKVYKAVLGNGEVVAVKKLWGGALKKDVENAGEGSAADNSFEAEVRTLGKIRHKNIVKLLCCCTHNDSKMLVYEYMPNGSLGDVLHSRKAGLLDWPTRYKIALDAAEGLSYLHQDCVPAIVHRDVKSNNILLDAEFSAC

SEQ ID NO: 138677 - protein, 163 aa, Triticum aestivum
  Clone ID: PAT_TA_33095.pep
RVRSKEVEASSIDRALEQQQWQPPKPWPPPAPRSFSSPRSLQLRPPSRARRPHRHRHRPPAGSARRTTYLSSDCASTSGWAESTSAGRTWPTRESGAAGMSAGNPAPRSACAPPSGMPPTSLTVPTSPTTSTPCSWFATSLGSPTSLAPPLHRVEAACGLAVP

SEQ ID NO: 138678 - protein, 156 aa, Triticum aestivum
  Clone ID: PAT_TA_33096.pep
PAGPGAANTHLLKGSRRSIHRSSIRAATMATSRAPLLLLAAILAAAASVQGQATPPAPAPSAGGQCTPDYLSELGLCVDFRLGRVDLRGKNLADERERCCRNVRGKPSAAECLCTAFRDAPDVSDRADFADDVNVVLLVCDQPQIPDLACPASTSG

SEQ ID NO: 138679 - protein, 190 aa, Triticum aestivum
  Clone ID: PAT_TA_33097.pep
KPDGIQVRNNKIDQYCFGFVEFESQQSMQAAIQASPLYIGDTEVGIEQKRTSTRVVNGVVMNAGGGGRFQYGRGHRGDNFRGRGGGYMNSASYRGGDNFNRRDDGEDFSRRDDGDNFNRRNDGGENFNRRNDFRNRNEFSGRGRGPHQGNGYQHHNGNGFHQPRPFQNENGNGRYARVNNGPKQTPVAAA

SEQ ID NO: 138680 - protein, 54 aa, Triticum aestivum
  Clone ID: PAT_TA_33098.pep
LECHFQGQCFKHCVLEWLISIDCKVKNCLLVLGSFTSCKLWIMFFVMKDIRLNI

SEQ ID NO: 138681 - protein, 123 aa, Triticum aestivum
  Clone ID: PAT_TA_33099.pep
PRVRAMTKPPAADRPRMTLEDYVLFFTTRSGRHLTIDQLNQILFMHGFKKLYNSNKPVIVDALNSLDLLRPRRATVSINAVAPPPGAAGPSAALLSTEAVKRDIQDLGWRECPVGSVLSVHAG

SEQ ID NO: 138682 - protein, 125 aa, Triticum aestivum
  unsure (1)..(125): unsure at all Xaa locations
  Clone ID: PAT_TA_33100.pep
MNFRIFGLTNAPPTLQSAMNTILAELTRVCVLVFVDDILIYSKSLQDHVTHLQQVFDLLKQNQLYVKLNKCSFAQPQIEYLGHVISGQGVATDXKKILTVKEWPTSKSSTLEFGLSRTGVSFTGA

SEQ ID NO: 138683 - protein, 229 aa, Triticum aestivum
  Clone ID: PAT_TA_33101.pep
YLGTRCPCGPTNGVVDSAKPLFHAQRRQEDLKNGVDTAPLCPFNFLLIPLGGQVIVFVLMPRRRHLGSGSPAPSHIAATGLSQPTFGRRDPPIGSHTRRQQPSKLLLPRRLLQWCPTVDALLDLVLPRQTDSHDTTTVSLLLMLTRSLVRWPIRMAMPTIDQPPHPPWPDQNDYAEPRCEVLRPCKLQQKNPASNKKRNFNSELVRNCNGHFAVIQEIQKFVVDIIHAG

SEQ ID NO: 138684 - protein, 105 aa, Triticum aestivum
  unsure (1)..(105): unsure at all Xaa locations
  Clone ID: PAT_TA_33102.pep
TSPSPSSISSRISTSISGGTSSEIPTDIAGLPGGRRWHPTPFFPTTTYPIDPLARLSCSASVRRRCRHEPLSLLCSAEQPGQVEPANRGYDVECVHXRRPERQRA

SEQ ID NO: 138685 - protein, 130 aa, Triticum aestivum
  unsure (1)..(130): unsure at all Xaa locations
  Clone ID: PAT_TA_33103.pep
AALGTRNVRPMASDLPRSGAPKQPYAVRAVHPVDGSSFVSCHDHNYPYTVYMCHNTPATRAYMVEMEGXHSGLAVTVAAICHTDTSHWXPEHFSFKVLXGTKPGDGPICHYLPXGHNVWVKKEANRSSSS

SEQ ID NO: 138686 - protein, 122 aa, Triticum aestivum
  Clone ID: PAT_TA_33104.pep
IHDLLVQKKQYIVAVSPCIPQITIAGFFRSRTPADTSAPKNLRLLLVRVVGIIRRILISCQSGHLVLFTVRSSLERRLHRRLELAQGRSLACSLSACRGHAGSGRDLAHRCYIQALSFGFRF

SEQ ID NO: 138687 - protein, 126 aa, Triticum aestivum
  Clone ID: PAT_TA_33105.pep
GRRALYASDDFHLHVWIRGVDGDGIGVWVQQLIPSLSAQIERTTGESEGKLRVVQARSGCVYLYMSCITPIGTQRCWLFYHSLGTTEIELLIHGTFHDRAYPYIMAWPPCLIGDDEGTGHEVEGSH

SEQ ID NO: 138688 - protein, 141 aa, Triticum aestivum
  unsure (1)..(141): unsure at all Xaa locations
  Clone ID: PAT_TA_33106.pep
KLSTVVMPASQFSLYKLYNGNPSIHSIEEQSTSLFVFGQVAKPAISSGTAATPKIVKWFLNPKLMLFGGVSLNVSKRRVACIKSCAASFPPVAAPSCNAFLKYGYPLYLHIRPLYLTRSRTLGPSSGTSPXKLSKRRKFAS

SEQ ID NO: 138689 - protein, 146 aa, Triticum aestivum
  Clone ID: PAT_TA_33107.pep
THLCCVKMRGRVHGEANPWLLSTSPRRRRLAEFFRPLEASPPSPRGQDSVHPPRHQMLAAAPLLSPPPPSPPQLPSPDRGRTPRLEVLLLRPDRGRARRGRPWGRCTWATSRAARRAGSGSRRGGGGGEGRRGGTRRLGFVGGDSG

SEQ ID NO: 138690 - protein, 193 aa, Triticum aestivum
  Clone ID: PAT_TA_33108.pep
MAGGDGDRARAPKRYKSSAPSKAALVDETAEMNYADDFDDDARDGDNEVKKRDFTKLELKLDHVNRPLWACADGRIFLETFSPLYKQAYDFLIAIAEPVCRPESMHEYNLTPHSLYAAVSVGLETTTIISVLSKLSKTKLPHEIIDFIHGSTANYGKVKLVLKKNQYFVESPFPEVLKTLLNDDVISKARKAP

SEQ ID NO: 138691 - protein, 354 aa, Triticum aestivum
  Clone ID: PAT_TA_33109.pep
MAESFDKMKVEFTGHEESVQALAEAFHDSGEVPERYIRPEIDADPPAADAGGHALPTIDMSRLLDPEFSVEESAKLGSACEHWGFFQLVNHAVDGGLLGQTKADVAEFFGLPLEEKSAVAIPPNGMQGFGHHFVFSKEQKLDWVDLLFLATRPAQERSLDFWPTKPSTFRDTLDKYTTELASVAEQLFRFMAKDLGVDQEALLGTFKGLPQCVRINYYPPCRQAGKVLGLSPHTDGVGMTLLLHANDVQGLQVRKDGEWFSVDALPGALVVNIGDVLEILSNGKYRSIEHRAVVNPDKERITIAAFHSVHLPCTMGPFQQLGDARYKTVDGLDFTKGYFAAKLEGRRYLESLKL

SEQ ID NO: 138692 - protein, 119 aa, Triticum aestivum
  Clone ID: PAT_TA_33110.pep
GPAKFCSENRKFIFEYKHIFFFISPARNSATLHFYTAHGSLHCRIMIKQTKRKNCQTAKEPTFCGFPLYKLLAYDKQIFLPMTSASVLTHHPSHDHHRCCTVGTSDLWIKRQLTCSSHV

SEQ ID NO: 138693 - protein, 189 aa, Triticum aestivum
  Clone ID: PAT_TA_33111.pep
CFSSLLTAHRGPCRVAPSQAWAALPNATPNLNIGIDLWSASQSLAVIPVQGEANPGLALARCDGVGQLDEREIKRERRKQSNRESARRSRLRKQQECEELSRKVAELTTENNALRTELDQLKKACEDMEAQNARLMSQEPAAVTTTLGMSIAAPKVQQHDDEGKLHKKANNNSNGKYVGGSRKLEANPR

SEQ ID NO: 138694 - protein, 75 aa, Triticum aestivum
  Clone ID: PAT_TA_33112.pep
WTLSSKSITRGRELYPEGHHRQEYHITTSEERDINTWVWALPLATAKLGGGAPVSYHHHTPIFTVFLSSILLVKS

SEQ ID NO: 138695 - protein, 105 aa, Triticum aestivum
  Clone ID: PAT_TA_33113.pep
KDRTKKNGKDRSVMVIRYRGTSPKLGSCQGECPYPSDYVPFFAEGGVVYGGSPHKERRSSSLRIMPLSATVCSFNKIFSCVRYLFCIQANSIILKASISVGVRRL

SEQ ID NO: 138696 - protein, 130 aa, Triticum aestivum
  Clone ID: PAT_TA_33114.pep
LNRADKAPVVFRSVDFGPLKRSVSDVVSAKFGDAAGSGGWSVHVDAGVLDRLAGAAWTAAGASTATATSLESWADEVLCPSIRQLKRSLSSSDVDGATTVSLSAVEGIGRRRMDGDVLFPTSVTVAVDGN

SEQ ID NO: 138697 - protein, 298 aa, Triticum aestivum
  unsure (1)..(298): unsure at all Xaa locations
  Clone ID: PAT_TA_33115.pep
PTRPPTRPPTRPSYMDDASSPMAKIEPARTVTGKEMLAPKVAMFSSRGPSPDYPAIIKPDIAAPGVNILAAKEXIHAILSGTSMAAPHVAGVVALLKALHPNWSSAAIKSAIITTAHITDEHDMSILAEGLPRKIADPFDYGGGNINPHGAADPGLVYDIDPQDYDKYFRCTIVKRASVHCNTTGMLPAYHLNLPSISVPNLRSPVTVSRTVTNVGDVDSVYHVEIQSPVGVRMEVDPPVLVFDAKNKVRMFQVKLSPVWKLQGDYTFGSLTWGNDQKVVRIPVAARITIQDFYADVA

SEQ ID NO: 138698 - protein, 146 aa, Triticum aestivum
  unsure (1)..(146): unsure at all Xaa locations
  Clone ID: PAT_TA_33116.pep
CIREAIRMHTSAPVLVRKAHTXFRVHTKEGEEYDIPGGHNVVVPTALNNKLAHIYSDPHLYDPDRFGPGREEDKVGGKYSFTTFGGGRHVCPGMALAYLQIKVIWSHLLRNFELKLISSFPKADGSKMNQEPKGKVMISYKRHQLL

SEQ ID NO: 138699 - protein, 345 aa, Triticum aestivum
  Clone ID: PAT_TA_33117.pep
WPLMSPLPSYGYGRERKGPRYGSLIHGQDLKDVIITGHNGTINGQGQSWWIKFRKKLLNHTRGPLVQLMRSSNITISNITLRDSPFWTLHLYDCKDVTVSGTTILAPIAGAPNTDGIDPDSCENVMIENCYISVGDDGVAIKSGCGPWGIAYGRPSTNITVRNVIIRSMVSAGVSIGSEMSGGVSNVLVENVHIWSSRRGVRIKTAPGRGAYVNNIVYRNITLENVRVGIVIKTDYNEHPDERFDPKAVPVVGNISYTSIHGQRVRVPVRIQGSAEIPVRNVTFHDMSVGILDKKHHVFQCSFVQGQVIGYVFPVPCKNLDLYNERREMVKQSTLQNISDIDYSF

SEQ ID NO: 138700 - protein, 162 aa, Triticum aestivum
  unsure (1)..(162): unsure at all Xaa locations
  Clone ID: PAT_TA_33118.pep
APGQRGPSSPPGHSPARPGALPPHGTCRDPDSYVLAAILRPWRVSHVSSGLLEMGIRGVTVSDVRGYGAQXGGSTERYEGSEFSEDTFIAKVKMEIVVCKEQVEPVIDKIIEKARTGEIGDGKIFLIPVADVVRVRTGERGVHAERMIGGLSDKLPPVITIS

SEQ ID NO: 138701 - protein, 111 aa, Triticum aestivum
  Clone ID: PAT_TA_33119.pep
SAPLPSGVGTGSRRSSPAGAVSPIDSRPACPRAERAALREQEQVGSSHAAAVRDQPGASDRHHLLLHALRLLPHLRPAHHRHRCSAEELRHRPTSSTGYQPWSPARLRTPG

SEQ ID NO: 138702 - protein, 80 aa, Triticum aestivum
  Clone ID: PAT_TA_33120.pep
SVSYGIEPDEEGSAGLRLTARGSVTTYTYRVDTDGRTHLNSVGWKRFPDGKNLRVGQAILITIRNTHRPGLRMMIVFDII

SEQ ID NO: 138703 - protein, 142 aa, Triticum aestivum
  Clone ID: PAT_TA_33121.pep
DDYFFELITRYLVSTPWGHLLQIRVVLDKYQEHYVRVDVDRLDLKSSQMVGVSPAKALRGHAAFLGQNSRGILSVDKFPEVRPDCIYFTTPRLRGDVEHRHNQWSGVKVYDLRSRKLEDAFLSGGGHYGTICPSEVWFTPSL

SEQ ID NO: 138704 - protein, 252 aa, Triticum aestivum
  unsure (1)..(252): unsure at all Xaa locations
  Clone ID: PAT_TA_33122.pep
FEAIFVSCEDSSQKPTVLILHGGPHSASVSSYSKSSAFLASLGFNLLIVNYRGRRATGRKALQSLPGKVGSQDVQDCLAALDHVIEEGLXXDASRVAVVGISHGGXFLTTHLIGQAPERFAVAAARNPVCNLSLMIGTTDIPDWCYAVACGTEARRLASESPSLDHLRIFHQKSPIAHISKVKAPLLMLLGGADLRVPMSNGLQYARALRERGGEVKTIMFPEDTHEIDIPRSDFESFLNMGVWFKKYLKQI

SEQ ID NO: 138705 - protein, 146 aa, Triticum aestivum
  unsure (1)..(146): unsure at all Xaa locations
  Clone ID: PAT_TA_33123.pep
GGERLPLQDGLFDLIEDXGXGVVLDTGTAVTRLPPDAYTALRDAFADAVGGGLPRAPGVSLLDTCYDLSGYASVRVPTVALYFGRDGAALTLPARNLLVEMGGGVYCLAFAASTSGLSILGNIQQQGIQITVDSATGYVGFGPTTC

SEQ ID NO: 138706 - protein, 394 aa, Triticum aestivum
  unsure (1)..(394): unsure at all Xaa locations
  Clone ID: PAT_TA_33124.pep
MVRETGYYDVLGVSPAATEADIKKAYYVKARQVHPDKNRNDPLAAEKFQELGEAYQVLSDPAQRQAYDSYGKSGISTEAMIDPAAIFAMLFGSEVFEDYIGQLAMASMASLDIFGEDEKIDARKLQEKMRAVQKEREEKLAEKLKNRLHIYVQGNKKEFIQVAEAEVARLSDAAYGIDMLSTIGYMYSRQAAKELGKKASXLGVPFIAEWFRNKGHFIKSQVTAATGAIALMQLQEDLKKHLSSECNYTDEQLEAYMQSHKKVMVDSLWKLNVADIEATLSRVCQMVLQESNVKREEVRARAKGLKTLGKIFQRVKLNNEGEAATMKHTINNLDDNVGTSPDSSPTSPRVQPFDANPPYSQSPYVEAPRFGGTHSPFNFPMPTAPPGAQRNPVP

SEQ ID NO: 138707 - protein, 294 aa, Triticum aestivum
  unsure (1)..(294): unsure at all Xaa locations
  Clone ID: PAT_TA_33125.pep
PRVRGELHLAVRFTCTAWVXNMMAMYGRPLLPKMHYSQPISVMQLDYLRHQAMQIVSARLSRAEPPLRREVVEYTLDVGSHMFSLRRSKANFYRITSLFCGFASMAKWYDGIRSWRNPITTMLVHMLFLILICYPELILPTIFLYMFMIGLWNYRFRSRHPPHMDTKLSQAEFTHPDELDEEFDTFPSNRPADIVRLRYDRLRSVGGRVQTVVGDLATQGERAHALLSWRDPRATAIFIFLSLVVPIVLYVTPFQVLLVITMLYLLRHPRFRSRMPSVPFNFYRRLPAKSDSLI

SEQ ID NO: 138708 - protein, 154 aa, Triticum aestivum
  Clone ID: PAT_TA_33126.pep
LHISSGAKNDSVRSAKIDTRYHLDLCKNVFGEGVYPDVSMTNLYYGGTRIAGSKIVFANGSQDPWRHASKQKSSEELPSYLIECSNCGHCTDISGCPQAPSNIGGDSSKCSSPEAVNKVRKQIVDHIDLWLSECQDQGRDTVTKQGSRWSIATY

SEQ ID NO: 138709 - protein, 439 aa, Triticum aestivum
  unsure (1)..(439): unsure at all Xaa locations
  Clone ID: PAT_TA_33127.pep
SPDPSATLAALGLASGDLLXLTLSEELLWQPPPXKKLPRNPSPDTASIGQIASGSXSPGEAGGSSSPPQNLNIQPVSSXLPQNLNIEPISSPRPRALHVEPILPVASDPPDVXMAEAVHAXXSLSSLVIGILKREMEAEDAGCANGTVIHRLAVSLQAALVDAGFLAENPMGSRPRLLKDWASGAAATLTVKYTLPELVAMLPEGEEGKTVVLNCSLMPNFVMIYGCVPGACSEVRRLCLELPKLAPLLYLDSNEVGATEEKEILELWRVLKDELCLPLMISLCQLNGLRLPPCLMALPGDLKAKVLEFVPGVDLARVQCACKELQDLAADDNLWKMRLELEMSPSSKGSGWSGDWKHRFVAAWKVDNSRRHHKRPPSPRFSGYGWGIGTRNPLNFPVIGGDSDRLPFINHNILGRSFGNQRRNISPNCNFEGHRQGFP

SEQ ID NO: 138710 - protein, 79 aa, Triticum aestivum
  Clone ID: PAT_TA_33128.pep
GFAAGADSQMGQPFAASAIALESNGLTRFSVSNVFLRNLNSSFSSYWQLMIRYPTLPMDNSMCGLTISAYYLMPCIRMI

SEQ ID NO: 138711 - protein, 127 aa, Triticum aestivum
  Clone ID: PAT_TA_33129.pep
EPSLDDDVYIHRHVRSAVFHTSGSSTAADGRQRVQSAPVSHVRTQLRGISPAASFEFLTNPPSLSSPGPVAISQTQEPVAAGASASSTLLPRLVMSPRSRVTATSGSMPRETVCRRRPRRRRPGCPC

SEQ ID NO: 138712 - protein, 165 aa, Triticum aestivum
  Clone ID: PAT_TA_33130.pep
CIASISSMGFAFLRYRLIPLSRVWLRVSKNEVPLNVVWLSVVVAFVMALTSLGSAVAFQAMVSIATLGQYIAYALPIFFRVTTARRSFVPGPFHLGRYGVVVGWAAVLWVAFLTVLFSLPVAYPVAKDNFNYTPVAVGGVLLLSVGAWVVNARFWFEGPITNVDL

SEQ ID NO: 138713 - protein, 176 aa, Triticum aestivum
  unsure (1)..(176): unsure at all Xaa locations
  Clone ID: PAT_TA_33131.pep
MASQDSKPAQVPAAAELTAPAAAAAGEAPNPTSPTXAQNPSAAAAGGAATDLEKKMRRAERFGTQVVMSEDEKRSSRAERFGTGSSNEKMVRNRKNEVHGLRRFGPSRTPIRLIGYLRAKKKSPRLEAIWARGKGRWQGRRSKCERRGPLRLAGQAPSGSSGRKGQRHLQAGRRLP

SEQ ID NO: 138714 - protein, 472 aa, Triticum aestivum
  unsure (1)..(472): unsure at all Xaa locations
  Clone ID: PAT_TA_33132.pep
MPREIITIQVGQCGNQIGMEFWKQLCLEHGIGKDGLLEDFATQGGDRKDVFFYQADDQHYIPRALLMDLEPRVINGIQNSEYKNLFNHENIYLSEXHGGGAGNNWASGYHQGEQVVDDIMDMVDREADGSDSLEGFXVLCHSIAGGTGSXMGSYVLETLNDRYSKKLVQTYSVFPNQMETSDVVVQPYNSLLTLKRLTLNADCVVVLDNTALNRIAVERLHLANPTFAQTNSLXVSTVMSASTTTLRYPGYMNNDLAGLLASLIPTPRCHFLMTGYTPLTVERQVNMIRKTTVLDVMRRLLQTKNIMVSSYARTKEASQAKYISILNIIQGEVDPTQVHESLQRIRERKLVNFVEWGPASIQVALSRKSPYVQTTHRVSGLMLANHTSIRHLFSKCLGQYEKLRKKQAFLDNYRKFPMFADNDLSEFDESREIIEGLVDEYKACESPDYIKWGMEDLGDANVAAALESKLVV

SEQ ID NO: 138715 - protein, 195 aa, Triticum aestivum
  unsure (1)..(195): unsure at all Xaa locations
  Clone ID: PAT_TA_33133.pep
LLHLSLAAVXQSKLARAPGAAKNLLSISSDSHEPFPLPRXALMVICNVAACAEGRTALMDAGAVATFSVILSNDAHRSELQECCVAALYDMSKGSPRFRGLARAAGADRPLILIAEQADPGVHKDMARKALRAMLGLGDINGGGLHDFSNSERNDDYCGTMASSLPVRRRRAASWGAPPASKLPSSHHWRSVCID

SEQ ID NO: 138716 - protein, 251 aa, Triticum aestivum
  Clone ID: PAT_TA_33134.pep
MEMQRVAIVGAGMSGLTACKHVLERGFRPVVFEAEADAIGGVWAHTLASTRLQTPRPQYEFTDFPWPPEVPELYPSHDQVMEYLRSYARHFGVLECVRYGSRVTALEYSGAVNEEEMMAWEQWAGNGEAFGSGRGEWRITVQHGDDVEIPVADFVVLCVGRYSGIPNIPTFPPAKGPEAFNGTVIHSMDYSNMNDAKATELIKGKLVTVVGYQKSALDIATECANVNGPTHPCTMIVRTKRWIIPDLYAWG

SEQ ID NO: 138717 - protein, 341 aa, Triticum aestivum
  Clone ID: PAT_TA_33135.pep
GDSFWHPSDTMLSGMRISVNAEVRAQVRGPPERMLFTSWASDTDPSPGRFALGLDPANPSQAFIWRDGNVPFWRSGQWTGLNFVGIPYRPLYVYGYKQGNDPILGMYFTYTATNTSLQRFVVAPDGRDVCYMVKKSTQEWETVWVQPSNECERYGACGSNAICTVVQDAKAKVFRMIGFKPKLADEWNAGNRSQGCVRNPPLDCQVNKTGDGFLSIPNVKWPDFSYWVSGVTDEYGCMNTCQQNCSCGAYVYMTQLTGCLHWGSELMDVYQFQAGGYALNLKLPASELAGSHIAVWKIATIASAVVLFVLLACLFLWWKRGRNIKDAGLRRWGRSRRVCTR

SEQ ID NO: 138718 - protein, 530 aa, Triticum aestivum
  Clone ID: PAT_TA_33136.pep
TRAPFQSETDRVPRSENQNRNHNFNSDSPPFEQYTNNSHETAPGFSTDKKSIDMLTEASAAEAEAVSAVWRAAKEASHASSEDSLSDGIGSESPLSETSPMADDLDEARAMEPDVKLHSRAVVVAKEAVGDLGCLVRQLSLDQFENESRRMHPANNDQSYSSKKALNRQRSPQGLHKKVISLLLRPRNWNAPADRTFFLDSYEVGELCYAAEVGFMQEPTVLQLKAPVKVFGDLHGQFGDLMRLFDEYGYPSTAGDITYIDYLFLGDYVDRGQHSLETITLLLALKIEYPEHVHLIRGNHEAADINALFGFRLECIERMGESDGIWAWTRFNQLFNYLPLAAMIEKKIICMHGGIGRSINSVEQIEKIERPITMDVGSIVLMDLLWSDPTENDSVEGLRPNARGPGLVTFGPDRVAEFCKRNKLQLIIRAHECVMDGFERFAHGQLITLFSATNYCGTANNAGAILVVGRGLVIVPKLIHPLPPPVNSPESSPERAMDATWMQELNIQRPPTPTRGRPHSAGDRNSLAYI

SEQ ID NO: 138719 - protein, 274 aa, Triticum aestivum
  Clone ID: PAT_TA_33137.pep
AISIFALLDRKSEIDSSRNEGLTLDEVKGNIDFQHVSFKYPTRPDIQIFSDFTLHIPSGKTVALVGESGSGKSTVIGLLERFYNPDSGTISLDGVEIKSLNINWLRDQAGLVSQEPVLFNDTIRANIAYGKDGEVTEEELIAAAKASNAHEFISSLPQGYDTTVGERGIQLSGGQKQRVAIARAILKDPKILLLDEATSALDAESERIVQDALDNVMVGRTTVVVAHRLSTIKGADIIAVLKDGAIVEKGRHEVLMNIKDGVYASLVELRSASS

SEQ ID NO: 138720 - protein, 271 aa, Triticum aestivum
  Clone ID: PAT_TA_33138.pep
PVPFLCFNRLSELLVHKPGEGLLLSLLATFLSPLRWILSKFVESYYMWAVPMRKHGMVPEHSFFQALSSWLIAIMPDKFYDKVEQGSIILKKANEFSFCKEGVIVQGEPAPIKSDVVIFATGYNGDQKLRELFASPLFREIDVGTPATAVPLYRLCVHPRIPQLAIVGYSESMGDLHTSEIRSKWLAHFLDGGFCLPAIRSMEENVKEWEAYMKRYSGDYFRRSCVASIGIWHNDQLCKDMGCEPRRKKGFLADWLIPYEPVDYAGVNLRN

SEQ ID NO: 138721 - protein, 218 aa, Triticum aestivum
  Clone ID: PAT_TA_33139.pep
IQEAHNGLYVGYADASLGPDGNTYVLGTYASNILRVTPEKEISTFYVADKLEPPRLYGFTGIAHVGNAMIVPDNIIGQLIRFDVRDKVGTPVVIKQTPYHEFKTANVLHFPERYNDTILLVAENMTPDHPFGGVSVYQDKTQQFNEVEFLGFLPSRLQNALTTSARQMTDRIYVVALPTDGANITVAGKSSRFEFQDITEELDLMIHPKSEGEVRDEI

SEQ ID NO: 138722 - protein, 227 aa, Triticum aestivum
  unsure (1)..(227): unsure at all Xaa locations
  Clone ID: PAT_TA_33140.pep
RLGFDPAISSHFHVFELXTAVALDLNNKYDYRIEEVGIYSSKAGGWTHQIVWDNSIEILCLSGGAFFDGVLYLRSDSNTVAAIDVQGNYRIIPVPTSPDXRGVPNVYVSRGQLYNADHGGPELSAWGLEDSISENCSTLKLKVSHVQLIGVEYSSAREHYSVISAHPEDNVIFIIVESASGIFWQMKLFSYEMDSRELRFVCDLGRNSRCPYLSYVPLFSESLTDGH

SEQ ID NO: 138723 - protein, 145 aa, Triticum aestivum
  Clone ID: PAT_TA_33141.pep
CGRYPPAVRTAVPVDGRFEHIVLSCNAISDHAIIWIEREAQRAVNLMLEHERTMKAPENQRMDGETAATRDHNEEQQAALRRAVALGIADVKLPSTYGTFDENANPDESEASPVLLDSGRRRTVWNEWIARIFEKDESGQMVPRR

SEQ ID NO: 138724 - protein, 65 aa, Triticum aestivum
  Clone ID: PAT_TA_33142.pep
TSCMTSLKFGWPASHKHFPFLYVNPWFLGPTGFRFSHHQLRSVFSIHFSRDRDQPLKKLFSGSKD

SEQ ID NO: 138725 - protein, 116 aa, Triticum aestivum
  unsure (1)..(116): unsure at all Xaa locations
  Clone ID: PAT_TA_33143.pep
FFFFFXXFXXKEINNTKSLFHSCSFIHEHRNFNFEAHGLAKHATSLGTGRHVWHGHTYDPITEFKALTSKDYAFEETSKDYCGDVYISTLQMDHAAVVRTLWRTTVLTVRPGSKPK

SEQ ID NO: 138726 - protein, 47 aa, Triticum aestivum
  Clone ID: PAT_TA_33144.pep
TFWGAPFFFFFFFFFFNFFFFFFFFFFFFFFFFFFFFFFFFFFFFPR

SEQ ID NO: 138727 - protein, 114 aa, Triticum aestivum
  unsure (1)..(114): unsure at all Xaa locations
  Clone ID: PAT_TA_33145.pep
MATHHRALLLLLAVLLPAAATADPDAVQDFCVPDPGRGRPVELNLIRSYPCRSPANLTAGDFAFSGVRAAGNFSADTGFAGVSVTPAQFPGLHTLGMSFARADSRAPGXVNPPH

SEQ ID NO: 138728 - protein, 450 aa, Triticum aestivum
  unsure (1)..(450): unsure at all Xaa locations
  Clone ID: PAT_TA_33146.pep
MREIISIHIGQAGIQVGNSCWELYCLEHGIQPDGLMPSDTSVGVAKDAFNTFFSETGSGKHVPRALFVDLEPTVIDEVRTGAYRQLFHPEQLISHNEDAANNFARGHYTVGREVVDLCLDRIRKLADNCTGLQGFLVFNAVGGGTGSGLGSLLLERLSVDYGRKSKLGFTIYPSPQISTAVVEPYNSVLSTHSLIEHTDVVVLLDNEAIYDICKRSLDIERPTYTNLNRLISQVISSLTTSLRFDGAINVDITEFQTNLVPYPRIHFMLSSYAPIISAEKAFHEQHSVPEITNSVFEPSSVMAKCDPRHGKYMACCLMYRGDVVPKDVNSAVHSIKTKRTVQFVDWCPTGFKCGINYQPPTVVPGGDLAKVRRAVCMISNNTXAVAEVFSRIDRKFDLMYAKRAFVHWYVGEGMEEGEFSEAREDLAALEKDYEEVGAEGEDDEDEGDEY

SEQ ID NO: 138729 - protein, 69 aa, Triticum aestivum
  unsure (1)..(69): unsure at all Xaa locations
  Clone ID: PAT_TA_33147.pep
YISISHIQHXSFISHITYHISFIHTHCSYISKFXXYIYYNAKFHQDSKFHHSKLDTMQSFIKGXASTPS

SEQ ID NO: 138730 - protein, 142 aa, Triticum aestivum
  unsure (1)..(142): unsure at all Xaa locations
  Clone ID: PAT_TA_33148.pep
VDFFSPGCGGCRALHPKIAQFAERNPDVLFLQVNYEKHKSMCYSLHVHVLPFFRFYRGAQGRVSSFSCTNATIKKFKDALAKHSPDRCSLGPARGLEEAELLVLAANRDLXFTYNEKPTLVPIAEAIQREAASIGGPWDAIA

SEQ ID NO: 138731 - protein, 155 aa, Triticum aestivum
  Clone ID: PAT_TA_33149.pep
ACRYRIDHARVDFFSPGCGGCRALHPKIAQFAERNPDVLFLQVNYEKHKSMCYSLHVHVLPFFRFYRGAQGRVSSFSCTNATIKKFKDALAKHSPDRCSLGPARGLEEAELLALAANRDLEFTYNEKPTLVPIAEAIQMEAASIGGPWMPLPAGA

SEQ ID NO: 138732 - protein, 181 aa, Triticum aestivum
  Clone ID: PAT_TA_33150.pep
STPTAAVAAALSNPSGSRVDFFSPGCGGCRALHPKIAQFAERNPDVLFLQVNYEKHKSMCYSLHVHVLPFFRFYRGAQGRVSSFSCTNATIKKFKDALAKHSPDRCSLGPARGLEEAELLALAANRDLEFTYNEKPTLVPIAEAIQMEAASIGGPWMPLPAAATQPLALGSENGSLIPSGR

SEQ ID NO: 138733 - protein, 173 aa, Triticum aestivum
  Clone ID: PAT_TA_33151.pep
GRLSPRHRRARPGLATAGATLVARSTSPPAAGAAHSAAQNPNVLFVQVSYDSHKSMCYSLHVHVLPFFRFYRGAQGRLCSFSCTNATIKKFRDALAKHNPDRCSIGPTRGLEESELLALAANKDLEFTYTKQPEPVPSGDREVIAPGSPRLPPPAKPLVRQGSGERTLVSSGR

SEQ ID NO: 138734 - protein, 230 aa, Triticum aestivum
  unsure (1)..(230): unsure at all Xaa locations
  Clone ID: PAT_TA_33152.pep
QIRHEGAALTYQXTCLDGFANTTTDAAAKMRGALNASQELTEDILAVVDQFSASLGSLNIGRRLLGEEDGVPYWRVDGKRRLLEAEPSAPEFKPNVTVAADGSGDFKTIKEALAKVPPKSASMYVMYIKAGTYKEYVSVGRPITNLVVIGDGDDKTIITGNKNFKMNITTKDTATMEAIGNGFFMKGVRVENTAGAENHQAVALRVQSDQAVFYQCYFDGLQDTLYXHAQ

SEQ ID NO: 138735 - protein, 71 aa, Triticum aestivum
  unsure (1)..(71): unsure at all Xaa locations
  Clone ID: PAT_TA_33153.pep
LEXNPTKGNKSWSSTAVAAALELVDPPGCRNSGTSAPSPHTPQRPPLLPVPPAPFLLPALEQRCASVGQQQ

SEQ ID NO: 138736 - protein, 181 aa, Triticum aestivum
  unsure (1)..(181): unsure at all Xaa locations
  Clone ID: PAT_TA_33154.pep
AXRTQDNTGAPMREXDXKEATPFAYGSGNVHPNRAVDPGLVYDITPNGYFTFLCSLGFSTKDLSRLSSGKFTCPAKPPPMEDLNYPSIAVPALRHRMTIKRRLKNVGRPGTYRASWRAPFGVNMTVDPTVLVFEKAGEEKEFKVKVASEKDKLGRGYVFGKLLWSDGTHYVRSPIVVNALD

SEQ ID NO: 138737 - protein, 269 aa, Triticum aestivum
  unsure (1)..(269): unsure at all Xaa locations
  Clone ID: PAT_TA_33155.pep
MMSSPAESETSFFPDHLAEQQQQQPPFAEQEQLCYVHCNFCDTILAVGVPCSSLFKTVAVRCGHCANLLSVNLRNLLLPATANQLPFSPSLLSPTSPASPHGLLDEMSSFQAPSSLLTDQASPNVSSITSSSNSCAINTPAMSMMPPPEKPAQRETPQRKSAASGTKHPEKRQRVPSAYNRFIKDEIQRIKANNPDITHREAFSAAAKNWAHFPHIHFGLMPDQGLMRKTSIQSQLDGAGDCMLFKDXLYAAAAAAAATAASSMGATPF

SEQ ID NO: 138738 - protein, 196 aa, Triticum aestivum
  unsure (1)..(196): unsure at all Xaa locations
  Clone ID: PAT_TA_33156.pep
MPEEMVLCGTASFKDVDKGEPTSGGGKQAQRKEKKKPGAGKKENPYASRGLDKFSMVLAELESRREKVLRRVDGGDHVMVRFVQSETKGWVPIVVKLPAEEPAAKAEPKKKCKFKLAVSPTPPPTQPPSPRTESTSPRGGDDAVMHVAAATAPAVAAAPAKKKXSAAGRWPWADRXIRPSQYWPFRAMLLLVSLVV

SEQ ID NO: 138739 - protein, 185 aa, Triticum aestivum
  Clone ID: PAT_TA_33157.pep
RVSEGPQEPHFGPLQQFMPELREGMAIGLMVTYASLVESVKRSCIEDNIELFERKINALAHLEENGFDVKLLQHSLMKLLEAKWEHTKHLGHLDELKELVPRKESAMSHKHALLVEKEGAIFQLEQKLECLRGEAEQIARETKDEDAELLRLKEGVNIAQEACVNVEVRFHDILADMRSRLQLSE

SEQ ID NO: 138740 - protein, 172 aa, Triticum aestivum
  Clone ID: PAT_TA_33158.pep
LLQSEHCRGKIVMELINANPVIHEKRERRTRQAPENIDENAPEAIDQLEIFDHIRDIKDPEHPYSLEDLNVVNEDSVEINDELSHVRVTFTPTVEHCSMATIIGLCLRVKLMRSLPPRYKVDIRLTPGSHATEAAVNKQLSDKERVAAALENSNLLDIVEECLSPTLGLRPE

SEQ ID NO: 138741 - protein, 284 aa, Triticum aestivum
  Clone ID: PAT_TA_33159.pep
RLAGARPPCLSMPPEKSPQSPVACAQRVLISNKLGEKLVGLLHEACSKELVILCHGFRATKDDSILVDLAAALASAGVNAFRFDFAGNGESEGLFQYGNYRKEADDLRSVVSYFSEQKYDIIALVGHSKGGNAVLLYASMYHDVTVIVNISGRFALEEGIEGRLGKNFLQRIKKDGYIDVRNKKGKFEYRVTEESLRDRLSTDTLLSSRSISKDCRVLTVHGSEDETVPARDALMFAAHIPNHDLHIVVRANHRYTGHEQELTSLALDFIKPRPRKSSSLRPKL

SEQ ID NO: 138742 - protein, 128 aa, Triticum aestivum
  Clone ID: PAT_TA_33160.pep
VHLLVFDPPMRQRRKTCLFEAIRTIENATRTVVKDLNYGRLNKMEQDFGYLRLRLNEAFDTIDRVAKGYLYAIRYMPAFLHQLHNVIAHTFPPTRVVDKSTNEALKNIEVVAHNLRTEAIVLKTSYMC

SEQ ID NO: 138743 - protein, 390 aa, Triticum aestivum
  Clone ID: PAT_TA_33161.pep
MKVSFGILATLLGASSYVASAAPTDQSSASDLILSLNEKATSALENAETEPRKRSAGPKKCTIFNAAVRRDWKTLSKKDKKAYIDAVLCLRKKPSKADPAFAPGARSRYDDFVAVHINQTLSIHGTGNFFTWHRYFTWAYEKALQDECGYKGTQPYWNWFETGDFATNPVFDGSETSMSGDGKYFEHDGAWSGKQNIFIPSGKGGGCIKNGPFAGAVANLGPPSPGMTGMEATTTPLNYNPRCLRRDLSSYSIDQWLNLPNLYNITLGKASNTIQAMQDEFQGRFSDKFLGMHAAGHFVMGGDSADLFSSPNDPVFFLHHSMVDRIYWVWQALHPRRAKDIAGTITILNTPPSRDAVKSDVLNMGVNAPLITIEDGLDTLAGSPFCYIYL

SEQ ID NO: 138744 - protein, 83 aa, Triticum aestivum
  Clone ID: PAT_TA_33162.pep
KGGTTFLSCTRAASGHTQAIHPTCVDLNFWHWFDLAYKYYIFYVTKDACDLSEAVAFLVTIHVFRKKMVIIDDVCLSSFFAIY

SEQ ID NO: 138745 - protein, 249 aa, Triticum aestivum
  unsure (1)..(249): unsure at all Xaa locations
  Clone ID: PAT_TA_33163.pep
SGRQAGDGGGGGGAGTSAGPVLDDSIMSWYLHLESGKFWFPAQVYNREHGHVGFMMSCYDAELSYDFRTDTFHARYPPHGRRTVVLEDGVQWDRFRAPHVETPAHDLHASDCLHELRPGENIEIQWRRNKEFPYGWWHXELVGHLGSCDGNEHFCRWLVSVSVVPALVPSFYSMPEPCFVCQSRSPSLLRPIFLPKRVLKIKTTAYCATNIRSRFNPTNFLASSCVFAVCSTNTFFTCVKNIPLDYLSI

SEQ ID NO: 138746 - protein, 136 aa, Triticum aestivum; identical to SEQ ID NO: 106789
  Clone ID: PAT_TA_33164.pep

SEQ ID NO: 138747 - protein, 115 aa, Triticum aestivum
  Clone ID: PAT_TA_33165.pep
GGQGPGEGVKMCALMHVLHAIVRGTDESREMVVVLRMLLSLSLTYTHTSTNRRPFSHVYTTYRHLSMSHSCMIICTFTPLYVSITHTVSTLPFRHNTHMDTYTHSLSVTHTKSVL

SEQ ID NO: 138748 - protein, 119 aa, Triticum aestivum
  Clone ID: PAT_TA_33166.pep
MHQRAHFDTVTRALPTSRPAQSLREYPFLSLGFFSQYLTHTHTHAHTHTHTHGAQHTHTHTHPSTQFIPIQGYTVTTLACASLHPNMHNTSIVKEGIEQIKDGDHTALENAGSFGSRVM

SEQ ID NO: 138749 - protein, 148 aa, Triticum aestivum
  Clone ID: PAT_TA_33167.pep
LTPPPALSLLHKITNPSLPRTKLSIPQPTRSFPSRPCFSCSLIKHVVSSPSTYTESRCTRISCILHVSIFLTYLTSYSLFLSLSLSLSVLLGLSPTLSSTYIQSFPPYLLHLCKVFLHVFFNLIGYCSKCWFFNWLFWSFVWSCCSDQ

SEQ ID NO: 138750 - protein, 285 aa, Triticum aestivum
  unsure (1)..(285): unsure at all Xaa locations
  Clone ID: PAT_TA_33168.pep
MHHPRARYPPGYDYGGGGRGGNGGGGGGGGGGGGGNQNYYGGRNPHPQHHDYQQQQQQHAQRNSFPQQQQQQHAQRNSFSQQQQQQHQQQQHQQWLRRDQAAAQASGEGAARTVARLDAVDTSSQDWKAQLNIPAPDTRFRTEDVTATKGNEFEDYFLKRELLMGIYEKGFERPSPIQEESIPIALTGSDILARAKNGTGKTAAFCIPALEKIDPEKNAIQVVILVPTRELALQTSQVCKXELGKYLXNIEVMVRSWRKQALKGTTSMRFVPNLFNLRRGTPWRT

SEQ ID NO: 138751 - protein, 439 aa, Triticum aestivum
  Clone ID: PAT_TA_33169.pep
MTRTGSSAKNKESVQTEIDMESKRSSTAAGHIADLPEQIWWAILERLPPKSVLRFRAVCKSWLNRISNNNFLEEYHGRQKPQHLIVPVDPDNTRHKMSHRVDAVDFQHPEDGFRSIISFTSFGVFEVFDTDEETAEHLMSAVQGSIGGLLLVSFEHRCYICNPGTKESRRLPQLDDHEILGLYMLGDEFRVLYLKEDEEGDAEFFVLSVHQSLSNKSIGYCPVSPAANLPEIDGPKKLGFSLQSSAIEPPAMVGANLYWAPLELWPREITVFDYQSELFHWMKLPKTKERSKSNTNNTMKVLELDGELGLSLPRARAASVELWVLDSLKMWELKHSIQLPVADITGFGAHTWDPFLMSMDGGVIVRCVSQGQGQGGEGQQGTQALLYCNRHGELAPGPLFVGDLAAPAIHLFKQSIRRHALFQGHQQDATSPLSLFRDL

SEQ ID NO: 138752 - protein, 385 aa, Triticum aestivum
  Clone ID: PAT_TA_33170.pep
SICQVFSTLSWSWSFKSVHANRESSSDACGYGYHGKTLDKLYDEEQKLYQLVKDEEFARLEYRKYSSLLKKLESGEHDRLQAEKVRENIEELQTRIMSLEEAVSLTCLTISKLRDEELYPQVIELAAGLVHMWRNMYECHEVQNHIAQQASLLGNQPGSEPTTDSHCYATSQLEGEVSAWHNSFCNLITLQREYVTILNEWIGLTDCLPDNEGFMRSSSGIRSLCGELEHALKKLPEKVAAEAIKAFLSVIHSIVLQQAEERQLKKKSDNIESKFHAQLEKHSENAMQSSRQGSHARSYSVPKDDPKRDVFRKGAEEENDRYVDSPGTSPAEAQTRHLTALPNAVPPLQGLPGARVPAVVQPRPRIQTAAQEAGYTSRGSPAGSS

SEQ ID NO: 138753 - protein, 70 aa, Triticum aestivum
  Clone ID: PAT_TA_33171.pep
LNKAELILKAFVLDLQVCCNKSYNTLMRAYCMTRSSTESLDLQNRMLELGFVPSSDTCRSLVYGLSRSIA

SEQ ID NO: 138754 - protein, 153 aa, Triticum aestivum
  unsure (1)..(153): unsure at all Xaa locations
  Clone ID: PAT_TA_33172.pep
MAPKVAVAKKGDAKAQAAKVAKAVKSGSIKKTAKKIRTSVTFHRPKTLSKARDPKYPRISTPGRNKLDQYQILKYPLTTESAMKKIEDNNTLVFIVDLKADKKKXIKAAVKKMYDIQAKKVNTLIRPDGKKKAYVKLTPDYDALDVANKIGII

SEQ ID NO: 138755 - protein, 160 aa, Triticum aestivum
  unsure (1)..(160): unsure at all Xaa locations
  Clone ID: PAT_TA_33173.pep
LPKLLLPSKGDAKAQAAKVAKXVKSGSIKKTAKXIRTSVTFHRPKXTLSKARXPKYPRISTPGEGTSLDQYSDPQGNPALHKLGECNEEDKRTTTHFVFIVDLXKADKKKDKRAAVKKMXGHSGQRKVNTLIRPDGKKKAYVKLTPDYDALDVANKIGII

SEQ ID NO: 138756 - protein, 303 aa, Triticum aestivum
  Clone ID: PAT_TA_33174.pep
MPHTVLGISCKLVMTKYVGTIFYSPVCLMQYLFHQSSAAKSYGAPHMQLNATYTGLKRVLVAAGVALKITGAQRVFFSLPHSIGLLANGRLVATNKDLSQILPLSHSTCAPLLHMRVVGSSVTIVAHETNVSGGHMKPLLTSGDAIELLSDQSEVNDMSGRLISACAFCSISPRLPKLEKLLKTWFSERNGFNRTMNFFEARVTSMTLVKFRLELERDITEEDGMWDDVPEWKTLPVVQRITLDVIARVEEEGRLKAISVKKVRKSLQIADATSWSSLTSNVSFADFTSLVLPPDPLSLDVKW

SEQ ID NO: 138757 - protein, 204 aa, Triticum aestivum
  Clone ID: PAT_TA_33175.pep
RVGTADLRSDKADGMRGLKMRRCPTQAQFNEEIQDDQAEAALVKKLLEESGNDTKRKKQPVDTTNQGANKTKQFKALTPKESTPRGAKEVDSSFTEGGLSSKLKTKLAVDANDIILVKKKNVQGKDGLKEKRQGARGDSLVCGACGQLGHMRTNKLCPKYGEDPETSEMDAISYRPNPLDVASHGQTKTLGRRLVAKVSSDVPN

SEQ ID NO: 138758 - protein, 69 aa, Triticum aestivum
  Clone ID: PAT_TA_33176.pep
MSATTGAVPFWRTAGMTYIGYSRLCASMVRSCLKEPYKSEAAEVEKVHYSRSKWSDGKQPKPTICEDDK

SEQ ID NO: 138759 - protein, 205 aa, Triticum aestivum
  unsure (1)..(205): unsure at all Xaa locations
  Clone ID: PAT_TA_33177.pep
MAAARAALLRRPGLGAAAANPVLFSGHGLRYRKLEVILTTTIDKLGKAGETVKVAPGHFRNYLMPKMLAVPNIDKFAILMREQSKLYKREEEVVVKEVSKEEDDARQAEEKLKQCQAAAKRLDNALLVFRRFISEGIELRSPVTKDEIVSEVARQLNVNIYPDNLHLVQPLSSLGRPRGATSVTXAIPRGYGKLQWTLKVRIRRP

SEQ ID NO: 138760 - protein, 123 aa, Triticum aestivum
  Clone ID: PAT_TA_33178.pep
TVLTTLLHFTVMLNSRYKGNSLHAFPEEEPKQHQVAVSRAASKGRYARFKENLNAKPQETKQHHHQVAVSCAASKGRNRDGWMSQERSTPEGINMEEHALRFQPLPPPRGRVTLTWPPSELHL

SEQ ID NO: 138761 - protein, 515 aa, Triticum aestivum
  unsure (1)..(515): unsure at all Xaa locations
  Clone ID: PAT_TA_33179.pep
MPHRPTPPSPPRPSFGTNPPHSPLAAGMDVQMGEPQAAPPPAAAAAAPAPSTIQHLKEIAAVIEAGSLSKEVRRISRAVRLTVALRRRLAARDVSAFLAFALPXNSDAYARLTPLLPKEDEAEMDIDAAAPATQISIKHGLPEIEIYCXCLVLIFLIDQKKYDEAKACATGSIARLKNLNRRTVDVLASRLYFYYSYVYELTNTLAEIRGNLLGLHRMATLHHDELGQETLLNLLLRNYLHYNLYDQAEKLRSKAPRFEAHSNQQFCRYLFYLGKIRTIQLEYTDAKESLLQAARKAPAAARGFRIQCNKWAIIVRLLLGEIPERTVFMQKGMKEALAPYFELTNAVRIGDLELFRAVADKFASTFSADRTHNLIVRLRHNVIRTGLRNISISYSRISLADIAKKLRLDTENPVADAECIVAKAIRDGAIDATIDHANGWMVSKETGDVYSTNEPQAAFNSRIAFCLNMHNEAVKAMRFPPNSHKEKESAEKRRERLQQEEELAKHMAEEDDDDF

SEQ ID NO: 138762 - protein, 100 aa, Triticum aestivum
  Clone ID: PAT_TA_33180.pep
PASLTAPPALRRVRVRLLSREAVKPGPARRPLPQPASCLLRPTRPSRLCLLSFVSCLVTFEQCFWLSLHNSTHWVYSNLSLLPACGRLYVHKLCNRSFLV

SEQ ID NO: 138763 - protein, 148 aa, Triticum aestivum
  Clone ID: PAT_TA_33181.pep
TYRCDQSSCPLRGTSLIGVGAAPTNLHKALQNFHMLWCPSENISTSEPCAFNLGRHLSNITIFSCRKGSNFPHLKEKNHFFSCRKHQALRRRTKDDALELLQDSKETANTAVRTRVGEGRCRWNRWDTRQTQKFTSHVVLYIFTHYWS

SEQ ID NO: 138764 - protein, 153 aa, Triticum aestivum
  Clone ID: PAT_TA_33182.pep
MAMALGSLQTSNPTISSFQCTQSLSHSSELSCPSRISTGSTLPSKTTKELFGIETEYCVAKASCAQVSQLGKPSSSQSNEVSWPANLRHQVEQLDHGTVIVGKNWCNHQAIFPKGFRSRVTFYSVLDPTRICCYISEVIDAGLLEPLFRVAVE

SEQ ID NO: 138765 - protein, 78 aa, Triticum aestivum
  Clone ID: PAT_TA_33183.pep
LEKVHVCCYLGLEKTFRLKFVKETTLKFVEKKVCLVHEARSYILVLFTDEFTIVKAEDHQYLKNVVPWELRKQHQAAS

SEQ ID NO: 138766 - protein, 225 aa, Triticum aestivum
  Clone ID: PAT_TA_33184.pep
RHEGKNYHTGTPRTSPRFELKPECRNGPLEELPAEALTSEGGDAELVREKMQHPGKDYHTGTPGTSASFEPKRECHNGPVEELLAEALTSEGGDAELVRGKVKRPKKNYHTGTPRTSPRFEPKHEYHNGPVEELPAEALTSEVGDAELVRGKLKHPRKNYHTGTPRTSPRFEPKHDCRNGPVEELPAEALISEGGDAELVRGKVKRPKNYHTGTPRTSPRFEPKA

SEQ ID NO: 138767 - protein, 133 aa, Triticum aestivum
  Clone ID: PAT_TA_33185.pep
SRVSDEAVGACGAGTTSSHVLGRACGRERSDVGCEPRSCRELPCFVRTSAHQNTRVKTSKWIEWLHVAPRAVFGSLSQRAWLHLVWLFAYHLLFFFFELAYHLLHPYRNTPSVPKNMSQTQFICNFAKKPSQI

SEQ ID NO: 138768 - protein, 280 aa, Triticum aestivum
  unsure (1)..(280): unsure at all Xaa locations
  Clone ID: PAT_TA_33186.pep
MRHVLKLSVTNMTQDYYAIGRYDDVADTFVPEVDGERSVEDCRTWRRFDYGHVYASKSFFDXARTDACSGHGLASPIASTMTLPEAGPVFXIVPRKVWLDGDGKQLRQGPIEEIETLRSKRVAALQGAHVNAGGVNEISGAGAQADVDAIFEIPSLEEAETFEPNWLLDPQKLCEENGASVPGGVGPFGLLVMASSDLQEHTAVFFRVFRHTLRNXIARAAAARDGGGGRTCITARVYPEHAENKNSHVFVFNNGSRLVKVSKLEAWRLAMASVNVVHGG

SEQ ID NO: 138769 - protein, 330 aa, Triticum aestivum
  unsure (1)..(330): unsure at all Xaa locations
  Clone ID: PAT_TA_33187.pep
QLRQQRALQQLGMMQSSAWRPQRGLPERSVSILRAWLFEHFLHPYXKDSDKIMLAKQTGLTRSQVSNWFINARVRLWKPMVEEMYLEETKEHQQQQDGGDDKGRPSGSGPAGGKSSSNADGVDDGTPRSMARAAAGAGTSEGGGTVQASLLELAGDHQAHAGFYDEEGEDGGLRRGFKKARAAGLEQQPPAAFDFGALHHAQAAAGGRGRRSEAAARRGDPPGAAHEDDGERRRGGREGPPPPPTGRGRGRRRVLSVRAGAQFGTDQSFAFAGAGGGVSLTLGLPHRRRPDGVGGGSSNGADSGGSGAAGYDMNMQTTKSFAAQLMDFVA

SEQ ID NO: 138770 - protein, 143 aa, Triticum aestivum
  unsure (1)..(143): unsure at all Xaa locations
  Clone ID: PAT_TA_33188.pep
EKYVIQYETDGSEHPHSPWEVHDARPPVGPWPFXTLESQLQEQMVXAVLGLQEKALRNQDRYGVLKLDTVAGKSDFINRFPVQFSIEVIRARLQSDYYRTLEAVKHDATVMLANAKSYFSKSGEMTKKIRKLFEWIQDKILSL

SEQ ID NO: 138771 - protein, 59 aa, Triticum aestivum
  Clone ID: PAT_TA_33189.pep
MRSHPSAASFLEELAHFPSPPALQSQFWLWLVTWHLGLFIALTFGQIGFKGRTEDYFQK

SEQ ID NO: 138772 - protein, 264 aa, Triticum aestivum
  unsure (1)..(264): unsure at all Xaa locations
  Clone ID: PAT_TA_33190.pep
RNSDEGSTSXXCPWYKGWEKETXAKATGKTLLEAIDAIDPPTRPTDKALRLPLQDVYKIGGIGTVPVGRVETGIIKAGMVVTFAPAGVTTEVKSVEMHHEQLPEGLPGDNVGFNVKNVSVKEIRRGNVAGDSKNDPPKGCESFNAQVIVLNHPGQVGAGYAPVLXDCHTAHIACKFSELLEKIDRRTGKSMEASPKFIKSGDAAIVKMVPSKPMCVEAFTDYPPLGRFAVRDMRQTVAVGVIKSVEKSDKAGKVTKAAQKASKK

SEQ ID NO: 138773 - protein, 119 aa, Triticum aestivum
  unsure (1)..(119): unsure at all Xaa locations
  Clone ID: PAT_TA_33191.pep
SRVGGGPLGEGLDIIYPGGAFDPLGLAEDPDPPVELKVKEVKNGPPAMFSMFGFFGQAIVPGKGPVXNLFDPVADPVNNNGWAFAPNFAPGSLMCLAIRPSVRPLDEICMGTCTLWINV

SEQ ID NO: 138774 - protein, 145 aa, Triticum aestivum
  unsure (1)..(145): unsure at all Xaa locations
  Clone ID: PAT_TA_33192.pep
KRAAATSTVSGLAGAGFTRGPAFSTSFTRGARGPARNPLMTRNRERNGRIPXMTFPGNGLRRNLNGIGFGLMGGLEPSSIPLIKGNSLRGFFFSRIGEEFAHFPLPPVFQLQFWLGLVTWXLGLFIGLTFGQIGFKGRTEDYFQK

SEQ ID NO: 138775 - protein, 104 aa, Triticum aestivum
  Clone ID: PAT_TA_33193.pep
HQLHVCLPSSTNKTRLLYRMSLDFAPWMKHMPFMHLLWSHFAEKVLNEDLRLVLGQQDRMNNGANVWNWPVSYDKLGIRYRLWRDAVERGVDRLPFSNEIESGS

SEQ ID NO: 138776 - protein, 85 aa, Triticum aestivum
  Clone ID: PAT_TA_33194.pep
QTAITRLAKPHACTKPKGMTDFTLNTHAQKQPLNSLRTMHMHELKLVNSLLLEVVLGPALEPDLAEGERDEQTQVPRQHLYTLLQ

SEQ ID NO: 138777 - protein, 84 aa, Triticum aestivum
  Clone ID: PAT_TA_33195.pep
WFICYNPLHGSWQIATNTLERVAPLTHAVGNVLKRVFVIGFSIIIFGNKITTQTGIGTWVAKAGVALYWDIKAKIEEEKRAKAA

SEQ ID NO: 138778 - protein, 174 aa, Triticum aestivum
  unsure (1)..(174): unsure at all Xaa locations
  Clone ID: PAT_TA_33196.pep
GXSVEMHHEQLPEGLPGDNVGFNVKNVSVKEIRRGNVAGDSKNDPPKGCDSFNAQVIVLNHPGQVGAGYAPVLDCHTAHIACKFSELLEKIDRRTGKSIEASPKFIKSGDAAIVKMVPSKPMCVEAFTDYPPLGRFAVRDMRQTVAVGVIKSVEKSDKGGAGKVTKAAQKAGKK

SEQ ID NO: 138779 - protein, 176 aa, Triticum aestivum
  Clone ID: PAT_TA_33197.pep
NSARGKSVEMHHEQLTEGVPGDNVGFNVKNVSVKEIRRGNVAGDSKNDPPKGAESFNAQVIVLNHPGQVGAGYAPVLDCHTAHIACKFSELLEKIDRRTGKSVENSPKFIKSGDAAIVKMVPSKPMCVEAFTDYPPLGRFAVRDMRQTVAVGVIKSVAKADKAGKVTKAAQKASKK

SEQ ID NO: 138780 - protein, 183 aa, Triticum aestivum
  unsure (1)..(183): unsure at all Xaa locations
  Clone ID: PAT_TA_33198.pep
LVFWNLLDRGRLPRFRRPSRSSSSPNSYRDCDGLRFVHIFSGPLIRSRGSLLLLPDADRHDRCPELVALLCPTSPLTAGCVWGATLFLFQXLAGTNAVVYYSTSMFHSTCIASNVAASALVXGDANVFGTMIASPLMVKQGRKSLLITRLSGXGASMLLLTLSFTWKALAPYYGTLVVVGTVL

SEQ ID NO: 138781 - protein, 75 aa, Triticum aestivum
  Clone ID: PAT_TA_33199.pep
AWSRPRLTIGGAFFLFAGIASFAWVFFFAYLPETRGRTLEDMSSLFGHTATHKQGAADADDDAGKEKKVEMAATN

SEQ ID NO: 138782 - protein, 76 aa, Triticum aestivum
  Clone ID: PAT_TA_33200.pep
HIFKAFEYFDKDHSGYITVDELEEALKKYDMGDEATIKDIIAEVDTDHDGKINYQEFVAMMKNNSPEIVPNRRRLF

SEQ ID NO: 138783 - protein, 96 aa, Triticum aestivum
  Clone ID: PAT_TA_33201.pep
IWSDGFRRSSCIASETTWTDLFFVICFLFFSYLLKCSLVRSNSYIADGKTGCFHQMRELRCAVINARTMDLMDSPLWPYLCPLLILDLCTCPGGRS

SEQ ID NO: 138784 - protein, 87 aa, Triticum aestivum
  Clone ID: PAT_TA_33202.pep
NKRAARSPGAMQTGWCSGCCGTSKAQLSLVTSQNQRAFVALLQEVRDLGWLLVLGSDVIVFSVQMNSLYVSELGNKTPICRISKRDI

SEQ ID NO: 138785 - protein, 86 aa, Triticum aestivum
  Clone ID: PAT_TA_33203.pep
YTILPSICSCISCLINLHCAQPARGHLARSIMVSGPGEGVVGYTTGNGATPHHDLRSPFKIDKNGRLTFNGVGAKACPGTCPGGRS

SEQ ID NO: 138786 - protein, 61 aa, Triticum aestivum
  Clone ID: PAT_TA_33204.pep
LFAGIASFAWVFFFAYLPETRGRTLEDMSSLFGTTATHKQGAAEADDGAGKEKKVEMAATN

SEQ ID NO: 138787 - protein, 232 aa, Triticum aestivum
  unsure (1)..(232): unsure at all Xaa locations
  Clone ID: PAT_TA_33205.pep
PWPSISNGAKDLVKRMLRQDPKERLTAAEILNHPWIREDGEAPDKPLDITVISRMKQFRAMNKLKKVALKIVVESLSEEGIVGLREMFKSLDTDNSGTITLDELRAGLPKLGTKITESXEIRQLMEAADVDGNGTIDYVEFISATMHMNRLEXREDHIFKAFEYFDKDHSGYITVDELEEALKKYDMGDEATIKDIIAEVDTDHDGKINYQEFVAMMKNNSPEIVPNRRRLF

SEQ ID NO: 138788 - protein, 217 aa, Triticum aestivum
  unsure (1)..(217): unsure at all Xaa locations
  Clone ID: PAT_TA_33206.pep
AKGEPSSSSPFFPIPSSSLASSPLIPLHSAPKGRPAASARSRRCDDVVFHPSPRQPLHSRKVPLSPPVKMMRCAVRGGGAHVVIGERRSPSSSPGSGRSVVRMSEGRGGXCCGGVRSRAADLAGLEMGRPSAGAAGLFRCPRYGRVRATASADPEDIPSDKLQAKSSGSVLPYVGVACLGAILFGYHLGVVNGALEYLSKDLGIAENAVLQGWTPSL

SEQ ID NO: 138789 - protein, 122 aa, Triticum aestivum
  Clone ID: PAT_TA_33207.pep
ASSEPPPSSSTLSSSPRLVKGAGEGVEELACIALPQHRFHGLGCSHFARRYYGNRFCFLFLWLLRCFSSPGCLLPAHGFSRQFKRLTYLGISGSMLIFNSPKHFVACYALPRLWVPRSRAEF

SEQ ID NO: 138790 - protein, 106 aa, Triticum aestivum
  Clone ID: PAT_TA_33208.pep
HLHQLHVCLPSSTNKTRLLYRMSLDFAPWMKHMPFMHLLWSHFAEKVLNEDLRLVLGQQDRMNNGANVWNWPVSYDKLGIRYRLWRDAVERGVDRLPFSNEIESGS

SEQ ID NO: 138791 - protein, 142 aa, Triticum aestivum
  Clone ID: PAT_TA_33209.pep
RSWDTDNSGTITLEELRSGLPKLGTKISESEITQLMEAADVDGNGTIDYSEFVSATMHMNRLEKEDHILKAFEYFDKDHSGYITVDELEEALKKYDMGDDKTIKDIIAEVDTDHDGRINYQEFVAMMRNNSPEIVPNRRRMF

SEQ ID NO: 138792 - protein, 82 aa, Triticum aestivum
  Clone ID: PAT_TA_33210.pep
MSGAQGAHPVGETTPTTYGSVGGGENRTRTDLRSREDQGNIQIEKVQDKVEDAASRKVDDSAFAARKEPGQAGDAGATGTGA

SEQ ID NO: 138793 - protein, 82 aa, Triticum aestivum
  unsure (1)..(82): unsure at all Xaa locations
  Clone ID: PAT_TA_33211.pep
MSGAQGAHPVGETTPTTYGSVGGGENRTRTDLRSREDQGNIQIDKVQDKVEDAASRKVDDSAFAARKEPGQXGDAGATGTGA

SEQ ID NO: 138794 - protein, 148 aa, Triticum aestivum
  Clone ID: PAT_TA_33212.pep
MKMAGSAVLLISLLSAVAPLPSEALNVRGHLLKSKTFRSPPILLGPGSVSNKYHHDVDFPRGHLAVKSFDAEVVDENGVPVPLHETYLHHWVAEPYYALKNSQSPDTQNLPKGMLKRNDGVCKTTLGQYFGLGSETRHTATWVLILWN

SEQ ID NO: 138795 - protein, 174 aa, Triticum aestivum
  unsure (1)..(174): unsure at all Xaa locations
  Clone ID: PAT_TA_33213.pep
MSLPPTDGGDDWFLDCGILEDLPAAACGAFPWDASVSSSNPSAEVGSYMNNSDVPKDSGSNKRLRSEPCGRPTSKACREKVRRDKLNDRFLELGTTLDPGKPVKSXDKAAILSDATRMVTQLRAEAQQLKDTNGSLEDKIKELKAEXDELRDEKQKLKLEKETLEHQMKLLTAT

SEQ ID NO: 138796 - protein, 144 aa, Triticum aestivum
  Clone ID: PAT_TA_33214.pep
MAAATSTVSGLAGAALTRRPAFSTSFTSGARVSARNPLMTRNLERNGRITCMTFPRDWLRRDLNVIGFGLIGWLAPSSIPLINGNSLTGLFFSSIGEELAHFPSPPALQSQFWLWLVTWHLGLFIALTFGQIGFKGRTEDYFQK

SEQ ID NO: 138797 - protein, 148 aa, Triticum aestivum
  unsure (1)..(148): unsure at all Xaa locations
  Clone ID: PAT_TA_33215.pep
MASLVAVQPVAVRGLAGSSISGRKLAVRPASAAVSRSTRRARGAAVVAKYGEKSVYFDLDDIANTTGQWDLYGQATAASPYNGLAEXKFFNTFAAPFTKRGAGCSKVLXLLGRAGSLLAXVSATASPDLLPIKKGPQLPPTPGPRGKI

SEQ ID NO: 138798 - protein, 115 aa, Triticum aestivum
  Clone ID: PAT_TA_33216.pep
VGTVLYVLSFALGAGPVPALLLPEIFASRIRAKAVALSMGMHWVSNFFIGLYFLSVVNKFGISTVYLGFASVCALAVLYIAGNVVETKGRSLEEIERELSPPSKADANAFLVSDQ

SEQ ID NO: 138799 - protein, 249 aa, Triticum aestivum
  Clone ID: PAT_TA_33217.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFATNFAPGS

SEQ ID NO: 138800 - protein, 422 aa, Triticum aestivum
  unsure (1)..(422): unsure at all Xaa locations
  Clone ID: PAT_TA_33218.pep
MAAASFTAAKFLAPAAARSGGDRARPFPAPSASSMRPLRHRPARRLGSVLAVSSDVLKAAPAAAAYPAVTREEALELYEDMILGRNFEDMCAQMYYRGKMFGFVHLYNGQEAVSTCFIKQLNQPDCVVSTYRDHVHALSKGVPARAVMADLFGKATGCCRGQGGSMHMFSEPHNLLGGFAFIGEGIPVATGAAFAAKYRHEVLKQSSPDGLDVTLAFFGDGTCNNGQFFECLNMAQLWKLPIIFVVENNLWAIGMSHLRSTSDPEIWKKGPAFGMPGVHVDGMDVLKVREVAKEAIDRARRGEGPTLVECETYRFRGHSLADPDELRRPXEKSHYAARDPITSLKKYIIEQNLASEAELKSIEKKIDDVVEEAVEFADASPLPPRSQLLXENVFADPKGFGIGPDGKYRCEDPKFTQGTAQV

SEQ ID NO: 138801 - protein, 626 aa, Triticum aestivum
  unsure (1)..(626): unsure at all Xaa locations
  Clone ID: PAT_TA_33219.pep
IDSAPSELSDLGKKIYPSLAPVVFLLRPPPSHLHPSHNPPASSPLIPLHSAPGAPAASGRRKVPLLPPVKMMRCAVRGGGAHVVIGERRSPSSSSPGSGRSVVRMSEGRGGLCCGGVRSRAADLAGLEMGRPSAGAAGLFRSTRYGRVRATASADPEDIPSDKLQAKSSGSVLPYVGVACLGAILFGYHLGVVNGALEYLSKDLGIAENAVLQGWVVSTTLAGATVGSFTGGALADKLGRTRTFILDAIPLAVCAFLSATSQDVRTMIIGRLLAGIGIGISSALVPLYISEISPTEIRGALGTINQLFICIGILAALVAGLPLAQNPAWWRTMFGISIVPSILLXALGMAVSPESPRWLFQQGKISQAEAAIKKLYGKEKVTEVMYDLKASGQGSNEPDAXWFDLFSKRYWKVVSVGAALFLLQQLAGINAVVYYSTSVFRSAGIASDVAASALVGAANVFGTMIASSLMDKQGRKSLLITSFSGMAASMLLLSLSFTWKALAPYSGTLAVVGTVLYVLSFALGAGPVPALLLPEIFASRIRAKAVALSMGMHWVSNFFIGLYFLSVVNKFGISTVYLGFASVCALAVLYIAGNVVETKGRSLEEIERELSPPNKADANAFLVSDQ

SEQ ID NO: 138802 - protein, 330 aa, Triticum aestivum
  unsure (1)..(330): unsure at all Xaa locations
  Clone ID: PAT_TA_33220.pep
QMYYRGKMFGFVHLYNGQEAVSTGFIKQLNQPDCVVSTYRDHVHALSKGVPARAVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIIFVVENNLWAIGMSHLRSTSDPEIWKKGPAFXGMPGVHVDGMDVLKVREVAKEAIDRARRGEGPTLVECETYRFRGHSLADPDELRRPDEKSHYAARDPITSLKKYIIEQNLASEAELKSIEKKIDDVVEEAVEFADASPLPPRSQLLENVFADPKGFGIGPDGKYRCEDPKFTQGTAQV

SEQ ID NO: 138803 - protein, 229 aa, Triticum aestivum
  Clone ID: PAT_TA_33221.pep
LAWSRPRSKNYTGGLFCCYDQTQCRVKEGFNGEVRKLFLQYTVTWLDWTDAVVPVKIYIFDVTDTAMLDGTPEHSCKVEYQVEECSAENRANNECIHTKTARAALPRGGDIVFSVAHQHSGGVGASLHGQDGRLLCESLPTYGTGKEAGNEANYIVGMSTCYPKPGSIKVSDGEVLTIVSNYSSDRQHTGVMGLVYILVAEPQQPTPAPSLCFSFPVPWCLPAWMSSNM

SEQ ID NO: 138804 - protein, 424 aa, Triticum aestivum
  Clone ID: PAT_TA_33222.pep
MKMAGSVVLLISLLSAIAPLPSEALNVRGHLLKSKTFRSPPILLGPGSVSNKYHHDVDFPRGHLAVKSFDAEVVDENGVPVPLHETYLHHWVAEPYYALKNSQSPDTQNLPKGMLKRNDGVCKTTLGQYFGLGSETRHTATWVPDPYGIEIGNEDKAPEGYEEKWLLNIHAIDTRGVVDKPSCTECKCDFYNVTIDEYGRTISKNYTGGLFCCYDQTQCRVKEGFNGEVRKLFLQYTVTWLDWTDAVVPVKIYIFDVTDTAMLDGTPEHSCKVEYQVEECSAENRANNECIHTKTARAALPRGGDIVFSVAHQHSGGVGASLHGQDGRLLCESLPTYGTGKEAGNEANYIVGMSTCYPKPGSIKVSDGEVLTIVSNYSSVRQHTGVMGLVYILVAEPQEPAPAPSLCFSFPVPWCLPAWMSSNM

SEQ ID NO: 138805 - protein, 535 aa, Triticum aestivum
  unsure (1)..(535): unsure at all Xaa locations
  Clone ID: PAT_TA_33223.pep
ASADAWADAWADAWVGNRTSRHRRAAADQPATAPPPAAQPKPQPPPKPQTAPAPAPTPEAGQVAMGRVLGRPMEDVRATYTFGRELGRGQFGVTYLVTHKATGQRFACKSIATRKLVHRDDIEDVQREVQIMHHLTGHRNIVELRGAYEDRHSVNLIMELCEGGELFDRIIARGHYSERAAALLCREMVSVVHSCHSMGVFHRDLKPENFLFLNNKEDSPLKATDFGLSVFFKHGEQFKDLVGSAYYVAPEVLKRHYGAEADIWSAGIILYILLSGVPPFWADNEDGIFEAVLLGHIDFSSDPWPSISNGAKDLVKKMLRQDPKERLXTAAEILNHPWIREDGEAPDKPLDITVIXSRMXQFRAMNKLKKVALKIVAENLSEEEITGLKEMFRSLDTDNSXGTITLEELRSGLPKLGTKISESEITQLMEAADVDGNGTIDYSEFVSATMHMNRLEKEDHILKAFEYFDKDHSGYITVDELEEALKKYDMGDDKTIKDIIAEVDTDHDGRINYQEFVAMMRNNSPEIVPNRRRMF

SEQ ID NO: 138806 - protein, 423 aa, Triticum aestivum
  unsure (1)..(423): unsure at all Xaa locations
  Clone ID: PAT_TA_33224.pep
MKMAGSAVLLISLLSAIAPLPSEALNVGGHLLKSKTFRSPPILLGPGSVSNKYYHDVDFPRGHLAVKSFNAEVVDENGVPVPLHETYLHHWVAVPYYALKDNQSSDAQKVPAMLKGNDGVCKRALTQYFGLGSETRHTATWVPDPYGIETGNQEKAPEGYEEKWLLNIHAIDTRGVADKPSCTECKCDFYNVTIDEYGRTVSKNYTGGLLCCYDQTQCRLKAGFNAEVRXVFLQYTVTWLDWTDAVVPVKIYIFDVTDTAMLDGTHEHSCKVEYQVEECSAENRANNECIHTKTTRAVLPRGGDIVYSVAHQHSGGVGASLHGQDGRLLCESLPTYGTGKEAGNEANYIVGMSSCYPKPGSIKVSDGEVLTIVSNYSSDREHTGVMGLVYIPRGPEPAAAGSRRHPCASVFPAPWVPYPGMDV

SEQ ID NO: 138807 - protein, 402 aa, Triticum aestivum
  Clone ID: PAT_TA_33225.pep
MPALGTLSAGGAAAGVAGLLRLRRGPALASPLPAAARAGAVHDGAQLVWGRQLRPALVLPAGLLPLQASKRLTLRPPAASAEPAGEAKSPGLLEKYPAITTGFFFFMWYFLNVIFNILNKKIYNYFPYPYFVSVIHLLVGVVYCLLSWAVGLPKRAPINATLLKLLFPVALCHALGHVTSNVSFATVAVSFAHTIKALEPFFNAAATQFVLGQTVPLSLWLSLAPVVLGVSMASLTELSFSWKGFINAMISNISFTYRSIYSKKAMTDMDSTNVYAYISIIALVVCIPPALIIEGPQLMQYGLNDAIAKVGMTKFVSDLFLVGLFYHLYNQIATNTLERVAPLTHAVGNVLKRVFVIGFSIIIFGNKITTQTGIGTCIAIAGVALYSYIKAKIEEEKRAKAA

SEQ ID NO: 138808 - protein, 143 aa, Triticum aestivum
  Clone ID: PAT_TA_33226.pep
MASLVAVQPVAVRGLAGSSISGRKLAVRPSSAAVSRSTRRARGAAVVAKYGEKSVYFDLDDIANTTGQWDLYGSDAASPYNGLQSKFFNTFAAPFTKRGLLLKVLLLGGGSLLAYVSATASPDLLPIKKGPQLPPTPGPRGKI

SEQ ID NO: 138809 - protein, 145 aa, Triticum aestivum
  Clone ID: PAT_TA_33227.pep
MAAAASSTVSGLAGAALARRPAFSTSFTSGGRVSARNPLMTRNLERNGRITCMTFPRDWLRRDLNVIGFGLIGWLAPSSIPLINGNSLTGLFFSSIGEELAHFPSPPALQSQFWLWLVTWHLGLFIALTFGQIGFKGRTEDYFQK

SEQ ID NO: 138810 - protein, 143 aa, Triticum aestivum
  Clone ID: PAT_TA_33228.pep
MASLVAVQPVAVRGLAGSSISGRKLAVRPASAAVSRSTRRARGAAVVAKYGEKSVYFDLDDIANTTGQWDLYGSDAASPYNGLQSKFFNTFAAPFTKRGLLLKVLLLGGGSLLAYVSATASPDLLPIKKGPQLPPTPGPRGKI

SEQ ID NO: 138811 - protein, 315 aa, Triticum aestivum
  Clone ID: PAT_TA_33229.pep
ESPGLLEKYPAITTGFFFFMWYFLNVIFNILNKKIYNYFPYPYFVSVIHLLVGVVYCLLSWAVGLPKRAPINATLLKLLFPVALCHALGHVTSNVSFATVAVSFAHTIKALEPFFNAAATQFVLGQTVPLSLWLSLAPVVLGVSMASLTELSFSWKGFINAMISNISFTYRSIYSKKAMTDMDSTNVYAYISIIALVVCIPPALIIEGPQLMQYGLNDAIAKVGMTKFVSDLFLVGLFYHLYNQIATNTLERVAPLTHAVGNVLKRVFVIGFSIIIFGNKITTQTGIGTCVAIAGVALYSYIKAKIEEEKRAKAA

SEQ ID NO: 138812 - protein, 143 aa, Triticum aestivum; identical to SEQ ID NO: 138810
  Clone ID: PAT_TA_33230.pep

SEQ ID NO: 138813 - protein, 144 aa, Triticum aestivum; identical to SEQ ID NO: 138796
  Clone ID: PAT_TA_33231.pep

SEQ ID NO: 138814 - protein, 144 aa, Triticum aestivum
  Clone ID: PAT_TA_33232.pep
MAAATSTVSGLAGAALARRPAFSTSFTSGGRVSARNPLMTRNLERNGRITCMTFPRDWLRRDLNVIGFGLIGWLAPSSIPLINGNSLTGLFFSSIGEELAHFPSPPALQSQFWLWLVTWHLGLFIALTFGQIGFKGRTEDYFQK

SEQ ID NO: 138815 - protein, 460 aa, Triticum aestivum
  Clone ID: PAT_TA_33233.pep
MGKEEKTHLNVVVIGHVDSGKSTTTGHLIYQCGGIDKRTIEKFEKEAAELGKGSFKYAWVLDKLKAERERGITIDIALWKFETPRYYVTVIDAPGHRDFIKNMITGTSQADCAILIIAAGTGEFEAGISKDGQTREHALLAYTLGVKNLIVAINKMDTTKWSEARYQEIIKETSSFIKKVGYNPKAVAFVPISGFNGDNMLTASTNCPWYKGWEREIKSGKLSGKTLLEAIDSIEPPKRPNDKPLRLPLQDVYKIGGIGTVPVGRIETGIIKPGMVVTFAPSNVTTEVKSVEMHHEQLTEGQPGDNVGFNVKNVSVKDIRRGNVAGDSKNDPPMGAASFTAQVIVLNHPGQVGAGYAPVLDCHTAHIACKFAEIQEKIDRRTGKATEAAPKFIKSGDSAIVKMVPSKPMCVEAFTDYPPLGRFAVRDMRQTVAVGVIKAVEKSTGAAGKVTKSAAKAGKK

SEQ ID NO: 138816 - protein, 263 aa, Triticum aestivum
  Clone ID: PAT_TA_33234.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVNNNAWAFATNFAPGS

SEQ ID NO: 138817 - protein, 263 aa, Triticum aestivum
  unsure (1)..(263): unsure at all Xaa locations
  Clone ID: PAT_TA_33235.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTXPELKVKELKNGRLAMFSMFGFFVQAIVTGKGPVENLFDHVADPVNNNAWAFATNFAPGS

SEQ ID NO: 138818 - protein, 420 aa, Triticum aestivum
  unsure (1)..(420): unsure at all Xaa locations
  Clone ID: PAT_TA_33236.pep
AAASFTAAKFLAPAAARSGGDRAPFPAPSAFSMRSLRHRPARRLSSVLAVSSDVLKAAPARRRVSXLFTREEALELYEDMILGRNFEDMCAQMYYRGKMFGFVHLYNGQEAVSTGFIKQLNQPDCVVSTYRDHVHALSKGVPARAVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIIFVVENNLWAIGMSHLRSTSDPEIWKKGPAFGMPGVHVDGMDVLKVREVAKEAIDRARRGEGPTLVECETYRFRGHSLADPDELRRPDEKSHYAARDPITSLKKYIIEQNLASEAELKNIEKKIDDVVEEAVEFADASPLPPRSQLLENVFADPKGFGIGPDGKYRCEDPKFTQGTAQV

SEQ ID NO: 138819 - protein, 114 aa, Triticum aestivum
  Clone ID: PAT_TA_33237.pep
ETQSMKQLSGGQKTVVALTLIFAIQRCDPAPFYLFDEIDAALDPQYRTAVGSVVRRLADLADTQFIATTFRPEILKVADKIYGVTHKNRVSFINVVSKEQAMDFIEHDQTANAS

SEQ ID NO: 138820 - protein, 304 aa, Triticum aestivum
  Clone ID: PAT_TA_33238.pep
VRQLKKQRDDLKALEANLEQTVQDGAKDLEQLMSSRSTYLVKQDECMKKIRDLGSLPADAFETYKRKNKKQLQKLLYDCNEQLKQFSHVNQKALDQYVNFTEQREQLQRRRAELDAGDEKIRELISVLDQRKDESIERTFKGVARHFREVFSELVQGGHGYLVMMKKKDGDAGDDDMDEDAPREADPEGRIEKYIGVKVKVSFTGKGETQSMKQLSGGQKTVVALTLIFAIQRCDPAPFYLFDEIDAALDPQYRTAVGSVVRRLADLADKIYGVTHKNRVSFINVVSKEQAMDFIEHDQTANAS

SEQ ID NO: 138821 - protein, 577 aa, Triticum aestivum
  Clone ID: PAT_TA_33239.pep
GPESRVDPRVRNNLFSGPIPPKLLNIPNLKKDGNPFNTSIAPSTSPSLTPTGPTPTQTPSSPSSPSGTPSSSNTPSSSSGGSTARDSRSSSGKHKSSTLRTVGYVFLGIVLFIIVVLLVIFCLSKYQERQSRHDYTTSQVGRVHQRVEEPKVKQASAQPRNDVKKGSAGVPDRKHVREINLAIPAALEKPPEKREERVINLERTESDIFAVEPPPPPPPPPPPPPVSPPPPPPPLPPPPPVSPPPPPLVEKVIVNPIVKPEKRASTPPRAGPSTSATSFSVATLQQYTNSFAEENLIRESRLGKVYLAELPEGKLLEVMKIDNANGRIPVDDFLELVACISDIRHPSILELVGYCAEYGQRLLVYNHFSRKTLHDVLHEREDLDSALSWGARLQVALGSAKALEYLHDTCEPPVVHQNFEPANVLLDNRFSVRVAECGLSVLTLSSSVTQLSGRMRALLNYEAPEIQESGTFTDRSDVYSFGVVMLELLTGRKPYDSSRPRHEQHLVRWAQSQFHDIESLIKIVDPSIRGECSEKVLSRFVDIISRCIPPEPEFRPPMSEIVQDLASILNAAGEESE

SEQ ID NO: 138822 - protein, 370 aa, Triticum aestivum
  Clone ID: PAT_TA_33240.pep
MSGGVDPETPPSSGGSATGSPMARKPPRHQLTAIRHCASSARIAAASTDLGLDSGTLSLISPADIRPSFLPVFRSGSCANIGPKSYMEDEHVCIDSLIEHLGMRTPAIPAPGAFYGVFDGHGGTDAVCFVRKNLLKFIIEDGHFPNSMEKAIRSAFVKADHAIADSHSLDRNSGTTALTALIFGRTLLVANAGDCRAVLGKRGRAVELSKDHKPSCKSEKLRIENLGGIVFDGYLNGQLSVARAIGDWHVKGSKGSISPLTPEPEFQEVRLTEEDEFLIIGCDGLWDVMTSQCAVSMVRKELMAHNDPERCSRELVQEALRRDTCDNLTAVVVCFSADPPPQIEIPRFRVRRSISMEGLHMLKGALDSNA

SEQ ID NO: 138823 - protein, 184 aa, Triticum aestivum
  unsure (1)..(184): unsure at all Xaa locations
  Clone ID: PAT_TA_33241.pep
GMYLAXASEKGTMIRVYIVAQAXTKSHSFRRGAYPSTIYSLSFGPCIDRPDVLAATSSSGSLHMFFLDSARNGRNQTNKLLGSIIPGSKAISDALDPANHHVIHNIAPAETKSCLAVHSVEYSQNSSKFPAVRTVVYVVTHDGYFREYTISTTKSNESSWVLEREFSLLDTGYTLKQNEHHHVD

SEQ ID NO: 138824 - protein, 150 aa, Triticum aestivum
  Clone ID: PAT_TA_33242.pep
NSSRGSRQIPIPLPSRSPLCSRLVASPSPILPPLSPNPSEQIADGSGLGELVRRRRHLRLLRLPRALLLHQPLHRRRRRRGGGQRPPPHARRRPLRPAPARLRPRPRRSRRQGWTEPGAGSSPPARVTASPAPLHRLRTAYSSPRPRPLL

SEQ ID NO: 138825 - protein, 387 aa, Triticum aestivum
  Clone ID: PAT_TA_33243.pep
DVYEQVGCKETFVGGKERYVISDDMKIKPASTRTMLLLPQAFGSDGIGHAFEEVEVSVSGTQVLSMLNASLSSDTVLTDAFLSKGTDNHKAAHATVTPIIRQNIIPLDQDSAGSSPEWTIEVFYHTREKKVMYAKCNHEFVDMLLGFLTYPISCVIKNMGAGTCHLGRCFDNLYRSVTDLDDVGHLAGVLSNMMFLDPGIMPFDIFTNIRSYRALDCRCPKDDNKHYCWHPELVEGGNYSSGDDLLVHQTSAMSVMKHWCGIDKANVLEMGIAVGKQEAVALLRALLTSETALTDVFISRLEEMQIFVKFSWGKTITVQVVRSDTIATVKSRMKDKVSMPTGCRHKLLYASRYLRDSCTVSDYNITRESTITCEFHKLMPTAGQDEA

SEQ ID NO: 138826 - protein, 189 aa, Triticum aestivum
  unsure (1)..(189): unsure at all Xaa locations
  Clone ID: PAT_TA_33244.pep
PLSSISRKSPQGIQLRKSASVGDWIVNAKPTSNSHHLKELCNSSVSSSVLIPHLENLVQQTTLQQDLIVNLLSSMQQNEKADGKCFFSSGYEILLFFGXILNLVFSSGAQSGTSSQVRNMQSETVVETSNTEKERSLLVKISELQSRMITLTDELISAKQKHVQLQQELNALYCREEIEDIRDEDNEET

SEQ ID NO: 138827 - protein, 190 aa, Triticum aestivum
  Clone ID: PAT_TA_33245.pep
RGTADPPTAGSTAGGGQQTAFFDSSVPSTPMYNSSFSPRYSEAGDDSSFDTFSTMHSFGAKDSTATTAAVASANDAFGRSDSFSSNADQGGGSSFMRYDCMTPTADKGAGNNRFMRYDSMSSNAEQGSGGNNSSSFMRYDSMSSNADHDRSNGYSFDDDDPFGTGPFKPSKPSTETSSPTRHGTDKWSAF

SEQ ID NO: 138828 - protein, 383 aa, Triticum aestivum
  Clone ID: PAT_TA_33246.pep
QVVIKSLETGTNLMHGIEACCEILEAMESDIDDSTRHDCLCTRAGLYLKRRWKNDVYMAIRDCNEARSIDFASFQAHLFMADALLQLGRLKEACEYAEAAHSLVLPNSVSAEQVENIKKRLAAAELEKNKKDQQGNTNTDARHGRLRSLSDLLFRSDVSGSSSQEGREDSDYDDEMELDFDTSVSGDESRDSDPGAVRGSLRLKLHRREDQPNEQSVGNGSAESTCNGDSAYEPDVAIDMKKRYVGHCNVGTDIKQASFLGEQGEFIASGSDDGRWFIWEKRTGRLVKMLAGDGAVVNCIQSHPYDCAVATSGIDNTIKLWTPDAEGTSMVDGPEIDVLSAIENNQKKLCRNRETLLPFEFLERFGAHEFAEGSLHPLECAQT

SEQ ID NO: 138829 - protein, 144 aa, Triticum aestivum
  Clone ID: PAT_TA_33247.pep
EEALALGEHGGGRISCCWSSQVGGGEADHPTGEGAVHRHPVPADPAPAHHQLCLRRRRRPDDPRRRHHAGRHLRHAHRDHPEGPRCCLLPGKDNRGHRRAPPQLLRPQRRPARHHMEHHQMYVFTVYHMTILTLKKKKKRAALA

SEQ ID NO: 138830 - protein, 414 aa, Triticum aestivum
  Clone ID: PAT_TA_33248.pep
MITSFKLVIAIPRREEANFRTMIGMIDGRTELKPAPAASVGDMRQLQVLDVVVSGEVADLESGGYVTAGTPLVLRQYLILEITVMAAKIAYENAAFVKNVVNNVWKFNFVGFYNGWNKFLKEDTTQAFVFTDRAKDASVVVVAFRGTEPFNMQDWSTDVNLSWLGMGAMGHVHAGFLKALGLQEEDGKDTNRAFPKDAPNGAAPIGKHIAYYKLREVIRDQLKAHPQARLVIPGHSLGGALAAVFPALLALHGETEILGRLGTVQTYGQPRVGDATFVSFFRAEVEKATAFYRVVYRYDVVPRVPFDAPPVAEFTHGGSCVYYDGWYDGKVLPGDAPNPNYFDPRYLLSMYGNALGDLLKGAFLWTRAGKDYREGPVSLLYRASGLLVPGLASHSPRDYVNAVRLGRIAPKSLL

SEQ ID NO: 138831 - protein, 86 aa, Triticum aestivum
  Clone ID: PAT_TA_33249.pep
MVPSCTSGSSRTEVTAERASLPRVRLGDLVMDPGVRPQGDFNVVSWESRLPPFPSFVHFVPNGNCAPGLAKQSTPLFGRKRPPVAL

SEQ ID NO: 138832 - protein, 136 aa, Triticum aestivum; identical to SEQ ID NO: 126263
  Clone ID: PAT_TA_33250.pep

SEQ ID NO: 138833 - protein, 73 aa, Triticum aestivum
  unsure (1)..(73): unsure at all Xaa locations
  Clone ID: PAT_TA_33251.pep
LLWTTISIHTTALRFHTEELTETGVDSPCSHAESTDSXPWWCLDMILSCHICRIRWGCQRDRLLPCWLTPLAT

SEQ ID NO: 138834 - protein, 73 aa, Triticum aestivum
  unsure (1)..(73): unsure at all Xaa locations
  Clone ID: PAT_TA_33252.pep
PTVXGEDXFLWINSXAFSFAQQPSQLPRRDVEVVHLTSTRKINQSFPFSHALEEVQQLILAYSVMRILVEVPT

SEQ ID NO: 138835 - protein, 99 aa, Triticum aestivum
  Clone ID: PAT_TA_33253.pep
MAGKLYQLMARLHLAKGRASADVPKGHFAVYVGEQRKRFVIPTAYLRHPSFLVLLKRVEDEFGFDHRAGGGLTIPCSEGDFADIVGGCSSSSSPAVDYH

SEQ ID NO: 138836 - protein, 80 aa, Triticum aestivum
  Clone ID: PAT_TA_33254.pep
CGLFSFHVYRIRMHMHLTYITCLHLSHRPYFSPPLSLILGLSPTLSPAYMQSFSPYLLHLRKLSLHISFTHWDVFKMLLL

SEQ ID NO: 138837 - protein, 64 aa, Triticum aestivum
  unsure (1)..(64): unsure at all Xaa locations
  Clone ID: PAT_TA_33255.pep
YITCLHLSHTXNFFLSLSLSISLSVSLGXSXTLSSTYIQYFPXYLLHLQKLSLHVSFTHWDMAK

SEQ ID NO: 138838 - protein, 277 aa, Triticum aestivum
  Clone ID: PAT_TA_33256.pep
RPAFLGHVGAKTSCGYSLADGGSLAWGLCYNHEMSPSQSYCDDSNELYRCAEGVEYYGRGALPVYWNYNYGIMGKGIKQDLLNHPELLEQNATLAFEAAIWRWMTPMKRMQPSGHDAFDGNWKPTKKDTLQRSLARLHGTRELDYMSNIVLRMFENTEVPLEDEKRFRIEMTFSRGADLSPLEDKTSETFSLLQEHTLPIMGPERLQEVGSCLTLDKFEKMVRPFAMPPEDFPPATPQALGYFSKGAGVLERLASFWPFHKGAANGKITEKAANCQK

SEQ ID NO: 138839 - protein, 221 aa, Triticum aestivum
  Clone ID: PAT_TA_33257.pep
NDEDDRETKYRLDPKYANVKTPDRHVRTRLYFTSESHIHSLMNVLRYCNLDESLHGEDSLVCQSTLDRLHRTRELDYMSNIVLRMFENTEVPIEDEKRFRIEMTFSRGADLRANEDKTSETSLLLQEHTLPIMGRWRPQAFRFRLKLDRFDIMLPPLSKSREDFSPAVPPQVLFCPHNGLWGSQTVYTLINFIHESINLYNKKTRRLDSLMNLLSNHIDLL

SEQ ID NO: 138840 - protein, 288 aa, Triticum aestivum
  unsure (1)..(288): unsure at all Xaa locations
  Clone ID: PAT_TA_33258.pep
SKLELQRRADDTSTASAMAAEYDRTADLRALDATCSGVRGLVASGVTHLPRIFRVSDGVHQPQPPPPQVPSQELPSSSAPSVPVIDLSGSDHAAVVAAVRRAAAEWGFFQVTGHGVPEAAMAAATDAVRGFHEADGGEGSDKARLYSREPARAVKYHCNFDLYQSPVANWRDTLYLRMAPDQPDAGDLPDSCRDALFEYAEQVKNLGSTLFELLSEALGLKPSYLTDIECNQGQIILCHYYPPCPQPELAIGTSRHSXTPGFLTILLXQDEIRGLQDFSQRRTNWVKR

SEQ ID NO: 138841 - protein, 362 aa, Triticum aestivum
  Clone ID: PAT_TA_33259.pep
MDVPWLLVAHGSVTALVVVSFLCGQWPIFEGTFVQSINHFLTSGAYRHFLRLVQAACGTGARDLVLGVEQYCCDRPNPILQVLYVAIIGGTYFIIVQSSFKYIPGYYVSVLHRYLSIVPRVRGAILFVLTSFSDPGTVTSENVSQYVSAYPFDNIIYVEKECSTCKITRPARAKHCRICDRCVARFDHHCGWMNNCIGEKNTRYFVAFLVWHFLLCLYGAIILGFIVAGELKDKKVVYILTVYYGIDNSFSALFPHVAQWLLAVHNTQILLVVFLGIIALLLGGFCAYHVHLCLSNTTTNETFKWQDYIFWMKKENAVKASAYTLKASINAASSEAQKSPQSKWEEVLLKVENTGRGAGREE

SEQ ID NO: 138842 - protein, 103 aa, Triticum aestivum
  Clone ID: PAT_TA_33260.pep
MSNSFAPPSNIRLAMVTQQQQYFQAQQHQQQYYYQPQLQYYQPQLQQQHQQQYFQAQQHQHQYFQQQPQYCVHPAGTYNPFGDPFTDLVTLAAPSKQGDLSLL

SEQ ID NO: 138843 - protein, 169 aa, Triticum aestivum
  Clone ID: PAT_TA_33261.pep
MDMRPAIDENPEGVLSGEWPGNFSLASYDDLRQYLESQIVSTDKMSPTAKLGEVMSRPVEVATPDQKLAEIDALFATQSGLPVVDGEGRCIGVVSKKDKARASNGLDSTIGEVMSSPAVTLTLEKTVLEAAALMLKHKVHRIPVVNEQQQVIGIVTRTDVFQALEASKA

SEQ ID NO: 138844 - protein, 163 aa, Triticum aestivum
  unsure (1)..(163): unsure at all Xaa locations
  Clone ID: PAT_TA_33262.pep
FHAPPPAPPPPPPPCSAPSSTPAXSSMPPPLPPPPPSPHXPAPPSLPYSSNHPCRRIPPPRSSQPASTSPTPTPSPPSLSTRTSPPTTPPPPASSPGPHPTTPPSSTPSASTPCSSSPPPTATPPISGHSSPRCVPRATASRRPPSRPPRRASGPMACPRTPT

SEQ ID NO: 138845 - protein, 118 aa, Triticum aestivum
  Clone ID: PAT_TA_33263.pep
GLHATQEETYIWMENQTREHEGLVYYWLGCHPSSENHPENVRIKSCSRPCPGRHSCLWLGLLKEGFLDPVEWLDEVDGGAAGEDAPGGEGGDVRGLDAAGGEEAGEGGAGRRESHRRR

SEQ ID NO: 138846 - protein, 123 aa, Triticum aestivum
  Clone ID: PAT_TA_33264.pep
SFPSHGEGYMQRKRKPTSGWKIKQGITRVLYIIGWVVQTQRIILKMYASKAVAVHPHRHLCLRLGLLEEGFLDPVKWLDEVDGGAAGEDAPGGEGGDVRGLDAAGGEEAGEGGAGRRESHRRR

SEQ ID NO: 138847 - protein, 151 aa, Triticum aestivum
  Clone ID: PAT_TA_33265.pep
PARSPTRPGGTGRRWARRRAPTCPAARRRPRRRRGRPSGPDGDVGVCLKFLSSGELTSLLLPLAQSPHLPPRREREKSSENANATAAMALPASPLHPLPLPLLPPSSAHIQPTDITALATWGVFAGSAAIYLVQPFDWIKKTFFEKPEPEA

SEQ ID NO: 138848 - protein, 106 aa, Triticum aestivum
  Clone ID: PAT_TA_33266.pep
MHFTPSKHLHQHHYHHHSTILDWRVPMYKKANAVGSKGRPPLFEVTGKGCYEAATINRRRRPCLRRRRPPRRLLHRPNLRLMSRPPHPPPCRLPRRRRRRRPCPHH

SEQ ID NO: 138849 - protein, 75 aa, Triticum aestivum
  Clone ID: PAT_TA_33267.pep
LVERCTIRPRHCICNLKSTGGSGTTRMIWHSSVSHWKCSYVRYYGGLLDDQHKSDRLQPSSGCLINTQEKFSLKQ

SEQ ID NO: 138850 - protein, 80 aa, Triticum aestivum
  Clone ID: PAT_TA_33268.pep
REDPSYSQRRAMACTGLSSTARLQGTHSTNIFLLHNHSSSRRIRAPFHPPAHSSSAPQGRCRFGHLPHLSGSPYNLLLAP

SEQ ID NO: 138851 - protein, 226 aa, Triticum aestivum
  Clone ID: PAT_TA_33269.pep
HASGNIESMQGIVSIGVTAAKVLVEDISHEYRRRRKEETDVARSRIETYVRSSLRTAFAQRMEEADSKRSSRNPTPVMSILAKDIGDLAIKEKNLYSPILKTWHPLASGVAVATLHSCYGSELKQFIAGLTELTPETVQVLKSADKLEKDLVNIAVEDSVDSDDGGKSLIREMPPYEAENAIANLVKVWIKERVDRLKGWVDRNLKQETWSPGANRDNFASSSVEM

SEQ ID NO: 138852 - protein, 148 aa, Triticum aestivum
  Clone ID: PAT_TA_33270.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNE

SEQ ID NO: 138853 - protein, 205 aa, Triticum aestivum
  Clone ID: PAT_TA_33271.pep
ILIHEECYPMDHLFHLACKAEQEIKRRVGHEENKRTVHIPRVDMIVNHQSDTMTTTSVVVRTTSPPPCDTSPPRVATSSELIIRGNDKGTDLPSLHENDECLVNLNAPSDELPTTLITPPILEDYVDNLTLPCDQTTEIPTILSAPIELTIDAKEPMFNHFDMTSNLGDDSVLNDLLHVCLFKHVVACKFDASKVYSPMLGWFND

SEQ ID NO: 138854 - protein, 367 aa, Triticum aestivum
  unsure (1)..(367): unsure at all Xaa locations
  Clone ID: PAT_TA_33272.pep
MASASPSWVILGRVAKVSAADADLPPGADLSLALPPPPRVALLTIPPRIFPGQTTSDNFPSVLAVDRSGLLLLHASQGPAAGPAIVDLPGRQEVCWRPFVAGYFVLDSKSASAFPLPNPERIMNPGRLGLIASPEGAGRYMVAELQPVAGGEQADLLCFSSQSGQWDRKTVAYPLPSRPLTPNGVVSHSGRLWWVDLSWGLITCDPFADAPVLSFVPLPPRKALKYMEDCAVLDKYRRVAVSRGKLRFVDMYKNRSSFGSAQISVWTLADPDSTEWTLQYEATFSEIFNDASFKATRLTRQLPVLALIHPKXPDVVYFFLDXHLFSVDCLTARSCNATLQLVEDYPTNHRNRFVGATALRSNIRCPL

SEQ ID NO: 138855 - protein, 80 aa, Triticum aestivum
  Clone ID: PAT_TA_33273.pep
EQRKEHVSEVTIRISNRQLQELVDKRAADDGHGHIWKSGRSASELLVDIMNAGEVHHHVEHCRAAHWKPALQSIPEAVES

SEQ ID NO: 138856 - protein, 108 aa, Triticum aestivum
  Clone ID: PAT_TA_33274.pep
MGNCAITHQATSWADDGEWELPSPGDEDEGQAEQRKEHVSEVTIRISKRQLQELVDKRADDGVWKGRRSASELLTDIMNAGEVHHHVDHCRAAHWKPALQSIPEAVES

SEQ ID NO: 138857 - protein, 114 aa, Triticum aestivum
  Clone ID: PAT_TA_33275.pep
RHEPRPCFESLKEVLLHHKPGPPYKIPVGRISAFPPFPVNNSLTQKVNAPHPNAMTNRPDKEHMCARVQKQCLHAIIAFLLNIPAIQIYCKDERSLLSKFTVKMRDPILGMVFE

SEQ ID NO: 138858 - protein, 150 aa, Triticum aestivum
  Clone ID: PAT_TA_33276.pep
QPAVRLMSLLCAPTPSPVQPAMGSCTYCRGRSGEGDRVTTARAQETSGSCSPRMPTSGSGKKLLNPGDREIVEPRADPPRTPPPRGASTLSELRAALACYRDLSKSGGSREEEVLIGGGRRSCHRGGGFLESGGRVEEDPRVRGRVGGRV

SEQ ID NO: 138859 - protein, 407 aa, Triticum aestivum
  Clone ID: PAT_TA_33277.pep
TRPTHASEKEGVMLIKKTAENIDEAAKELPDANLRPEDLWANHSKVVLPKPHMKDSASWRAVQKVREGGENIDLKHFRPVKPLGSGDTGSVHLVELLNTGEYFAMKAMDKNVMLNRNKVHRATAERQILDMLDHPFLPTLYASFQTKTHICLITDYYPGGELFLLLDRQPLKVLREDAVSFYAAEVVIALEYLHCQGIIYRDLKPANILLHRDGHISLTDFDLSCLTSCRPQVFLPEEGNKKSRRKSRSSPIFFAEPMRASNSFVGTEEYIAPEIITGAGHTSAVDWWALGILLYEMLYGYTPFRGKTRQRTFANILHKDIRFPASISVSLPARQLIYRLLHRDPANRMGSYEGSNEIKQHPFFRGINWALVRGTAPPKMDAPLLSDDVDKGLGDAAAAADNYTDMF

SEQ ID NO: 138860 - protein, 119 aa, Triticum aestivum
  Clone ID: PAT_TA_33278.pep
MVMGASGSKLEKALGDQFPEGERYFGLENFGNTCYCNSVLQALYFCTPFREQLLEYYMNNKNPGDAEENLLTCLADLFMQVSQSKKKTGVIAPKRFVQRVKKQNELFRSYMHQVTRHFL

SEQ ID NO: 138861 - protein, 200 aa, Triticum aestivum
  Clone ID: PAT_TA_33279.pep
FGTRVEYGLRGGEGAGAGVGELQEVWAAAKKQKVADEKKKDAENTKVIYARAKEYAGEYEAQDKELVQLKREARMKGGFYVSPEAKLLFVVRIRGINAMHPKTKKILQLLRLRQIFNGVFLKVNKATINMLRRVEPYVAYGYPNLKSVRELIYKRGYGKLNKQRIPLTNNKVIEEGLGKHNIICIEDLVHEILTVGPHFK

SEQ ID NO: 138862 - protein, 235 aa, Triticum aestivum
  unsure (1)..(235): unsure at all Xaa locations
  Clone ID: PAT_TA_33280.pep
MSSEAAKVVVPESVLLKRKREELWAAEKKTKAVEEKKKSSENVKVIYARAKQYAEEYDAQDKELVQLKREARMKGGFYVSPEAKLLFVVRIRGINAMHPKTKKILQLLRLRQIFNGVFLKVNKATINMLRRVEPYVAYGYPNLKSVRELIYKRSYGKLNKQRIPXTNNKVIEEGLGKHNIICIEDLVHEIFDRRPYFQEANNFLWALKLKAPLGGFKKKKNPFGQGGDPANRRNS

SEQ ID NO: 138863 - protein, 244 aa, Triticum aestivum
  unsure (1)..(244): unsure at all Xaa locations
  Clone ID: PAT_TA_33281.pep
MASEAAKVPVPESVNFKRKRGEVWAAAKKQKVADEKKKDAENTKVIYARAKQYAGEYEAQDKELVQLKREARMKGGFYVSPEAKLLFVVRIRGINAMHPKTKKILQLLRLRQIFNGVFLKVNKATINMLRRVEPYVAYGYPNLKSVRELIYKRGYGKLNKQRIPLTNNKVIEEGLGKHNIICIEDPVHEILTVGPHFKEANNFLGPFKLKAQLGGXLKKRRNPYLEGGDPCNRENYINPLGRRD

SEQ ID NO: 138864 - protein, 200 aa, Triticum aestivum
  Clone ID: PAT_TA_33282.pep
MAASGFGGGEAFRLSAASGAGALKLHKGDITLWSVDGATDTIVSAANERMLGGGGVDGAIHQAAGPQLVLACREVPEVKPGVRCSTGEARITPAFELPVSRVIHTVGPIYDMDRKPEVSLKNAYENSLKVAKENGIQYVAFPAISCGIFRYPPKEASNIAISAAQQISGDIKEVHFVLFSDELYNVWRETAQEMLTQFEK

SEQ ID NO: 138865 - protein, 200 aa, Triticum aestivum
  Clone ID: PAT_TA_33283.pep
MAASGFGGGEAFRLSAAAGAGALKLHKGDITLWSVDGATDAIVNAANERMLGGGGVDGAIHQAAGPQLVQACREVPEVKPGVRCPTGEARITPAFELPVSRVIHTVGPIYDMDRKPEVSLKNAYENSLKVAKENGIQYVAFPAISCGIFRYPPKEASNIAISAAQQFSADIKEVHFVLFSDELYKVWRETAQEMLTQFEK

SEQ ID NO: 138866 - protein, 236 aa, Triticum aestivum
  Clone ID: PAT_TA_33284.pep
MSRAATRIFPTPSLLPLPLSKWLRRRRPSICPARRTFAMAASGFGGGEAFRLSAAAGAGALKLHKGDITLWSVDGATDAIVNAANERMLGGGGVDGAIHQAAGPQLVQACREVPEVKPGVRCPTGEARITPAFELPVSCVIHTVGPIYDMDRKPEVSLKNAYENSLKVAKENGIQYVAFPAISCGIFRYPPKEASNIAISAAQQFSGDIKEVHFVLFSDELYNVWRWDCPGDADAI

SEQ ID NO: 138867 - protein, 244 aa, Triticum aestivum
  Clone ID: PAT_TA_33285.pep
MSSEAAKVVVPESVLLKRKREELWAAEKKTKAVEEKKKSSENVKVIYARAKQYAEEYDAQDKELVQLKREARMKGGFYVSPEAKLLFVVRIRGINAMHPKTKKILQLLRLRQIFNGVFLKVNKATINMLRRVEPYVAYGYPNLKSVRELIYKRGYGKLNKQRIPLTNNKVIEEGLGKHNIICIEDLVHEILTVGPHFKEANNFLWPFKLKAPLGGLKKKRNHYVEGGDAGNRENYINQLVRRMN

SEQ ID NO: 138868 - protein, 244 aa, Triticum aestivum
  Clone ID: PAT_TA_33286.pep
MASEAAKVAVPEKVILKRRREEVWAAEKKQKVAAEKIKAAENTKVIYARAEQYAGEYEAQDKELVQLKREARMKGGFYVSPEAKLLFVVRIRGINAMHPKTKKILQLLRLRQIFNGVFLKVNKATINMLRRVEPYVAYGYPNLKSVRELIYKRGYGKLNKQRIPLANNKVIEEGLGKHNIICIEDLVHEILTVGPHFKEANNFLWPFKLKAPLGGLKKKRNHYVEGGDAGNRENYINQLVRRMN

SEQ ID NO: 138869 - protein, 451 aa, Triticum aestivum
  Clone ID: PAT_TA_33287.pep
VIADYGVPLMVILWTALSYSLPTKIPSGVPRRLFTPLPWEPKSLQHWTVAKELFSVPLAYILLAIVPAVMVAGLYFFDHSVASQMAQQKEFNLKNPSAYHYDILVLSFSVLICGLLGIPPSNGVLPQAPMHTRSLAVLRRQALRKQMVRTAKEGMMNNASSSEVYGKMQEVFIKMDDKGNEDSAHKELKELKDAVITEGEKITEGNGAVTAPEVFDPEKHLEAYLPVRVNEQRVSNLLQSLLVAGCIGVVPVIQKIPTSVLWGYFGYMSIDSLPGNQFGERLQLLFIAPRRRYKVLEGAHASFLESVPFNQILAFTVFQLIYLLIVWGMTWIPVAGILFPLLFFFLVIIREHLLPKFFDTRHLWELDASEYEECEGVHRDPSIPEGDGESITRGIEDPSEYTAEVMEEFTTHRGELKHRAPSFRDERLIRLNSVQMTRQFSRISSFAPTRP

SEQ ID NO: 138870 - protein, 244 aa, Triticum aestivum
  Clone ID: PAT_TA_33288.pep
MASEAAKVPVPESVNFKRKRGEVWAAAKKQKVADEKKKDAENTKVIYARAKEYAGEYEAQDKELVQLKREARMKGGFYVSPEAKLLFVVRIRGINAMHPKTKKILQLLRLRQIFNGVFLKVNKATINMLRRVEPYVAYGYPNLKSVRELIYKRGYGKLNKQRIPLTNNKVIEEGLGKHNIICIEDLVHEILTVGPHFKEANNFLWPFKLKAPLGGLKKKRNHYVEGGDAGNRENYINQLVRRMN

SEQ ID NO: 138871 - protein, 244 aa, Triticum aestivum
  Clone ID: PAT_TA_33289.pep
SCTRATSPSGPESVLLKRKREELWAAEKKTKAVEEKKKSSENIKVIYARAKQYAEEYDAQDKELVQLKREARMKGGFYVSPEAKLLFVVRIRGINAMHPKTKKILQLLRLRQIFNGVFLKVNKATINMLRRVEPYVAYGYPNLKSVRELIYKRGYGKLNKQRIPLTNNKVIEEGLGKHNIICIEDLVHEILTVGPHFKEANNFLWPFKLKAPLGGLKKKRNHYVEGGDAGNRENYINQLVRRMN

SEQ ID NO: 138872 - protein, 244 aa, Triticum aestivum; identical to SEQ ID NO: 138867
  Clone ID: PAT_TA_33290.pep

SEQ ID NO: 138873 - protein, 117 aa, Triticum aestivum
  unsure (1)..(117): unsure at all Xaa locations
  Clone ID: PAT_TA_33291.pep
LAREEKKNXPCLVCKGKSPRGPLQWGAQGVCKEPSLLLISFSSILQKRSPSLKSLSLDYCNVTNEAFTELIIKASSARKNFSFPYVHLLMVTHMKVTSRACAQLKRLMFARGGPLGG

SEQ ID NO: 138874 - protein, 112 aa, Triticum aestivum
  Clone ID: PAT_TA_33292.pep
LGRGRGVSPSFHLCRRPPFPTASEEVKDGVLSSSSTITHTLTRPQLALAPSTGSISPPPFTLLTSNYSLHHDNPPFDFFCLMPIQQNTNDTLLCLCIRPLSTSQVLFPKRQC

SEQ ID NO: 138875 - protein, 115 aa, Triticum aestivum
  unsure (1)..(115): unsure at all Xaa locations
  Clone ID: PAT_TA_33293.pep
MVLPALPPLTADSLGVRRHHRLPPRAPRRLLRPDPPRLRHLGYRPPRSTXDGLVSVPKNIQRRDLEVGRNVGNGTLRWLDRMKPSAQLRPHPPRPPGSPPEQLRHLWTMNKDARS

SEQ ID NO: 138876 - protein, 193 aa, Triticum aestivum
  unsure (1)..(193): unsure at all Xaa locations
  Clone ID: PAT_TA_33294.pep
MLRLRSCVLSHLLSSPATSPLPSLHRLLSSAAAPTSPPAPASKWRSTSSPPAGSPERRPSRPPPSSPTXGPHPSPTPSSPSSPASASPAPTSPRXSPGTPSSSAPAWREPCPPSSPGSPASDCRLPRSRDSSRSPPTTTTPATNPSSPRWTTTCASSAPWRNSSGHSSITTISSHTTSRRWSSGMSGCCRSAR

SEQ ID NO: 138877 - protein, 144 aa, Triticum aestivum
  unsure (1)..(144): unsure at all Xaa locations
  Clone ID: PAT_TA_33295.pep
DPACENLLVNMXDPQRPICKMGDLGLSTERQRTLVSEGPDQWWVPSLREARRNSPSDDSDVYGFGIVLSEXLKGVPPHIMDKRAAELIGCDQTTAVIRLNVPXFIASXWKPLNGNSWACVTYIRLSLPGLSQRLRKMAPAMNVK

SEQ ID NO: 138878 - protein, 109 aa, Triticum aestivum
  Clone ID: PAT_TA_33296.pep
SGSLMLCSYCFRKMAPPPPPPCRLCKSRCASSLATGKLFGFYFQPSFRHAAIVPCNVRLKFNKLTGDIVTFEAPGGHTQWRSRKDAICRRLEEMDGPISSPACVLLVVS

SEQ ID NO: 138879 - protein, 281 aa, Triticum aestivum
  unsure (1)..(281): unsure at all Xaa locations
  Clone ID: PAT_TA_33297.pep
MMLRARRAAGPLLRLADAGAAGERICGGAQPSRAVFTRGFLDFFKTWSKETAEDAEKKAKAKARLTDEMSRGYFQDISEIRKNAGKIAVASKTIIPEVAAVKFPNLALESPAGRALQLPLVASPMLDGSHGAGGTVPVVPDAVLVCLSFRASSQKMAESWSLPFLDAFGATGKVEAYEAASXKENTMFQVSFIDSWLLSSSPVRRAFLKTMRKSDNPQRHAVYAFGDHYDFRKELQIVNLLTGYIYLIDRLGRIRWQGFGAATQEELSSLTACASILLDEK

SEQ ID NO: 138880 - protein, 224 aa, Triticum aestivum
  Clone ID: PAT_TA_33298.pep
VILRRLLSFLKPDTFQGAVKAMNERILSVLDASGSGRVDLGMFFAIIAPICSGPVDRRKRVVFDALLWRPASEGGRGQIRRSDALSYIKLLRAVYIPTHGASDMLEMHGESDPTMVSYIEFLEMFNDPDWGFGILTTLVKLEGSDHVRHGSHTCSICRYPIIGSRFMETKHSFSLCNRCYSEGKVPSAFKLEEYRFKEYSNESEALIDKCMCFNLNSKKLEADA

SEQ ID NO: 138881 - protein, 110 aa, Triticum aestivum
  Clone ID: PAT_TA_33299.pep
GRQWPKYPHTKAESTLAVRVEIHDQGSPTRMLTATTTCRSTISPPPLELLLGPCYTSMIHRLLQTEDTEEAYEPNQPSKTVTMLPHQRVELRGCLQLRTSRLKAQINTAN

SEQ ID NO: 138882 - protein, 234 aa, Triticum aestivum
  unsure (1)..(234): unsure at all Xaa locations
  Clone ID: PAT_TA_33300.pep
PTCPTRLKCGGFVLGFHICHNLADGFGMAQFIKAVSDIARGEAAPTILPVWERELLTSRGLLPAVNRLYPVHQPPVNGSGSAARDMMLSVPPESMVAKYFLFGPREVSALRDRIPAGHPARSATIFELVTAVMWRCRTVALGYEPGQRVRLMTTMNARGRWNNHTPIPWGYYGNAHVSPIAEVVVGELRGQPLADTVELVRETKRGMTKERMEXMVEAVALLREWPPSTMGRIY

SEQ ID NO: 138883 - protein, 302 aa, Triticum aestivum
  Clone ID: PAT_TA_33301.pep
AQVYGAPPASNENKLESTSQTENSVAGHVRPLSQTIVLGGVGYHMVNCGLILLKMLSEYVDISKCLPSLSFEVVQRVVEILKHFNTRTCQLVLGAGAMQVSGLKSITSKHLALASQIISFIHSLIPDIRRVLFLKIPEARKHLLMSELDRVTQDYKVHRDEIHTKLVQIMRERLLANLRKLPQIVESWNGPDDNDSQPSLFAKAVTKEVTYLHRILSQILLEVDLQAIFRQVVQIFHSHITEAFSKLEVSSPQAKNRLCRDVQHILVCIRKFPAQNFSAAPVRNYGLRDEFLAEKFGTDVDA

SEQ ID NO: 138884 - protein, 149 aa, Triticum aestivum
  Clone ID: PAT_TA_33302.pep
MDKLSVHHGQHNGISKPPVHHHGKGGGKGKGGGKGIKVVYISSPMMLTASAEEFRAVVQELTGRDSNVADHDAPGVSSYYSSSSSSSYSSFGRASPTAGATAAAGARALPPAMASTADYATGAGAMPPPFQSMYDQTGGAGLLYGQDYW

SEQ ID NO: 138885 - protein, 173 aa, Triticum aestivum
  unsure (1)..(173): unsure at all Xaa locations
  Clone ID: PAT_TA_33303.pep
MDKLSVHHGQHNGISKPPVHHHGKGGGKGKGGGKGIKVVYISSPMMLTASAEEFRAIVQELTGRDSNVADHDLPXSRPTTPPRPPPPTPRTGAPPRRPGLRPLRAPGLCRRRCRPRRTTRPAPEPCLRRSRACMTKREAPACFTAQTTGRIGDRSPRGGRRFGMPSNPSLAYV

SEQ ID NO: 138886 - protein, 145 aa, Triticum aestivum
  Clone ID: PAT_TA_33304.pep
MDKLSVHHGQHNGISKPPVHHHGKGGGKGKGGGKGIKVVYISSPMMLTASAEEFRAVVQELTGRDSNVADHDAPGAPSYYSSSYSSYGHASPTAGATAAAGTRALPPVMASTADYAAGAGAMPPPFQSMYDQTGGAGLLYGQDYW

SEQ ID NO: 138887 - protein, 160 aa, Triticum aestivum
  Clone ID: PAT_TA_33305.pep
MAMVASTSIAYHKPRLSVVCRKKDRDRELEREKEHKYPFKVVEITPPPRCLGVRCFPTNIHCGESVTIEGQAYTVSAVTHRYQLRKGRYEPSEKRLDVLSTGRYILNLYLDNLLDKPHTQAPTRSYAPCALSSQSAQSSPRLYMLYSRLLVQIYLFYFSS

SEQ ID NO: 138888 - protein, 201 aa, Triticum aestivum
  Clone ID: PAT_TA_33306.pep
MSTERERLDEIGKKIKREPDPAAAIAGVVVAVSQTEHHGPRRLGLVGPGIGGAANIATPCAACKLLRRRCAHECPFAPYFSPHEPHKFAAVHKVFGASNVSKMLLEVPEAERADAASSLVYEANLRLRDPVYGCMGAISMLQQQVNALEAELQAVRAEIFKHRYRQAGVGVGVANLIVDDDVSAAAAGGFMAPATSLVHTA

SEQ ID NO: 138889 - protein, 200 aa, Triticum aestivum
  Clone ID: PAT_TA_33307.pep
MSAKPTSKTFGKSTREVPASTEKAKKWYPAGDDAENKKVRKAVRSWTPRSSLQPGTVLILLAGRFRGKRVILLKSLDQGVLLVTGPFKINGVPLRRVNSRYVIATSYKVDISGLDESKIEEISQPKYFTAEKAKEKAGEEAFFKQGEKPQKKEVNSSRAADQKAIDKALIANIKKVDMLASYLSSSFSLRKGDKPHEMAW

SEQ ID NO: 138890 - protein, 170 aa, Triticum aestivum
  unsure (1)..(170): unsure at all Xaa locations
  Clone ID: PAT_TA_33308.pep
RVDPASAPLPPTRPAAGXRVLVRLRTIAQRGLYGEHDVVPISIFWQVPQYFIIGAAEVFTFVGQLEFFVDQAPDAMRSMCSALSLTTVALGNYLSTLLVTVVAKLTTRGGKQGWIPDNLNVGHLDYFFWLLAALSLLNFAVYLLIASWYTYKKTAGDDHPDAIAKGGAHD

SEQ ID NO: 138891 - protein, 200 aa, Triticum aestivum
  Clone ID: PAT_TA_33309.pep
GRQLDTATEIAASKGDVRLAILLSQAGGSMLNRSDVAQQLDLWKINGLDFDYIEEDRLKIYELLAGNIQGALLDSPIDWKRYLGLIMWYQLSPDTSLDIIIRCYHQLLGEGKVPNPVPVYIDEGPLEEALQWSPGDRFDISFYLMLLHANQDEKFGLLKTMFSAFSSSYDPMDYHMIWHQRSILEAIGAFSTNDLHVLDL

SEQ ID NO: 138892 - protein, 420 aa, Triticum aestivum
  unsure (1)..(420): unsure at all Xaa locations
  Clone ID: PAT_TA_33310.pep
SRRAAAPSAGKAKSKGGKGGAGASNDAPPTLQFDVDWVAEHARQVSRMLLGGMSVIGIYIWSSEGSFKATPSAVLSQVIRVVSQSVPWYGSDFDERLLLHLSYSPRRWACRICEMASGSLRPCDFKYSKLLASLQTFRCTYNFETRLTVVQAEPFKKACSIPFGQRAKGVQNAXALIDGDLFSDDMTITSEGPHEVDLLVPFKNNLPAGECSLEGVAGLLLFAGSVSALAYLGPKESISEAISDLKVDIIASLRSRLDIILDEADDDSTTNDMENSASQKVTQVNFHELREPYSFSFPRRILIPWLAGSYICDYLQQSETTKDAMERCKEVISLETEVENSILEPETAASTATLESFWDVVPGASSRARAGPGPKDERPEQATGSGRTQDNSFSILAALFVLLVALLVGFMFAFPANSKT

SEQ ID NO: 138893 - protein, 139 aa, Triticum aestivum
  unsure (1)..(139): unsure at all Xaa locations
  Clone ID: PAT_TA_33311.pep
DEEDLDDIKELGQSKWSKDFDEDTDRSKHADGSTHTLSVLAKTYGTHQKTLTWGDRLEKGGFSIGAAKRRPTSSLIIGPGSGYNSVSNPLAEDNSQAXKDKVNNETKRRFSEQLRDEGQSFRAVFDQRKQHWGFRQRKK

SEQ ID NO: 138894 - protein, 400 aa, Triticum aestivum
  Clone ID: PAT_TA_33312.pep
MPRRKKSRLDPVAGGRQIASKAQIDGTEQTSPLAICKLYEHINEGQRVAVRAMGTGQLLDIKCAYLHNTILTWFTRLYHSGRRGFVVPGRGFIPLTEESVHQILGIPHGDIEVKYETDYDMEQEFAATLFPGNGSTPNITTVATAIINHNEADDRFKKLWLIYIVSTVLAPTTDARISNKCYPMLADINRADRLNLCKFVVDQLHEHLSKGKYTNGCLLYCMLRYLDALDCDGMELELTDTPYRVNAWSRTQVDVVAELDMLEHDPPCFGKLQLKEEFREEAASGSGTSILSLFGGPGGFETWMKQNTHPSCSENNKLKVQGIIHKFASGLETLLGDLVQGMTAPTASNSTKSRRGRRNEIEKNDDTLFEDSSSSESDGDTDGDDDTSFASSSESVVLAE

SEQ ID NO: 138895 - protein, 335 aa, Triticum aestivum
  Clone ID: PAT_TA_33313.pep
MFLCFTPILLFLAFLFFTTQQNPRFGTFLFVTVVCYIVANGFTILVTLSSKLILYVAAILHVFAKRRWQSWEDGTHSPLVRQFLAFSFSFQSLKIVQMIKNNTNIAVAFATITLVCFVHPAIGLGLLLLSHSFHAHSALCSFLGASFRNIAQKKDLYKSKMDNNPILQSKNKPDGLEQLLPMDDSPTAAKSFTDSQLEVFDCRHGIMILHLLATLMFVPSLIAWIQRIGVGQRFPWFVDSALCVGVILHGLLGSQPTASFISFKLPGRRGREVGMSFLYLIGGFYSFISSMALAPYRALYAMAIIGFICFASRILETRGKVRGDTSSRKRHWHRH

SEQ ID NO: 138896 - protein, 191 aa, Triticum aestivum
  Clone ID: PAT_TA_33314.pep
SARGRNHALVSLQRCLTATEGIGLQSTTWSHAFDHIIFALLDDLLEIAQNHSQKDHRNMEGSLVLAVKLVAKVYLQLLPDLFGLSSFCKLWLGVLSRMEKCIKTKVRGKRSDKLQELIPDLLRNILVAMKSRGILAKRSTIGGDSLWELTWLHVNNISTGLQSEVFPSQEYEPPSNAGSPRGGLNDAEIKN

SEQ ID NO: 138897 - protein, 277 aa, Triticum aestivum
  Clone ID: PAT_TA_33315.pep
MFSSPEWVPSGWACLDLFERIQSIVKTDDAFWHAAAKVVKVTSPLVRVLYKLESDICPMGILYEAMHGAKEEICVNIGDESEFYLRIIDKIWDGYLHNPLHAAGPMLNPRIFYAAGFHPYTVISSGIAACIIQLGKAHYNPVKALAQLEVYEKKLGYFDTDPAKQQIMELPQVKWWSKHGACVPDLRTLARRVLSQTCFGATRYNIDWSLSEKLHAEWDEMMLPEQERFRQKEYVHYNSVLARSSPLLHGSSVKQHDRVTLVLQDWIRPQKQAACRH

SEQ ID NO: 138898 - protein, 77 aa, Triticum aestivum
  Clone ID: PAT_TA_33316.pep
MAEIEIKTAPADFRFPTTNQTRHCFTRYVEFHRCVSAKGDEAAECEKFAKYYRSLCPAEWVEKWNEQRENGTFAGPL

SEQ ID NO: 138899 - protein, 130 aa, Triticum aestivum
  Clone ID: PAT_TA_33317.pep
VSTNNGGNPFTDQMLTRLKEVHDREKEVHDALGYSEDQISELKKEIHRTRDEQLANITAMVEEKLNITVEKLQVQLMEEQNARLEAERVAAEARLKSDEEICKLKERLEKAQEENEEFRRLAATNKCAIL

SEQ ID NO: 138900 - protein, 172 aa, Triticum aestivum
  Clone ID: PAT_TA_33318.pep
LADRLSRHYPDSARIMCAQFSAFMGIPFSWILLTVIPQSTDYWLAYAITLFLMGITISWCATSANNPMFAEVVPPKHRTMIYAFDRAFEGSFASLAAPAVGLVTEKIYGYDAKTVNIANGSAQGAYALSRGLLTMMILPFGICVLFYSPLYLVFKHDRDNAKVARFKGQELT

SEQ ID NO: 138901 - protein, 199 aa, Triticum aestivum
  Clone ID: PAT_TA_33319.pep
TPVGPLLMDGAAHIASDSSEDDRASSSASSTGSASWRSRPHKWIHLRGRRRRRPLSARRGEGGEANGKGDGDDVQDLALPLGRCPSRRFLPRSYRRHWAPHGKRKEEPQLSMQARVNVIASSCSTLLFNVASADFARRPPDASHFAVTQSASSPLECVPMYSLPMCIYAESMENIEASSCIPISKISKWLVTFYIKVII

SEQ ID NO: 138902 - protein, 143 aa, Triticum aestivum
  Clone ID: PAT_TA_33320.pep
GDTSQEERELAMDQFNNSADAKVLFGSIRACGEGISLVGASRVVILDVHLNPSVTRQAIGRAFRPGQQKKVFVYRLVAADSQEESFHQTAFKKEVIPKLWFEWSEQHCTSDDFRLNKVDIDDCEDELLDNKAMRQDIKVLYKR

SEQ ID NO: 138903 - protein, 124 aa, Triticum aestivum
  Clone ID: PAT_TA_33321.pep
IAARYEAMERRAPAAALLRKRHAASWDHAAYAAAREAALAGAGLAESGVRGWRRPFVTHFTGCQPCSGDRNRDYSGDSCDDGMRRALNFADDQVLRDYGFRHAGPLSDDVRPLPFDYPAAAGRR

SEQ ID NO: 138904 - protein, 71 aa, Triticum aestivum
  Clone ID: PAT_TA_33322.pep
GIPWTEEEHRMFLEGLEKYGRGDWRNISRWSVKTRTPTQVASHAQKYFIRQANAATRGDSKRKSIHDITNP

SEQ ID NO: 138905 - protein, 160 aa, Triticum aestivum
  unsure (1)..(160): unsure at all Xaa locations
  Clone ID: PAT_TA_33323.pep
MDLHYQQPAPAARSPWAKVEDTAFQAALVTLPHPTPARRERVPARLPARTLPGAPGHYQVLVARAGFSKRGAVATIGCWDDVGSCTSRRTPRRSCGFPKVLYLYGLVXYGRGDWRNISRFAVRSRTPTQVASHAQKYFIRQANAATRDSKRKSIHDITTP

SEQ ID NO: 138906 - protein, 148 aa, Triticum aestivum
  Clone ID: PAT_TA_33324.pep
EDSQRQRGLSVILESISSVSTKVDGNSRSSSKRAKLLVMRMGPQIKKLSIKQQNERLEIENKILAIENHKMREELRTYRCVACLKIENACLKAELARSFRNAAAILEAEAQSELEVGFSSTAPQIPADTSATGPLQPGAAGGQDEQRE

SEQ ID NO: 138907 - protein, 46 aa, Triticum aestivum
  Clone ID: PAT_TA_33325.pep
LSFDAEEASAMSGAESSGMSSDSEGSAAGAAEDDDEEWEFMRGLTV

SEQ ID NO: 138908 - protein, 184 aa, Triticum aestivum
  unsure (1)..(184): unsure at all Xaa locations
  Clone ID: PAT_TA_33326.pep
APPERPAVDGVLSDLTCDSDGKVDQLIGGRSSLPLHELPAHGTRGYYLGMFLGGAYQXALGGLHNLFGGHSEXVVRVSQSDGPHCFAVTRAAXGPSCADVLRAMQHEPEVMPEVLKQRTTDDGATAAALARAFGSMPYLSFDAEEASAMSGAESSGMSSDSEGSAAGAAEDDDEEWEFMRGLTV

SEQ ID NO: 138909 - protein, 145 aa, Triticum aestivum
  unsure (1)..(145): unsure at all Xaa locations
  Clone ID: PAT_TA_33327.pep
EWYFYSRKDRKYPTGIRTNRATEAGYWKATGKDKEIFHPPFTLIGMKKTLVFYKGRAPRGEKTNWIMHEYRLESSKKLXPTHPPPPAPSPEPTWXSKEQWVVCRIFHKSTGLKKMVTLSYDMPMYTGAEHQQLCRLRYIASSHGI

SEQ ID NO: 138910 - protein, 306 aa, Triticum aestivum
  Clone ID: PAT_TA_33328.pep
VAAAIADVNLNKDEPSEPPAKAQLGQKQWYFHCRRDRKHPTGKQTNHAKIAGNWNANGNDKEILQPPFKLIGMKKTLVFYKGRAPRGEKTNWIMHEYRLESSKKLTSNPSITTRTVTRTNMASKEQWVVCRIFHKSTGLKKMVTPSYDMPMYTGAEHQQGFVDLDTLPPLMEYDMSSTCAHAPLFPGASSYKSHDVGTGSSMMGSVALPMMNYHYIGNNHHHQMMVNPTLPLSLYQHQQQHQQMMMHMGADQGLMVGAQPGGGLASMLSQEDAVAGLRNNYPGNTAATAVGETSLMNMGMDDIWQN

SEQ ID NO: 138911 - protein, 147 aa, Triticum aestivum
  Clone ID: PAT_TA_33329.pep
GALFASIPFTIFAAIYCVMFGIIAAVGLSFLQFTNMNSMRNLFIVGVSLFLGLSIPEYFSRYLTGAQNGPAHTKAGWFNDYINTIFASPPTVALIIAVVLDNTLDVRDAAKDRGMQWWERFRTFRGDSRNEEFYTLPFNLNRFFPPS

SEQ ID NO: 138912 - protein, 89 aa, Triticum aestivum
  Clone ID: PAT_TA_33330.pep
CQKWETLIYVWLVLVSCITQSTTNPGWPVTKKYEGFFFFNPLLDNFAWPRYSFKCTYATYIIQVAFDNLDLNIQESYTHRKILPLLTYT

SEQ ID NO: 138913 - protein, 376 aa, Triticum aestivum
  Clone ID: PAT_TA_33331.pep
MGSRREEERNEKIIRGLMKLPPNRKCINCNSVGPQYVCTNFWTFTCLSCSGIHREFTHRVKSVSMSKFTTQEVRALEQGGNQRARDIYLKDWDWQRMRLPDNSKPDRIREFIRTVYVDKKYAGAKSTDKPATDSESVKGNESETRRPDSYHSYSQSPPYDFQYEDRRYGKQVNTLARRPSDRALFDGKLGSLLYSPGRSRDQMHEDRFANESHGSRFSDFSASSTSDFRNDVLSPSSQDTGYSSPSVHHSRNVSAENPQSQRHPNAVSQIESNGGRRSQRTASSGSFGSFDGSSPSNKSVDSGVLPDAPTERPVPSAANRQSGASSVAHSTQPYALQQSANSSASQIAPQESLRHLPVSAQSQPQPTAFTCQRGLD

SEQ ID NO: 138914 - protein, 498 aa, Triticum aestivum
  unsure (1)..(498): unsure at all Xaa locations
  Clone ID: PAT_TA_33332.pep
AIQHIMEPKXNAIQLLEVADSLEAKELKKHCEDTAIRNLDYIFTVAAPSIMNASPEILANLERLLDEKSSEPWSHRRLPTMTATYPAVIDSDAEGDNAGGFPRLRDNQKPASKLYGMSGYGNFLQKESNAEQFVSKQIRAIRKKLQQIEMLEAKQLDGHQLDDQQLAKLESRASLESELAELGFPTEAFSRPSVYVPNKKSEGSKKQKKKIKQAAQSDITSIKHEDKEQNHIKELPDVIPTHGSSEKEPVKPSDDGTSSNTKAIFCPLGDKASRLTSSKKKNKKGGLSLFLSGALDDTSKLSLPTPAVPVTPKQEGPAWGGAKITKGPASLRDIQSEQRSKTNELMTTKAKDRHEDSPDSAGLLRLSSFMPDACSSPISVAPARAVPAHEGDKSTPPWSSSATSPNLSRPSLRDIQMQQEKRHHGVVSHSPKTRTSGFAIPSLGAAPEVVGVKDNVPNRWFKPETDTPSSIRSIQIEEQAMKDFKRFYTTVRIMKPQV

SEQ ID NO: 138915 - protein, 192 aa, Triticum aestivum
  Clone ID: PAT_TA_33333.pep
GVCCTSPAATGRIVEWALELSSFGLKFERTSTIQSRALAEFIAEWTPTPDEEIPETSIPVKEASKEWLMYFDGAFSLQGAGAGVLLVAPTGEHLKYVVQMHFPKEQATNNTAEYEGLLAGLRIAADLGIKKLIVRGDSQLVVCQVNKNYQSPLMEAYVDEVRKLEEHFDGLQMEHIPRAQNVVAMACQSAPH

SEQ ID NO: 138916 - protein, 204 aa, Triticum aestivum
  Clone ID: PAT_TA_33334.pep
SDPAERNPPPSGTLTLATRGEERGKANPKSLGVEKMQFLSYGSLSPTPITATQAELEAEAILKGKAEADIIKGKAEADIIKAKSEVEKEEVSLKDTAVEETAFIVKAKAEEEAVMGLKGADATSDSEVEDLYDNCPYDSDDDPDTVCAKLAAWYEEQVRKRHARLPWLKYDSAADILKMHGEASALYNGQQPVADDGVAPVVPV

SEQ ID NO: 138917 - protein, 200 aa, Triticum aestivum
  Clone ID: PAT_TA_33335.pep
ALQPFRPQQPYPQPQPQYSQPQQPISQQQQQQQQQQQQQQPQQQQILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFQSSQQNPQAQGSVQPQQLPQFQEIRNLALQTLPAMCNVYIPPYCSTTIAPFGIFGTN

SEQ ID NO: 138918 - protein, 450 aa, Triticum aestivum
  unsure (1)..(450): unsure at all Xaa locations
  Clone ID: PAT_TA_33336.pep
MSSVYACMLFLFFVVLNPVSLAAGATNSSGAAGFSLPLVPHYRTEAGVLEELLPEGDAEGGVNITSIRPKMIPLTGPVYSVRVGVGSGETQHFYKLALDLVRPLTWIRCRPCILEKKQEGSIFNTAVSPHYHAIASTDRRCTAPYKRGSRGRCIFDVKYQYHGSSAPGFLSTDXLRLRRPRSPVAASFPGCAHSTHQFDNHGVWAGVMSLNRHPTSLIRQLSDRGLAASRFSYCLVGKEHEHLHRRGFLRFGADIPDQPHARSTALLHGELAQGGGMYYVHLVGISLGGRRLTAITPAMFERDPRTLRGGCTVDVGTSHTLLAPDAYHILAAEVVAHLQSRGVHRAPGPVQNLKLCFRGAWDSIRAHFPSVTLHFDPESAVLFIKPELLFLAVTHQHTHYACFTVVPYAERSVIGAGQMLDTRFTFDLQHNRLFFAPEDCHLDTSAVGMT

SEQ ID NO: 138919 - protein, 354 aa, Triticum aestivum
  Clone ID: PAT_TA_33337.pep
MPSYIRFVLYSNSFFVQHVASVRTRLYTDRYLTSDYMLKNGVIRHDTPAASLPAHVYLHVEQTRLRLSDNIFCDDDQRLLRKFTWMILKSDSYFAPALFLTPMYEKELARMFPQREAVFHHLGRYLFHPTDRVWGIVRRYYEAYLARVDEKIGFQIRIFPEKPVKFENMYDQLTRCIREQRLLPELGDPASPAMNATGHDGKVKAVLIASLYSGYYDKLRGLYYESPTKTGEIVAVYQPSHEEKQEYASNEHNQKALAEIYLLSYCDKIAMSAWSTFGYVAYGFAGVKPWILLRPDWNKEVSDVACVRSTSVEPCLHSPPILGCRAKKEVDVARVKPYVRHCEDVGFGLKLFDS

SEQ ID NO: 138920 - protein, 530 aa, Triticum aestivum
  Clone ID: PAT_TA_33338.pep
VPLLENPTKGNKSWSSTAVAAALELVDPPGCRNSARAVTCAIAAVMVARRVAARARWRRAVALLRDFEEGCATPPARLRQVVDAMVVEMHAGLASDGGSKLKMLLTFVDALPNGDEEGVYYAIDLGGMDFRVLRVEIDVGSTAVINQRVETHAISEELMGTSQDLFNFVALTLKNFVEREDGKDAQKPLGFTFSFPVRQNSVSSGSLIRWTKGFSVGDTVGKDVSQCLDEALARCGSNMRVTALVNDTVGTLALGHYYYKDTVAAVIIGAGTNACYIERTDAIIKCQGLLTNSGGMVVNMEWGNFWSSHLPRTAYDISLDDETQNRNDQGFEKMISGIYLGEIARLVLQRMAQESDIFGDGAESLSTPFILSTPYLAAICEDDSQDLSEVRRILQEHLKIPNAPLKTRRLVVKICDIVTHRAARLAAAGIVGILKKLGRDGSASAASSSGRMREQPKKTVVAIEGSLYQEYPVFKEYLDEALVEILGEEVAQTVTLRVMVDGPGTGAALLAAVHSSNRQQQQGGRGGGSI

SEQ ID NO: 138921 - protein, 492 aa, Triticum aestivum
  Clone ID: PAT_TA_33339.pep
MASSVLEATRAAHEDLERLERLAVRELQRDPANARDRLFQSHRVRHMLDLVVSTSDKLVEIYEDKDGARKDEISTHLTAPVQSDIFPKYYERLKEIRDYHRRNHSARFVSETDDYEELLKEEPAIEFTGEEAFGRYLDLHELYNEFINSKFGSLMEYSAYVGTFAQTEKIAHNLKATRPYKEYLEHILEYLMSFLYRTEPLQDIEKIFTKLESEFEEQWTNGEVPGWENKGTEKESVLQESAVDLDYYSTVEELVELGPEKLKEALTARGLKGGGTVQQRAERLFLLKHTPLEKLDRKHFAKGDDLKKEIALIEMKMKRLCEILDEVIVRTKENAEKKLTLTYEEMEAEREEEEVQADSESDDEDQQIYNPLKLPMGWDGKPIPYWLYKLHGLGQEFKCEICGNHSYWGRRAYERHFKEWRHQHGMRCLGIPNTKNFNEITSIKEATALWERIQAKQGQNKWRPDLEEEYEDKDGNIYNKKTYTDLQRQGLI

SEQ ID NO: 138922 - protein, 406 aa, Triticum aestivum
  unsure (1)..(406): unsure at all Xaa locations
  Clone ID: PAT_TA_33340.pep
ARGPSAPGVRGAEPRHRRDLFVPRRGTQPVPRTPPGGRRAGRGGAARRRGRAPARSRRPGGRRARRECEKGQKGGKGEQEADGQGREPAGSAIGQQRQRRLASRASXAAPVATIWTALAGGKEAAPEDLERGSSGAASGAGVLRWRMQTGGWLRLFGDFDVFDPRATSILTWKWYLNARRXVSPEPGGPARDPIATSLAPVALAGVASTLCTYPMELVKTRLTIEKDVYDNLLHAFVKIVRDEGPGELYRGLAPSLIGVVPYAAANFYAYETLRGVYRRASGKEEVGNVPTLLIGSAAGAIASTATFPLEVARKQMQVGAVGGRQVYKNVLHAMYCILKNEGTAGLYRGLGPSCIKLMPAAGISFMCYEACKKILVDDKEDEPQEETETGQAGGQAAPKSSNGARP

SEQ ID NO: 138923 - protein, 101 aa, Triticum aestivum
  Clone ID: PAT_TA_33341.pep
MACHQRSASLPSIAHSSESKVEVELQGLKSCISSPSATIDTMCGGYARLGDIYKCIEEIMGLPSNQVGLSFPQNKKMVEEELERSLLLIDLCNSMQEFSKS

SEQ ID NO: 138924 - protein, 173 aa, Triticum aestivum
  Clone ID: PAT_TA_33342.pep
GSFGHTSDSIKRVNSDGSILSVSNTSISGCSGCHNELLTAAQPDVSTELQPSKMESDLVYENEITSPIESKMSNSRYTPTLPHDHIHDVPSSQLDPCNSGDSNFLDLEWLSNSGNSSDERSLAVSTPDAHLSTENVISDIIPETMENQVAGVQAQKLPEQFVQWVNDGDSFWF

SEQ ID NO: 138925 - protein, 102 aa, Triticum aestivum
  Clone ID: PAT_TA_33343.pep
GITYALHKWLYGRRPTTLFQVLPNNKRLIFRIHRACKSSVPGHVKASNSCMHKKTKQIQGMHTYTCQAKSQFIFYCSFIGMKHIRNEMLNKFQCSCIQKAKH

SEQ ID NO: 138926 - protein, 203 aa, Triticum aestivum
  unsure (1)..(203): unsure at all Xaa locations
  Clone ID: PAT_TA_33344.pep
DDLDEGGGNADDRCERMCQHYHDRREKKQCMKGCKYGESGLLGSDDGHEHGDRCQTQCKRFRPGSYDRQQCVEKCQCQQKEDEEAMDHHSGGGHGHGDRCQAQCKRFPRGSYDRWQCTERCQSHQQDDEEVMNHHGGGGHGHGGGSCEQKCQQRYRHEHDKQQCVRDCKXRRWRRRRWAWPRGRRAPARQGDGGRSHPRGGVV

SEQ ID NO: 138927 - protein, 333 aa, Triticum aestivum
  unsure (1)..(333): unsure at all Xaa locations
  Clone ID: PAT_TA_33345.pep
MGVKCGVGVWCLLLAGLLLLAVASAAEXGHEEKEEEIRWCKEDCDWKAGEDTGKARECKEQCERRRHGHELLQEDGDSFDRCVSKCRGHGGWWGKERWERCRQICRQRQEGEGGDDDFDEGDNADDRCDRMCQRYHDRQEKMQCMKGCRHGESGLLRSDDGHKHGGRCQTQCKRFRPGSYDRQQCIEKCQCQQKEEEEVMNXTAGGGHGHGDRCQTQCKRFPRGSYDRWQCTERCQSHQQDDEELMNHHGGHESSSCEQKCQQRHRHEYDRQQCVRDCKXRRWRRRRWAWPRGRRAPARQGVGGSKPSSRRCNGWMKVSSFQELDLFTGLASC

SEQ ID NO: 138928 - protein, 234 aa, Triticum aestivum
  Clone ID: PAT_TA_33346.pep
MGVKGGGVVWCLLVAGLLLLAVASAAERDTEEEIRWCKEDCEWKAGQDTGKARECKEQCEHHRRHDHGHEPQDEDGGIPDRCKRECESHEDMDIKLRCTLECWRQQKREGDADGFDEGRNTDGRCERMCRHYHDRREKKQCMKGCRYGESDLLGSDHDGHEHRDRWQTQCKRFRRGSYDRQQCIEKCQCQQKEDDEAMSRHGSGDRGHGQNCQGKGVQRLAREDRARGCKGSGG

SEQ ID NO: 138929 - protein, 142 aa, Triticum aestivum
  Clone ID: PAT_TA_33347.pep
TLPHSFNGNKLCRVRKSLSVLQKQANIFEKASTQLDSYLQSKVDESEEEPWSLEIQEFSYWIALTPLSDNHGGTTEENNRTEKINSSKVGCSKRWSRVPSLPSYIPFGELYLLGDSSVTTLSDSEYSKMTSAVLVTLQRFLS

SEQ ID NO: 138930 - protein, 164 aa, Triticum aestivum
  Clone ID: PAT_TA_33348.pep
MHHPSPFLFLPLLLLAAAPLVATAATFNCVGGVYKANSTYEANLRRLAAVLPAETASSQDLQATRGVGYWPNRPRASSRCYWGVGPSSCAACVAGAFREAERACPYGKKAVVFARNCTLSLADFPRALGFRTISWFDLLGPGLIFQAIGFAWLFFMLLQEWRDK

SEQ ID NO: 138931 - protein, 58 aa, Triticum aestivum
  Clone ID: PAT_TA_33349.pep
IIDLHDATIRGYYHDKNKTIYMYKKKKTNFMHEPISRPKVFLISSSLSIISFAGPEPV

SEQ ID NO: 138932 - protein, 142 aa, Triticum aestivum
  unsure (1)..(142): unsure at all Xaa locations
  Clone ID: PAT_TA_33350.pep
TQEKQRDHWPAFMKFKESELAQERSRINKINAAKKEHYHKLGLGVYVVARPKWDKAEQQMVYAGVIPVTLSWPPGSKTWFYMHGRILDPKTGQVLEKGKXKGAHLKILVAIEEAXRGVFTPNRENDELMGALXNHEHPGKNT

SEQ ID NO: 138933 - protein, 88 aa, Triticum aestivum
  Clone ID: PAT_TA_33351.pep
RPQSKDGNEPNEGQVVLYKPRADVFLSFVDKGPESEKGVSLNRVLKRFHREREANGSELGKGKEEKELWRSLRLRQNDQGEIVLFSVE

SEQ ID NO: 138934 - protein, 205 aa, Triticum aestivum
  unsure (1)..(205): unsure at all Xaa locations
  Clone ID: PAT_TA_33352.pep
MLAKWSTFSFCPLNAFPPFIILLLAAAYIHVPATAIVAVPSAHXYTFDSDSHLVDFTHLSRKDLEYNEEGSVTSDLVVQLCKDVQTRSQAGGFIDFGRFTNHRSFETGSKPIDYIQRFHNGDLAKCETTFEEMGRTAQVNIMCGRCSNKVCKDEHGCICGVSYDERMCRTVVELAIPCPKRGPRVFTGFTRGLHPRSAQVVYNGL

SEQ ID NO: 138935 - protein, 112 aa, Triticum aestivum
  Clone ID: PAT_TA_33353.pep
VSFGRAAFHPVNFALSPFHRKDIVMHVEGVAALQQHLHQVIVSNEEPAFEELAREKLSLELAREKAVSRQAKQNTRKRDGSVTAAAVGASLGAGLGIVMAVIMGAASALRKP

SEQ ID NO: 138936 - protein, 308 aa, Triticum aestivum
  unsure (1)..(308): unsure at all Xaa locations
  Clone ID: PAT_TA_33354.pep
MPFKLVKNSAYYSRYQTKYKRRQQGKTDYYARKRLITQAKNKYNAPKYRLVVRFTNKDIICQIVTSEISGDKVFISAYAHELKAYGIEHGLTNWAAAYATGLLVARRALKKLGLDEDFAGVEEADGEYKLTEAAETDDGERRPFKVFLDVGLKRTSTGARVFGAMKGASDGGILVPHSEKRFPGYDMETKELDADTLRNYIFGGHVAEYMETLADDDEERFRSQFQKYVDDDVEAEGLEDLYTEAHAAIREDPFXKVESDAPRRSVSRSASRRSCSGIKKLLYLIGSRAFEDCWPLHWVWSFEERDGP

SEQ ID NO: 138937 - protein, 180 aa, Triticum aestivum
  Clone ID: PAT_TA_33355.pep
MTCALAPGSPVFSPSRLGLLEQLQLHNHHGCSSGGACFLPSSPLRPFAHLRARIHPEPSPCAVQPPPAAKAADPSSSPAVKAPVKRRRPAPLLVPAAATVAPAVLEAAAATGVEEVAEQGEGFAAFCRRGKGRKRVEMEDRHVAAVALGGDRAQALFGVFDGHGGKGAVEFAADNMPRIV

SEQ ID NO: 138938 - protein, 253 aa, Triticum aestivum
  unsure (1)..(253): unsure at all Xaa locations
  Clone ID: PAT_TA_33356.pep
MASSATREVLMLEAPPSEAAGVPWRPPPDAETVDALPYIDGDYGDPAVKREVDRLVEEEMRRAHRKPADFLRDLPPVPIIGFENHPMLAKEYERVRAGKPPATIEMSRYGLEPPPANKRNDVLAWRQALRNAQSQLQHQIVRIENLELMLKHGVEVWKLQNRKMESVLSRTQKMTLEYNEKIETVNRERKFHQQNTGGQLHALTVEWQELCQKNMAIQAAXCVDLQNQIDLLKLEAKEQGMGMETNPQATAGT

SEQ ID NO: 138939 - protein, 293 aa, Triticum aestivum
  Clone ID: PAT_TA_33357.pep
HVTLLMDQVISTKNPFNIDDTRSDDLFELASGYRLEAPNVFESEQEVDSTSKTVSNQTSVADGKHCPTSDDRMVAVSCKNGYAVDAEDASVSSSADPAKNVFLHDALVNHDKKEGESHTNGIIDAPSQVFPTEFGTMPVSQEINAVSTHVEEKTGTEDTKAKDETPVENIDDSEEKKQTEDASAKEMTAVLHSDNVEEDKLAKDTGSKEVTAVQSTENIHEKVQTEDDRAKKIDGEFNTADVGNRQTDVASKEEKTDEVQQTDNAEEKSRLQKLLQRRRTRCKAGIKLKSEAG

SEQ ID NO: 138940 - protein, 274 aa, Triticum aestivum
  Clone ID: PAT_TA_33358.pep
MSTIDSATVSRNAHGRIERVASFDRTVWTADCNSDGTQVVLGTNTGAGLLNLETGTLSWLYRCKSDILSQQFVHSGNVVLCGLRNGSIVPVDVRERHSSRPTGRSSPSTARGTVPMLSARHNARGRNQADKAKSSRVISMPSAVCSLVSLSSDEHYFLGSSMDGSIKLFDLRLIQKGAIQSYAGHVNSHNNLPLVVDPSETLLMSGGEDCTVRIWSIKTGEQIFAKSVADTLFTALCWPESNLDLDGSSSLFDLNHSWGAWMGSRDGLFYMHGT

SEQ ID NO: 138941 - protein, 77 aa, Triticum aestivum
  Clone ID: PAT_TA_33359.pep
FLLQLLITHGDAGTKGALKDEHVFASAKCQALAELLPSLANDGHRVLIFSQWTTMLDILEWALEVIGITYRRLDGST

SEQ ID NO: 138942 - protein, 179 aa, Triticum aestivum
  Clone ID: PAT_TA_33360.pep
MAAMARSTRSVATERAYHHFAPASTRGLMGYPATAGGPVTADEFDESDVWGSFNPGEEAEQPARSGAELPRVRAVPVARPGRKTKPVDRAGGGGAAHGSLPVAIPDWSKILGGEYQGHQAGDWELDDADDEDVEGAPVVPPHELASRRRAASLSVNDGMGVGRMLKVRDAVWKKTGFQA

SEQ ID NO: 138943 - protein, 202 aa, Triticum aestivum
  Clone ID: PAT_TA_33361.pep
FQSAWGDNLLGIRRKSTGIEADQVKSTEPVTDLENQSSVSQDNGQGNNSSSNQQDWKLNEYVVSCLLSLCVTVCDMLISADQDLTPQFESTTPMDGVSSFPMKLKQIVGKNMHHRSDRLAILKLTCKMVISMMKHRGSYVKEDLQSLMDTLSTASKDMFLIDGSMVFDIKEDGGGATKPEPFRSLVSLVKEAQELVNKRNEL

SEQ ID NO: 138944 - protein, 51 aa, Triticum aestivum
  Clone ID: PAT_TA_33362.pep
FEQDVLSEMGWDLYYASLAQAMLMAPPAAAAALGDYGEAHLADVPLWSYQS

SEQ ID NO: 138945 - protein, 288 aa, Triticum aestivum
  unsure (1)..(288): unsure at all Xaa locations
  Clone ID: PAT_TA_33363.pep
TGLARLPXTLIKLEKLERLFFSQKDVWSTMWKPPQGLWKMKALREVGWILLEDDAVEVAQEVGELENLQRLSIYVDCERPNGPKVLEELALSLSRTHSLRSLDMGTMSYEANALNFLLELPSPPRLLRFLRIAGGIDKLPNWVESLTYLVEFHMSWAHFIDDQLFGVLCKLPNLKSIWMQRNCYTGLELIARAAHNFPALKNLRGTCDNEMPRVYKFEEGSMTKLEKLSLNFDNWSEKSIVGIEHLTSLKEVQLAGKRGNPALDRTLEQLKVESGRHPNQFTVGVKYD

SEQ ID NO: 138946 - protein, 91 aa, Triticum aestivum
  Clone ID: PAT_TA_33364.pep
AAPASSVVHATMPAQLFKIGCLHLLVITAILDAFFEDLGLLKAMIDRPTYSGCGIACTLGVCSFVCAAFDRFPACRFFFSAKKCILLIVPS

SEQ ID NO: 138947 - protein, 52 aa, Triticum aestivum
  unsure (1)..(52): unsure at all Xaa locations
  Clone ID: PAT_TA_33365.pep
MAAEDGARSPTRMLAEGHLRIATGGRAPADGFIXXXXIPHSQHLNKDVAPTS

SEQ ID NO: 138948 - protein, 172 aa, Triticum aestivum
  Clone ID: PAT_TA_33366.pep
AGRPGRQAGGVQGETEERKNPQQEQSRRRRKGIKQEDDSGQPEGARPRARGGAEAQLQERRRRPHPGAAPREGQEGAGGEERQEGGAGLREHLHGRQGQGRQEVVGEAPPDPAPATGMGRRRHHDCHAFVPCLLAASADPCALIVYGWLKLSLAANLCCMSLLYSDEILNSR

SEQ ID NO: 138949 - protein, 176 aa, Triticum aestivum
  Clone ID: PAT_TA_33367.pep
MASSHLAAAASMVLFLAVFAASTNAATFNIKNNCPYTVWPAATPIGGGRQLNTGETWTLDVPANTPSGRVWGRTGCNFNGNSGSCQTADCGGALSCTLSGQPPLTLAEFTIGNGQDFYDISVIDGFNVPLSFSCSNGPNLVCQADKCPDAYLFPTDDTKNHACNGNNNSYQVTFCP

SEQ ID NO: 138950 - protein, 201 aa, Triticum aestivum
  unsure (1)..(201): unsure at all Xaa locations
  Clone ID: PAT_TA_33368.pep
MASSHLAAAASMVLFLAVFAASTNAATFKFANDISXTIPRSEGSESPQLTSRTYMWPAXRPPGSPTQLRRDVTRTLDVPAKPSGCRVWGRTXCNFNGNSGSPCQICXTAFCGGALGLVHAVRAARFAPLTLRVHHGNGPFTHISVXIDRLQRGPLSFSCSNGPNLVCQADKCPDAYLFPTDDTKNHACNGNNNSYQVTFCP

SEQ ID NO: 138951 - protein, 204 aa, Triticum aestivum
  Clone ID: PAT_TA_33369.pep
ILFLPKGRNTQSKTWNYRFFPLDLAYCFAQRYSPATTSSAASLRGTSIGVQRHCFSVTDLANFFKTIYKKTPPEMPLARHSLLLLIWGGADVGASPPGGSGQPAVALDPASSLTSSSWPTTQARRGGRNGALASGSSRIPTNSKENDCWEVSSGDAMGGRPPLRRAVVGGSGGGTPRGRRRPMAARCGPMGARRLLSWRWLPRD

SEQ ID NO: 138952 - protein, 271 aa, Triticum aestivum
  unsure (1)..(271): unsure at all Xaa locations
  Clone ID: PAT_TA_33370.pep
GVCPHNRHEKPQGKFDAVLHGVIDFDSEPWPVISDSAKDXWITRMLNPRPAERXLTAHEVLCHPWIRDQGVAPDRPLDTAVLSRIKQFSAMNKLKKMALRVIAESLSEEEIAGLKEMFQTMDADNSGAITYDELKEGLRKYGSTLKDTEIRDLMDAADVDNSGTIDYIEFIAATLHLNKLEREEHLVAAFSYFDKDGSGYITVDELQQACQEHNMPDAFLDDVIKEADQDNDGRIDYGEFVAMMTKGNMGVGRRTMRNSLNISMRDAPGAI

SEQ ID NO: 138953 - protein, 232 aa, Triticum aestivum
  Clone ID: PAT_TA_33371.pep
MASAELGSDACGFPCGGDDGAMAALSPTVVVSVLASLLERHIARNERATAGATAGHGPEASGEDARRAAAFDGGTVLDMGMREFLERFSRYAHVSPQVYVVAYAYLDRLRRGGDGAGAVRVVATNAQRLLTAAILVASKFVEDRNYKNSYFAAVGGLSAAELSSLELDFLFLMRFRLNVSVSVFRSYCRHLEREVGHGGGYQVERCLEKALLVSSGEARRQHRQTPAAAAAQ

SEQ ID NO: 138954 - protein, 152 aa, Triticum aestivum
  Clone ID: PAT_TA_33372.pep
PCTDAAMTYFFSDLSYKCDCFKKKKKKKKKKKKKKKFKVNIKKKKKKKKKRFATKKGAGEDKVKSAAPPPPLRGTSMEAAGIVWCRRRYGARRRLGTGGRRWRPERAALGAMGFNISLALTHARPVPLRAHPASAATPLPPSTEHAAPTPVQ

SEQ ID NO: 138955 - protein, 73 aa, Triticum aestivum
  Clone ID: PAT_TA_33373.pep
DASIYHNLHEQLQLSSCYKLMEESNDEAEKRIREGAFAKGVRDTAFEDLLAVEKKDDAFWRRDGKLRSISDSM

SEQ ID NO: 138956 - protein, 237 aa, Triticum aestivum
  unsure (1)..(237): unsure at all Xaa locations
  Clone ID: PAT_TA_33374.pep
MRVSHLVLLAISVILSRQVPPQSPQPSLPLAGGGGKKRKNPRRKQEGMDRTAKLGAVEEEKGPTPNTLLLPRLSGPMKQRITEEYRRLFGAFGGIEEFFHQVHEFLSTLVDARDELLQKSENTRRSITIRKAMLSNSRNGRSSHDHLRLCQQVDKLEFEYERLKKDASIYHNLHEQLQLSSCYKLMEESNDEAERESGKXLAKRVRDTGFEELLAVEKKDNAFLRRDGKLRSILDKM

SEQ ID NO: 138957 - protein, 108 aa, Triticum aestivum
  Clone ID: PAT_TA_33375.pep
GKQAEWRDRCRWLEAEFSKDQRPLKVLLAEASLEGKEKKPSTKERVLSFTRRGASKDDASSAKPGAAGSDDQYWNSPAKMPHDNNNVDKRSKVRKQPWMPFICCHSVH

SEQ ID NO: 138958 - protein, 69 aa, Triticum aestivum
  Clone ID: PAT_TA_33376.pep
ETSWSGFQGTWFHFSTCGDVLGWDNYLLHSSTTQVYPWGLKLLCMMMLVPFCIRSLSLLASTLSTIRIY

SEQ ID NO: 138959 - protein, 76 aa, Triticum aestivum
  Clone ID: PAT_TA_33377.pep
QLHEAAGGEGHGELRGGTGEAGKNEAGQEEWRFCSQWYHWSGAGFLRGCAAFPLQPCIPLMLRKPLGKVDWSFQFR

SEQ ID NO: 138960 - protein, 75 aa, Triticum aestivum
  unsure (1)..(75): unsure at all Xaa locations
  Clone ID: PAT_TA_33378.pep
XMGSALVIGGLXIYLYGKANEQHEKTASVTGMQKEGDKEIQRSGVGVTTEERPHPVLLESSVIQLDEELDAGVSK

SEQ ID NO: 138961 - protein, 150 aa, Triticum aestivum
  Clone ID: PAT_TA_33379.pep
MAATFNVNAEAGLKKLDGYLLSRSYICGYQASKDDLAVYSEFSVAPPSTCTNVARWYNHIDALLKLSGVTAPGQGANVLTSCVPDTSTTDVADAPAADDDDDSDVDLFGDDTEDEKKAAEERAAKAKASTKKKVYGQSSTVLDVKPCDDE

SEQ ID NO: 138962 - protein, 209 aa, Triticum aestivum
  unsure (1)..(209): unsure at all Xaa locations
  Clone ID: PAT_TA_33380.pep
MAATFNVNAEAGLQKLDGYLLSRSYISGYQASKDDLAVYSEFSVAPPSTCTNVARWYNHIDALLKLSXVTAAGQGVKVLSSVGPETSTTDVAEAPAADDDDDSDVDLFGEETEEEKKAADERAAKAKAFTKKKDIGRTAVLLDVNPWEGATDMGKLXEAVRNLTRGALLXGLSKLMPAGFWTKNVSHLWYPPLPTRGLPDPSMDKPFLV

SEQ ID NO: 138963 - protein, 94 aa, Triticum aestivum
  Clone ID: PAT_TA_33381.pep
AAPPLGAAVPNRSSDPQSSGSSPSRSRKSKRLPFLVANPESKQSFPDYNQKQALFRIQSPSFHWWREPSSYIYIWPGRTASPVNLWRRRAAATP

SEQ ID NO: 138964 - protein, 248 aa, Triticum aestivum
  unsure (1)..(248): unsure at all Xaa locations
  Clone ID: PAT_TA_33382.pep
MAATFNVNAEAGLQKLDGYLLSRSYISGYQASKDDLAVYSEFSVAPPSTCTNVARWYNHIDALLKLSXVTAAGQGVKVLSSVVPETSTTDVAEAPAADDDDDSDVDLFGEETEEEKKAAEERAAKAKAFTKKKESGKSSVLLDVKPWDDETDMVKLGGAVRSIKMEGLLWGASKLKPIGYGNKKLKXMMNHIGDPWAGDTLNEDHFWVEPAHEDPPKWNIVAFTKTKSFWSKRMGGGGPLRHTNHFFT

SEQ ID NO: 138965 - protein, 70 aa, Triticum aestivum
  Clone ID: PAT_TA_33383.pep
GPFIKEPLFFFVCVFIFCFLFFCFVFFFFFFFFFFFFFFFFFFFFFLQRKRIATGIQPHCLISYEANNTQ

SEQ ID NO: 138966 - protein, 101 aa, Triticum aestivum
  Clone ID: PAT_TA_33384.pep
MDRPSASTVGEVNPDDRISSLPNDILLNILDRLDVCNAARTSVLSRRWSQLPAMLPRLVISAPDLLPSETKTKKTNGKLVRRTKAAVAETLANAGCPMLNW

SEQ ID NO: 138967 - protein, 158 aa, Triticum aestivum
  Clone ID: PAT_TA_33385.pep
TRPEQKGIGSQLCAAACRAPISTISPSPSPSPSDASNEDPPVLEQRRPNKQLPLWELQPPIQAAAAAAAAPFRAATGNRSNQAAPLRAADGNPFRITIRNRPSFEFSLRVSIGGGNLAAIYKSGLAVTTVPANFKRRRATLSSQRPVTRSASAHPPST

SEQ ID NO: 138968 - protein, 110 aa, Triticum aestivum
  Clone ID: PAT_TA_33386.pep
MARTSRRRRAAKLMAKPSVKAESFLDELKYNLDDRLSKLPNDILVNILDRLNCRDVTRTSVLSRQWSQLSAKLSWLKISARDLMHSQASVSDDELDEKLAKTIHLRRSMQ

SEQ ID NO: 138969 - protein, 80 aa, Triticum aestivum
  Clone ID: PAT_TA_33387.pep
MGDEKTAATTARPCRTGGGGGFSGRSGGGFGGRGAGGFGGRGRGRTDRGRGKGGGGNLELSAADLDADLDKYHSAAMQIS

SEQ ID NO: 138970 - protein, 139 aa, Triticum aestivum
  unsure (1)..(139): unsure at all Xaa locations
  Clone ID: PAT_TA_33388.pep
GQGLQKLDGYLLSRSYISGYQASKDDLAVYSEFSVAPPSTCTNVARWYNHIDALLKLSGVTAARQRCEVLSSVVPETSTTDVAEAPAADDDDDSDVDLFGEETEEEKKAAEERAAKAKASTXKKESGKVVNFCLMKPMR

SEQ ID NO: 138971 - protein, 168 aa, Triticum aestivum
  unsure (1)..(168): unsure at all Xaa locations
  Clone ID: PAT_TA_33389.pep
FTDPVDEYLMQYLMDYEDKKFQNVSKEGLKLGKDSKLKELKESFKELTDWWKKALESENVDSVKISNRLHDTPCVVVTSKYGWSANMEKIMQAQTLSXTPSKQAYMRGKRVLEINPXPIIKELRDXVAQDNESEELKHTAKLVYRRPDGDGFNLPTQGVRPTSTRAKG

SEQ ID NO: 138972 - protein, 337 aa, Triticum aestivum
  Clone ID: PAT_TA_33390.pep
QDPVECTIRFFSATFYLSDDAPLSVGHAVGSAMVTHKIEKAEFRVLTQKKRLECTIGDMLTYGKRFVLFFNKCLNAFAGLTRLCLQNLRFAESDFVSNILVTCKQLNYLGFLNCDTKSWITLQVEHAQLSELSIVNCRFDMVELTWLPKLTCLAFEIWIAFNEPPLSFGYVPLLEVLSLSNVAYNRHKMVKLSTFLGETSVLDLKLGFKCEKIWVQPECLTRRQAYVFCQLRILNLLSIPEGYDLTWTMFFLEAAPSLKELILTVIDHPCEMEMDQKVRRQKSYSRNKGVQWESPTSNFKHHCLTKLTFFCFQSEEYMVSHVRRVMKATVNLGDVTV

SEQ ID NO: 138973 - protein, 176 aa, Triticum aestivum
  Clone ID: PAT_TA_33391.pep
DNEVDMLSKLPDDILLNIVERLDIADATRTTILSRRWKQIPAILSKVVIMVGSFQPKHEGRKLTSDDILQANTAMLEATRGILERRAGNPYSIHLLRMEFYLGDESIFIGQTVANTIATQKVASVEFIILTKLRNVFTNNELLTYGSQFMSFFDSCPVTFGGLARLTLENLRLGES

SEQ ID NO: 138974 - protein, 179 aa, Triticum aestivum
  Clone ID: PAT_TA_33392.pep
LTWTMFFLEAAPSLEELYMSVWDHPCEMEMNQEIRREQLYSENKGVEWESPTSNFKHHCLAKFILVGFQAKDYMVSHVRRVLKAAVNLQDVYLYDRLVCAKCQEKVKNARRYDALVRGICPGVNLPIKFPCTNEDQRAVQKRMPRGIGSLAKIHFLSSNKIKAEHWPRIAVDSLGAIED

SEQ ID NO: 138975 - protein, 195 aa, Triticum aestivum
  unsure (1)..(195): unsure at all Xaa locations
  Clone ID: PAT_TA_33393.pep
QQLXILNLVKIXEGYXLTWXMFFLEAAPSLEELYMMVWDHPCKMKMDQEISENKGVEWESPTSNFKHHCLAKFILVGFQAKDYMVAHVRRVLKAAVNLQDVYLYDSLACAKCHKKVENARTSDAVVRGMCPGVNLPIKFPCTNEDQRSVQKRMPRGIGSLAKIHFVTSKEMRAEHRRRMGVMGANWMLSRLGQRI

SEQ ID NO: 138976 - protein, 194 aa, Triticum aestivum
  unsure (1)..(194): unsure at all Xaa locations
  Clone ID: PAT_TA_33394.pep
EFQNVSXEGLKLGKDSKLKDLKESFKELTDWWKKALDTEGIDSVKISNRLHNTPCVVVTSKYGWSSNMEKIMQAQTLSDASKQAYMRGKRVLEINPRHPIIKELRDKVAQDSDSEGLKQTARLVYQTALMESGFNLPDPKDFASSIYRSVQKSLDLSPDAAVEEEDEVEEPEVEEKESGKAEEPEHEQYDKDEL

SEQ ID NO: 138977 - protein, 326 aa, Triticum aestivum
  unsure (1)..(326): unsure at all Xaa locations
  Clone ID: PAT_TA_33395.pep
LFEGIVDSDTLPLNVSREMLQQHSSLKTIKKKLIRKALDMIRKLAEEDPDEYSNKDKTDEEKSEVEEKKGQYAKFWNEFGKSIKLGIIEDATNRNRLAKLLRFESSKSDGKLASLDEYISRMKPGQKDIFYITGSSKEQLEKSPFLERLTKKNYEVIYFTDPVDEYLMQYLMDYEDKKFQNVSKEGLKLGKDSKLKDLKESFKELTDWWKKALDTEGIDSVKISNRLHNTPCVVVTSKYGWXSSNMEKIMQAQTLSDAXSKQAYMRGKRVLEINPKHPXIKELRDKSPKTVTAKALKQTARLVYXTALMETGQLPDPRTCVNIYGR

SEQ ID NO: 138978 - protein, 200 aa, Triticum aestivum
  Clone ID: PAT_TA_33396.pep
MGKGSRDDMLSALPDDILVNILDRLNVPEAARTSILARRWGQLCGKLSRLIISVQDFLPEGVLHSNVSVDELVRTNAAVVQATESILARRNPGEHTIRLLSTTFYLRDDAPLSIGRAVGHAMATHLVEVAKFSVRTGTDDIAEIDDDELVTCGRKFMVFFDACSNAFGGLTSLELQNLRFGESDISSILVSCKRLKHLHL

SEQ ID NO: 138979 - protein, 174 aa, Triticum aestivum
  unsure (1)..(174): unsure at all Xaa locations
  Clone ID: PAT_TA_33397.pep
MAATFNVNAEAGLKKLDGYLLSRSYISGYQASKDDLGCVFKSSQVAPPSTCTNVARWYNHIDALLKLSGVTAPGQGXVKVLSSVVPETSTTDVAEAPAADDDDDSDVDLFGXRKTEEEKKAAEERAAKAKASTKKKESGKSSXLLDVKPWDDETDMVKLEEAVPSIKKEGPLWV

SEQ ID NO: 138980 - protein, 416 aa, Triticum aestivum
  Clone ID: PAT_TA_33398.pep
MANTAVAKVIKSILARRDPGGWPIRLSMTFYLRGSVPISVGHTVGNAMATLKVEKAEFTVLTEKKGRKCSIDDVVNYGTRFVSFFNECHNAFAGLTRLYLENLRFRESNFVSNILVTCKQLNYLGFFNCDTEDWITLQVEHAQLIELSIVNCRFDMVKLTWVPKLTRMVFEFWMSFKEPPLSFGYVPLLDVLSVSNVGLSWHEMVKLSTFLHETSVRDLRLGFKCEKIWVQPECLTKRLASVFHQLRIVNLVDIPEGYDLTWTMFFLEAAPSLEELYMTVIDHPCEMIMDEEKRRKGYYCDNKGVEWESSSSNFKHQRLTKLTIFCFQSENYMMSHVRRVMEAAVNLEDVYLYDRLTCSRCRDVEPLKPIRFPEASRQRCWVEKQIRGDIESLATVHFLATDVIRDDHLARIPRGY

SEQ ID NO: 138981 - protein, 541 aa, Triticum aestivum
  Clone ID: PAT_TA_33399.pep
SSGRPGRYSEFINFPIYLWATKEVDVEVPADEEESSEEEESTTETTEEEETEDEEKKPKTKTVKETTTEWELLNDMKAVWLRNPKEVTEEEYAKFYHSLAKDFGDDKPMTWSHFSAEGDVEFKALLFVPPKAPHDLYESYYNANKSNLKLYVRRVFISDEFDDLLPKYLSFLMGIVDSDTLPLNVSREMLQQHSSLKTIKKKLIRKALDMIRKLAEEDPDEYSNKEKTDDEKSAMEEKKGQYTKFWNEFGKSVKLGIIEDATNRNRLAKLLRFESSKSDGKLVSLDEYISRMKSGQKDIFYLTGSSKEQLEKSPFLEQLTKKNYEVIYFTDPVDEYLMQYLMDYEDKKFQNVSKEGLKLGKDSKLKDLKESFKELTGWWKKALDTEGIDSVKISNRLHNTPCVVVTSKYGWSSNMEKIMQAQTLSDASKQAYMRGKRVLEINPRHPIIKELRDKVAQDSDSEGLKQTARLVYQTALMESGFNLPDPKDFASSIYRSVQKSLDLSPDAAVEEEEEVEEPEVEEKESGRAEEPEHEQYDKDEL

SEQ ID NO: 138982 - protein, 221 aa, Triticum aestivum
  unsure (1)..(221): unsure at all Xaa locations
  Clone ID: PAT_TA_33400.pep
MAATFNVNAEAGLKKLDGYLLSRSYISGYQASKDDLAVYSEFSVAPPSTCTNVARWYNHIDALLKLSGVTAPGXQGVKVLSSVVPETSTTDVAEAPAADDDDDSDVDLFGEETEEEKKAAEERAAKAKASTKKKESGKSSVLLDVKPWDDETDMVKLEEAVRSIKMEGLLWGASKLMPVGYGIKKLQIMMTIIDDLVSVDTLIEDHLCVEPANEYLGRDHA

SEQ ID NO: 138983 - protein, 806 aa, Triticum aestivum
  unsure (1)..(806): unsure at all Xaa locations
  Clone ID: PAT_TA_33401.pep
MRKWALSCALLLVLLLTTLPDPAKKLQVNAEESSDEVGDFPKVEEKLGAVPHGLSTDSEVVQRESESISRKTLRNSAEKFEFQAEVSRLMDIIINSLYSNKDIFLRELISNASDALDKIRFLTLTDKEALGEGDTAKLEIQIKLDKENKILSIRDRGVGMTKEDLIKNLGTIAKSGTSAFVEKMQTGGDLNLIGQFGVGFYSVYLVADYVEVVSKHNDDKQYVWESKADGSFAISEDTWNEPLGRGTEIKLHLRDEAKEYLEEGKLKDLVKKYSEFINFPIYLWATKEVDVEVPADEESSEEEESTTETTEEEETEDDEEKKPKTKTVKETTTEWELLNDMKAVWLRNPKEVTEEEYAKFYHSLAKDFGDDKPMTWSHFSAEGDVEFKALLFVPPKAPHDLYESYYNANKSNLKLYVRRVFISDEFDDLLPKYLSFLMGIVDSDTLPLNVSREMLQQHSSLKTIKKKLIRKALDMIRKLAXEDPDEYSNKEKTDDEKSAMEEKKGQYAKFWNEFGKSVKLGIIEDATNRNRLAKLLRFESSKSDGKLVSLDEYISRMKSGQKDIFYLTGSSKEQLEKSPFLEQLTKKNYEVIYFTDPVDEYLMQYLMDYEDKKFQNVSKEGLKLGKDSKLKDLKESFKELTDWWKKALDTEGIDSVKISNRLHNTPCVVVTSKYGWSSNMEKIMQAQTLSDASKQAYMRGKRVLEINPRHPIIKELRDKVAQDSDSEGLKQTARLVYQTALMESGFNLPDPKDFASSIYRSVQKSLDLSPDAAVEEEEEVEEPEVEEKESAKAEEPEHEQYDKDEL

SEQ ID NO: 138984 - protein, 810 aa, Triticum aestivum
  unsure (1)..(810): unsure at all Xaa locations
  Clone ID: PAT_TA_33402.pep
MRKWALSCALLLVLLLTTLPDPAKKLQVNAEESSDEVGDFPKVEEKLGAVPHGLSTDSEVVQRESESISRKTLRNSAEKFEFQAEVSRLMDIIINSLYSNKDIFLRELISNASDALDKIRFLTLTDKEALGEGDTAKLEIQIKLDKENKILSIRDRGVGMTKEDLIKNLGTIAKSGTSAFVEKMQTGGDLNLIGQFGVGFYSVYLVADYVEVVSKHNDDKQYVWESKADGSFAISEDTWNEPLGRGTEIKLHLRDEAKEYLEEGKLKDLVKKYSEFINFPIYLWATKEVDVEVPADEEESSEEEESTTERTEEEETEDDEEKKPKTKTVKETTTEWELLNDMKAVWLRSPKEVTEEEYAKFYHSLAKDFGDDKPMTWSHFSAEGDVEFKALLFVPPKAPHDLYESYYNANKSNLKLYVRRVFISDEFDDLLPKYLSFLMGIVDSDTLPLNVSREMLQQHSSLKTIKKKLIRKALDMIRKLAEEDPDEYSNKEKTDDEKSAMEEKKGQYAKFWNEFGKSVKLGIIEDATNRNRLAKLLRFESSKSDGKLVSLDEYISRMKSGQKDIFYLTGXSSKEQLEKSPFLEQLTKKNYEVIYFTDPVDEYLXMQYLMDYEDKKFQNVSKEGLKLXGKDSKLKDLKESFKELTDWWKKALDTEGIDSVKISNRLHNTPCVVVTSKYGWSSNMEKIMQAQTLSDASKQAYMRGKRVLEINPRHPIIKELRDKVAQDSDSEGLKQTARLVYQTALMESGFNLPDPKDFASSIYRSVQKSLDLSPDAAVEEEEEVEEPEVDEKESGKAEEPEHEQYDKDEL

SEQ ID NO: 138985 - protein, 226 aa, Triticum aestivum
  Clone ID: PAT_TA_33403.pep
MAATFNVNAEAGLKKLDGYLLSRSYISGYQASKDDLAVYSEFSVAPPSTCTNVARWYNHIDALLKLSGVTAPGQGVKVLSSVVPETSTTDVAEAPAADDDDDSDVDLFGEETEEEKKAAEERAAKAKASTKKKESGKSSVLLDVKPWDDETDMVKLEEAVRSIKMEGLLWGASKLMPVGYGIKKLQIMMTIIDDLVSVDTLIEDHLCVEPANEYIQSCDIVAFNKI

SEQ ID NO: 138986 - protein, 226 aa, Triticum aestivum; identical to SEQ ID NO: 138985
  Clone ID: PAT_TA_33404.pep

SEQ ID NO: 138987 - protein, 808 aa, Triticum aestivum
  unsure (1)..(808): unsure at all Xaa locations
  Clone ID: PAT_TA_33405.pep
MRKWALSCALLLVLLLTTLPDPAKKLQVNAEESSDEVGDFPKVEEKLGAVPHGLSTDSEVVQRESESISRKTLRNSAEKFEFQAEVSRLMDIIINSLYGNKDIFLRELISNASDALDKIRFLTLTDKEALGEGDTAKLEIQIKLDKENKILSIRDRGVGMTKEDLIKNLGTIAKSGTSAFVEKMQTGGDLNLIGQFGVGFYSVYLVADYVEVVSKHNDDKQYVWESKTDGSFAISEDTWNEPLGRGTEIKLHLRDEAKEYLEEGKLQDLVKKYSEFINFPIYLWATKEVDVEVPADEESSEEEESTTETTEEEETEDDEEKKPKTKTVKETTTEWELLNDMKAVWLRNPKEVTEEEYAKFYHSLAKDFGDDKPMTWSHFSAEGDVEFKALLFVPPKAPHDLYESYYNANKSNLKLYVRRVFISDEFDDLLPKYLSFLMGIVDSDTLPLNVSREMLQQHSSLKTIKKKLIRKALDMIRKLAEEDPDEYSNKEKTDDEKSAMEEKKGQYAKFWNEFGKSVKLGIIEDATNRNRLAKLLRFESSKSDGKLVSLDEYISRMKSGQKDIFYLTGSSKEQLEKSPFLEQLTKKNYEVIYFTDPVDEYLMQYLMDYEDKKFQNVSKEGLKLGKDSKLKDLKESFKELTDWWKKALDTEGIDSVKISNRLHNTPCVVVTSXKYGWSSNMEKIMQAQTLSDASKQAYMRGKRVLEINPRHPIIKELRDKVAQDSDGEGLKQTARLVYQTALXMESGFNLPDPKDFASSIYRSVQKSLDLSXPDAAVEEEEEVEEPEVEEESGKXEEPEHEQYDKDEL

SEQ ID NO: 138988 - protein, 85 aa, Triticum aestivum
  Clone ID: PAT_TA_33406.pep
QAVHNRCSSDTQYITLHYINIASFQAVLTQIQLSKSKTSSNLLTRRTGSNFRRSLCCTTRGQGFSRPLGGQNADQRSCSHDWKTM

SEQ ID NO: 138989 - protein, 87 aa, Triticum aestivum
  Clone ID: PAT_TA_33407.pep
LNQTNQGFHQIMDKSLEWQQIYGAKEREGKSLPSRMDWGSNPRIKSSDLRGMQRDEELPGRAGAAALKSLCSAQGLGAARQSVAHSS

SEQ ID NO: 138990 - protein, 373 aa, Triticum aestivum
  Clone ID: PAT_TA_33408.pep
LHGDDLREMVQECYEVAAEYETKHDLEKLDELGESVAGLDPGDSIVIAKAFSHMLNLANLAEEVQIAYRRRVKLKKGDFADENSAITESDIEETLKRLVFDMKKSPAEVFDALKNQTVDLVLTAHPTQSVRRSLLQKHSRIRNCLVQLYSKDITPDDKQELDEALQREIQAAFRTDEIRRTQPTPQDEMRAGMSYFHETIWKGVPKFLRRVDTALKNIGINERVPYNAPLIQFSSWMGGDRDGNPRVTPEVTRDVCLLARMMAANLYCAQIEDLMFELSMWRCNDELRSRADELHRSSKKDAKHYIEFWKKVPPNEPYRVILGDVRDNLYNTRERSRELLSSGHSDIPEEATLTNLEQLLEPLELCYRSLCAC

SEQ ID NO: 138991 - protein, 124 aa, Triticum aestivum
  Clone ID: PAT_TA_33409.pep
RQTEVSNHRREGRRRKEKPDTTSRRLEQPWRRRSDPLPQGLIWSARPRSAMPAPGARPAVAVPSRNHRRATPPRRPKDQHHRSTGSPPTTAARAGSAPQPPSATQASPGDLLRRRRGGRQIWRG

SEQ ID NO: 138992 - protein, 205 aa, Triticum aestivum
  Clone ID: PAT_TA_33410.pep
ARRRYPGYDDPMQLAAQTAFSVSEVEALFELFKTISGSVIDDGFINKEEFQLALFKSKMDNIFANRIFDLFDVKKRGVIDFADFVQALNVFHPSIPMEEKIDFSFKLYDMDNTGFIERKEVKQMLIALLSESGMRLSDETIESIIDKTFSDADVNQDGKIDRAEWENFVSRNPSLMKIMTLPYLKDITTTFPSFVFNSKVDDIVT

SEQ ID NO: 138993 - protein, 127 aa, Triticum aestivum
  Clone ID: PAT_TA_33411.pep
MMGGGLTLQSGAAAHVFSRRVTPQPRPPAPARGDHSPGAATLSTPLPVDFFTGTQTVNDVVDDAVSCPRPEAAASVRIHGTDDLQPASSASAPSSTRLSGALLRATMAQWPAEVRAGGGSQRGARDG

SEQ ID NO: 138994 - protein, 153 aa, Triticum aestivum
  unsure (1)..(153): unsure at all Xaa locations
  Clone ID: PAT_TA_33412.pep
AAAERAMALAFDGGVAATAAGNSYRWAPAAERVVGVPRTPNGDATRTTLRLGLRRRRGVATQLELSSDDGGVAERQRRTSAIGDCGRSRRDKVQGGMGKCDTGLAGREGFYSRSVSIGILGDFTESGRSLRGNLRGCAGMSSXTIHLAHRLAK

SEQ ID NO: 138995 - protein, 325 aa, Triticum aestivum
  unsure (1)..(325): unsure at all Xaa locations
  Clone ID: PAT_TA_33413.pep
ENGGLGIKNIECFSRALRLRXGVFKWQDEERPWKGSATPCDDTDRQLFSSCTTICLGDGSIASFWMNKWLNGNSPSVLAPDVFKLAGFKRVTVKEGLRNGKWMQGLQRLDTEKQLNQFVHLWHEVQMINLSVKRDTAIWNLTTSAAYSACSAYDAQFCARIEKPGLARVWKSKMEGKVKFYIWLLLQNRNWTADCLQARGWPNNDQCKLCDQEAETASHIALKCSYAREVYFHFRQQNNAVWTTTDMAQSVSEWWXSVLSIVRETREKTKEEITLGAYIVWNLWKERNRRVFEHKELTTLALTRLIRDDIRCFNEATRGTAVPGE

SEQ ID NO: 138996 - protein, 132 aa, Triticum aestivum
  Clone ID: PAT_TA_33414.pep
AELLLERRPRTARERARVARLRLGAASGVGRGGGEAGGDGGVVHDVVEALRLHHPQPQLPRLLLRQHPEPPFPPLLLRRRFSGRLGVDVVGLARPPQQRRPPLGAPAGRGGAGAGPPEPRRRRPDGERRGGS

SEQ ID NO: 138997 - protein, 86 aa, Triticum aestivum
  Clone ID: PAT_TA_33415.pep
VKKNGVIWLHLHLHLRRRTKETLFVLLKLLGAVAHAAVSHEFSEHKLKLLQLFCLLFYPSCWTRNYVNDVFLATADFLEYQSLIGN

SEQ ID NO: 138998 - protein, 599 aa, Triticum aestivum
  unsure (1)..(599): unsure at all Xaa locations
  Clone ID: PAT_TA_33416.pep
RRKTRSQWDAPPMPLHAVSLLMEAIYLKARALHVRGTFKDAAQECRMILDIVEAAVPEGLPAGFGKGCKLNEIICKAVEFLPELWKLAGFSLEAISEYRRSLLNNWNLDGETIAKIQKEFAVFLLYSGCEARPPNLHSQLDGSFVPRNNMEEATLLLMILLRKFNLRRVERDPTVMHHLTFALSISGQLKPLAVQFEELLPGLLDKREWSYNVALCYLAEKDDSTALNLLKRMLKFGQDSDNLKELLLASKVCVEKGAHAEGAAYARRAITNIQGGCKQLAGVADLLLGVSLSXSARYAISDTERASWQCEALEVLGSAEKNMHGQDCRIMYNLSLENAEQRKLDAAVFYAKKLVKLEAGSELRSWLLLARILSAQKLFTDAETVVDAALDQTGKWNQGDLLRTKARIQAAQGQLRDAVGTYTQLLALIQLRTKSFGAGISLAKGGEDDKSLETETWYDLALLYLGMSQWRDAEVCVSKIRATNCYSAFAWHATGKLCEAKDLPKEALGAYFRALDFDSKHVPSLISSATILRQLGDRPLPSVRCFLTDALQLDRTNHMAWFNLGLLYKEEGGRSAAEAAECFQAAALLEETAPVEPFR

SEQ ID NO: 138999 - protein, 601 aa, Triticum aestivum
  unsure (1)..(601): unsure at all Xaa locations
  Clone ID: PAT_TA_33417.pep
RRRSKXGSGSVTNVVPTAGNGTPVRPQSSNSAKKKATKSQLESDASVGPNGKASPEEAESEVSKPGSRVGRRRKASAKSQNGTXEDAGLDNPDLGPFLLKHAXRDLIASDNPRRALKYALRATKSFEKCAGGKPSLNLVMSLHVVAAIHCNMGKYEEAVPVLQRSLEIPVTEEGQEHALAKFSGCMQLGDTYGMLGQIALSLQWYAKGLEIQKQTLGEQDPRVGETCRYLAEAHVQALQLDEAQKLCQMALDIHRDNGQPASLEETADRRLMGLICDTKGDHEAALKHLVMASMAMVANGQETEVASVDCSIGDIYLSLGRYDEAVCAYQKALTVFKTSKGENHATVASVFLRLADLYNKTGKLRESKSYCENALKIYQKPIPGTSLEEIATGLTDVSAIYETMNEHDQALKLLQKALKMYNNSAGQQSTIAGIEAQIGVLHYISGNYGDAYDSFKSAITKLRTCGEKKSAFFGIALNQMGLACVQRYSINEAAELFEEARTVLEQEYGPYHADTLGVYSNLAGTYDAMGRLDEAIEILEYVVEMREEKLGTANPDVDDEKRRLAELLKEAGRGRSRKAKSLENLLETNPYTIGKRTTVAA

SEQ ID NO: 139000 - protein, 92 aa, Triticum aestivum
  Clone ID: PAT_TA_33418.pep
GRKPSDHTMPKGQQSLVTWATPRLSEDKVKQCVDPKLNSDYPPKAVAKLAAVAALCVQYESDFRPNMTIVVKAIQPLLNQKPAGPAAEAPKP

SEQ ID NO: 139001 - protein, 157 aa, Triticum aestivum
  unsure (1)..(157): unsure at all Xaa locations
  Clone ID: PAT_TA_33419.pep
ANALVLATGERDGVAIGKPTAFDGYYDVPEGMERIVKYVNQRYENTPIYVTENGYSQYSNNTMDELINDVERVNYLQGYLTCLSSAVRKGANVRGYFXVWSIIDNFEWTYGFTVKFGLYHVDYETQKRTPKMSAKWYRDFLMGSRPTNQVQTPRADS

SEQ ID NO: 139002 - protein, 184 aa, Triticum aestivum
  unsure (1)..(184): unsure at all Xaa locations
  Clone ID: PAT_TA_33420.pep
RRQNTVQDTVPEAKPRRHQQCASITNHRGSSGAAANNAVVPVPAVAEHQNLNRHEIEIEGKKINDTDKRNNGGVGAAQVPTSNGQTTPPTATFDLGXKKPEDAVRELNEQPHREFTTDETDSDDMGDDYTDDGEXGQDDGKMQYRIQFQRPNPVGTNNAPPPPTTAATAAPTSTPASSFLAMVQ

SEQ ID NO: 139003 - protein, 52 aa, Triticum aestivum
  Clone ID: PAT_TA_33421.pep
SCDLTLCARDGDGHQIALLCWLQLCSVAGRHTSEVFLVVTAAIMSSHTSFRR

SEQ ID NO: 139004 - protein, 111 aa, Triticum aestivum
  Clone ID: PAT_TA_33422.pep
RRITASACYITTARAPSRRSCIVAPGGSLQRCRLVASGVMHHNSRSTKSSKLHRNTRWLPAASRLDLPILPCCSTDDERRRPPATTPSCCVAALMGCGSTYGLPLLAPLQC

SEQ ID NO: 139005 - protein, 235 aa, Triticum aestivum
  Clone ID: PAT_TA_33423.pep
SAKEDTRHASLLRPLMQEARVTTPCSSSEKSGTSSSGTKRRGRGSFLYDKSVLYSDQCGSERDLDDKGSDPARGGSKGHADEKDNKDAAKRFGTRHALVLYDFPPSTRTTDLERIFEKFGDHGVAVRWVNDSVALAVFRTPSSAKEAQACVPPRYKVRSLKDNDDLLAKIDGTDLEPPKPRPKTSARTAQRLIAHGMGLKQFTTIDAGERKEQEEARRSRITARQAARDDAWGED

SEQ ID NO: 139006 - protein, 195 aa, Triticum aestivum
  unsure (1)..(195): unsure at all Xaa locations
  Clone ID: PAT_TA_33424.pep
RPGRSQVGNPEFKKRFDELPGLRALHVRNKPDLIPLYPSNLLGYANVGDELSVNSKKSPHVRPDTTNVGDYHNLQGILHTVAGWNGEKGEXFKLQVNRSVALVNKSSAFLKDDNLVPESWWVERKKGMVLGPTGEWELEQPAEENLPVPPVVTGKVIDDDVAATISSKEPKIPEDLGKKKTRGTKFLPACFQGVN

SEQ ID NO: 139007 - protein, 156 aa, Triticum aestivum
  Clone ID: PAT_TA_33425.pep
ACTKNVFISSFAEIPGSFVSIMIVDRIGRRLSMASMLFTSCVFLFPLVFSRTEILTRISLFGARLCISASFTIVYIYAPEIYPTSVRTTGIGVASSVGRIGGILCPLVAVALVHNCHQTTAILLFELVVFLSGVAVMFFPFETKGCRLNDTEADMH

SEQ ID NO: 139008 - protein, 208 aa, Triticum aestivum
  unsure (1)..(208): unsure at all Xaa locations
  Clone ID: PAT_TA_33426.pep
MARRGRVELRRIEDRTSRQVGFSKRRAGLFSTASELAVLCDAVVALLXSSRPAGKLYEYASSSIEGTYDLYQRFAGAGTNLNGGDASNNNDGDPSNIQSTLKDIASWSIQNNADVSDANKLEKLEKLLTDALRNTKSKKMSAQQNSGAGTSGENANGPRGNKKRGRTLEQTCRCVCIWYKLCSVPDATLFLKGVSKTCQGCCYKRAVG

SEQ ID NO: 139009 - protein, 185 aa, Triticum aestivum
  unsure (1)..(185): unsure at all Xaa locations
  Clone ID: PAT_TA_33427.pep
QXGSRLVAAXYVLYSSATIFCISFGAGTHGFTLDRSTGEFVLTHPSMQIPPRGQIYSVNDARYFDWPEGLKKYIDTIRQGKGQHPKKYSARYVCSLVADFHRTIIYGGVAMNPRDHLRLVYEANPLSFLAEQAGGRGSDGKTRILSIQPVKLHQRLPLFLGSMEDMLELESYGDVQQKVNPGYDV

SEQ ID NO: 139010 - protein, 271 aa, Triticum aestivum
  Clone ID: PAT_TA_33428.pep
EIREARRIKMLHQPSKVMDMQFELQGLRTLISEKTQLCNQLKKELAMIKRLEQDSSKLFELEGSDTLGSQFRIVPRVDGAPDISSGPPRWYRVISGGHRELVSGATRLTYAPEPFDVGQLLQAEIILKADKVTVQTDGPINHASGLEHYVESLMKRADIEFNVVVTQMNGNDYASKSVHVFHIGKLRVKLRKGRSTKARESYSTTMKLCGSRGGGNAAACAVFWQTRKGLSYTLAFETDRDRNAAIMLARKFASSCNVVLAGPGDQVHGGG

SEQ ID NO: 139011 - protein, 314 aa, Triticum aestivum
  Clone ID: PAT_TA_33429.pep
HASDGIVRSMAIGAVFTDYAGKISCLDFHRKEDLLVTSSEDDSIRLYNTTSATLSKTTYHKKHGADRVCFTHHPSSILCSSRYNVESGESLRYLSLYDNRCLRYFKGHKDRVVSLCMSPVNDSFMSGSLDHSVRIWDLRVNACQGILRLRGRPSVAYDQQGLVFAVAMEGGAIKLFDSRSYDKGPFDTFLVGGDTAEVSDIKFSNDGKSVLLTTTNNHIYVLDAYGGEKKCGFSLESSRNIATEAAFTPDGQYVISGSGDGTLHAWNINTVQEIACWNSHIGPITALKWAPRRAMFATASTALTFWIPNESSSS

SEQ ID NO: 139012 - protein, 320 aa, Triticum aestivum
  Clone ID: PAT_TA_33430.pep
LRFFASRRPSRPCPCGLDSPAAAGTGVSSACSSLYGVGFLMDSPACLLESVPAVPSNGSGTSSVGAGGADISPGKQSALDGASRQGEDADCSSEAGMCAGFSKSASSGFKKALQKCATFPPSAAAAEQDDSCCAADDDALPKDAHTYQRSVSLPSTVKLIPAIKGSRKKNGIPLPAVPRPAEDRHIKWAADVYDPPVSSVSHSVNNSYQRRPKPRKKDKSKQKEKRKARNKKKTSNASQNQAVLQTSELEDLGTSIGREAPADPGKLETEMLDYGIKQPKRPNAEAASCSRRLLKCISPPPRPPESPAGDSRLCSSISVM

SEQ ID NO: 139013 - protein, 186 aa, Triticum aestivum
  Clone ID: PAT_TA_33431.pep
FNAHAETKEAKLQSELAALMYMKTRLVRVRGPGGKLAFGASGEAEVVSARGRGPGGRGFMSGAGETELQLQRRRIQERRLSLLAQIEDVRRTRAIQRSSRKRHGGPFGQDLVTVAVVGYTNAGKSTLVNALSGAGLYSDDRLFATVDPRLRSVILPSGRKILLSDTVGFISDLPVQLVEAFHATLE

SEQ ID NO: 139014 - protein, 323 aa, Triticum aestivum
  unsure (1)..(323): unsure at all Xaa locations
  Clone ID: PAT_TA_33432.pep
SQHQSPTLARLSTMRSLRGLLAVSGHLAAASGASSSPHSVLFARALQILSQPEPVRLHKLSAPDSGIVELRLERPEARNALGKEMLKGLRSAMDKVGADPTANVVLVASSVPKVFCAGADLKERRLMGPSEVREFVNTLRATFSSFEALPIPTIAVGVPAAFGGGLPGARACQRRICGESATFSLPVTGLARRPGATAAVNMGVEXGGTQRLPRIVGRARAKELIYTGRXFDATKAVNXGIEGWRYDLSSALAXRRRVRRASSAHSGSPSKVVAAFSREXKHLYLSSWVAIEEECYGHVLHTLYRLEGLAAFAEKXRPLYTGK

SEQ ID NO: 139015 - protein, 267 aa, Triticum aestivum
  unsure (1)..(267): unsure at all Xaa locations
  Clone ID: PAT_TA_33433.pep
MAGSMELPTKGGFSFDLCRRNAMLEKNGLKMPGFRKTGTTIVGLVFADGVVLGADTRATEGPIVADKNCEKIHFMAPNIYCCGAGTAADTEAVTDMVSSQLQLHRYATSRESRVVTALTLLKTHLFNYQGHVSAALXVLGGVDVTGPHLHTVYPHGSTDTLPFATMGSGSLAAMSVFESKYREGLTRDEGXIALVAEAIRAGIFNDLGSGSNVDICVITKGKTEYLRNHELPRRGYSFNKGQSEVLSTKITQLKLKPEVADGDAMEE

SEQ ID NO: 139016 - protein, 229 aa, Triticum aestivum
  Clone ID: PAT_TA_33434.pep
AALAGAGTPPHGSPVAAKRAAATAWKRPENGPVLVAPASPIMDADSWPALPGLASPQPPTPPKASPKAAPPPSTVAAILPVSLDISDAPDATPDQDALETVILPVSLDISGAPDATTVKDAVTSSPPVRRVLMMPAGDDGPEMHALIPEPSLGYSPNARSNGTGVHHQNGRFGSHPHGRGGSYGGGSRRGNGGGGSRHGHEHHGGFDGQRRGGGRRDGHGPGHQHRVHQ

SEQ ID NO: 139017 - protein, 331 aa, Triticum aestivum
  unsure (1)..(331): unsure at all Xaa locations
  Clone ID: PAT_TA_33435.pep
MATGVGEARGETVLVTGASGFIGSWTVRLLLARGYDVHAAVLNPDDKAETEHLLALAGGDEGRVRFFPCDLLDGAAMLAAARGCSGVFHLASPCTVDRVLDPQKELVVPAVEGTLNVLRAAKEAGGVRRVVVTSSVSAVVPSPGWPAGEVLDERCWTDIDYCDKNGVWVXASKTLAEKAAWKFAEENGLDVVVVNPGTVLGPMIPPRINASMAMFLRLLEGCTEEYKDFFIGPVHVEDVALAHITLFENPSASGRHLCVEPICHWSDFASKVAELYPDYKVPKLAEGXRSPGLVRAETVPKKLMALGLQFTPLEKIIRDAVESLRSRGCIA

SEQ ID NO: 139018 - protein, 121 aa, Triticum aestivum
  Clone ID: PAT_TA_33436.pep
ARLAILHLNDKSHSCLPLDVHCHGCTNNGSIHMKHPPTHFDCGHTDLSLGYDACNDEVCRDAQNKEDDDEEEELREEEERIRESFDYLDDVEFMEKLRKKRAELLALHSKIQEDEEAACKD

SEQ ID NO: 139019 - protein, 106 aa, Triticum aestivum
  Clone ID: PAT_TA_33437.pep
QDLTVESALSMFSSEASAKAMVKMMCPEVAQLLLAHAYQVCLSVDGDSSEANDAAKMMGASLLEISCKFVLAFQNLRKINTNIQISQFEKEALFTAATLTRKLQNG

SEQ ID NO: 139020 - protein, 73 aa, Triticum aestivum
  Clone ID: PAT_TA_33438.pep
QEESKGAEIGTGKEGLGFRKHLLNMNQHSSKLINCQARRNSQAHSLCNNGMGSKGGTMHGWAPLRGQTQQDLV

SEQ ID NO: 139021 - protein, 211 aa, Triticum aestivum
  Clone ID: PAT_TA_33439.pep
MNSSAVTCCYWPPPPHAPGGKASPSPRLNNKSSTRIGRRDLVLRSSELATLAAIFHFSGTKPSYLGVQKRPPALALCPATNNCVSTSERISDSNHYAPPWNYNPKDGPRGKPISKDEAMKELIEVVTKTKPDNFSPRVVEKGDDYVRVEYESPIFGFVDDVEFWFPPGNKSIVQYRSASRSGFIDFNANKKRVKALRLALEKKGWASESTF

SEQ ID NO: 139022 - protein, 86 aa, Triticum aestivum
  Clone ID: PAT_TA_33440.pep
VARPDRIPPAPRDFVPLLSSALCDLALFLLFFLHKKVLPLLYLAPWLLLFISHKSLLPSLLFFTLLDSHIDGILTIISAFAHISAR

SEQ ID NO: 139023 - protein, 46 aa, Triticum aestivum
  Clone ID: PAT_TA_33441.pep
MIYSDSGHETAHRVYIGSSTRSTLSILQLFSFCFSIPMPAPAGRVG

SEQ ID NO: 139024 - protein, 172 aa, Triticum aestivum
  Clone ID: PAT_TA_33442.pep
NASIPQGAWHISPSHLFPASFSTSGRCRSQAIVVVRHPDNLLPPTPSSPPATTPSAPAAAPLTVPPAPPRHRITGGPPTSAPPSPCCSSSSPHHVQTTAALLSSLYCCCFFPSIFCCSALYTLLLPLSPNNTAALLLKLFSNPRICCCSSPNTAASSPSPRCCFFFKSPAAS

SEQ ID NO: 139025 - protein, 200 aa, Triticum aestivum
  unsure (1)..(200): unsure at all Xaa locations
  Clone ID: PAT_TA_33443.pep
MDGTPPPKPEAKLAAGEAGYVLEDVPHVSDYLPDLPTYPNPLQDNTAYSVVKQYFVDPDDTVCQKIVVHKDGPRGNHFRRAGPRQRVYFEPDEVHACIVTCGGLCPGLNTVIREIVCGLSDMYGVTKILGIQGGYRGFYARNTIDLTPKSVNDIHKRGXXPILGSSRGGHDTMKIVDSIQYRGINQVYXIGGDGSQRVQE

SEQ ID NO: 139026 - protein, 237 aa, Triticum aestivum
  Clone ID: PAT_TA_33444.pep
MARRHPAATSAKRRAAPPNPSPTPPAADGSHPLLHAARRGDLRLFKRLVRDLDKGRGRHREVVDAAKEEGLGALHFAAGKGRLRVCRYLVEGLGVDVDAVDDAGRTPLLVALLRGIMDTASYLLDHGADPGKADDEGFAPLHHAATAGDRKMVELLLAKGVSVDPVCVDGTPLYAAAIEGHDEIWQILLENNADCNKKIPGIDTPLLVAITAPSVKCVKLLVEYFVCRLVRMSMTVF

SEQ ID NO: 139027 - protein, 159 aa, Triticum aestivum
  Clone ID: PAT_TA_33445.pep
GRTAVEQAKYVPPTPLPPPYVPPYVPPTPPYTPPYVPPTPPYTPSPPYVPPTPPYTPPYVPPPSPGPGRKTCPIDALKLNACVDVLSGLVHLVIGREARSKCCPLVQGVADLDAALCLCTTIRARVLNINIYLPVALRLLITCGKHPPNGFQCPTVLDA

SEQ ID NO: 139028 - protein, 324 aa, Triticum aestivum
  Clone ID: PAT_TA_33446.pep
PDAPAPWPALPESVPSCLLASPSSCSCRARTGRTATARRDMAAAVVVILDTTTRPTTASRPSTTTGHRRATNAHRATRRRPAPTPPTPPYGAPRRHGHRVSAAQAAPGPPRPTHRLVHSTAARRYGPPTPLPTPYVPAYTPPTPPYTPPYVAAATPHPPTPPYIPPTPPYTPPYVPWATQRTGTNTPPHPRADAVRLRRPARRAGPPGERAGAPEPVRPARAAGGGPAHRPVALHPRPGAPPPGRRRTAPRPPPGPPPAAPSRTTGSAAPPRPPPTPHRRAATPTPAALLCAMGRVAAPSTRRAPPPCGRHVWRCPRRRSSPPP

SEQ ID NO: 139029 - protein, 244 aa, Triticum aestivum
  Clone ID: PAT_TA_33447.pep
NGPGKEFILIDGEYVHRNDPNLSPREGDWICQNPRCGNLNFARRSHCNNCNKHRYESSRSPHRVPARPLGPPCDRAPPREMARYKPAPRDWGVGDPRSYPARSPPERVGRFPDPLQRERGFRGERELRDPVKFEWSAAEYKQRERPHGGLYLDRSRSPQGSWGSDMRDRSRSPAGNRPMKGAFLGRGRPDLEYAGSYVGRGRLDAGRGRGRGRGRVYRPGGDPYPGEGRDDRRAALHGRDDGRY

SEQ ID NO: 139030 - protein, 213 aa, Triticum aestivum
  Clone ID: PAT_TA_33448.pep
MVAPNVKAETMRLMDRRSALEAEMDAIIAALSAPGGAGITGSLVDAEGFPRADIDIPAVLAQRRKLGELRNDHKDVTNKIEKNLEVLHSTKLTRNEQSIPRSSGISAPLHGGLSQNDPMEEDLVTRLPFAMIDDIADGSPAALDGLLLGDEIVKFGSVEAGGRLQERLVSEALSSEDNQVSLLIIRQGSPMNLTITPRKWHGRGLMGCHFRIL

SEQ ID NO: 139031 - protein, 242 aa, Triticum aestivum
  unsure (1)..(242): unsure at all Xaa locations
  Clone ID: PAT_TA_33449.pep
VSISDDAGQHSGRGADYNYEGLIPSSPSEFDIRWPADELDPITLNYTSGTTSRPXGVVYNHRGAYLNTIGTVLAYDITPMPTYLWTVPMFHCNGWHLPWGVAMQGGTNVCLRHFTAAVIFDTIERHGVTHMGGAPTVLNMIVNAPAADRRPLPGTVRVMTGGAPPPPRVLAWMEELGFAVYHIYGLTETYGPATVCTWMPEWDALPGEERARLKARQGFQHIAMEEADVKDPATMESVPRDG

SEQ ID NO: 139032 - protein, 212 aa, Triticum aestivum
  Clone ID: PAT_TA_33450.pep
SSSIEYLGGYSLNTLIIDDESSKFINSLDDLSSPPKFLVALELSGKMVQLPSWITQLSALTKLTLSVTALRTDNLLLLSNLDALFSLTFSFRAEKQDSETLTILAENKLSSDGEITIPDAGFKSLRLLRFERPPGQVLTFSKNAMPELERLELRFSMLEGLYGVENLAGIKVVHLTLKDKDGEYMTKEVQHEVETAVKRRTDGKAPKIILDQ

SEQ ID NO: 139033 - protein, 159 aa, Triticum aestivum
  Clone ID: PAT_TA_33451.pep
NLKRATNYSPFLFGSIELQSLTESSPSPLSRVHSLPGLRPLSDRRAQPRRCRRLLLRCAALLPERFCSPLPFQNGFCSARAQSLSSYSCGTCACAPVSSAPHRSSSSMLEDLLVAANGTAGARSCGSGGLARVGGGGGRRGRRHRGHPLSSPPYAGVPS

SEQ ID NO: 139034 - protein, 181 aa, Triticum aestivum
  Clone ID: PAT_TA_33452.pep
MGRKRAVLVGINYAGTKAELKGCHNDVARMRRCLVDRFGFEDAGIRVLSDADRAAPQQQPTGANIRRELARLVADARPGDSLFFHYSGHGTRLPAETGQDDDTGFDECIVPSDMNLITDQDFTELVQKVPDGCLFTIVSDSCHSGGLLDKAKEQIGHSTKQNKAQQGKREERSDSGSGGFR

SEQ ID NO: 139035 - protein, 112 aa, Triticum aestivum
  Clone ID: PAT_TA_33453.pep
RFGCVPLAHVQDACDAHLFLADAPAAEGRYLCAGGSHTAAHIARLLASHYSPFNPEKRFGDDLDGASPASQVSSKRLLDLGFRFGHDAGDILRDAVAQCVDHGFLEPPGGCD

SEQ ID NO: 139036 - protein, 233 aa, Triticum aestivum
  Clone ID: PAT_TA_33454.pep
RSTRPRARSSSLLPLLAVAAEAVPPTPTPRSNPAAAAGGAGAPPVPTPTPWPEQFHAVMFTNLTESGGRLQLIDLYYDWPRGRNLNLIRNQLSGDPTYDVEWTNGTSYIFDSASCRTIRFPVGVLPPDWLHGAVYLGRESTDGFDCHLWTKVDFVWYYEDVLTHRPVRWNFFNGMQQHVMSFEVGGVLEDSHWQAPSHCFADDATAAAATGTDAASSLLRLARTTAAAVTSAA

SEQ ID NO: 139037 - protein, 309 aa, Triticum aestivum
  unsure (1)..(309): unsure at all Xaa locations
  Clone ID: PAT_TA_33455.pep
ERERERERERERQRCRARLDRLAAASAGDDAEWEDIRLKRILVDYMLRMSYYDTATKLAETSGIQDLVDIDVFLDAKRVIDSLRNKEIAPALAWCAENKSRLKKSKSKLEFLLRLQEFVELVKAKNFLQAISYARKYLAPWGSTHMKELQRVTATLVFRSSTNCAQYKVLFEQNQWDSLVDQFKQEFYKLYGMTLEPLLNIYLQAGLTALXKTPFCFEGNCPKEDPLSLDGFRKLAEPLPFSKQHHSKLVCHITKELMDTENPPLVLPNGYVYSTKALDEMAKKNGGKIICPRTGEECNYTELVKAYIS

SEQ ID NO: 139038 - protein, 129 aa, Triticum aestivum
  Clone ID: PAT_TA_33456.pep
RFVRGSSFVRGELVAAYGGWSRPRVALSHGRSSRARRPRVVMADGLFSGVAGLAPRTGKASLPVPQGECEAEERRHRGRHPRTSSRSTASPPSSSSSSVTGKQVCDQPATGHAISIPRHWIMAWLMAYA

SEQ ID NO: 139039 - protein, 150 aa, Triticum aestivum
  Clone ID: PAT_TA_33457.pep
HHQLHRPPHRPRRPGRPRRLARCHSRPEARSRLGTLGAGMGDRAANDGPGAGRDDGVHDGVLDDGDGLRIRVRGQAPRRHAALLVRLRPDLRYGHGQMRLHALTASTGATQAACPARPAITPYRSRPPPSRRQSPCMHHDTSDMLYGLID

SEQ ID NO: 139040 - protein, 188 aa, Triticum aestivum
  Clone ID: PAT_TA_33458.pep
TRIACNILEEDPFIFFIPLPKPEFNLPREGDPKPVRDIACYNGVIKFVEMDHLYRREVVSISNRNKRFKMTKDLDSVDKIYDLDILLRPHEDFLEAPKEQLVDIPDGWKIRTCYRHTSWDHWRKGHIIHVDDILANNPNHSVLLPKFWDGCGKSPLRNLTTAHPTLSPNGGDLLYLMSYDQTAWMVGC

SEQ ID NO: 139041 - protein, 39 aa, Triticum aestivum
  Clone ID: PAT_TA_33459.pep
VSQKLRPVPCSIPLKGSYSATEHICRSPVAHVLTIILPL

SEQ ID NO: 139042 - protein, 130 aa, Triticum aestivum
  unsure (1)..(130): unsure at all Xaa locations
  Clone ID: PAT_TA_33460.pep
XIFNKSVAQDPKLASSVLTVFIIALCKXGGFKTALGVMSSLPSNIESSNSHVILLKCLTDVEEIEMASEHIKWIRRYCSSAFQNIMNELVASLSTSASLQPVRKLVCYLHSQGLVNEVGPWMKLIEDDYA

SEQ ID NO: 139043 - protein, 218 aa, Triticum aestivum
  unsure (1)..(218): unsure at all Xaa locations
  Clone ID: PAT_TA_33461.pep
VVLEEKSGLSTHADGTQDGPSWLEEGHGTTACELRSRSRWPSTADRQATFYPFIYTVEVGTQRQRFCMLASNIPGVEQPSFTPSSSTKPHIIGDWLGEGGLHPFAMRRLQLLSTPPEQTPAHRNRSASVFRADAVSRPAVTVARAACHQWRRPTQPPSPWPGRPPSRTAAPHPQRAQRDRSTPDATSPSSIANCRRGYAGKEFGADAAAISSFXVNDG

SEQ ID NO: 139044 - protein, 325 aa, Triticum aestivum
  Clone ID: PAT_TA_33462.pep
MGRTKDELLARLEELKIDFKRYDHPVVLTVEEQAKHVGNFGGALTKNLLLKDKKHRLYIVSALADTKVDMKILSQRLGLGKGGVRMAPEENLCQVLQVPLGCVTPFALFNESASAVSLLLDQGFKSKQSCYFHPLTNDVTIALSSSNLDKFLLSIGKQPAYVDLEASPVVGKDNPPDLADLVPSGAFCSSEESVENPTPKDAPQVNVPKEKTCLPEVKAKPKVQKKGAESSESKVPTNNGANVEIFASDVLEVIFPLFLSEASKKLNIKQEELTQILKLDDFKRRAAPDLESVTNMFKNAAYTAGFHAGFDTMLKSGLGGMPSRK

SEQ ID NO: 139045 - protein, 249 aa, Triticum aestivum
  unsure (1)..(249): unsure at all Xaa locations
  Clone ID: PAT_TA_33463.pep
QYQWQPLCGRSADKPAAPDTHAKKAPADDPTSDGEPVTPTARGGGGIYIVVTLGLGCPVNLPVFSAGIAAQLARYPRFCSIQVTDESNGGNPRWVRTVVNVDDHTIVPTLDPVAVAADPDGAVEDYLASLPALPMDRSRPLWEFHFLDFPTSEATCTAVIRVHHSLGDGTTLIALLLASARSAADPTRLPAMPEQPARTGAIYAPRPXVXXGVLPFLAWAWSYLVLAWNTVVDVALFAAXIAFLXDPHT

SEQ ID NO: 139046 - protein, 116 aa, Triticum aestivum
  unsure (1)..(116): unsure at all Xaa locations
  Clone ID: PAT_TA_33464.pep
XGGXLGTGPPPVRYRQVFPSTQQLAKMRCIQMLLLPIAFLVLSSDVIMEASAGIGIDPISCMSNIIQPSPKPCDNQTCRKACVERIGYGTEGKCVTEGCECTYCTNWPPRQSTNEP

SEQ ID NO: 139047 - protein, 65 aa, Triticum aestivum
  Clone ID: PAT_TA_33465.pep
MGTRVRRWGLATCVASLASSRRSATSRRWRAVAAHASVTRPTSFCPEEGDDCHWASTVLGLPVGC

SEQ ID NO: 139048 - protein, 149 aa, Triticum aestivum
  unsure (1)..(149): unsure at all Xaa locations
  Clone ID: PAT_TA_33466.pep
GQCHPRRGDAPRGCHGSGGGRGGGXGVVRRRGKRADPVRVVPGGRRRRGAERELLPRRAGAAEDGGHAGRTARALQVPGAVRPVIRRAPGPRPAAPGALQARHLHPRQPPHRLRQDTVSGRRGEPMVIVRGWREVMTRSGRRRSSWPAE

SEQ ID NO: 139049 - protein, 159 aa, Triticum aestivum
  unsure (1)..(159): unsure at all Xaa locations
  Clone ID: PAT_TA_33467.pep
MAPSTRRAKCHPPMGLPRGRPPRRGAAPRGCHGSGGGRRSGRPRRRXGVVRGRGERADPVRVVPGGRRRRGAERELLPRRAGAAEDGGHAGRAARALQVPGAVRPVLRRAPGPRPAATRALQARHLHPRQPPHRLRQDTVSDRSAGELMVRRVHAGGVK

SEQ ID NO: 139050 - protein, 57 aa, Triticum aestivum
  unsure (1)..(57): unsure at all Xaa locations
  Clone ID: PAT_TA_33468.pep
GTRLEMRKGFIVLGKDDDFCAXLGLATAVGGTRMEVILPPFIEAAISGFGLDYSELM

SEQ ID NO: 139051 - protein, 80 aa, Triticum aestivum
  Clone ID: PAT_TA_33469.pep
SGLANLFGPPSSWSIVGRVLVSQLCCSMMKITSFLLAGGRDTPVSGLVCRAATSCFLHFCFSGVCLFSLLAPVSYNYSCN

SEQ ID NO: 139052 - protein, 86 aa, Triticum aestivum
  Clone ID: PAT_TA_33470.pep
FKHRSIQDSSRWSFRFQQGWPGGNPGGELPSGWESGGNHHQEQRTGRIEHDGCLEPDRIMRLSGNKGCFELLQFVMLSVIRVPPAN

SEQ ID NO: 139053 - protein, 122 aa, Triticum aestivum
  Clone ID: PAT_TA_33471.pep
HLEGAAGFYKSETGGSSKPESHGTSDCPRGGGGSSSKCTRAAEVHNPSKKWRSRINEKMKALQSLIPNSNKTDKASMLDEAILIEYLKQLQLQVQDNEMLKGQSESMTLQCSCTVPLNITQE

SEQ ID NO: 139054 - protein, 144 aa, Triticum aestivum
  unsure (1)..(144): unsure at all Xaa locations
  Clone ID: PAT_TA_33472.pep
LPLSFRANKKLRGPVSHRGSVETSLSTSTKRFRVAPAARSARRPRCAPPAGPPSXGHSWRGPRGPPGPGRPGRPAPGHLDGPPPAPGGGAPAPXGPPPPPGPNPSKKWRSRINEKMKALQSLIPNSNKVAPQNHLLYHFVFLRP

SEQ ID NO: 139055 - protein, 155 aa, Triticum aestivum
  Clone ID: PAT_TA_33473.pep
LTQASIVNPCLSQHQPSFLESLQPFPPIPLIIRIVLDYRRSFPSSIQRLKAVRRAISNDTLLSATALGSQHPDAKLAHLGVVVAASVGGITACAALEDGALDLGGGISDGGGCGESSNAVDSGKEDGGELHVDGWVGWALGEAKDCLKSGGWMWK

SEQ ID NO: 139056 - protein, 89 aa, Triticum aestivum
  Clone ID: PAT_TA_33474.pep
AAPDGARHDVPGEEGFRAAARAGRRLELSVIEERMAARGDLRQRWRGVCVCSEQMCFQNLLLLIHCPFMLSRCGLYLGRLRCSRPRNAY

SEQ ID NO: 139057 - protein, 94 aa, Triticum aestivum
  Clone ID: PAT_TA_33475.pep
MGPQQDRSASKALANGTAVAPERKDGKVVHYKECQRNHAAGIGGYAVDGCREFMASAPAGAEALLCAACGCHRSFHKREVEAVECDCSSDTSGR

SEQ ID NO: 139058 - protein, 521 aa, Triticum aestivum
  Clone ID: PAT_TA_33476.pep
MGCCRSSLRAVTHPHPEKPPGAGAAPARRPSFSASAHRAAPPPAAAAAASGSSSEAGFAEFSLAELRAATGGFAAENIVSESGDKAPNFVYRGRLQQHGQGPRPAIAVKKFGKMAWPDPKQFAEEARGVGRLRHRRLANLIGYCCDGDERLLVAEFMPNDTLAKHVFHWENQTIEWAMRLRVAYHIAEALDYCSNEGRPLYHDLNAYRVLFDENGDPRLSCFGLMKNSRDGKSYSTNLAYTPPEYLRTGRVTPESVIFSFGTVLLDLLSGKRIPPSHALDMMRGNNIQMLMDSHLEGNYSTEEATALVDLASQCLQYEARDRPHTKKLVNILEPLQTKLEVPSYEMLGIPKHEEEVAPPPAPQPPQHPLSPMAEACSRMDLTAIQQILVSTHYRDDAGSNELSFQEWTQQMRDMLEARKRGDLAFRDKDFKTAIECYTQFVDVGTMVSPTVYARRSLCHLMCDQPDAALRDAMQAQCVYPDWPTAFYMQAVALSKLDMQSDAKDMLSEASQLEEKKQKNSR

SEQ ID NO: 139059 - protein, 561 aa, Triticum aestivum
  unsure (1)..(561): unsure at all Xaa locations
  Clone ID: PAT_TA_33477.pep
MADTPTSRMIHPFSNMQGQNPKQDPGSMYSDNPQHPCXPLAALSSHPRSSHMHHYIPQVPSPHEAGAXCENQVAQKTHSLDPPGAAGCMRDVSPSRHSFTPPPIRSGGGSPSSHHDSHSDSTNGSPVSASCVTVTTEDPNDLKQKLKDLEAEMLGPDAETVNSLEASVAKQLSLEPDXWAQMMDFPRGDLKELLLACARAVEEKNMYAVDVMVPELRKMVSVSGTPLERLGAYMVEGLVARLAHSRHYLYKSLXGAKEPKSSDLLSYMHFLYEACPYFKFGYMSANGAIAEAVKGEDRIHIIDFHIAQGAQWISLLQALAARPGGPPTVRITGLDDSVSAYARGGGLDLVGRRLSHIAGLCKVPFEFHSVAMAGEEVEEGHLGVIPGEALAVNFTLELHHIPDETVSTANHRDRILRLVKSLRPKVLTLVEQESNTNTAPFPQRFAETLEYYTAIFESIDLTLPRDDKERVNMEQHCLAREVVNLIACEGAERVERHEVFGKWKARLTMAGFRPSPLSSLVNATISTLLQSYSENYKLAERDGALYLGWKNKPLVVSSAWH

SEQ ID NO: 139060 - protein, 84 aa, Triticum aestivum
  Clone ID: PAT_TA_33478.pep
KLCKEQKNQTMSSVEEHKKQREVVNLVVQLHVILWSTMQTRTLLCSCVAAATTCYFVEHHAYVRTLLCNCCNCMLFCGTPCIYM

SEQ ID NO: 139061 - protein, 109 aa, Triticum aestivum
  Clone ID: PAT_TA_33479.pep
GTTFITKYKTFLQFFFYYIFFFFATNQQSILLLAIAIITIFRYPAFRMHNLDSQTSKVSIRLRQVLPLQAKVQRTNKTLKVLYIIHFFHCSFVSGAHTPIQNQRQQNQQ

SEQ ID NO: 139062 - protein, 119 aa, Triticum aestivum
  Clone ID: PAT_TA_33480.pep
MVQRLTYRKRHSYATKSNQTRVVKTPGGKLVYQYTKKRASGPKCPVTGKKIQGIPHLRPTEYKRSRLSRNRRTVNRPYGGVLSGPAVRERIIRAFLVEEQKIVKKVLKIQKTKEKTTKS

SEQ ID NO: 139063 - protein, 86 aa, Triticum aestivum
  Clone ID: PAT_TA_33481.pep
QEKWLSSTRATGRRFLGCPLSGPDRCSWFMWIDEAWGPVLSRSLIQLWDQALLDSGRAARLQTKKKEMEQAYLELWTERSNMEIEN

SEQ ID NO: 139064 - protein, 93 aa, Triticum aestivum
  unsure (1)..(93): unsure at all Xaa locations
  Clone ID: PAT_TA_33482.pep
EIKIAITTTLFSTRLVSVASTLTGLSHMHASSPSSIRPPHLGGSVLDIFTMHQVVGRETLIGEDSMRDLYWTVSLSPLFSXLLSYPAPDGHVV

SEQ ID NO: 139065 - protein, 273 aa, Triticum aestivum
  Clone ID: PAT_TA_33483.pep
MNPRVNQEWTPFEVEGARSIIDWLKNNYCNDGTIYGINKKHEIVGTLQAWFPRKTMQQVTDLYVDLAAKMHMLQCLEKEYHGTNSDHGVNYTVDGHAHKNFWLQEAAMQGTDFLFGCPLKSMQTMDTQQEVSMVEQNKVVLENRMRIHQPVLAPCAKGFWTPDEHRLFLHGLSICGRGKWKDISKHFVPSRTSTQISSHAQKYFMRLKSKGSGSQRYRINDAELNDANPWKMKSTINSWQALAFQSTVGADNQNPSFDLQTLSSPFVTMNNIA

SEQ ID NO: 139066 - protein, 202 aa, Triticum aestivum
  Clone ID: PAT_TA_33484.pep
AWSRPRYMRHLVAGDVVSGPLITFSGVEKVGDIVTALRITGHNGFPVVDEPPLTEVPELVGLVIRSHLLVLLKGKMFMKEPVKMSGSFVMERFGAFDFAKAGSGKGLKIEDLHFTDEEMQMYVDLHAIANTSPYTVVETMSLAKAALLFRELGLRHLLVVPKTPYRPPIVGILTRHDFVAEHIHDLFPSLNPHNFHSASMGG

SEQ ID NO: 139067 - protein, 91 aa, Triticum aestivum
  Clone ID: PAT_TA_33485.pep
SPCRRTLRLVFAATTEVSIASARCRRLTCKAHIAPRATSCYSWPLMSKLGSSLTTSLPSLHVLISCTFSICCYILLQVRLIQFDVMLLWQL

SEQ ID NO: 139068 - protein, 220 aa, Triticum aestivum
  Clone ID: PAT_TA_33486.pep
MASQQPSLAILVREPDGFTVWPGPPYPPGSSPPQRLPKTACSATSFSSDGSRLLATVASASATVYDCSSLSVIRSFDLPGLTSAALSPTGSYLQTFQKSSSPQVKNVTVWHVDTATALYQHYQKNLSKANWPMVQFSADESVACRMATNEMQFFDTNDFTKGIVYKVRLPGIAALQLASAPGSHVAGFVPEAKGVPASVQIFSCDKDAQNQVVARRSFFR

SEQ ID NO: 139069 - protein, 166 aa, Triticum aestivum
  Clone ID: PAT_TA_33487.pep
MDLSTEMSLYSKGSSQGIGSEILPISSSPPDSTQSTGRGNGATKEKQDGSIRRRQKVEADTQDDLLSDSIKMIKSFLPRPVSSMRLNTDAGSPDPAARSSGGSFLDGFKSVVRRSPSAPSFADSENNGVSIWSSSKWTFNHESFTRPLLDGLPKPATGRRMKAALD

SEQ ID NO: 139070 - protein, 239 aa, Triticum aestivum
  unsure (1)..(239): unsure at all Xaa locations
  Clone ID: PAT_TA_33488.pep
GKGDKEFLAXIRLEMNYNPEKFKLSQPLMEVLGVEVDTRARVIAALWQYIKAKKLQNPSDPSYFMCDPQLKKVFGEDKMRFAMLSQKISQHLAPPPPINLEHKIKLSGNGANSSACYDVLVDVPFPLQKEMTAFLANTEKHKDIEACDEVISASIKKIHEHRRRRAFFLGFSQSPVEFINALIASQSKDLKLVAGEASRNIERERRADFYNQPWVEDAVIRYLNRKPPGGNDGPGAGGS

SEQ ID NO: 139071 - protein, 163 aa, Triticum aestivum
  Clone ID: PAT_TA_33489.pep
GLPRLFSDDEEVVDGAARLGYLLAVTVFFSSIGPVLSGVAVGAGWQLQVAFVNIGCYYLVGIPVGVLLGFKFKLGALGVWTGMLTGTLLQMAIVLVIIMRTEWEKQALLAAARIKEVGGKNEDQPLATAACREDEQMDTANDETYMQTRERNRELECNEQALV

SEQ ID NO: 139072 - protein, 190 aa, Triticum aestivum
  unsure (1)..(190): unsure at all Xaa locations
  Clone ID: PAT_TA_33490.pep
MAILLCCVTSKALAPHTPVVFRQQRSTGISASARXRQIPIGLTTKSWGINPAXIRRATQIPAVGGRPRRTASARSQSPNTRLFFMGQRGWLVPSFLQHLLNWRFKSTGEIRRSKQQEATIKMVEKVAEAAERIADDVFEVFPGNERLKKAASSVKAVADEIEKDVDKAEALLHKVKPSQLPTIVICYFPV

SEQ ID NO: 139073 - protein, 109 aa, Triticum aestivum
  Clone ID: PAT_TA_33491.pep
LFSNLCNMHNESKLNMQIHESRLNLTFFLLILIHQSSRGFTRCHLTTPSRCCTPCCVPTTSQRRRPSPCTLAARSGHLLMWTTLSQGRSPPCLAATSRCNFCWLHTNSS

SEQ ID NO: 139074 - protein, 195 aa, Triticum aestivum
  unsure (1)..(195): unsure at all Xaa locations
  Clone ID: PAT_TA_33492.pep
MCSKNKSIEKHASEVYTMXVYEQFVQAIRESEPYMVEAVIPNLRYIARRPSGETREKWSRVEYEVNVREDGEAFMCVCKRFEHTGMLCCHAVKVMIHLGVREVPRLHVMPRWTAKPLQCQMHCRGEPRTDTCQQCRRSMLHDQFLYLAHRACEDERCYEVVARGISKLSRELAAEDAVPRRRSTKPASRKPRRKR

SEQ ID NO: 139075 - protein, 131 aa, Triticum aestivum
  Clone ID: PAT_TA_33493.pep
HQKSLLAGLTSTAAADGGASHYDVEEVGAERCEQLKFPAVVEVENHGPMDGKHSVLMFLRWPNATGGRPASQLVGFQSQHLEAGEKASLTFDVSPCEHLSRAREDGKMVIDGASHFLFVDEDDEAEISFDA

SEQ ID NO: 139076 - protein, 346 aa, Triticum aestivum
  unsure (1)..(346): unsure at all Xaa locations
  Clone ID: PAT_TA_33494.pep
GRVGFGPPCEXITPLRGLNGYVKDVRFEPGCIDTACWSAATGKAVAVARSTDHVILFMGTSQAQEEEGRDRTSLLLPGQQQSLIKAVASAAKRPVILVLLTGGPVDVTFAKLNPKIGAIVWXAGYPGQAGGLAIARLLFGDHNPSGRLPVTWYPEEFTKVPMTDMRMRADPATGYPGRSYRFYQGQXVYKFGYGLSYSKFSRQLVVSGNGNKAPNTNLLAGLAATRTADGGASYVVEEIGADGCEQLKTTPTCPAGARCRYSGPRHGKRSVLMFLRWPNATGGRPVSQLIGFRTQHLKAGEKASLRFDVSPCEHFSRAREDGKKVIDGGSHFLRVGQDEHEISFES

SEQ ID NO: 139077 - protein, 213 aa, Triticum aestivum
  Clone ID: PAT_TA_33495.pep
RFHPSVLRSRDPCCVVIFHRVEMHRPRNAWWNRTDGAETRSTLEGQRQFNINLHKAQQRLRTARNNAPNLTKRVLGGFVKTFEYEYDDEAIGNVHNGTMIIAYDDGIEQPHDITVVILEDWANASEIGDAIVAHTEKLSSYGGDLLVQAYFSTFCHNAQRYIVAYEPFVPASIQGIRSEPFFAHDELELSECWRERMRSFIELLHIAAQCNIR

SEQ ID NO: 139078 - protein, 115 aa, Triticum aestivum
  Clone ID: PAT_TA_33496.pep
LLHELYGTMNVDLSPPIAGTKMHMSPPSTARASTNRKSMRVLAPMSHHSALLQTSATSHFSSVRTGTCPSTQTVAVDKLASQPFASIHPVAIPKRHLDLPFLIRQPENQGWSEPF

SEQ ID NO: 139079 - protein, 197 aa, Triticum aestivum
  Clone ID: PAT_TA_33497.pep
MPVAWILVFWRVGLDFWTHYFFTVLGASYTFPSWRMNNVPHTTFLLTHACFLFYHMASNMTLRRLRHSTAHLPQSIRWLFEAAWILALSYFIAYLETLAIANFPYYEFVDRDIMYKVGSLFYAIYFLISFPMFSRIDEKAEKWALSRVAVDALGAAMLVTIILDLWRIFLGPIVPIPESRRCGQPGLAWFHAQNESV

SEQ ID NO: 139080 - protein, 248 aa, Triticum aestivum
  Clone ID: PAT_TA_33498.pep
VQKRAPTPETYLAKIYAHSSIGQLQRAFGTLREFENAYRNFEGIDKELFSPFTSLQPLVVACCKDGFTTLDSVYVQLENLSSADPPYKSVAALNCVILGCANIWDIERAYETFEAMKEKFGLTPDIHSYNALLAAFGKLKKTEEASNVFQHLVSLEDVKPNATTYSLLVDAHLVNRDPKAALAVLDEMVDVGFTPSKETLKKVRRRCSRESDFDSDEKLQSLCKRLNLRMGGEARRELLYNIEYSAEY

SEQ ID NO: 139081 - protein, 150 aa, Triticum aestivum
  unsure (1)..(150): unsure at all Xaa locations
  Clone ID: PAT_TA_33499.pep
FRANNAPVPRRLASIYSEVQTSRIAHTLPLPSVLRSHFTLADEPASTAARSPDEIAKLFSSLHGRXSTAVLPSAEPVATKPLKIGIVLPGGQVPGGXMNRLLCVTDYLQEGAKGSTMYGLRXPAGVMKGNYVELTADFVYPYGNQVCQHN

SEQ ID NO: 139082 - protein, 560 aa, Triticum aestivum
  Clone ID: PAT_TA_33500.pep
MAAAAVASNGGAAPVPGRLASVYSEVQTSRIAHALPLPSVLRSHFTLADGPASTAAGSPDEIAKLFPCLYGQPSAAVVPSAEPVETKPLKIGVVLSGGQAPGGHNVICGIFDYLQERAKGSTMYGFKGGPAGVMKGKYVELTTDFVYPYRNQGGFDMICSGRDKIETPEQFQQAEDTVNRLDLDGLVVIGGDDSNTNACLLGEYFRGRNLKTRVIGCPKTIDGDLKCKEVPTSFGFDTACKIYSEMIGNVMTDARSTGKYYHFVRLMGRAASHITLECALQTHPNVALIGEEVAEKKETLKNVTDYITDVVCKRAELGYNYGVVLIPEGLIDFIPEIQKLIAELNEFNEIFVVDVAEAWKSKLEPASRELFDFLPKTIQEQLLLERDPHGNVQVAKIETEKMLIAMVETELAEIEKRGKYSAHFRGQSHFFGYEGRCGLPTNFDSSYCYALGYGAGALLQFGKTGLISSVGNLAAPVEEWTVGGTALTALMDVERRHGKNKPVIKKAMVELDAAPFKKFASLRDEWASKNRYISPGPIQFSGPGSDASNHTLMLELGAEI

SEQ ID NO: 139083 - protein, 56 aa, Triticum aestivum
  Clone ID: PAT_TA_33501.pep
LLIKLCTHRDGLEVTDDVSIVEYLKHPVYITEGSYTNIKVTTPDDMLLAERLMSDK

SEQ ID NO: 139084 - protein, 303 aa, Triticum aestivum
  unsure (1)..(303): unsure at all Xaa locations
  Clone ID: PAT_TA_33502.pep
MELRLCLHLHLHPHARPASAPTPPPCPAAVLLPASRPVRRLRIGGSCGVAQRRSTRRSHSAICGAEPDGAQGGEAVKERSVSVILLSGGQGKRMGANMPKQYLPLLGVPIALHSLKTFCGMKEVKEVVVVCDPSYKNLFEGSVENLQIPIKFTTPGNRXQDSVFNGLQEIDGESELVCVHDSARPLVSSEDVKKVLEDAAVHGAAVLGVPVKATIKEANSDSFVVKTLDRKTLWEMQTPQVMKPNLLKDGFELVKRDGLEVTDDVSIVEYLKHPVYITEGSYTNIKVTTPDDMLLAERLMNDK

SEQ ID NO: 139085 - protein, 118 aa, Triticum aestivum
  Clone ID: PAT_TA_33503.pep
AVLSEDAQVPKRPTQWLETLPSISHPYSKNLQLLRSSNFLFLISHHLWIWIGRPIINPIIRHVYDGVANTHKMLESSSDLYEHIVLIMQFLIVVTSMVYQVLNQLNNIEIAISCTIVS

SEQ ID NO: 139086 - protein, 374 aa, Triticum aestivum
  unsure (1)..(374): unsure at all Xaa locations
  Clone ID: PAT_TA_33504.pep
MRIQELPGDCDGGGGGGGAGELQLRREDGGADGSELKLRGEDGVVAAAGEEXGEGAGTMRASAALGAKRAAVGVGARMLFYPTLVYNVVRNQCESHFHWWDQVDEHVLLGAVPFPSDVLRLQKLGVCGVVTLNESYERLVSKSLYEAHGIENLVLPTRDYLYAPSFDNLCKAADFIHRNASCGKLTYVHCKAGRGRSTTVVLCYLVQYKQMTPAGAFEHVRSCRPRVLLASAQWKAVQEFYQLRVKKIHGSSCIDSPIVKKVPSPSPVLLATRNLITFDEKTFVMVSESDLEGYNADALAVNVGSGLWEISLVYRVQFASQAAFAGFSYLWLQCRAHKDTEALTESIGSESCSLEAEQPANGHHCLLQGVVVNP

SEQ ID NO: 139087 - protein, 110 aa, Triticum aestivum
  Clone ID: PAT_TA_33505.pep
EASAASMTCWVISIIFNPSASCFSNSMRFLVSLRAQAIYFLPNPSHLVFRIDLRAQAIDCRSPMGHEPRTRRRRQRPDGTHKVGRRRRPETQGRHLSNKRAQRHQVRHGH

SEQ ID NO: 139088 - protein, 76 aa, Triticum aestivum
  Clone ID: PAT_TA_33506.pep
FFCLCSKQLSCKHSLDFPYSNGRAPAGFVIFFYEAGSAKQETCRLSWHETQLQLNNSCNIVLIFQSSKKRPQYVHQ

SEQ ID NO: 139089 - protein, 131 aa, Triticum aestivum
  Clone ID: PAT_TA_33507.pep
PVATRPWRAFMTHSGWGSTLESVAAGVPMVAWPFTTEQFLNEKLIVNVLGIGVSVGVTKPTEGVLTGGSGGAKVEVGMEQVKSALEKLMDGGAEGEDRIRKVQELKAKAKAALENGGSSCMNLDKLVQSVV

SEQ ID NO: 139090 - protein, 57 aa, Triticum aestivum
  Clone ID: PAT_TA_33508.pep
NTWRRSGFTCVHLFQTSPEVFHTRCAFHLSTLYVVPIKEVIYFWCNAIPPPPKRDGK

SEQ ID NO: 139091 - protein, 343 aa, Triticum aestivum
  Clone ID: PAT_TA_33509.pep
MSPQPTLATTTTPATGPNPSYYQTAPVSQESIQRTEVLLHLYAYQHTQGKPNANQTVIVDPKLPACFGALAANDWTIYDGTCTNANLVAHAQGLHIGAGMTKENWFICFNMVFVDRRFMGSSFKVMGDFRGNEGEWAIVGGTGEFAYAQGVITFNKTWSAQANVRELHVRALCLSFSKAPETPCSRTPRQSSVTKIGPWGKISGEFLDVPTTPQRLECVTIRHGVVIDSLAFSFVDQAGGQHNVGPWGGPCGDNKDTIKLGPSEIVTEVSGTIGVFGAANVEYNAITSLTITTNVRTYGPFGEPQCTRFSVPVQDKSSIVGFFVCARKYVEALGVYVCPPISN

SEQ ID NO: 139092 - protein, 49 aa, Triticum aestivum
  Clone ID: PAT_TA_33510.pep
ESDKLARYNKKPTITSREIQTSVRLVLPGELAKHAVSEGTKAVTKFTSS

SEQ ID NO: 139093 - protein, 61 aa, Triticum aestivum
  Clone ID: PAT_TA_33511.pep
PARTGSTARVDGESAKLARYNKKPTITSREIQTSVRLVLPGELAKHAVSEGTKAVTKFTSS

SEQ ID NO: 139094 - protein, 200 aa, Triticum aestivum
  unsure (1)..(200): unsure at all Xaa locations
  Clone ID: PAT_TA_33512.pep
AVPCSSRPAIPAPTSPPSSTLTSPHHTNTPPPPPDAEPHAPEADKKPAADRKAERGEEGRRXPPGKTPTGEKRXPEGRLAAGQDGGERRPPAREKGGTARRAAKTKKGRGDVQVTTSPTVLKQAHPGLGIYSIVKYIMNSFAKEMFEQLAGETTKMATYHKQXTITSLGLXTSVRLXLPRELAKPAPSAGTPALTKFTSS

SEQ ID NO: 139095 - protein, 157 aa, Triticum aestivum
  Clone ID: PAT_TA_33513.pep
LSTNMSNNFLRHTLMCIQASGKPVHVRLQIQIDKEDIHEGSATAKLEKDQHSKKKQRSPWSSSPLQRSPLDVDLHRRQTHRLRRRRTSTTSNLGGEETPHMKALMSGSRHLLQRAGSETFNHIGPKQFPVRKRYLSSSSSRSGPRATLLHQDSQIYP

SEQ ID NO: 139096 - protein, 180 aa, Triticum aestivum
  Clone ID: PAT_TA_33514.pep
LMPQANSQTTQRMRDRIQTPPLLFVCLFLEKKNACNNIDFILRIFIFSSINLVKVNKVSLWPNLICRLKRNRGSTLLLRKRPALTRQGRSQRASVAQCGRSRCGCALNCGGTHKRASATPATRKGSRGKMDATRSTGPPPSAAPRIPATHCPATLGKDPPRCIGAPKHLKMESRYATRRV

SEQ ID NO: 139097 - protein, 348 aa, Triticum aestivum
  unsure (1)..(348): unsure at all Xaa locations
  Clone ID: PAT_TA_33515.pep
EFFTSGKITFSLYTLSVLALPRATESHHRKGKNGREGPVVDCFRHCTLPPEREPSLSTHPSPPCCKSPSPSGTWRKEWPSPPLFRLEPPPEPPSWVRTPRQPPAPXRAPMVHQARPSAPTTTANHAGPSAPAPAVADDYIVPMTPPPSVFTIPPMDWLLGGPSAPFLGEEEMFPCELAPPPLPPYGFESCPARTGAPPRKPSPTPSDELPEHFIPPGYGPVPDLPSPTPAAAGTGGYPSIPDLNIKIKVEEEEIEDQGSSSTPPRSSPATPPPPPAPPLPLTPPPKARRILRQFAAAMAQNRAALRGAAWAGCPLATGAPGASSAEQGRAAKRGQLASPLKTAGQRES

SEQ ID NO: 139098 - protein, 170 aa, Triticum aestivum
  Clone ID: PAT_TA_33516.pep
ALCTGSFHSHISLLPHNFLATKSAGAPPTLFFAECRNDGTQTQEMGWCCPVDVPSPGTEQVRCLYCEYAGSRVVHPAQGSFVGRGVELEKMWGGEELYSEEYTNDCIIACSREPTYWVDYLEDDCIYRSYRLDGSDEGEKMILKKGIPDAEEMKYLIEKGFLIIEDDGLS

SEQ ID NO: 139099 - protein, 377 aa, Triticum aestivum
  Clone ID: PAT_TA_33517.pep
MDTSGGGIHAAGGAAQIQGMATHGGRYVLYNVYGNLFEVASKYAPPIRPIGRGAYGIVCAAVSSDTGEEVAIKKIGNAFDNHIDAKRTLREIKLLRHMDHENILAIKDLIRPPRRDDFKDVYIVTELMDTELHQIIRSNQSLTDDYCQYFLYQLLRGLKYVHSANVLHRDLKPSNLFLNANCDLKIADFGLARTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAPFSFDFEQPSFTEEHMKELIWRETLAFNPDPPY

SEQ ID NO: 139100 - protein, 293 aa, Triticum aestivum
  unsure (1)..(293): unsure at all Xaa locations
  Clone ID: PAT_TA_33518.pep
GPTKXIDWDTLIDTVCSQAEDVPEIDWCEPGEAAAMEALLGTKDGFLTERIKSYDSDRNYPTKPTALSGLSPYLHFGHISAQRCALEAKKRRHLSPKSVDAFLEELIIRRELADNFCYYQPHYDSVAGAWEWARKTLKDHAADKREHIYTREQLENAKTADPLWNASQLEMVHHGKMHGFMRMYWAKKILEWTSGPEEALSIAIYLNDKYHIDGRDPNGYVGCMWSICGLHDQGWKERLVFGKIRYMNYAGCKRKFNVDAYISYVKRLVAQPKKRKPEESLNSAAKYSKSEKD

SEQ ID NO: 139101 - protein, 210 aa, Triticum aestivum
  Clone ID: PAT_TA_33519.pep
MALPRHGERRRQARSMALWSTEKKTAAEVVAALELHRHPHGGFYLETFRDPSLTLPKSALPPQYKVDRAVSSAIYFLLPAGEIARLHRIPCAEAWHYYMGEPLTVFEVHDDGQVKMTVVGPDLRKGQRPQYTVPPYVWFGAFLTHDIESFTDDGSVFVKTPGRDPDLHYSFVGVTCAPAYQFEDDEMATRDGMKALAPNAEAFINYLVPA

SEQ ID NO: 139102 - protein, 453 aa, Triticum aestivum
  unsure (1)..(453): unsure at all Xaa locations
  Clone ID: PAT_TA_33520.pep
PAGGTSTISPPSSLPPSPTPPAKLPRLLLHCAAPPSLPRPAPTLRPAPRPDPDLGICAGAVLAIFIPASAAAAAAKAAAAKEARTAAARKQAPAEQGDGPARFGAGPGGKKADEEGRSRQADFPRLAIRRLQRRLDAVVGRTVPPPPRPSRWVXRSAAAGRGPAPPGTMPAXAVQQAGPAVKRVKRVRKKGYRGIRRRTWGKXAGDLRNRCKGVAGCLGTYDTAEEAARAYDAEARKIRGKKAKVXFPEDAPTVQKSTLKPTAAKSAKLAPPPKACEDEPFNHLSRGDNDLFAMFAFNDKKVPAKPAESVDSLLPVKPLVPTETFGMNMLSDQSSNSFGSTDFGWDDEVMTPDYTSVFVPNAAAMPAYGEPAYLQGGAPKRMRNNFGVAVLPQGNVAQDIPAFDHEMKYSLPYVESSSDGSMDSLLLNGAMQDGASSGDLWSLDELFMAAGGY

SEQ ID NO: 139103 - protein, 73 aa, Triticum aestivum
  Clone ID: PAT_TA_33521.pep
ISACTPYIISLCSIPMHVVIVHNGNEHVDKKRRALGGNKISCRHHSMMGANAAPLPAFQIVIKRNITVQPVDP

SEQ ID NO: 139104 - protein, 147 aa, Triticum aestivum
  Clone ID: PAT_TA_33522.pep
RGRGRGTWFGVRGLVAAGRTYVNSLAIRKACEFLLSKELLPSGGWGESYLSSQDKVYTNLEGNRAHAVNTSWAMLALIDAGQGQRDPACLHRAAKILMNFQSEDGEFPQQDIIGATNHNLMLTYAQFRNIFPIWALGEYLPGRLLVA

SEQ ID NO: 139105 - protein, 85 aa, Triticum aestivum
  unsure (1)..(85): unsure at all Xaa locations
  Clone ID: PAT_TA_33523.pep
GDSQLVVRQVNKDYQSPLMEAYVKEVTRLEEHFDGLQIEHIPHAENSIADHLSKCAEXKPPVELGTFVIHLTQPSISPKTMARKR

SEQ ID NO: 139106 - protein, 289 aa, Triticum aestivum
  unsure (1)..(289): unsure at all Xaa locations
  Clone ID: PAT_TA_33524.pep
XKASAIAKFVSANKIPLITTLTQETAPAIFDNPIKKQILLFAVAKESSKFLPIIKETAXSFKGKLLFVFVERDNEEVGAGVAGRPGIAGQETTVLAYTGNEDAKKFFFSGEISLDTIKEFAQDFLEDKLTPSYKSDPVPESNDEDVKVVVGKSLDQIVLDESKDVLLEVYAPWCGHCQSLEPIYNKLAKYLRGIDSLVIAKMDGTNNEHPRAKPDGFPTILFYPAGKKSFEPITFEGDRTVVEMYKFLKKHAAIPFKLKRPDSSAARTDGSGSTTEGEKSSGSNPKDEL

SEQ ID NO: 139107 - protein, 263 aa, Triticum aestivum
  Clone ID: PAT_TA_33525.pep
RRGGASPGRFGGHGGRGDSPGFGGRGRGDSSGFGGRGRGDFSGGRGGRGRGFGGRGCSDRGPHDRFISDGRGRYDGRRGFDKGRGRSYSRSPDRSRSRGYDRRSDSRSLSSRSRSRSRSWSRSRSRSRSWSRSRSRSRSRSRSRDQGPVERRPRVRSGFDVLPPATEAGAAVTGPLPVPLPGSVSDVAAPIPRQSLADASDMSPMSPGGLVHVQEGAPFMGGNDANISSRQADQPSQATDLTIPPSFSAAANFPGPAVQQDAP

SEQ ID NO: 139108 - protein, 290 aa, Triticum aestivum
  Clone ID: PAT_TA_33526.pep
MAAPRPTVLVTGAGGRTDTLSLLPSPPVSPTKPRRARAARRATAVVTGAGGRAGQIVFSKLRERSDQFAARGLVRSEESKQKIGGADDVYVADIREAEHLAPAVQGADALVILTSASPKMKPGFDPTKGGRPEFYYEDGAYPEQVDWIGQKNQIDAAKAAGVKHIVLVGSMGGTNPNHPLNSLGNGNILVWKRKSEQYLADSGVPYTIIRPGGLQDKDRGVRELIVGKDDELLQTDTKAIPRADVAEVCVQALQYEEVKFKAFDLASKPEGEGTPTKDFKALFSQVTARF

SEQ ID NO: 139109 - protein, 438 aa, Triticum aestivum
  Clone ID: PAT_TA_33527.pep
MAAPNNDPAAASASASTSDAALAAPEDTSIEALARRVQEHMTLANNPTARRHKFWETQPVGQFGDVADVSLPDGAIEPPSPLSEVRADPYPLPAAFEWFTCDLDDDALLADLYALLAHNYVEDDENMFRFNYSPAFLRWALRPPSFFRAWHIGVRAKESKKLVAFISGVPARIRARDDVVRMAEINFLCVHKKLRSKRLAPVLIREVTRRVHLENIWQAAYTAGVVLPTPITTCRYWHRSLNPKKLIDVGFSRLGPRMTMSRTVRLYKLPDAPLTPGFRQMELRDVAAVTRLLRAYLARYVVAPDFDELDVEHWLLPQEDVVDSYLVESPETHEVTDFCSFYTLPSSVLNNANYSTLKAAYSYYNVAVKTPLQQLMNDALIVAKQKNYDVFNALDVMENEGFLKELKFGPGDGQLHYYLYNYRIRNGIKPSELGLVLL

SEQ ID NO: 139110 - protein, 145 aa, Triticum aestivum
  Clone ID: PAT_TA_33528.pep
RKSRNRPELAIRRRRLPQHKHRHPSKRRGHQAPKAAGDAKLLIQSLTKAYAATPTNLKIIDLYVVFAVATALVQVVYMGIVGSFPFNSFLSGVLSCIGTAVLGVCLRIQVNKDNKEFKDLPPERAFADFVLCNLVLHLVIMNFLG

SEQ ID NO: 139111 - protein, 100 aa, Triticum aestivum
  unsure (1)..(100): unsure at all Xaa locations
  Clone ID: PAT_TA_33529.pep
MGIKWPGQCGAAASLALLLVLLVAAPPRGCVAAAGSGGGGLTRGSFPXGFVFGTASAAYQYEGAVKVDGRGQTIWDTFAHTFGMYFTSPVLLLYSYKRLS

SEQ ID NO: 139112 - protein, 192 aa, Triticum aestivum
  Clone ID: PAT_TA_33530.pep
MAGPGEKPSSTSANGNGTKAPLPPAAPGGSGIAKRLPRLAFVFLLALLYRQLQAPPPKICGSPDGPPVTGTRIRLSDGRHLAYHESGVPKEHANHKIIFVHGFDSCRYDALRVSPELAQELGIYILSFDRPGYGESDPHPARTEKSIALDIAELADSLHLGSRFYLVGFSMGGEIMWSCLKHIPHRLAGVSI

SEQ ID NO: 139113 - protein, 167 aa, Triticum aestivum
  Clone ID: PAT_TA_33531.pep
MPRITSVESPGCPPLRAITTDILGLIKVVEARTRPAGVAKVVETWGEPDASRAILVASLADRAVDPVLAVARKNGVVELLNPLNGDALAAFKFSRTDQTVGAVENDPLVALHLFRKHAPDLTTLGTFLACTEKGKASVRSVAKEDTASDSDVGPSSTWDVCNEYMAF

SEQ ID NO: 139114 - protein, 94 aa, Triticum aestivum
  Clone ID: PAT_TA_33532.pep
MPGSQADEIDWENLSNKELHDKFQQMMTEQVQDVLNNFEEAMEKITGLEKTFETKLDNRFNELLARLPPPAPAAPNAPLLQQQQRLPPRRRRNP

SEQ ID NO: 139115 - protein, 242 aa, Triticum aestivum
  Clone ID: PAT_TA_33533.pep
MGAAVGGGQGGEEEETRQAKEMAAARRRWETLIREQKIKTLTPREAGYTFKLTDKVLLDVRPSNERQKAWVKGSTWIPVFDVDTSSDLNGLSKKAFNFMIGGWWSGSSTMSFNKNFVQQTEEKFSKDADIILVCQKGLRSIAAAEQLYNAGFKILFWVQGGLEAAEEEDFEREGSQPFKLAGIGGVSEFFGWTDQQRAQAAKEGWGYRLLFTGRLVGAIVLADALFVGAQSIGPLLQQLQPH

SEQ ID NO: 139116 - protein, 275 aa, Triticum aestivum
  unsure (1)..(275): unsure at all Xaa locations
  Clone ID: PAT_TA_33534.pep
IYQXKHFAGTSYGQLICGRAGYCLVVDVFSGAVVSPPRLPFSGDFEFGREFYFSGTLTAPIASPNSHLLVSTAISLFDWPVGSDSWSELQLSDESIEQIVEFNGQFIAMDDCYKIYALQLPPQLGLQEITTEWVGHLPPSSYTKPWLVVCGDMLLMVSCFWTVSSGSSVLQCIPHHLDMXTNPAKWVEVNQLDNWALFVGGDMRSRPFSCMSPERWGGRSKWLYYAGPSSFIVHGVGDERAPSAGPKVEYWRSRPMSRKLQPLWVYPSMFYTDAQ

SEQ ID NO: 139117 - protein, 157 aa, Triticum aestivum
  Clone ID: PAT_TA_33535.pep
PTPPNCLPHQSAKQGDRIIYRSAGEEHSNCRKKEQRGRNGIPRDETDEEGRPQRTDQRRQLQQDRDRSSVPLRPASAQLQYDPQQPPPPPTAPPTQSHKRHPRRPNPTSSKSGRGGAAGTLAPEAPNAAQHAADHPSPSPCRTSLRPSMDTRPAKKS

SEQ ID NO: 139118 - protein, 219 aa, Triticum aestivum
  Clone ID: PAT_TA_33536.pep
MGAEAECDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATGGAAWEEASDSGDSPRPCKRASPGPESPTGSDRSELSHGSGQVFRPVPRPGGFDAISADVRPPPPRQDEDPITSLSLSLPGLEHGFHHDSARSHFQELSPSPR

SEQ ID NO: 139119 - protein, 207 aa, Triticum aestivum
  Clone ID: PAT_TA_33537.pep
MRRFLTDRARRAVAASLRGATRPAAPSPAPAAALSRPSPSAPSAMAAYMARAMSTSAAGTPPVSLDTINPKVLEFKYAVRGEIVTHAQNLEQELHKNPESLPFDEILYCNIGNPHSLGQQPVTFFREVLSLCDHPALLDKSETHALYSSDAIERAWQILEKIPGRATGAYSHSQGVKGLRDEIAAGIAARDGFHASGDNIFLTDGAS

SEQ ID NO: 139120 - protein, 168 aa, Triticum aestivum
  Clone ID: PAT_TA_33538.pep
MAAGTAWAGCHLAHLPQIPISVSIPVTGAAASSRRRRCGLAAAAGAAAAAATDGRVLGRRPVEDVYKVRVVRGAAAQERVEALRAMETWSTWRTGGRCHLAWDWQVDQLVYIVAGEVRVLPAGATTGEEYMHFVAGDLVRYPKWLEADLHFDGPYEERYRFLAYGDDN

SEQ ID NO: 139121 - protein, 110 aa, Triticum aestivum
  unsure (1)..(110): unsure at all Xaa locations
  Clone ID: PAT_TA_33539.pep
KLPELLDFDKDLIHLEAASKIQLKLLXEEMQAINKLWTCISDEISCAISVMILLRLLPQALKSFLDSAEAVVRSLISLYSEVEWSILXISQYFGEDPARCPFEQGFVWPL

SEQ ID NO: 139122 - protein, 148 aa, Triticum aestivum
  Clone ID: PAT_TA_33540.pep
CSTESIMLPPHKHLTKQHHKFSVHRAPLFVLEGVPLLHQIRHLLSQTIVISGMECSFPEAGVWNGGSYHVLDVLHSPLVIIEGVLRSSMAWTPMEEAAHTSLRLDGLHGVRSGSGVSEQQHCQVSINLKNNLPWRPGKKQSLLVCLRA

SEQ ID NO: 139123 - protein, 141 aa, Triticum aestivum
  unsure (1)..(141): unsure at all Xaa locations
  Clone ID: PAT_TA_33541.pep
RTRTSVKKTRSTRKTVIRGPPPAGCIRAHLPRQRRRLRLGQCQRGEAGWRCVFSSLSSFSLSQDFLKEIKMCAHICVFSTNLGISINAKQSNMLQQKKKKRFLQACLSTNXETHXKMQEQSIFYMAIEPWXWYSPILRLES

SEQ ID NO: 139124 - protein, 432 aa, Triticum aestivum
  Clone ID: PAT_TA_33542.pep
YHIGAASIARSLASYFIQFLELIPSVKGNVPSWIGHGEEFFGGVISVNILAPILLVILTVILCRGVKESSAVNTFMTTLKIIIVIVVVFAGVFEVDVSNWSPFMPNGFKAVVTGSTVVFFAYVGFDAVANSAEEAKNPQRDLPIGILGSLLACVILYVAVCLVITGMLPYTLLGEDAPLAEAFSAKGLKFVTVLISIGAVAGLTTTLLVGLYVQSRLYLGLGRDGLLPSIFSKVHPTLHTPLHSQIWVGCVAAVLAGLFNVHALSHILSVGTLTGYSVVSACVITLRWSDKATNSRSLGKISIWQEGVFCLVIVALCGFIAGISYRFSYSIAFIIIAFLIATAGSFSLLFRQVYVPVDPPRFSCPGVPMVPIVSVFFNMFLFAQLHEEAWYRFVILSFIAVGVYAGYGQYNAVPSTSDHSSVAYHGVPSEAP

SEQ ID NO: 139125 - protein, 119 aa, Triticum aestivum
  unsure (1)..(119): unsure at all Xaa locations
  Clone ID: PAT_TA_33543.pep
GEVCTVVWQVENAASIKVVAMARHPRAGVCSFGLRSSTMIPXTDKGDEELCSVYVPTNHLYIGDIFLVNSAEIIRPNLSIREGIEIIVSGGMTMPQVITALGPAPDKNEGTRLSRMMTV

SEQ ID NO: 139126 - protein, 83 aa, Triticum aestivum
  Clone ID: PAT_TA_33544.pep
RAVYEVDQQGSRMKQLISMPNSYGYVVFTYLYCVGTSSLIFALLVPSLISSGFLLWSHERTKLNAALFIMKMSNAMTFCSYYM

SEQ ID NO: 139127 - protein, 142 aa, Triticum aestivum
  unsure (1)..(142): unsure at all Xaa locations
  Clone ID: PAT_TA_33545.pep
THSCLLIHPLFFTASGVEILEDERRVLSFRIVGGEHRLANYRSVTTVSEVASTVAGAPAGDPGXSESYVVDVPPGNTSDETRLFVDTIVRCNLPVAGAHGGATRAWPCRTSIDARHALRQTRKVPPAVDRAMRARLGLWNLE

SEQ ID NO: 139128 - protein, 331 aa, Triticum aestivum
  unsure (1)..(331): unsure at all Xaa locations
  Clone ID: PAT_TA_33546.pep
RGTEASDSRVRVVSRSLVKAAGTVTPRILAVSNLDLLPRPIPSLLLCAYRKPSTGCFGDVVAIFKASLPSLLEHFFPLAGRLVYSPRSGVPEVHCDNQGAELVVGEAGVELASLDYGALGASLARIGALVQYGADVVLSVQLVSFACGGFTVAWCSNHVVMDGYGLCMLASMWSELARSGRIDTTRGGGAPSFDRSVLPRPRAAPSYSSSLSGAFTPFEGKHLVHSLTAESXCVTRLYYVEERDIAMLRARASGEGVGERRATRLEAMSAYLWKAMAPPGXPPGSDETCRMGWWVHGRRRLSAPGNEPAMRNYVGNVGTFALAEAAGPPPP

SEQ ID NO: 139129 - protein, 136 aa, Triticum aestivum
  Clone ID: PAT_TA_33547.pep
PTRLDSIQPLGDGIRRRRPRTAAAPAYGGGARVRRQLQAVGRVAAYLGGGFLLLSTASTAAVRSLRFLSDTNQRKFAMQCGACEGKGTYGCRLCRGSATVEWSPLYDPVFVNPCLCPTCDGTRVQRCLNCLGKGYA

SEQ ID NO: 139130 - protein, 158 aa, Triticum aestivum
  unsure (1)..(158): unsure at all Xaa locations
  Clone ID: PAT_TA_33548.pep
QISQDQWAVRVAHHAPWLAYWWNTQKLFPASSVISFNPAIFSREDMAMIPKFASRPCTSQARQQGEHESLHRDMTVGFGKWGWSPLEMEXPFPAGEADVHLWDGRGRDLIVXPLALSRYIAERLAWVRXHELPTAGHRVPVADGMGDVVLSEMLLEEN

SEQ ID NO: 139131 - protein, 60 aa, Triticum aestivum
  Clone ID: PAT_TA_33549.pep
FCFPFLFCFVYYLVILFVSCLFFFFFLKDYFFLLEQSTLYSLGSFFLLTESCDNNQRGVY

SEQ ID NO: 139132 - protein, 230 aa, Triticum aestivum
  Clone ID: PAT_TA_33550.pep
EEFGTRQLEVDLEERAEPDVLSCSTNSDRLKGILNAPRSLGYSEEIEKKLEKYSNTSAAGGGVQSDITEGNAGMHRARGQGVPAERSKAVTVEEQRLESAWLQAVEKHTPGVRPEKYQVVPQTGGGQYHKKSSLATVVPSRNIDKDLSNGLKALKISESHGSQKGQNVGMENGFVISPSLLHSNNELANCDNESVASESGAPGCHGLFPCWKTEKSKRGKAKRQTRLKPS

SEQ ID NO: 139133 - protein, 237 aa, Triticum aestivum
  unsure (1)..(237): unsure at all Xaa locations
  Clone ID: PAT_TA_33551.pep
SAAPSRREEDAAILRAHARLGNRWAAIARLLPGRTDNAVKXHWNSSLGRRAARAPGGGAAWEEASDSGDSPRPCKRASPGPESPTGSDRSELSHGSGQVFRPVPRPGGFDAISADVXXPPPRQDEDPITSLSLSLPGLEHGFHHDSARSHFQELSPSPRSPSPPPAPAPQPSSSYPFSGDLVAAMQEMIRAEVCKYMSGVGLPAGCGAGAVGEACIPQLVEGVMRAAAERVGVMTRQ

SEQ ID NO: 139134 - protein, 161 aa, Triticum aestivum
  Clone ID: PAT_TA_33552.pep
PINGESSRTTPPSSASLSAEKARGRLHHPVHLHQRREPEDNDAIQCIFISEESTRTTAPSCASSSPNRVNFCSTAWQEKMTGVARDGDFPSCPVGLMDERSIFLRNAILTISMASAAGSKKLLRLWKRRHTVVYANHIEGNDRIPSPGTSFGSAVALVLAY

SEQ ID NO: 139135 - protein, 335 aa, Triticum aestivum
  unsure (1)..(335): unsure at all Xaa locations
  Clone ID: PAT_TA_33553.pep
MRMFSKACSLVVSSLPRCSSSAPAIRGQPSLIPRVSRKWLGKPLMYGIGTLLVMPLRTIHGVGRMFGAARYLCNMTSVSSSLQIELVPCLQDNYAYILHDVDTGTVGVVDPSEAVPIINALEKRNQNLTYILNTHHHYDHTGGNLELKAKYGAKVIGSEKDKDRIPGIDITLSEGDTWMFAGHQVLVMETPGHTSGHVSFYFPGSGAIFTGDTLFSLSCGKLFEGTPEQMNSSLQKXVGSSDCDEVVRGHEYTLSNSRFALSIEPGNEELQEYAASTADLRNKNTPTVPTTIAREKQCNPFLRTSSPEIKKRLSIPDHFDDARVLEVIRRAKDNF

SEQ ID NO: 139136 - protein, 292 aa, Triticum aestivum
  unsure (1)..(292): unsure at all Xaa locations
  Clone ID: PAT_TA_33554.pep
LRENNINLGKVYNIIGIFFGSVEKVPFTKRTLRNICGKISREQAEDELRKTLQVFADIWSSDPGFSYVVLAEKDSKVKNLMWANGSRRMQYRFFGDVVTFDTTYRTNLYDMPLCLFVGVNNHYQSIILAGVLMCDEQEESFEWVFSEFIRMMGGPAPKTILTDQCRAMEVAIKKIHPNTVHRLCKWHVLKRXKETLGWLYTKKCDFQAEFHKVVNHMLTEEEFESAWDALLDKYNLRGHNYMTQIYETRHKWAKPYFRGVFCAKMTSTQRSESANHMLKTDMPPASPMHVFV

SEQ ID NO: 139137 - protein, 160 aa, Triticum aestivum
  Clone ID: PAT_TA_33555.pep
QRASPLYAVAFLRFLYIHYATVRSTTPFEELSKAHMLGQDTALPFEERRRLEGEEEALVPAPAAYGVGGDEVLGDELLRLPTLDLHPHALRLPHLLVCRRGSLLSRPLLPAAGPHLGPEPINQPPQLPHHHHRWILLRIGMIPSLSEQEEADGSSWRKGI

SEQ ID NO: 139138 - protein, 142 aa, Triticum aestivum
  Clone ID: PAT_TA_33556.pep
RLIGAAPTHGHRQALNLLRRGSLPASASTTRPVAASSPQASRDRRPSSCAWGGGSTTRPTCKGRWSIALAVLTVGFSPLSYPTDSSPLLISLALCGKSYDGLGAMEVSALAIRHWACCHLRLIISLLLSWLLRPVGSNPPLG

SEQ ID NO: 139139 - protein, 179 aa, Triticum aestivum
  Clone ID: PAT_TA_33557.pep
TRGHLTGLQPGDSDNERQLRQTTPTSQGQALDMPLNACHSKAAFREQDALARQQLLQVVAAACLPVALLSSLCSVCHRSHSLDFRSEFCFLSLFSSFIRLKGGKKKKKKSLSLGDQANKGRSRVCRGRRRSKQGHGMVWLRTYVFTVDFLPSGGRRRARGGGRCGSGRVAALAWRRRPP

SEQ ID NO: 139140 - protein, 177 aa, Triticum aestivum
  Clone ID: PAT_TA_33558.pep
FSKLNLICIVMYIYFFVTWDPNWSKRQTGYNRLPRPGSIRSEKLYRKMYSNYTALIDEHHENAASLEYDDFKEKVMAWVQSGSKYVFLAHKLSLGSLVVLQAKLTPAAIQFCGKGNERPNSKGLKLREEVLQRLSRCGLVRKAQHADDMMHTLLCNLTGMRRFGRYPGFDQRHGFSM

SEQ ID NO: 139141 - protein, 273 aa, Triticum aestivum
  unsure (1)..(273): unsure at all Xaa locations
  Clone ID: PAT_TA_33559.pep
SSPSLARGGKVGTEVVQASVDQKXTSMKHLVLNLGDPTLRERSLAELSQEVLRIYPALSPPTLTSAASTRVCNVIALFQCIASRPETRSPFIEADIPLYLYPFLHTVDKAQPFEQLRLATLGVIGALVKDENTEATEYVLQCETIPLCLNIMEMGNEPSKTVSTFILLKVLLSEVGLKXCDTRGPFYAIAFALQKRVDSPDERPSARLLKCIIRCYLRLFDHRRGRAVLKTSLPGVLRNGTFNGYLMGDPSAQECLQKLLAAFHRCNGNTIVP

SEQ ID NO: 139142 - protein, 221 aa, Triticum aestivum
  Clone ID: PAT_TA_33560.pep
SPHPLDLSMSLPSSPSLPSAPSVGTGGVLGTEVVQASVDQKMTSMEYLVLNLCDPTLRERSLAELSKEREMFPDLAPLLWYSFGTIAALVQEILRIYPALSPPTLTSAASTRVCNALTLFQCVASRPETRSSFIEADIPLYLYPFLRTVDKAQAFEQLRLATLGVIGALVKDENTKATEYLLKCETIPLCLNIMEIGNEPSKTLSLFNRVESPRKRPWRGC

SEQ ID NO: 139143 - protein, 139 aa, Triticum aestivum
  Clone ID: PAT_TA_33561.pep
KKKKKKRKKKRKKTEEKEAETTGQKQTFDTTVENSGAEPTERDTVDGKQSSKSKKSKRKHNDGAPAVEVSAGDQIVTREDKKRRKEPVVLEASNQTQNTNEGENREIKKRGKESSKASPDFSENASAGGEEAGLGVNND

SEQ ID NO: 139144 - protein, 210 aa, Triticum aestivum
  Clone ID: PAT_TA_33562.pep
PIHRNSRDSRLAHAKVRGKYVFIRPYHDDFLRFCFQNFELGVWSSRMKVNVDDVVDILMKDLRRHLLFCWDASHCTTTKCSTLENQRKPLVLKELKKLWNKEDPDLPWEQGEFSPSNTLLVDDSPYKALCNPPHTAIFPQPYSYHNRTDNSLGPGGDLRVYLENLAAADDVQRYVQEHPFGQPFITESDPNWDFYAKIRDRLEKREKCAA

SEQ ID NO: 139145 - protein, 206 aa, Triticum aestivum
  Clone ID: PAT_TA_33563.pep
GAAAGCAGSGRPLVSAAAMTVPPPGGRRRRSLIRCRLPLGSPGTPCAGRPSLVNPTAASALTGQSASRCCAGSDGCLLATRRRPAKGVARGRQLTTWRRVRWGRWWSKGWRAMKEVLALTVSTIIMAAAACGSAHLPVDQINKKKNDQTSRSRSPPAKSFLRPNSSALSLIPRVPWRPGDGGREAARIGEGSRRRTGEGSLFLLLS

SEQ ID NO: 139146 - protein, 199 aa, Triticum aestivum
  unsure (1)..(199): unsure at all Xaa locations
  Clone ID: PAT_TA_33564.pep
LRRKLQHPPLQHQHCSVGPLMLHCRRRVPRCSTGSAASSTRRRRRSSIAAWEALHRSTGSRRRAQRCSTRNHHESAASEHWELQASTAMKHREPSRECCIGAWGAVGERFIAAPAPARLHRSASTPTRLHCSTVAVVERRVTSPAAPMSGKKLGGASIGSFVATPVGHASKPPLIRGSEGWWSSLGASXHGGREEQKRG

SEQ ID NO: 139147 - protein, 113 aa, Triticum aestivum
  Clone ID: PAT_TA_33565.pep
EELRCGSTFHSNDRNLNRVECWGPLRDARRVTGGWGRARDAPAASHGRRRTDHGKGRKRAREYARASGRGGAPGSATAASRPSASSPGRRSTKWPPTPARRRRSDMARTYYVD

SEQ ID NO: 139148 - protein, 93 aa, Triticum aestivum
  Clone ID: PAT_TA_33566.pep
VLLAHKTYIYKLVGCKSRPFSFGSEPRKHSLHGDPRSNPLPLPNLHTPMIFGSQMPCSPTVSTQSTQHINSSTRSSSSTHVPNSLQRPVDAGC

SEQ ID NO: 139149 - protein, 187 aa, Triticum aestivum
  Clone ID: PAT_TA_33567.pep
MDFFIPPFMEIIDAELQIGPPGSGGGGDSQKKRSSSTAALAVTSEASGTDDHDAAPASKDQAVGWPPVGAYRKSTFQSASASAAKESKGPGEAGKRGRLYVKVSMDGAPYLRKVDLRTYGGYGELRAALDALFGCFSSCSGPSPDNGQFAMAYEDKDGDLMLAGDVPWDMFISSCKRLRIMRSSEAR

SEQ ID NO: 139150 - protein, 97 aa, Triticum aestivum
  Clone ID: PAT_TA_33568.pep
HTGSNNKVSHSQIHTIAKTKTKGLFGMVIHRLHESGGALIPLLQNFELQPAPFRGKAVERRGSKQALKFKFSQTLGGLLHALFLWPVTHILSSAEIS

SEQ ID NO: 139151 - protein, 60 aa, Triticum aestivum
  Clone ID: PAT_TA_33569.pep
TCPFGTSCFYKHAYRDGRLEEVVLRHLDCDDGSTLCQTSSAGCGFPGRLHIYRIIPKTSV

SEQ ID NO: 139152 - protein, 304 aa, Triticum aestivum
  Clone ID: PAT_TA_33570.pep
YSPGPQSLESLHLNGATSAPRLAEDDENSVASDLHCFELNMHGDAVQTHDLAGTRRTVADCMYSPMRRLEFSDGVSVEGSRISTARPRSEKGKVKPGSSKAQLHTSAPEISSRNCDRIDPIDVQNETVMTQVSRRLHDDLLKIKSEAPQHAFLERKPHDHHPRTYQFRECASSSDLLHNLHSPARQLKNHQRASLDYQISECATAGDVRGLRSPSWQLKNQRASLDYQISECATTGDLHNLCSPSRQLKNHHRPSLDHEISESSPARSLGSKDNTLKAKLLQARLEGQHARIWASGYPLISTRR

SEQ ID NO: 139153 - protein, 212 aa, Triticum aestivum
  Clone ID: PAT_TA_33571.pep
IAIAVVFLAEQILSIPVAAAACFLSPGSPPIPGPPLSQGHPPVACANPAPCRWRGPHQLASSEGVLLQIVVPLPRPRQLQRVLLQIEVLLAGGGTASDWQPQVQIAAPSHAAPGTAADSLPTWSRSPPGGLEVGSNSNSSKQAASPARHNNLEESVPMKMISMISTCTRALILVKMTSTCTMALMPTKMQSVSFLIFPIKMMSLSTQILNVK

SEQ ID NO: 139154 - protein, 200 aa, Triticum aestivum
  unsure (1)..(200): unsure at all Xaa locations
  Clone ID: PAT_TA_33572.pep
VPTHEATTPPAPPRTPISSPVLPLLSSLHLPDRAVAPRRPAPSSLLLPAPPPSCHWPQGNARPPVRRPEQPNADPSARPSPNRCTPRPXPSARPSAVAPNILRLPPSGPPSRPSAAAPSILLPPPHTTAPPVAHPSPSTLRAPRPLVVLSASRAPPSEQPGAPPRELRRSSTAHPRPPSLPRRGVGASQLPSAARPERHG

SEQ ID NO: 139155 - protein, 290 aa, Triticum aestivum
  unsure (1)..(290): unsure at all Xaa locations
  Clone ID: PAT_TA_33573.pep
EQLLGSRSIASALPRFNWSRRGGTGSSFPVGMVPRDMVNAPAERLHDQGSVVNRKCEKVPKKIHKSEREKRKRGTQNDLFNELGAMLEPDRQNNGKACVLGDTTRILKDLVSQVESLRKENSTLKNESHYVVLERNELRDDNSMLRNEILELQNKLIMRLQSNPIWSQDTTTRSAVAVPYPTSGVFPVQHSPHSPVITSTALSLHPVITEQCYAAPPRELQLFPVXSSSSTAGAHPAQDQWISNSVTRPQARYPTPAAMSPVNEFPIPSKDGRGATMQEWPREGGTSEEV

SEQ ID NO: 139156 - protein, 163 aa, Triticum aestivum
  Clone ID: PAT_TA_33574.pep
MLKKDPKPLICQLNRIFFLNEVVKRRGGVNDLGKDIWVDPSVELRFPFEPKKDISCCLQLTNKAASSYIAFTINIDVNKYCAQPSKGILAPCSKCYITITLRPQEEAPLNMQCVDVLVMQGIRVSEHFTSDEITQDIHANAGVVDEVILPIAYIALDNQPLSQ

SEQ ID NO: 139157 - protein, 136 aa, Triticum aestivum
  Clone ID: PAT_TA_33575.pep
AAAATPWSGRAPCRTTTSSRRRRIQAAGVITSLATPCKEEVMPRVPVEWTAACRRSSCRRRRWRPTTSGASRSSGQRCRRRSTATTDCDGCCCAVCRLYRYPHRCVSELDSFARTKRAGFAKISTEISLEFVSSQS

SEQ ID NO: 139158 - protein, 70 aa, Triticum aestivum
  Clone ID: PAT_TA_33576.pep
FKLEKTLVGHQRWVWDCVFSVDGAYLITASSDTTARLWTMSTGEANMVYQGHHKATVCCALHDGAESAPS

SEQ ID NO: 139159 - protein, 143 aa, Triticum aestivum
  Clone ID: PAT_TA_33577.pep
GKAAEERQHFKSVIMCALILILGLLVQGQIQVAEGKSCCRDTRSRNCYNVCLLVHPSTPCSKMCGCVLTRDSTCPREYPKLNLLPGSAEPDAVEYCKLGCRLSVCDNVNSAELRKDMKVGVERCGDACGRFCNDATNIASVDA

SEQ ID NO: 139160 - protein, 129 aa, Triticum aestivum
  Clone ID: PAT_TA_33578.pep
PATPAASPGCAGLPAQPPTSSLPGFEGPPSRLGVRRPAWVVRTESNVRRERPKRPDPPCTICKGTGTINCRNCFGRGRINHVDLAVLPKGEWPQWCQICGGSGLDYCHRCHGTGEYREPMGFHFTVNRK

SEQ ID NO: 139161 - protein, 110 aa, Triticum aestivum
  Clone ID: PAT_TA_33579.pep
KNKRARLEQIRVILGLSDSQRTPTPGESLRDFYKRTNMYWQMAAYEHTQHTGKELRKDGFDLAETRFKELKPILDELAVLEAEQKAEEEASASTSSKKDLKKGKQKSAGR

SEQ ID NO: 139162 - protein, 285 aa, Triticum aestivum
  Clone ID: PAT_TA_33580.pep
MVTNHGVPEDLQSAMMDACKELFGLPPEQKAEFMDAGPMDPVRVGTGFNSAVDGARYWRDYVKMFAHPELHCPAKPDGLRGVAAEYAARTRGLLLELTAAISESLGLPAGRIAERLDLGSCFQILVGNHYPPCAAGPDDDDGAVGLPAHSDHGLLTLLFQNGVDGLQVKHDGRWLLAKPIPGSLFVIAGDQLEIVSNGRYKGVLHRALVDRAQARMSCVSLLGPCLDAVVKPVPELAVPPLGLEFRGVKYRDYMEHQQSNKLNEKGALDLVRVQRHILTDTLFSS

SEQ ID NO: 139163 - protein, 78 aa, Triticum aestivum
  Clone ID: PAT_TA_33581.pep
NYSKLGVSLWCEHEHDETCAGTANCAGGLRMFSCVAREVLYARTGKLCCCCANLSCHRFHRLCEVLCMKRSLNLYLVQ

SEQ ID NO: 139164 - protein, 126 aa, Triticum aestivum
  Clone ID: PAT_TA_33582.pep
PPAQGAVRAWDRRPRPSGTAPARGGQAPSSGARPPRRDGGKGAPGPRPARGVPRRRGDGGRGWPRGRPRGGRGGAGCRAACGAQRGPRGSAPGGGWTRCGSPRRASRTPGLAGAPGAPAGAGRGPG

SEQ ID NO: 139165 - protein, 445 aa, Triticum aestivum
  unsure (1)..(445): unsure at all Xaa locations
  Clone ID: PAT_TA_33583.pep
ARACTAVMYKATSGSCLPTGQSESSSRGDQPATEEAFQDLSLIDKQRGMSEQAQSSTMRLAEKKRSTAEKNIGMDVLRKXYFSGSLKDAAMSLGLGPTTLERICRTHGISRWPSRKINKVNRSLKKIQTVINSVHGVDSSLQYDPATGSLVPAVSLPEKTSFPSCDAVSSPSVGKTVDEKSGPKSEQGYSSPEGWERDSCQLQRSDAQKGEGGEFHMQTTNYSGSGDHGSYGPNITHHISSEGTQGPLYPTGAVSALHDKETGCIEPLPCVLPSIKTTRDQIVGRNSPPMQQADIDMFDDREGREHTHPSTSGMTDSSSGSASSHPTFKKNPARPLKDKSSPALTVKATYNGDTVRFKFLPSMGWYNLLEEIAKRFKLSMGVFQLKYKDDEDEWVIMANDSDLQECVDVMDSMGTRNVKLQVRDLPCLISSSGSSSCLQLEGHNS

SEQ ID NO: 139166 - protein, 220 aa, Triticum aestivum
  Clone ID: PAT_TA_33584.pep
LSCLPRLRKLVLDGTVITNQAMEYLGAGVCPLASLSLRGCGMRPEDCIPLLLAGSVKESLHALDLSRIPSLTDDAIMVIVRTRTPLTELRLRENPEIGDASVKALASMQFKGVTCGSTLQLLDLYDCGGITLLAMKWFKKPLFPRLRWLGLKGSLNRIMVDALVLTRPFLRLACGGEELGTPYRDTSGEWCRHEDDDSEDLEPWQLDGEPVSDAETTNEE

SEQ ID NO: 139167 - protein, 270 aa, Triticum aestivum
  unsure (1)..(270): unsure at all Xaa locations
  Clone ID: PAT_TA_33585.pep
GAXAQWRKIGSSPSWXKVCKRYRQYYQQLQAVISSFETVAGLSNAAPFASIALRTMSKHFKYLKSTIQSQLRNTSKVAGGKDSLGKEDMANFGLMAGGAALMRGSNANAFSQPHNIWRPQRGLPERAVSVLRAWLFEHFLHPYPTDSDKQMLAKQTGLTRNQVSNWFINARVRLWKPMVEEIHNLEMRQGHKSSAADKNQLGPQQQTQQHSPDSSGRPSDPSNSHQGQSSSMSQNRSAHAAHRHIQSELSPMTHDMPGQVSFAYNGSGMA

SEQ ID NO: 139168 - protein, 318 aa, Triticum aestivum
  unsure (1)..(318): unsure at all Xaa locations
  Clone ID: PAT_TA_33586.pep
HGGGRPLFTVLILALFAPPADASPWQVCGNSGTYTTGSAYQANLNRMADTILANISTSPTLFATGALGAAPNQTVYALALCRGDVDASFACLVCLKSGFRDGQVLCDSDMDVTMFYDICHVRYSNRNFLAFTNNSQQHAFFSNSPSLGSSVAARFQTFVTKLLNATADFAAVANSTRKFATGEMDVDRNYFGGQFDKISSLAQCTPDLTPPQCRACLAAAMSEMPRLVFPSNPRGARVVGERCGLRFDVFPFYDGNPMVRLQVGGAGGKTKDTPAVVIVLAILGGLXXESIFIGLSTLQSATSNFDEKNKLGXXXXXA

SEQ ID NO: 139169 - protein, 129 aa, Triticum aestivum
  unsure (1)..(129): unsure at all Xaa locations
  Clone ID: PAT_TA_33587.pep
KFLSSLWFLPVPCXKLPTAQNSEHKFDRSLDPQSSNPASLPSKSTEASSISWMTTKQGRTGGTGRLTKQMHQMPTLTSRCSLRRFRIVAAGKFLMVIHHLYMLLYFLFKRGSFSTIRPLNNPSSHASTT

SEQ ID NO: 139170 - protein, 86 aa, Triticum aestivum
  Clone ID: PAT_TA_33588.pep
PSCQLCCACERCLHSPFGVVAPFYVPSSCRILYLGRIRLHVSSSIIPSSACLLYCPVCCVQQPHQVRDFIFQPFNMDVVIVPDFLA

SEQ ID NO: 139171 - protein, 83 aa, Triticum aestivum
  unsure (1)..(83): unsure at all Xaa locations
  Clone ID: PAT_TA_33589.pep
XRAGTHILCFLRDLWRPGAARLRRSADGTKPGVVPLSPPVPLPSPCHIHRPWQAMSSMYHQVVHVLWSLHRYRQGVVKEHGSW

SEQ ID NO: 139172 - protein, 257 aa, Triticum aestivum
  unsure (1)..(257): unsure at all Xaa locations
  Clone ID: PAT_TA_33590.pep
SARGRGPLHVRTFAAAAARPAMASTSTTLPDWLMLDRFVFWSENFTXPQDADSTLATGTNSMDKKFQICFKLVEPPEVSRLFLQMDEGLSQSHSFDIIAAHRAAVLLQMSYPILVPGYENIIPMIDYFLYYTAGGGSPPSLQRLPPLDGTIAQVQDQIKASADVMTNQFLRRLKCLDLGVLCRGEDEVAVAQLEITESGAPPKLQVLCPSISRSWEVKHPPIVPCDDVKEXDLEEVFKNFDAHTVIPFKSYLCWVDY

SEQ ID NO: 139173 - protein, 229 aa, Triticum aestivum
  Clone ID: PAT_TA_33591.pep
HDEVLQLHTCNLFFFLSIFADFEFSAVENTYKIITRIHELTFEWQKCDVQLALTRLISCLGRGDRGGNGDQEERGHPGRQGPQGEEGVPPCRAARTAGRTAERRTAAGGPARPCRPSSSSWGRVPRSSWPTICLRLLTWRRVRHSPRVKPTRLFRGEGDAKGLRATKRIVGTVSDKDLRGKKVLHGANRNILLDDSQNITDDNCIRASVLSIKFLMAKGAKAILANHLA

SEQ ID NO: 139174 - protein, 90 aa, Triticum aestivum
  Clone ID: PAT_TA_33592.pep
MVNPLPWGRRAIYSVSPNVAVVMQVRAGRTSGQGAGHPAWQGTKITELKQRKKQRGRTSGAKPRHPAYQESPDIRHMAGHPASSPNRIAL

SEQ ID NO: 139175 - protein, 119 aa, Triticum aestivum
  Clone ID: PAT_TA_33593.pep
IDKGLLISQDTGHDGVQHSGYAPRADPDHRNFCASSESNSLQHNDYLPRIEPNRRNFSSPWEANSSQSLLDDIRDQHGCFSSVQAQRNSTPCLFADGNNFQQAESVNSNIKHMCSISPR

SEQ ID NO: 139176 - protein, 165 aa, Triticum aestivum
  Clone ID: PAT_TA_33594.pep
KPRGGAFTLQSIHLSPLAEACSRKDLTAIHEHLETAGYKDDEGTANELSFQMWTNQMQATIDSKKKGDTAFRQKDFSMAIDCYSQFIDVGTMVSPTIYARRCLSYLMNDMPQEALDDAVQALAIFPTWPTTFYLQAAALFSLGKENEAREALKDGSAVETRSKGH

SEQ ID NO: 139177 - protein, 266 aa, Triticum aestivum
  unsure (1)..(266): unsure at all Xaa locations
  Clone ID: PAT_TA_33595.pep
RSSPPPPPPSLSSSTASINAKGGDGRSDHDDVDARKPLVVTTGGGYKMGSSLAAGSSSMAIICESHVSALLCTLIVALGPIQFGFTGGFSSPTQDAITRDLSLSISEFSVFGSLSNIGAMAGAIASGQMVEHVGHKGALMIAAVPNILGWLAISLAKDTTFLYTGRLLEGFGVGIISYTVPVYIAEISPRNKRGALGCVNPLSVTPGMVLAYVLGMLVPWRMLALIGTLPCTILIPGLFFIPESPRWLARMNKMDDFEALXQGDSS

SEQ ID NO: 139178 - protein, 142 aa, Triticum aestivum
  Clone ID: PAT_TA_33596.pep
MKWKQDASIRSSEIGFGGLTHLPRTPLEYPVISMYEPSVIYFMIGHDQASYMYNKVWIVAIDISNGKVKSSSAYINGTEQVGDLCADEALYFAREKPQVYSTFLPAEFSKHLNLLGTRTGLLQGGSDQAIGIAVTEKKRKLM

SEQ ID NO: 139179 - protein, 167 aa, Triticum aestivum
  Clone ID: PAT_TA_33597.pep
AGPESTAPDMHQATGPPLSERYHAEAAQLREKFHAMDISRVAVDPTDRRWSSCQRSSARHQVPLHLLHCALPAPRSLPEALPAAVSQILLSTRLCFPCDVAGFTISTTMGVTSPRERVETMAIMLPFLPSLPRSANCGRKPWRRQRSRLSSRRLQLQHRISDPSVIR

SEQ ID NO: 139180 - protein, 133 aa, Triticum aestivum
  Clone ID: PAT_TA_33598.pep
YIKCTKQNKQQTDVNGKGFHITSSTFKQNKSFRNSSKFCPSNSLFFHQIRTMKAPEGARKEGSRVGMSKRRTISPRLAPWKGAALRDVPGLGLGEGDDHPLVLLAEHDLAAEAGVLVELPVAGGAREGISTSY

SEQ ID NO: 139181 - protein, 58 aa, Triticum aestivum
  Clone ID: PAT_TA_33599.pep
FTRIIYFLECTPYIYFPYSVSIRVLIKQFPASNHVSLRFGLSLRGNESTVLWRVTRSR

SEQ ID NO: 139182 - protein, 108 aa, Triticum aestivum
  Clone ID: PAT_TA_33600.pep
MSEKSHRLYVKGKHISYQRGKRNTNPGTSLLKLEGVDNTEAANWYCGKRVAYVYRAQRAIQGSKIRVIWGKVTRPHGNSGAVRAKFRSNLPPKSFGASVRVMLYPSSI

SEQ ID NO: 139183 - protein, 121 aa, Triticum aestivum
  Clone ID: PAT_TA_33601.pep
TQYPLPMRPSDGLKARTKGGPPNGGKLRRKSRLQHRTALFLLMLHLKKRVAHSVSSEAQEANASAPLAASVPLHQEAEGSASLIATEAQKPSTVASQLSRSGSSRTTESAPDGGQGNAGAA

SEQ ID NO: 139184 - protein, 206 aa, Triticum aestivum
  Clone ID: PAT_TA_33602.pep
PALCTWRMSSPKPTESEPELTKNRVVGREKEDELAGAIGVDSRPRPSRPSPHDGRWPPPLRRSSLFFLPRSSLTSILAMEPYTPPPAANPSPTSIRPDPVQPTPPATGSAVSIAPLCPTPILASPASPCLPRSHVVPGSALSWWLWQIRLREARALRPPTSATKMDGDLGGLARRRAPAWLRGRELRCGCSSDGNGGTAGMWMWSH

SEQ ID NO: 139185 - protein, 119 aa, Triticum aestivum
  unsure (1)..(119): unsure at all Xaa locations
  Clone ID: PAT_TA_33603.pep
AWSRPRYYIDNLVGNKQAYFERSPINFADRFTCPVILFQGLDDPDVSXXQATTIYKAIKDKGLPVALVEYEGEQHGFRKAENIKFTLEQQMMFFARLVGHFKVADNIAPIKIDNFDKAS

SEQ ID NO: 139186 - protein, 128 aa, Triticum aestivum
  Clone ID: PAT_TA_33604.pep
LFFVQVLSSDECSNRGQTVILQSLHAIVVSSGSESGYFDPTKKPVVKTREDGKQWLSLPLGRHFSNPSGPELKLLKSLMSHQPMVPASLKHWGSDNIYQFPNIPIFSEVLPLVTVLDCGLRNLAQLRQ

SEQ ID NO: 139187 - protein, 158 aa, Triticum aestivum
  unsure (1)..(158): unsure at all Xaa locations
  Clone ID: PAT_TA_33605.pep
SIKLHGKLTXLPDFFLKVXFLVRELQLSKTGLSCEDLSDLQQLDLLLYLKLDEDSLVFVDGTFTFQSDGFKSLKGLCFETPKLPKIEVMEGAMPVLESLQLFSQNIQGLDVSAIKSLHHLKEVTLRSSVDAQTMRFWEDEAKKHKNRPTIVVAQSQNT

SEQ ID NO: 139188 - protein, 115 aa, Triticum aestivum
  Clone ID: PAT_TA_33606.pep
MKIELIGNKTEPHPTEPLMYNGTSSNYNAMPNSLLQRGGPRGPFHGNGRSGGSGQGGAGKRGMFQGNVRPGNTVQDGGGRGQGRARGHDRSRVPTSAADLDAELEQYHAAAVKQK

SEQ ID NO: 139189 - protein, 81 aa, Triticum aestivum
  Clone ID: PAT_TA_33607.pep
RRSPFDRYAIVSCSQLRLGCACADSRWGAWPSSYRLIDRHGSLLFPSFNSIVREAGSPNKCGRLQHQGYHFTGFFYFLVGS

SEQ ID NO: 139190 - protein, 71 aa, Triticum aestivum
  Clone ID: PAT_TA_33608.pep
SHAIQAPDNAGSDGDESDGGSDVSLPDPSRSPVPDIVQRPLALSHLTVRALRVAYGNTARVVYCIVDPRVP

SEQ ID NO: 139191 - protein, 159 aa, Triticum aestivum
  Clone ID: PAT_TA_33609.pep
PSGEKHKESDEYKRAQEEEWASRQRQLAIQAEEAKEAKRLRKRKKAEALRLLDMEKRQKQRLEEVRETQRKSEETIQLKEQCRGAVRLELEIIERRYTDMASILRALGIPVEGGEVKAAYKQALLKFHPDRVSRNDIYEQVKAEETFKFISRFKEKLRI

SEQ ID NO: 139192 - protein, 331 aa, Triticum aestivum
  unsure (1)..(331): unsure at all Xaa locations
  Clone ID: PAT_TA_33610.pep
FGTRCVRXISGGGNAGNALTGAARLGLNTRLISKVANDEIGGTVILELKEAGIDVSHVIISDGGNTTFVYVIIDKKTKTRTCIITSGYPPMVPGDISMSNLSAALQDVNLLYLDGYSHEMALSVGKQADLMKIPILVDAEPERTKTELEHLLGLSSYIVCSGKFPEKWTSISCIPSALLEILVQYPRARFVIATLGENGCMMLERIEDDSGIDAVDIGNVAESLRLKVHKDDSLPTCVSSKFMRLSGRGHGTIHGRLLIGTAEKIPAPELVDTTGCGDAFIGAVLYGLCTEMAPEKMLPFACQVAGIKCRAIGARTGLPWRSDARLSKYLR

SEQ ID NO: 139193 - protein, 111 aa, Triticum aestivum
  Clone ID: PAT_TA_33611.pep
KIDGTWNDHFAGSMAKPCCGHVVGVSSSGSHDCDDFAVVLYKPIFNLVCSGFSSQRVVSGIFELEQSVLGYHRGCYGAIFYTYAFLLNYIMFITLLCQCSSACHCRVSESI

SEQ ID NO: 139194 - protein, 225 aa, Triticum aestivum
  unsure (1)..(225): unsure at all Xaa locations
  Clone ID: PAT_TA_33612.pep
AYEFAXMGSLHDVLHGRKGVQGAQPGPPLNWMQRMKIAVDAAKGLEYLHEKVQPSIVHRDVRSSNILLFEDFKAKIADFNLSNQAPDMAARLHSTRVLGTFGYHAPEYAMTGQLTQKSDVYSFGVVLLELLTGRKPVDHTAPRGQQSLVTWATPRLTEDKVKGCIDPRLEGEYPPKGLAKLGAVAALCVQYEAEFRPSMSIVVKALSPLTLSRQTPPAPAAALDS

SEQ ID NO: 139195 - protein, 288 aa, Triticum aestivum
  Clone ID: PAT_TA_33613.pep
MDSRFSSGSGDVRSGSSLTVGERLCAAFLPFVAVAEAVFFVLADCLADICPSSSSSSRLRRESSASSFLTAKKKSHHLFRRRVGPGCTSLDFRNLARLAEESRCFSVNEVEALFELYKKISCSIIDDGLIHKEELQLALFKTPSGQNLFIDRVFDLFDEKKNGVIEFDEFIHALSVFHPCSPVEDKINFAFKLYDLRQTGFIEREEVMQMVIAILNESDMKLSDELLEAIIDKTFEDADTDRDGKISQEEWKEFVLRHPNLLKNMTLPYLRDITTSFPSFVFNTAVED

SEQ ID NO: 139196 - protein, 35 aa, Triticum aestivum
  Clone ID: PAT_TA_33614.pep
ALQELNGINGLHGQLKIKGLDNVLSKDEATKTDMK

SEQ ID NO: 139197 - protein, 72 aa, Triticum aestivum
  unsure (1)..(72): unsure at all Xaa locations
  Clone ID: PAT_TA_33615.pep
SRXNRMMPFGVGRRICAGLGVAMLHLEYLVAKLVKEFEWQEVAGDEVDLTEKPEFTVVMAKPLRARLLPRTR

SEQ ID NO: 139198 - protein, 179 aa, Triticum aestivum
  Clone ID: PAT_TA_33616.pep
FTSRYDRRANPQDSCILNNILEIFCSSIPPSDNNFRARVTVEQGVEQARSSSGDFMSPHMGKAVAFLEIGKKPAPWDEPSTTADIGDLEVGLGGMLDEKKGRLTHASPGVSRDQLSLELVEGRAGMHSRHSSWDPRAETSESVNSNSVQTAPTEETNGSGHVTTSGALASTNGMPQMNI

SEQ ID NO: 139199 - protein, 277 aa, Triticum aestivum
  Clone ID: PAT_TA_33617.pep
SVSVYRPTLSWGSFATCGRRETMEDTHFMLTCMSEEKDVHSFGIFDGHRGAAAAEFSVRAVPGFLKQFGHTASPIDALAEAFVSSDTAFREELIAHQKSKRIIQKDWHPGCTAVTALIVRNKLFVANAGDCRAILSRAGKPFPVTRDHVASCPKERERVIKEGAEVRWQIDTWRVGAAALQVTRSIGDDDLKPAVTALPEITETDLTADDEFLVMASDGLWDVVGNEDVLSIIKDTVKEPGMCSKRLATEASARGSTDNITVIVVFLRPVSTAERIY

SEQ ID NO: 139200 - protein, 167 aa, Triticum aestivum
  Clone ID: PAT_TA_33618.pep
MASHAARLLLLLALAAALAGRSDGAWCVCRTDLPDATLQRTLDYACGSAADCKPIQPNATCFAPDTVKAHCSYAVNSYYQRSGQNPLACVFSNTAVISSTDPSTNGCKYPASATPSAPGSPPPPMAQGPNGDLKDTSGGADVFPVAGAATRAVILACCSLLALYFIA

SEQ ID NO: 139201 - protein, 279 aa, Triticum aestivum
  Clone ID: PAT_TA_33619.pep
EQMCRNRHLKPRPVQKGCLVSPLVTPWGPWGCSGHGMRCRARATAGQIATRLAVPATGRTSAPPLVSLGSPFGSGAIGACGGGRGWGGGPGAAVLGRAGPGRWGRTPVPPLVSFRGPFRPYGVGAVRLDGVRGEAGAVALQRLVLSGAAASAVQRPQQQPSGQGPARHAPRPMGGEAGARGGPREEQAALARVGLQWGTRLHASSFVLCSVASGRSVRHTHHAPSAAERPASAAASARSRRRRIAWDAMDGAEQVPSSLPSPVWCGGVESERRRAYPVT

SEQ ID NO: 139202 - protein, 186 aa, Triticum aestivum
  unsure (1)..(186): unsure at all Xaa locations
  Clone ID: PAT_TA_33620.pep
XCTTRPTRVAIFHRQVKADADLSFHPPKMAARQWVRWEEEILLEDDDEHHTECFYLRCAPLLGGGVSERDLAVVGKYCPDPAPGNMVYSADPQFLRFLQEGITCDSVLAMGVTVRVEITQLSWKSRKEVIDWLNLLVSESSGQASNRGAANPVNSVPVQEICITNEQAPVPAIDEEQVIDLTMSDD

SEQ ID NO: 139203 - protein, 81 aa, Triticum aestivum
  Clone ID: PAT_TA_33621.pep
HLRKRQESELRIWKVVSGALQKVTSTFLVGDKWHTVCVIVTQPGSFVFFCYIFLNQLSLKPCVQITNHFHHRISCVKIFEN

SEQ ID NO: 139204 - protein, 87 aa, Triticum aestivum
  Clone ID: PAT_TA_33622.pep
WTDRAQNMASKVFAVLAIVLVLTHGHLPPVMGEKTPSDRPKVLPRQDAAPAVAGNGAPAAPGFTEEKGWFFQRPLARPTPLPPSLKL

SEQ ID NO: 139205 - protein, 63 aa, Triticum aestivum
  Clone ID: PAT_TA_33623.pep
NGGDAVGRGDLKKKKKKKKKKKKKKKKKKKKKKKKKKKKKKKKKIKKKKKKKKKKGPPQRFQL

SEQ ID NO: 139206 - protein, 61 aa, Triticum aestivum
  unsure (1)..(61): unsure at all Xaa locations
  Clone ID: PAT_TA_33624.pep
ELEQFTKRSHQFVYNRIGGIYCEILPKSEYFSKALXIFHHAQNDLTKERFTAAMWANLACN

SEQ ID NO: 139207 - protein, 161 aa, Triticum aestivum
  Clone ID: PAT_TA_33625.pep
FLWVAGDYCEYFSDCLTRGTGCIKIIKIDGALFKSGGGTFGVRFARFQGLQVHCVVYMLDGDDIFRYDFASNGWSKEATLRRKIPETELCGFVSLNGELHVLKSAKLPAETLHPRRQLKKRLALEFQVYNPLARKWRVFTTYPPVSVPIDFRTAALCTVEL

SEQ ID NO: 139208 - protein, 203 aa, Triticum aestivum
  Clone ID: PAT_TA_33626.pep
MEALYLLASLSTTLLTSALLSLLLLLRLPFARRPAPGGAGAGAARLYEGRVRHSRRRPAGHAFEYAVRYALVDLDLLPLSGHLSAAEARGIASTSGPVRLLTVPKSVGYEQNPLSVYYCYDAAAKEQDEDLKMCIAEVTNTPWGEKVMFTFQPGSDLVAKPLHVSPFMDMLGNWSIRANAPGDNLYVAIAVQHPTLGNYFTAA

SEQ ID NO: 139209 - protein, 465 aa, Triticum aestivum
  Clone ID: PAT_TA_33627.pep
ATWALRLAGDRASERWTAAMIALVGLLRYAKCVLFSATPRPSDSKADVDVEDDGESPAPPPDLRCPISLDLMRDPVVAASGQTYDRESIDRWFSSGKSTCPKTGQVLANLELVPNKSLKNLISKWCRENGVAMEVCEASKSEQAQAVAANKAALEVARMTASYLVKKLSVSFSPDAANRVVHEIRLLSKSGSDNRAFVGEAGAVPMLVPLLYSEDAGLQLNAVTALLNLSILEANKKRIMHADGAVEAVTHIMSSGTTWRAKENAAAAVLSLASVHTYRRRLGRNPSVVEKLVHLVRTGPTSTKKDALAALLSLAGERENVGKLVEAGVAEAALSAISDEETAAAVLAALAKRGGAEAIVSIDGAVARLVAEMRRGTEWARESATAALVLLCRRLGARAVTQVMGVAGVEWAIWELMGTGTDRARRKAASLGRICRRWAAASAADGERGAECPASSVVPPAMMAS

SEQ ID NO: 139210 - protein, 337 aa, Triticum aestivum
  unsure (1)..(337): unsure at all Xaa locations
  Clone ID: PAT_TA_33628.pep
RARALASFLGRLPCFGPSLGGPAARRGATGPLTPPFDWGQSPYVTRNPARRPTKVIAINKXFPGPVVNVTTNYNVAVNVLNNLDKPLLITWDGIQQRXKNCWQDRVLGTNWPIPPGLNWTYNFLVTHLRGSFFYFPPLSMQRAAGGFGGVTVNNRAVISVPFDTPDGDVRLFIGDWYNKNHTDLRKMLDDGKELGMPDGVLMNGKGPYRYNDSLVPAGIEYETIDVEPGKTYRFRVHNVGVSTSLNLRIQGHNMAMVETEGSYTMKQNFTNLDIHVGQSYSFLVTMDQNASSDYYIVASARFVNESLWTRVTGVAILHYSNSKGKASGPLPDPPNDE

SEQ ID NO: 139211 - protein, 69 aa, Triticum aestivum
  Clone ID: PAT_TA_33629.pep
PEPATSDSSSSSSSSGSPKRRKRGEAAAASMAMALVPPSSQLSRPAHAWYPAVPAEQVAMAPCVQQLVS

SEQ ID NO: 139212 - protein, 179 aa, Triticum aestivum
  Clone ID: PAT_TA_33630.pep
SYIKVMLEKELPTCSAFENLTTLEIGEWYLTEDLFVVLRFLQLSPRLEELTLMNRPLDEGAEIDCMPIDGMTFRCPLLESVVIQCSEGDGRIDKLLSVLVVNGISPDNINIAFYDEIEKRDRAERIRADEERSKELRIFEKRVRRNPEWREYDPYAMSESDSKQSDDGFSDASDDPDDY

SEQ ID NO: 139213 - protein, 170 aa, Triticum aestivum
  unsure (1)..(170): unsure at all Xaa locations
  Clone ID: PAT_TA_33631.pep
TRVEVIEVHYLFGAEYDNLEIMNHPXSIIRSMSETQNXSVLAQLGWLDMRLPTLYTLSWPDRVYCSEVTWSRLDLCEMGPADNSKLSTTRNTHRLMGDMRQANEEALELFIDEKISYLDIFKVVEMTCDAHRNELVTRPSLEEIIHYDQWARKFAANLEPSSSGRSPVLA

SEQ ID NO: 139214 - protein, 517 aa, Triticum aestivum
  Clone ID: PAT_TA_33632.pep
LAWRTDEEFAREMLAGLNPHIITRLNVFPPRSTLEGYGDQTSKITVEHIQHNLGKLNVDKAIDAKRLFILDHHDNFMPHLLKINSLPNTFVYATRTLLFLQDDGTLKPIAIELSKPLLNDLGTKVVGADSKVYTPPSCGSESEWAVQDTIWQLAKAYAAVNDSAWHGLISHWLHTHAVIEPFVIATNRQLSVTHPIHKLLQPHYRDTMTINALARQVLISAGGFFEMTVCPGEHALRISSEVYRNWNFTEQALPVDLIKRGVAKADTESPCGVSLHIKDYPYAVDGLAVWSAIETWVDEYCRIYYPCDDVLRSDVELQAWWKEVREVGHGDIKDQPWWPKMTTVNVLVRSCATIIWIASALHAAVNFGQYSYAGYLPNRPTVSRRQMPEPGTKEYKEVETDPDLAFIRTITSQLQSIIGVSVIEVLSNHSSDEVYLGQRDEPKWTSDVKAKKAFEDFSQKLIDIEKRIMNMNANRQLKNRNGPAKFPYMLLYPNTSDIDGESATGITAKGIPNSISI

SEQ ID NO: 139215 - protein, 137 aa, Triticum aestivum
  unsure (1)..(137): unsure at all Xaa locations
  Clone ID: PAT_TA_33633.pep
VQHPTLGNYFTAALDAKLVGQTNDSVKLAXIFWLMPHKVAAGIYWEAFQXLWLKNVRFLDHPRYLSGSYRSEALKRDLEIRSSCSFLHQKPRESIGRSGTATTDETAENSNHQNYKDGGGSIGARWCVWTDAQWPWC

SEQ ID NO: 139216 - protein, 76 aa, Triticum aestivum
  Clone ID: PAT_TA_33634.pep
MRQQTVTEKKFGGIAPKKPLISKDHERAYFDSADWVLGKQAASNNAQAAAIESLKPKLKRTPHHQLPPRKPACASG

SEQ ID NO: 139217 - protein, 204 aa, Triticum aestivum
  unsure (1)..(204): unsure at all Xaa locations
  Clone ID: PAT_TA_33635.pep
MAVEWSDAGEEFLLPDEFLDDDFFSEEEKAAVAARSESDEEDSLAGLSRRLAGLLGGDKLAVTPAKEEVTAGSPKSTLCGLPKSGQESPNSGASQGNSPPSSPLEQQPADPWDVLYEAAWQVNSIPAPGHPYVLHGRGGFVPPARKASPPPPPPHVPAPAGTAAGGVYYHPXQHLITQRQIQAARFHLLKQQQLFKQQRDRQLA

SEQ ID NO: 139218 - protein, 361 aa, Triticum aestivum
  Clone ID: PAT_TA_33636.pep
MRPPAPSPTLRPALPRRPAPAPHPQLSQRQGQPPPCRSLHPSFPAAAASSPLQQTQRPHQMSQPLNMLGNPHLSQTQGTSHPSPQQQPYSTMPMQLAKERQFQHRLVSQQHNSLPVAGVQNGPQIQQQNHASPVTSTPSSQPLHQKQQSAQSPTDSSALANRPANATEPKQKKQQGQQQPRQNQQQRNQASQQAKLMKSLGRGNSTVTPQTPAADATPPSAVPTASKKQVPDRNLMQHGQGSSAGNKAATAVTPQPGNQHKLYASVQQPPNIGNQGLVQGPPSHTVFAAQPPPLHSRYPVSTQQRPMNPAQNNIQRMMMQQSLQMKPDSRMDAQMDQVQHSQGDSSYTYISQFRSRQPWGF

SEQ ID NO: 139219 - protein, 251 aa, Triticum aestivum
  unsure (1)..(251): unsure at all Xaa locations
  Clone ID: PAT_TA_33637.pep
EEALXYVLVPLGLVLMLGYHAWLLLRIQRRPATTVIGVNAINRRIWVRHIMEEPSGKHAVLAVQTIRDNIMASTLLASTAITLSSLIAVLMSGGGGGGPGAGGGGLLPDAPLVVGATGEAALSAKFFAILVCFLVAFLLNVQSIRYYSHTSTLVNVPIRAHRLRRPGLAVDYVTGTLNRGSYFWSLGVRAFYFSCPVFLWLFGPIPMFAACVVMVCVLYFLDVCEDWEEEQGVSGGDETSERGKDAGGTQV

SEQ ID NO: 139220 - protein, 292 aa, Triticum aestivum
  unsure (1)..(292): unsure at all Xaa locations
  Clone ID: PAT_TA_33638.pep
SGLGGGKGRAGSDEGEDSDDDEWAPPPELYTGGERSGMVVRDRSKRKNVADEVFKQAKRKGAKQGPARRQSSSSRSFPGASRLLTGETVQPDAPQPPRXIVHNIYFWSDGFTVDDGPLRSFNDPEHASFLESIMKSECPXKLAPADGMSKVNVNLIRKEEKCPESLKRPAPFQGGGRNSXAAPSENSAPSDISPAAAASSTATTTVPKTITVEDSLPSTSLQIRKFAEPVKRPAPFQGGGTSHXRAFIHTTRPGXSSDYTLQVGFPPKXPLDDATKTIEEAGVANSVIIQEV

SEQ ID NO: 139221 - protein, 177 aa, Triticum aestivum
  Clone ID: PAT_TA_33639.pep
KLLHPVYPLSSLSSIIPVAPLSSLSSIIAVASYLSSAHGSATPYLSSNNARATEATAGALVLFHSGGQTTRIPRHLPLRRPDHLEPAQHRICRGRGPRPWIWPREIIFSIVSVGSVLGWQGRFLMSSVAGFHHHRRFQLGRDGEGTQLCRDVGFDVCSEATSGWTIRVRINCLVSNI

SEQ ID NO: 139222 - protein, 390 aa, Triticum aestivum
  unsure (1)..(390): unsure at all Xaa locations
  Clone ID: PAT_TA_33640.pep
MGPRSRPRVTMKGTQAISVTLLMSFLVLATRGKDVRYRRQEEDSTQILTYQGVNKTIQMEDGDVYDCIDVYKQPGLNHPLLKDHKIQMKPSSIPVWMDTETFPSDSFSQAEPSIIECPTGTVPILRSNGSTTIATHNIDGLKNDMQWERAGLRYMGDLYGARASLNVWEPKVKGSQDSSAIWISIENRRGQQPDRVSAGLRVAPALSGDAFVRLHVAWFDGYSXRGCIDHSCPGYVQVHPHIGPGSRIQPSSVYGGDQRVAGIQIFKEPKSNYWWVSYNNIAIGYWPGGLFEFIRYKGDLAFWGGQVEGPTASSKSTQMGSGHFASEGFRKAAFIRKIEIADDTVKFATPNRYIVGQGSSDPSKYTTGGFEISKDFGMTIFYGGPGSMRA

SEQ ID NO: 139223 - protein, 497 aa, Triticum aestivum
  unsure (1)..(497): unsure at all Xaa locations
  Clone ID: PAT_TA_33641.pep
RTPQKLAPYAAITCAKRLTHYMXFCQNSWRDNFCEYWRNFVNEIFAPTAKKRWCVSLYGSGRQTKGVFPQDVWHCEICNRKPGRGFETTVEVLPRLCQIKYASGTLEELLYIDMPRESQNASGQIILDYAKAIQESVFDQLRVVREGHLRIVFNPXDLKIASWEFCARRHEELIPRRXIIPQVSQLGTVVQKYQAAAQSSTSLTTQDMQNNCNSFVACARQLAKALEVPLVNDLGYTKRYVRCLQIAEVVNCMKDLIDYSRQTGSGPINSLHNFPRRSPAGINPLQPQQQQPEEQQSVPQSSNQSGQNSAPMAGVQASASANADVTSNSSLTCAPSTSAPSPSVVGLLQGSVNSRQDHPMGTVNGLYNSGDDGVIPKVNSTSSLQSNPSPSFSSQVPTSSNNNMMPAPQNTNQLSSPAVSSSNLPPMQPPATRAQEPEPXDSQSSVQENLXQEMMSSQMNGVGHXANDMKRANGTLPLGINGVNCLWGLGRHQLGSR

SEQ ID NO: 139224 - protein, 363 aa, Triticum aestivum
  unsure (1)..(363): unsure at all Xaa locations
  Clone ID: PAT_TA_33642.pep
TVHTGGPSPIETVKGHSFSREIMKSLRRKPARSGAESLPSPLGPLRADGGARGSARPPLQQNLSXDSVGRSHEIAGKIQEDEFPIVSTHKEPPVSPAXEPPQPRAAAESXTVSQPYLALTHPSRKSXLGCANSIESTTQMTQCATEACSSXAGENTPLFYASVAGNEHENIQDNNSERSSVISISYGGDNDRDEILQDESSSCNHDGSSVQDSEAETSDKTADPDGSSEKTVVSNERKPFISKFQWLLKLGRPSGEGSIEKGSGEKSDGKDAVDASCSEGNSNNPRGNTKLAAGDKKVMGTFKNLGQSMLENIQVIESAFQQDRSQPGPMENFSNNILGGKGQVTATAALTELRKISNLLSEM

SEQ ID NO: 139225 - protein, 169 aa, Triticum aestivum
  Clone ID: PAT_TA_33643.pep
MGSRYEVEITVGSARDLKNVNWRNGDLKPYAVLWIDAGARCSTRVDLDNGDNPAWDEKVVVPLPPASRLEDAVLYIDVVHANAAEGVKPLVGSARLPLRDVGGKASRNLRLKRPSGRPQGKLDVRVAVKEPARYYDSNVPGGYPAPAGYAPPVMPTWWGVGATGPRRAP

SEQ ID NO: 139226 - protein, 347 aa, Triticum aestivum
  Clone ID: PAT_TA_33644.pep
MDMRALNLKAAGPSFLAPRRHPPATWAPLPAGEIGRRRQPARLTKLAVSASGKKSRNGRDGDDPKSKPSPSGKGDASTPIGDDDADAVSQNHGELKPSDTMYVPSNLSYWRDVRASFVIPKSEQAVDVNTLPQTSFDGPVHCLPRKWAHSISAPESGCVLVATEELDGNGTFERTVILLLKLGSRDAYDGPFGVILNRPLYTKMKHVNPSFRDQATPFGDCSLFFGGPVDMSIFLMRTNEGRPIKGFEEVAPGVCFGFRTDLQKVGHLMKNGALSPDDLKFYVGYSAWDHDQLLSEIDAGYWVVTSCSSGLITDALTTDPSCLWSEVLQLMGGQYAELSQKPKEDGA

SEQ ID NO: 139227 - protein, 159 aa, Triticum aestivum
  Clone ID: PAT_TA_33645.pep
MYVSVGVSNEPLAMRRVVYNLPTSWFTATCHAFSVHSVLDIAAGLAAGLAAGLTGGWCSWTCSLACPTCRPPSAPANPSAISCVTSPTVFTSGSLFLRVDICAAAYLAVIARAQKMHPLPVHYADHMRVRCSGRCRVAGRLICHLRTRNLTATGGLQRT

SEQ ID NO: 139228 - protein, 120 aa, Triticum aestivum
  Clone ID: PAT_TA_33646.pep
RVDRDQKDMDNADAAGELVGPIPPLPDAQVDNDGASVEQSTSNAKSGENVAMNEGAVDKVDSSKLDGQDNTNGRMDVDAGSQEEGNNVPAAPDATIVDVGNTPVSSDQAVSNEESDVVPE

SEQ ID NO: 139229 - protein, 223 aa, Triticum aestivum
  Clone ID: PAT_TA_33647.pep
HYTHLLTGYIGSVSFLNTVLQVVDKLRSVNPDLIYVCDPVLGDEGKLYVPQDLVSVYQEKVVPVASMLTPNQFEVELLTGLRITSEQDGLKACNTLHSAGPRKVIITSALIEDKLLLIGSYKRTEEQPPEQFKIEIPKIPAYFTGTGDLTTALLLGWSNKYPDNLEKAAELAVSSLQALLRRTVEDYKRAGFDPASSSLEIRLIQSQDEIRNPRVTCNAMKYK

SEQ ID NO: 139230 - protein, 316 aa, Triticum aestivum
  Clone ID: PAT_TA_33648.pep
MARPPILSVALPSDTGRVLSIQSHTVQGYVGNKSAVFPLQLLGFDVDPINSVQFSNHTGYPKFRGQVLNGNQLWDLIEGLEENELLHYTHLLTGYIGSVSFLNTVLQVVDKLRSVNPDLIYVCDPVLGDEGKLYVPQDLVSVYQEKVVPVASMLTPNQFEVELLTGLRITSEQDGLKACNTLHSAGPRKVIITSALIEDQLLLIGNKLLLIGSYKRTEEQPPEQFKIEIPKIPAYFTGTGDLTTALLLGWSNKYPDNLEKAAELAVSSLQALLRRTVEDYKRAGFDPSSSSLEIRLIQSQDEIRNPQVTCNAVKYK

SEQ ID NO: 139231 - protein, 210 aa, Triticum aestivum
  Clone ID: PAT_TA_33649.pep
TTPQLAPRLSLRNRERQRDPSQVRNRTDGGTAHTWAWPATTGAAGSTRPCPAAACARTASATASSASAPTARGRAPAPAPPPPPRPPRPPPPPSAASAASSSGSAGSGARGPWPAAAAPTRGAGPGSGAGPRSGSPRPARAWSWRARRSATPPRTRRHWSWSGRAPPLRRSWRPKRAGGGGSCPARSRRCATASRALPPAPAPEATPGRA

SEQ ID NO: 139232 - protein, 263 aa, Triticum aestivum
  Clone ID: PAT_TA_33650.pep
KRRLLQISRLICYKIKPPSQPSDLSDCGCTIATHGVIVFLLCSTMHHAHPSSICTCRRPRCTEAASDRCIAAPRSHPGAAQMATPSEAKKLQRNNFLGRNARREVPTALIATPDELQRPRGATMQLRHASLQPRRSFNDPRGAPLQPQRTSLEQQHRCGACCVGCRQHHERVASDVALQHHELCRPGKIHGQLVLQGGSQPACCEGSSHRCSAAVPLAVATTPPIGVVAIWQHMVVAVRSQQPGLLTLPASMAIRFGGRKNER

SEQ ID NO: 139233 - protein, 142 aa, Triticum aestivum
  unsure (1)..(142): unsure at all Xaa locations
  Clone ID: PAT_TA_33651.pep
MGAGIRILAAALLALAAVRGATAQLRQGYYSASCPNVEAIVQAAVALKVQQTPVAVGATVRLFFHDCFVQGCDASVIIVSSGNNTAEKDHVSNLSLAGDGFDTVIKAKRRGHAVPQXTLVSCADILTMATRXVIGLADGPAY

SEQ ID NO: 139234 - protein, 243 aa, Triticum aestivum
  unsure (1)..(243): unsure at all Xaa locations
  Clone ID: PAT_TA_33652.pep
DAWVHSYLASAGVDGVKVDVQNILEALGGGHGGRVVLSRKYQQALEASIARNFRDNGIICCMSHNTDNLYSSKRNAVVRASDDFWPRDPASHTIHIASVAYNTVFLGEFMQPDWDMFHSVHPMAEYHAAARAVGGCAIYXVSDKPGNHDFDLLRKLVLPDGSILRAKLPGRPTGDCLFSDPARDGKSILKIWNLNAHSGVIGAFNCQGAGWCREGKKNLIHDVQPGTITGAVRGRDVSRLQEV

SEQ ID NO: 139235 - protein, 312 aa, Triticum aestivum
  unsure (1)..(312): unsure at all Xaa locations
  Clone ID: PAT_TA_33653.pep
MDVGGAGAGDLDRDGGVGVGDDLDIEHDQDVDVDRVRPPAPPRPRPSRAGVGGGGEEGEIAMVAAEXFVSCGAARPPPVLDYTIHXSEFHKTRLACFTVFSPYAPCPTLTNYYFPEVKFTSPDTATYSIPRVLAPMPQKYVRCATKNFGRYHVSEPPVEHLRDPLYKTEREIMKVFLTKHYRNRRFSDTDFFLDFEEIYVIDSKTRSITRAKVVVNVPAGKGRDRRNDLLLIRYGGESFRLTDKSQRDDATTIIQSGEWTGPSRDGVWRCRSRSAVVFSTRFGSDGPPASPRLCRVGCDFVVSLAAACARAN

SEQ ID NO: 139236 - protein, 114 aa, Triticum aestivum
  Clone ID: PAT_TA_33654.pep
ASGWRREPTRRIWRYRSSTKKADDGVKEVKLDQQRGLAAPEQGVQEHVRHHEREGLSPAPYNFGYATEQGPAQRLRPMHIPTDLQSRGPPKNLQGVLLRIHPCICSTIIVIPGK

SEQ ID NO: 139237 - protein, 135 aa, Triticum aestivum
  Clone ID: PAT_TA_33655.pep
AKLTKTASPSPRSGCAAGVVQERGPRRGRAADGVVPVADEERQQGRRGGGRGRAQERERGGLGRRGDGQRRRQQRGVVARGGAAVVRPAHPALGRRRPAAVQPSRRLLVTRPSSPLSINTPTKEKNETKFFLLFS

SEQ ID NO: 139238 - protein, 157 aa, Triticum aestivum
  Clone ID: PAT_TA_33656.pep
AAAACTAFRLSSIHPTRHGKQNTSSSSFLLHHHINLSHLSRLQPADQTSKRRGGNALPNHLLIYHLTTKQQKSVCSGPLSATTFVPFRSIPFHTSVRHLYTNFGFQRQGMLHAYDQPVSGFHQPGPGFGGAYMPPAAPDPGFGGAYMLPGPTGLCWS

SEQ ID NO: 139239 - protein, 70 aa, Triticum aestivum
  Clone ID: PAT_TA_33657.pep
FFFFPGDQHRGAPPQSFSSSQWLHGYTPAQLDQYMEEGFLYPCTHTTRPAHPATNSRTKLTTTCTIHIHA

SEQ ID NO: 139240 - protein, 61 aa, Triticum aestivum
  Clone ID: PAT_TA_33658.pep
WFPLLNSVVFYYKTTMWSCLSGTTCSHVCSRTSSCFGACYRSSFPENLATSSRDPGKCRSG

SEQ ID NO: 139241 - protein, 97 aa, Triticum aestivum
  Clone ID: PAT_TA_33659.pep
GTTTEVNPTKSLWGGAQLPQSRYYNNRSSGWVCWPRHPLYRLSRDRYYSSWEMFQPSYLPEIQIWLVSGYSRLIESRKKNESLQHKSTRQRCEILGK

SEQ ID NO: 139242 - protein, 446 aa, Triticum aestivum
  Clone ID: PAT_TA_33660.pep
MAIGGGGGGGSWSIHGRPDVTSRYDVLGRAGSGAYADVYRGRRRSDGAPVALKEVHDAVSAQREDDALLAAASESSPHVITLLDHFPGGDHDDDVLVLEWLPLDLAAVVREGRRAGGLPAGQLKRWMLQVIEGVAACHRAGLVHRDLKPGNLLISEHGVLKVADFGQARILQEQPSDEPEIPAAQEPETLTAADYLHEIDQLRAKSTYGDVDRMSLQDGNTSCLATCSTADIDDDPFRASYSYDAEEDIGDEESGAFTSCVGTRWFRAPELLYGSTSYGQEIDLWSLGCILAELLSLEPIFPGQSDIDQIGRIIGVLGNITEESFPGCSNLPDYNKIFFSKVEKPTGLKASLPNRSASEVSIVKRLLCYDPAKRASASELLNDPYFTEEPLPVPTEALQVPASKGEDDDSSAEEWGNYRDGNSDSDIDEFGSMDVTKTDKGFSIRF

SEQ ID NO: 139243 - protein, 83 aa, Triticum aestivum
  Clone ID: PAT_TA_33661.pep
FLTPCCHLLVALLQPQLPCPHPNLHKLQYDLRQHPVILHSGTLERTFSPHFTITSPTHNPATSAGDPSTTFETYKPWSTSGHF

SEQ ID NO: 139244 - protein, 46 aa, Triticum aestivum
  Clone ID: PAT_TA_33662.pep
MGWIPDNLNEGHLDRFFWLIAGLSSLNFLAFLYFAQQYKCKKASVL

SEQ ID NO: 139245 - protein, 69 aa, Triticum aestivum
  Clone ID: PAT_TA_33663.pep
PASTRRPRASTQRPRARTAAMFPLLFLAWKGYVKEERCVGRLAVACIKSLYSLSYDTECVTVEKTPTPR

SEQ ID NO: 139246 - protein, 180 aa, Triticum aestivum
  unsure (1)..(180): unsure at all Xaa locations
  Clone ID: PAT_TA_33664.pep
SILVGNALCRLISGGDILVFDLGMSXLDVIEKPAFYYVTDGCFQILRMEGGGLGLAVLLDLTIQLWERKSNSDGVVGWVLLKKTIPLEGMFPRRMNSVRIVGYDEDTNVIVLTSMTGNFTLQLDSMQLKHIVKRNNICYDPFYPYTNFYTAGRAVGREGVNLELIVIGPDLLTYYLGRTI

SEQ ID NO: 139247 - protein, 573 aa, Triticum aestivum
  unsure (1)..(573): unsure at all Xaa locations
  Clone ID: PAT_TA_33665.pep
GAAGAVSVALSPAAATGARLAPSAVAVPSASTQLLPASAPPYWAGPSATRTGRSLAPPRVALLGRGGGGISTQAAGVAAALVAKGERNIPEAYPRNPPALGDNVVDSVGDIGGMGSDVSGSDAQSWSAAPFVASISSFGTEHNFAAMMYPLLISAMGIVVCLATTAVGTDLAAVKTVEGTRPSRNRXIPISAVRMTVGTATLTXLVLPRAFTRRDWRPPLPAPRSWNSVFGRPAAWXAWLIIGYVSPFLTCRLGELYEVMNGXGYFSFGLYLSMXLLNAACRLAAGPAAARPPRGALCAAAAGLCIDAYGPISDNAGGIAEMSGMPHVVRERTDALDAAGNTTAAIGKGFAIGSAALVSLALFGAYVSRAGVAAVDVLSPRVFAGLLAGAMLPYWFSAMTMRSVGSAALAMVEEVRRQFDSIPGLMEGTAKPDYATCVKISTDASLKKMLAPGALVMLSPLVAGTLFGTETLAGLLAGALVSGVQVAISASNSGGAWDNAKKYIEAGASAEARALGPKGSDAHKAAVIGDTIGDPLKDTSGPSLNILIKLMAVEALVFAPFFAAHGGLIFKHL

SEQ ID NO: 139248 - protein, 51 aa, Triticum aestivum
  Clone ID: PAT_TA_33666.pep
QQIIPLCTQTQSDFTKKIMEAELECQARCKIFSLGSACTMLQHATVGLQEP

SEQ ID NO: 139249 - protein, 192 aa, Triticum aestivum
  unsure (1)..(192): unsure at all Xaa locations
  Clone ID: PAT_TA_33667.pep
MAITVRRSTMVRPAVERPRERLWNSNLDLVVPRFHTPSVYFYRRPEAGADGFFDADRMRLALADALVPFYPMAGRLARDEDGRVEIDCSGEGVLFVEADAPGAAVDDYGDFAPTMDLKRLIPAVDYSDDISSFPLLVLXVTYFKCGGVSLGVGMQHHVADGMSGLHFINSWSDLCRGAQIAVIPFIDRTLVR

SEQ ID NO: 139250 - protein, 254 aa, Triticum aestivum
  unsure (1)..(254): unsure at all Xaa locations
  Clone ID: PAT_TA_33668.pep
YLPAFIKSQLLLHLESDNSAQLSQXITPNQLLAHLVEAEMIKRTKEGRYKGKKFSSVCHFFGXYQARGSLPSNFDCDYAYVLGHISLHMIAAGLTGYMATVANLKDPVHKWRCAAAPLTAMMSVRRHLRGPGAIPIGKPAIHPSPIDLKGKAYELLREKASSFLLDDFYRTPGGIQFEGPGSDAKPITLTIEDQDYMGDIEMLKLYLDKVKTIVKPGCSRDTLKAAISSMISVTHVLTVMSHPLNAELPLYHFN

SEQ ID NO: 139251 - protein, 124 aa, Triticum aestivum
  Clone ID: PAT_TA_33669.pep
GNKKNNLIEVEGRQLCSVQFVLNFSPVLCTPLPRNLNPFHLEHFCCTPSVPKYRSLGLLFQPGEKLTIDLNTLPSKFESRSIVFHLRLRPPPPPTLPPSTSISTSTLTSALHLHLHLRPPSPPP

SEQ ID NO: 139252 - protein, 135 aa, Triticum aestivum
  Clone ID: PAT_TA_33670.pep
AWDWQLQAVEWQLQAFGNGMQRRLVVDQFDTKSALAETAVAKTGLGGYLPSIALLHRGLVGSMDHLHGLVNVDLLVASKHGQAEAELASSRTSSGIEESALEGIVFSTLVEPMTQLVSRPCEVRRDLVTAKRIPG

SEQ ID NO: 139253 - protein, 109 aa, Triticum aestivum
  Clone ID: PAT_TA_33671.pep
GGTQCVQEALKHRSHHHSAFTRLTLTSLAKDATFNSKYVNLSSTFPNASCRSKDTSLWKLFTYIHERAIQIQPVLEVGTTPNSFLNKIYLNYWGLRGPSEASSRIPLVA

SEQ ID NO: 139254 - protein, 75 aa, Triticum aestivum
  Clone ID: PAT_TA_33672.pep
SVVVSTVHTNDTCKPTRLRSAWLCLCFSCLISRACKLGIRLRVISRVEGSSSSARVLCVLQPKCIYMGFLFHFQK

SEQ ID NO: 139255 - protein, 142 aa, Triticum aestivum
  Clone ID: PAT_TA_33673.pep
MASMALAEILLFWEGTDHTTGTSLEASRTRDGEDTTSVFHILGRATYQACQEATETNPETMDGAFHPRKGMPWIPLGCVSAKGYRWMSQCSPMRREWPRKPYTITKQREKWTEEEHEKFLEALKLYGRSWRQIQEHIGTKTA

SEQ ID NO: 139256 - protein, 340 aa, Triticum aestivum
  unsure (1)..(340): unsure at all Xaa locations
  Clone ID: PAT_TA_33674.pep
GTRPRRARGRRRDAGRPTTPAALASSGAEREDRVGCVALPRVAPHPHLNVSVRNSTLRALTTTLGENRGSVFXPVKYVLMENDISLPVCFRLFDLFHILTTDPDTVTRIAKGVVGDFAAENVVYLEIRTTPKNNEAKGMTKRSYMNAVVKGLKSVEDVDVVLFDSNLRNDETPSSTPMTDLGGDRKGKKIYVRLLLSIDRRETTSAALDTVNLAMEMKDQGVIGIDLSGNPVVGEWETYLPALEYAKELGIPTTIHCGEVPNRKEIQAMLDFCPQRLGHVCCLXTSLSNEYYLVASTFGLSKAELFRLAQGAVEFVFAGDEVKKSLRAVFERAAAERIES

SEQ ID NO: 139257 - protein, 121 aa, Triticum aestivum
  Clone ID: PAT_TA_33675.pep
RNHSIGFSQQPSIDRLGLVTRSLQCNRSGSVRAQRLARVQLEPTPRTHARTCTRETRIARPPTSHRNRELPEIFLPLASTTVFPSWTAQRMSCSCVSGPPRMKSPFSVMIFCHRSRSPPHL

SEQ ID NO: 139258 - protein, 179 aa, Triticum aestivum
  unsure (1)..(179): unsure at all Xaa locations
  Clone ID: PAT_TA_33676.pep
VADGVDIVQNLRALEVKGSFIAXSLTSDGRYLISTGMDSNVYIWNFDNSSSASQKGEAKSVRSCEMFFSKDVTTAVPWPGVHPDRHVKPARLTEKSASVSPLRRHGGESRSPGTWFFADGMRGSVTWPEEKLTSAKPVNGPRLADCLSAISAAWNMVIVTASHGGVIRSFHNYGLPVTL

SEQ ID NO: 139259 - protein, 78 aa, Triticum aestivum
  Clone ID: PAT_TA_33677.pep
DSTWQSGRVDLNQTHCRHYYRVPHRPTTLPMGLKSDPCPNPPGNPTQSCTHRVKQRTTFFKFHWQQTLLSPRQKQSCA

SEQ ID NO: 139260 - protein, 97 aa, Triticum aestivum
  Clone ID: PAT_TA_33678.pep
LRGTESCDVLVPFATPGGHLFRANNITHSVSNLGATMLKYRLTPPPDEVYSLHRKLSGAFLACIKIGAVVPCREMLFKVYEQYDFSDDHLEVLSNTG

SEQ ID NO: 139261 - protein, 108 aa, Triticum aestivum
  Clone ID: PAT_TA_33679.pep
LHVPQATAARHDAVRRLASTSQPPSLSISILCTSLFEHFIHPCRLHPEQILPFAAPLLHTLEWCLCLLQPLRLQILGCQDADYVQSNRETRYVPCIEKNVQTYVFPRG

SEQ ID NO: 139262 - protein, 206 aa, Triticum aestivum
  unsure (1)..(206): unsure at all Xaa locations
  Clone ID: PAT_TA_33680.pep
MGEQGTSGSEGGGSMVEAQAPAKKGDGRAADPRLQGISDAIRVVPHFPKPGIMFNDITALLLRPGVFKDAVDMFVERYRGMXIAAVAGIEARGFIFGPAIALAIGAKFIPLRKPGKLPGAVISENYTLEYGTDCLEMHVGAVEPGDRVVVVDDLVATGGTLSAAIKLLERAAADVVECACLIGLPKFKDFYKLDGKPVYILVESKK

SEQ ID NO: 139263 - protein, 200 aa, Triticum aestivum
  unsure (1)..(200): unsure at all Xaa locations
  Clone ID: PAT_TA_33681.pep
MGEEANCDAVMEAGNGNGKAKENGHAVAAMPDVKADDAVVAPADPRLQGIXTPIRVVPHFPKPGIMFNDITTLLLRPRXFKDAVDMFVERYXGTGIAAVAGIEARGFIFGPAIALAVGAKFIPLRKPKKLPGXLISETYVLEYGTDXLEMHVGAIEPRERVLIVDDLXATGGTLCAAINLLERAGADVXECACLIGLPKL

SEQ ID NO: 139264 - protein, 208 aa, Triticum aestivum
  Clone ID: PAT_TA_33682.pep
MKRKNKEQRRADGITDRGSDSLETMRPNKKQRLGGGSGSDEETSPYLVVGHGSVSPAFSVFKVEPYTDGGGDTPVSIPRRLARLKCKHNMSFVPLRLKDRRWIVGVGGSSTENYYGPGTIIFDTEKQLVIRGPEPKSIKSHPILLPIDQKIYALSRSPSVKGPLDYLPWFEVLDLSQAQEVDGCLTNCKWSSLQRPPFFPWELTPRQY

SEQ ID NO: 139265 - protein, 232 aa, Triticum aestivum
  unsure (1)..(232): unsure at all Xaa locations
  Clone ID: PAT_TA_33683.pep
FSKXQLIFGGKSYYGALLCCTWSSDGKYLLTGGEDDLVQVWSMDDRKTVAWGEGHNSWVSGVAFDPYWSPPNADGTGENAVYRFGSVGQDTQLLLWDLAMDEIVVPLRHPSGGSPTFSSGSPSAHWDSACPPTGILQPSPRMRDVPKLSPLVAHRVHADLLSGVVFSTESIVTICREGLIKIWARPGHSENNQQSNSSELALSNTVSKDRAITSFSKASGSSFKQPSLLGLT

SEQ ID NO: 139266 - protein, 165 aa, Triticum aestivum
  unsure (1)..(165): unsure at all Xaa locations
  Clone ID: PAT_TA_33684.pep
SKHEPTHNSVSLILLGCTASTSSTTFSRSTQEGPPVMAAAAASPSTPWHSLHLFPLSPPSITPGWRSNSSLLDIAAXSMPTRTRSKLLAXVYWXAXKGNNRXGPRXRCLQRRVQPHAXGXHSLVQXTLWXTVSXVPLXPQESGXXGXDGXXRVLXFVQESFHCNQ

SEQ ID NO: 139267 - protein, 96 aa, Triticum aestivum
  unsure (1)..(96): unsure at all Xaa locations
  Clone ID: PAT_TA_33685.pep
GWFKSSWLCHHLLSWGLPAKEELEIFXSRMSKKTIYSRAALRDAWNTDPDYLYPEIQAWIQDKYQSQLGAIWEQMHQEVRLEGRELFPKRFKKVKG

SEQ ID NO: 139268 - protein, 199 aa, Triticum aestivum
  Clone ID: PAT_TA_33686.pep
GSSESEACNRVADPAIHNLLLTEKPMSIAAAVTGTATAAVHAPVHHAPHHASTQRTAPRREQSPLNPSSQALRAAGSGASPAADGVRTHIANLDRVLGKPPRTPSQAGPPSSKQEQESEQEPLNIRHGLLNALNLSFFVPMPGMRARMAADEHMSPRSLMHMQQLLSADSPRASPESTIAPRWRALHGEGGWAGLLDPL

SEQ ID NO: 139269 - protein, 111 aa, Triticum aestivum
  Clone ID: PAT_TA_33687.pep
DVLFGFILHEGVHLHLAGLPSGSWRNSPGDFFLEWVDKHIDTFRGQEQNGAHVTLVKLCVAKNYDWKRIGFQTVPKTHIILDLLVDLQCLFSGFYSGFFNVPYSVILSVLS

SEQ ID NO: 139270 - protein, 244 aa, Triticum aestivum
  Clone ID: PAT_TA_33688.pep
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAIARVDMAGRDLTDYLMKILAERGYTFSTTAEREIVRDIKEKLCYVALDFEQEIQTAAQSSSLEKSYELPD

SEQ ID NO: 139271 - protein, 375 aa, Triticum aestivum
  Clone ID: PAT_TA_33689.pep
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAIARVDMAGRDLTDYLMKILAERGYTFSTTAEREIVRDIKEKLCYVALDFEQEIQTAAQSSSLEKSYELPDGQVITIGNERFRAPEALFQPSVLGLESGGIHVTTFNSIMKCDVDVRKDLYGNIVMSGGTTMYPGLSDRMQKEITALAPSSMKVKIIAPPERKYSVWIGGSILASLSTFQQMWISKQEYDESGPSIVHRKCF

SEQ ID NO: 139272 - protein, 234 aa, Triticum aestivum
  unsure (1)..(234): unsure at all Xaa locations
  Clone ID: PAT_TA_33690.pep
MRPMHLLGVTCLWILSCALLLGGACSDGLLRINLSKKRLDKETLAAAKSARQETNLLRSGDGSRHSPGLSGDDTVPLDNYLDTQYFGEIGVGTPPQNFTVIFDTGSSNLWVPSSKCYFSIACYLHHKYKSTKSTTYKKNGETCTISYGSGSIAGFFSEDSVLVGELVVKNQKFIETTREASPTFIIGKVDGILGLXGFPEISVGXAPPICQSMQEQKLIEKDIFSFXLNRDPDA

SEQ ID NO: 139273 - protein, 498 aa, Triticum aestivum
  unsure (1)..(498): unsure at all Xaa locations
  Clone ID: PAT_TA_33691.pep
MRPMHLLGVTCLWILSCALLLGGACSDGLLRINLSKKRLDKETLAAAKSARQETNLLRPDDGSRHSLGLSDDDIVPLDNYLDTQYFGEIGVGTPPQNFTVIFDTGSSNLWVPSSKCYFSIACYLHHKYKSTKSTTYKKNGETCTISYGSGSIAGFFSDGAVWADQLDQWVHGVSASSREASPTWILGDVFMGAYHTVFDFGESRIGFXNPREDLVYQGSGPVLYILQARASCKVNNKLIRSISRKEQMNXATSICIAICYVWLDMDLQTAHTMTRHEVDVXAHSGSSLLAGPTTIVAQVNHAIGAEGIISTELAWSRPRYGEMILELLVAQTRPQKVCSQIGLCVFDGSHSVSNQIESVVNKNEKRGSDLLCTACEMTVVWIQNQLRKNQTKELILDYANRLCERLPSPNGESTVDCHQISEMPDLAFTIANKTFTLTPEQYVVKLEQSGQAICISGFMAFDVPPPRGPLWILGDVFMGAYHTVFDFGESRIGFAKSA

SEQ ID NO: 139274 - protein, 112 aa, Triticum aestivum
  Clone ID: PAT_TA_33692.pep
MKEDIGHRASGPAMLDLFVPAVGETREQTCAVCLEDFLEGGKKLKRMPCYHSFHQRCMFNWLRFNRRCPVCRFAMTSVEEQRALDQAKAEAAATCGDGPEAAKRRRLDPATD

SEQ ID NO: 139275 - protein, 152 aa, Triticum aestivum
  Clone ID: PAT_TA_33693.pep
EFKLSINEYLANLSYSPVHSLAGIIAFNKAHPIEERLKDFGQQNLILAQNTNGIGHVERAWIRLLKKLSANGLEKMMKEQQLDAIVAPEHYASNHLAIGGHPGIVVPAGYNEKGVPFGICFGGLQGYEPRLIEMAYAFEQATEVRRPPMFKP

SEQ ID NO: 139276 - protein, 127 aa, Triticum aestivum
  Clone ID: PAT_TA_33694.pep
MRRPAMGRAMGAALVLAVLAVAAATAGAVDGDVKCAECGTGTVPVLPPPPPYYYYSPPPPASYSGVSNCPPPPGGYIQIGGSGPGKGRMYPQDPGFMPSSAPPRHGSSAVHITVCSFAALAVLRAFW

SEQ ID NO: 139277 - protein, 231 aa, Triticum aestivum
  Clone ID: PAT_TA_33695.pep
RPPTRPFKRKKLIRLWVAEGFVKGRGESTMEEVAEGYLEELVHRNMLQVDTRNPFGRIKSFRMHDIVRELAVDLCRRECFGVVYDQDEHMESLDETDARRLVIHKMKKDIYQSVSGVHRLRSVIALDINIPSSTLLPLIAKKSRYMSVLELSGLPIGKVPDGIGDLFNLRYLGLRGSKVKLLPRSLEKLSSLLTLDLSGSGMKELPRGIGELKKLRQLFTDKARDRFTTDF

SEQ ID NO: 139278 - protein, 212 aa, Triticum aestivum
  Clone ID: PAT_TA_33696.pep
GTRAEEELASDNDLEAENKKQKAVTELSASVKSEPLTTRRRALQSWMDGNSNSTIEFPDGLPAASSRSKKEKLSDAEMLAKKAEAAQRRKMQVEKATKESEAEAIRKILGLDTEKKKEERKQKEREEKEKAARAQELARSSIRWVMGPTGTVVTFPEEVGLPSIFNSKPCSYPPPREKCAGPSCTNAYRYRDSKLKLPLCSLECYKAVRGSA

SEQ ID NO: 139279 - protein, 190 aa, Triticum aestivum
  unsure (1)..(190): unsure at all Xaa locations
  Clone ID: PAT_TA_33697.pep
MEKRKKAEEDEEQKQPPAAESLWGGDLLPEILREILSRVPYRSLCRFRCVSTAWLALCADPAVRRRSPQTLSGFFCYSQHDVGGGQRRDGVGFLNLSGWGRPLVDDPSLSFVRVRGYRHVTPIHCCSGILICYCWKFDMSDEADFVVCNPATKEIWAALPVPQNEMMTRLNTXXLCFDXAIPRRFKVFVS

SEQ ID NO: 139280 - protein, 128 aa, Triticum aestivum
  Clone ID: PAT_TA_33698.pep
IRPGRPSRAIWYSTAVQKNHSLPSNLAGGGGAFPPIPNKIPRRCPRGSAFVCSSARGTTAGRRALAPLFLVAPLLLAGEPSRWVIFSYKLHLRVATPPSTLHGCGTQCVASATRRRPSLRLTTTIKRH

SEQ ID NO: 139281 - protein, 110 aa, Triticum aestivum
  Clone ID: PAT_TA_33699.pep
RNQSGHKPSDPSHRLMGQRLSASISSDHVNPHPRFVLLWEQQPNTASRCRPTVAVLQHNIAGSHCSDAACHNADTHSGAKLHCSVAVLNLSHRQQQHPLHGNIAGSSTRF

SEQ ID NO: 139282 - protein, 504 aa, Triticum aestivum
  Clone ID: PAT_TA_33700.pep
MEVWSIRAAQLLLFFFLLSERHGSCAALGEEGRVMSFREEHPSGWLWNLGQKKVFSAAATRLVKGNKLSIEIPNELQERIMISEVLTDGRQQPCRKCLTKTIRSTTLRQLLQARGLQESAPSSKATDQHPMSSPPSHSQAETNDSSSVLHWVIYALCVSGALGLVIIASVVYLLVSRRKKDNTVNPWATGLSGQLRKAFVTGVPSLGRAELEAACENFSNVIGTVSDSALYKGTLSSGVEIAVASSPVKSAKEWSDRSEEQFRNKISELSKVNHKNFMNLLGYCTGAAPVTRMMVFEYAPCGSLFEHLHVREAEHLDWPTRLRIIMGVTYCLEHMNQLDPPVTPRTLNSSSIYLTEDYAAKFSDTEFWKDDDADASAPTRSAGQDSIVYKFGILLLEVISGRLPFSEDHGLLVLWASSYLDGKRPIGSMADPVLRASSPVPEEDLAALCDVVRLCINREAAKRPSMGEVAGLMKGAVRLSPEQTTPRNNPLWWAELEIMSTAST

SEQ ID NO: 139283 - protein, 50 aa, Triticum aestivum
  Clone ID: PAT_TA_33701.pep
SWVDLSLRKISHLIDVGWPSVWVRIATQWATAGLFIWSLVAPLLFPDREF

SEQ ID NO: 139284 - protein, 413 aa, Triticum aestivum
  Clone ID: PAT_TA_33702.pep
MWAASCLASCCAACACEACRTAVGSIGRRSARIAYCGLFALSLLASWVLREVAAPLLQSIPWINHFHKTPDREWFETDAVLRVSLGNFLFFTILAAIMAGIKDQKDPRDKVHHGGWMAKIFCWVVIVFLMFFVPNGVVSFYESISKFGSGLFLLVQVVLLLDFVHGWNENWVAKDEQFWYMALLVVSVVCYIGSFAFSGLLFHWFTPSGQDCGLNMFFIVSTLILVFVFAIVALHPKVNGSLLPASVIGLYCTYLCYSGLSSEPRDYECNGLHNHSKAMSTGSLTLGLCTTILSVVYSAVRAGSSATVLSAPDSPHAGSDKPLLPFSKADEEETKDVPKPVTYSYSFFHLIFSLASMYSAMLLTGWSTSVGESGKLVDVGWPSVWVRIATQWATAGLFIWSLVAPLLFPDREF

SEQ ID NO: 139285 - protein, 89 aa, Triticum aestivum
  Clone ID: PAT_TA_33703.pep
MKHIFKIIAVLAAISAVWVALLETSTVPRSFTWLLPIYLVVALGCYGLFMVGYGLMFFPTCPQEAVLLQQDIVEAKEFLSKRGVDVSSD

SEQ ID NO: 139286 - protein, 488 aa, Triticum aestivum
  Clone ID: PAT_TA_33704.pep
MVVANGNVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARGQKIPLFSAAGLPHNEIAAQICRQAGLVKRKEKTDNILENAEEDNFAIVFAAMGVNMETAQFFKRDFEENGSMERVTLFLNLANDPTIERIITPRIALTTAEYLAYECGKHVLVILTDMSSYADALREVSAAREEVPGRRGYPGYMYTDLATIYERAGRIEGRKGSITQIPILTMPNDDITHPTPDLTGYITEGQIYIDRQLHNRQIYPPINVLPSLSRLMKSAIGEGMTRRDHSDVSNQLYANYAIGKDVQAMKAVVGEEALSSEDLLYLEFLDKFERKFVAQGAYDTRNIFQSLDLAWTLLRIFPRELLHRIPAKTLDQFYSRDASH

SEQ ID NO: 139287 - protein, 182 aa, Triticum aestivum
  Clone ID: PAT_TA_33705.pep
SFRIPAALFLTCHIYHLMEYKECGLSVRAWWNNHRMQRITSASAWLLAFLTVILKTLGLSETVFEVTRKESSTSSDGGAGTDEADPGLFTFDSAPVFIPVTVLSMLNIVALAVAAWRAVVGAAAGVHGGPGIGEFVCCGWIVLCFWPFVRGLVSRGKYGIPWSVRVKAGLIVAAFVHICTRN

SEQ ID NO: 139288 - protein, 346 aa, Triticum aestivum
  Clone ID: PAT_TA_33706.pep
AARGGRPSLAATAAARHRGLMLPDRSYRPTRSLFATSALSMPPWAKRPNTPEWLTQQSNWIGYVAVCESEREVARMGRRDIAIVLRGTATCLEWTENLRASLVPLDGEAGEGKQAGPEDPKVARGFRSLYKTAGEEVKSLSEDVMDEVRRLMEKYKGEELSITIVGHSLGGALALLVADEIATTVPDAPPVAVVSFGGPKVGNAAFVDKLKQSGKVNVLRIVNAGDMVTKVPGVAPRLPLSKEQYQHVGAELRIDSKNSPCLRPDVGPASRHDLEAYLHLIDGFTATGHPFRYDARRSVIRLLQLQKGNVKKEYVNRARELGVDPAAPADVGRSMAYGNCPVASPS

SEQ ID NO: 139289 - protein, 87 aa, Triticum aestivum
  Clone ID: PAT_TA_33707.pep
WQRRVPGKPWRLKLACILLQLCKCHPRSRAKVPLTPQPTRPITELSAAALHHATGTRIIVVSRRLASIRCTHRSSLSPSRRAFPNRR

SEQ ID NO: 139290 - protein, 175 aa, Triticum aestivum
  Clone ID: PAT_TA_33708.pep
VYVWNYGCIQIVKERVGVGGTGARPRRRRGRVRDLDAGPRRPPPPPRPPPPPPPLPQCLRRLRGLGQLRWQPAGVCYVTYASPFVNLKLLCGGEVVLILLPFFLVNEDSPMEGALPLPGCSANDQILAEKGIITKNNMLVLCPPMLSVPAQILILHLFLRPSSHRRVCSQLFLSL

SEQ ID NO: 139291 - protein, 242 aa, Triticum aestivum
  unsure (1)..(242): unsure at all Xaa locations
  Clone ID: PAT_TA_33709.pep
MVKGAVRYEPGPAFQESGEQGKLEIPASGSTEFWLIQWPLNHVNASDFNGQEVSLNKHHDDGNLGNLESSSGKSYELVSFAAQQPDATVFIPSGSEMKAVGKISRRVCLVRYPEPEELEKEKPSFGSLTPGSRRPAGSSRKTMSRFSGLSKNRSSQGSALSLGQENRSSQGSALSQGQQSVEPTPKHKQKRRDESSLGGHSNVSAKSSEGSQARGAGSNTTXEMLQTPVEKSKKKKRVRIEE

SEQ ID NO: 139292 - protein, 384 aa, Triticum aestivum
  Clone ID: PAT_TA_33710.pep
FCGAYEDKGSVHVVMELCAGGELFDRIIAKGHYSERAAATICRGVVNVVNVCHFMGVMHRDLKPENFLLATKDENAVLKATDFGLSVVIEEGKMYKDIVGSAYCVAPEVRRRNYGKEIDVWSAGVILYILLSGVPPFWAETEKGIFDAILQGEIDFESQPWPSISESAKDLVRKMLAQDPKKRISSAQVLQHPWLREGEASDKPIDSAVLSRMKQFRAMNKLKKMALKVIASNLNEEEIKGLKQMFMNMDTDNSGTITYEELKAGLAKLGSKLSEAEVKQLMDAADVDGNGSIDYVEFITATMHRHKLERDEHLFKAFQYFDKDNSGFITRDELETALIEHEMGDADTIKDIISEVDTDNDGRINYEEFCAMMRGGMQQPIRLK

SEQ ID NO: 139293 - protein, 340 aa, Triticum aestivum
  Clone ID: PAT_TA_33711.pep
MHRPAPPSPRAFLGPPPSPPAPSPAPPPGSGGAAASAPPGQTTHAGCGAASGGGAFFIMESQQQQQQMEAVSAPAASTNGGGELIGYVDVHVRSARDIQNICIYHKQDVYARLSLPGEGAPAASTQVINGGGRNPVFDQSVRVGVRAGDVDAALRCEVWMLSRVKNYLQDQLLGFALVPLPDVVAAEGGTLAREFPLSTNDLFHSPAGFLELELSYIGVVPDVIPVSPTPKPALADPDESENAGGGAGAGAGKDYENMEFPDMNLVEENQIMLSEYVGLPCTAMETQSSESLLTSEDVDGAATESHDAGVRVVQSFSTDYSTADSAGAFRSETAVSSVST

SEQ ID NO: 139294 - protein, 111 aa, Triticum aestivum
  Clone ID: PAT_TA_33712.pep
DSGHGAYSLLKLRLEKLHIPEQLVEVHVSPEAASGGVAVVAGKLAPGVPRRVAAGRRSGERGRREGLCRPLHPFRRLSRRALLLLLFLAQGSRRLLICADEDSGGLGAGVP

SEQ ID NO: 139295 - protein, 101 aa, Triticum aestivum
  Clone ID: PAT_TA_33713.pep
CRLLVWVLEDHASGLWTLKCTASILELLGSPCRAPNEFYQAVAIHPDCNLIFLEDAGQEALLMSYNMDTGKLDIVCSLGDRWAQRFHPYIPCFVEKPPVPQ

SEQ ID NO: 139296 - protein, 445 aa, Triticum aestivum
  unsure (1)..(445): unsure at all Xaa locations
  Clone ID: PAT_TA_33714.pep
MDEFELEDNLEFILQSIQELIEDQGDNNPFGEVNQNELLANLVNYDQDNLMPDVSVEDVVNGKDVQGIPWEKMLFPRDQYREMKMKGYKNYQNLSYAREDALQDCKQVERDGPYYDFQYNTRRARLSIVHFQLRNLVWATTKHDVYTVHNQSMTHWSSLNQISTELINGDDCIIPKQRGHGSQSVSMVQFTTMAVDNDFLXVVGGFHGELICKRLEDDGIVFSTRVTDDENAITNSLEIYQDPNGSRRLVVANNDCSVRIFDTKYFDLLNHYVFPWSVNSVSVNPDATLFAVLGDHEDGLVVDPKCGKPIGKVRGHLDYSFSSAWHPDGNILATGSQDTTCRLWDIRNLSQSLAVLXGRLGSIRCIKFSSDGRFLATAEPIDFVHIYDCFADYGKSHEIDFFGEIAGLSFSPDTEAFYIGVADQTYGGLMEFKRRHQHHYLNCLW

SEQ ID NO: 139297 - protein, 235 aa, Triticum aestivum
  Clone ID: PAT_TA_33715.pep
MESSCKKRSKGALQSESEHEIEVKQEILENDEASEQEQTYTESASVAPSGMDHRGENNNKGAEESIRNYGKHVSDPVNTGCQPSKFGRPSTEEVRRIHSGSISVYLKDITVYQERIRSDPSKSTHVNNAGYYSRHGALEPVSVSKDIKVPLHDNGRVCGRDGALELVTGPPEETPRWRQEQYALNILEDVQNARIAEKTRMEMEIRILKAQIASMQRQVMNMDHVGEVISRSKRH

SEQ ID NO: 139298 - protein, 262 aa, Triticum aestivum
  Clone ID: PAT_TA_33716.pep
MATGGAPKPEEETVVFPDWVMLERIFRKRCHDDLDAAGEAVNKNKTAAPVKIDSGHSCFVSFTLAAPPGSSYFNLHWPERQGSEELLAFVRAVDKNLVLFDISIPDRIRYFDAPPDLFVYTASAPPPPVQQLPRRSTKQFLAHQFTTGILQLKAEHCYIVADLNVHLKKEGASAELCVFNSGATDWRIITEVLADKLPDLWFTDDVFAFDGRFLCWVDYFSGVVLCDFSKNVDSQVLHFVPFPGGIKYPDDARFPRYVRPKA

SEQ ID NO: 139299 - protein, 392 aa, Triticum aestivum
  unsure (1)..(392): unsure at all Xaa locations
  Clone ID: PAT_TA_33717.pep
MRPSLCHVPFLLLLLLHVVIARPFFPLPSKTSNEEKKPIQTFRPYNIAHRGSNGEIPEETSAAYLRAIEEGADFIETDILASKDGALICFHDVTLDDTTDISGRKEFANRRRTYEVEWANVTGWFVVDFTLEELKTLKVKQRYSFRDQQYNGKFSIITFEEFISVALDASRTVGIYPEIKDPVFINKHVKWADGKKFEDKFVDTLLKYGYRGQYMSENWLKQPLFIQSFAPSSLVHVSNLTDSPKIFLIDDTTVRTQDTNQSYGEITSXDDYLAYISNYVVGLGPWKDTIVPVAKNYLLEPTDLVARAHAHNLQVHPYTYRNENQFLHFDFHQDPYAEFDFWINTMGVDGLFTDFAGSIHKYQELKSPHPKDATANSLLVKIAQLIAAYEGH

SEQ ID NO: 139300 - protein, 118 aa, Triticum aestivum
  Clone ID: PAT_TA_33718.pep
MLPLHQCHCGVKAIGFSTPTDDPLTLGLRGDLDGSRCSTGDAGELGALVVVIAVCKDVRYLDVHHRTTTVSELQYCVFKCENVDGPTVDVGMAYVWWSTLRVCCLQTTCLLLGAALVM

SEQ ID NO: 139301 - protein, 263 aa, Triticum aestivum
  Clone ID: PAT_TA_33719.pep
GRPTRPELRELEKNKKGDQAAVGPVELSSPNKGNSHISLPEVEVAEKSSPGNKTVGTAIPFSPSDIKKTYKDATLPTHWKAFDTVIFREQDDGLHASAKIAAFDFDGCLAKTSVKIIGADKWSLQHKSIPDKLQSLYNDGYKLVIFTNESNIERWKNKRQQAVDSKVGRLDNFIECVKVPIQVFIACGTGKGKGTPDDLFRKPNSGMWWLMAEHFNSGIAIDMDQSFYVGDAAGRENDHSDADIEFAKAIGLKFHVPEEFFGP

SEQ ID NO: 139302 - protein, 78 aa, Triticum aestivum
  Clone ID: PAT_TA_33720.pep
MGLWSFLEGVLLIANALAILNEDRFLSPRGWSFADARGVQGANTFKGQMIGLIYAAQYMRFPLILLNGITILVKFVSF

SEQ ID NO: 139303 - protein, 176 aa, Triticum aestivum
  Clone ID: PAT_TA_33721.pep
MASSGGHTVPLLARLPAEAAEAYTTDGTLDFDGNPALKNRTGGWRACRAVLGTEFCYCLAFYGISYNLVTYLTGVLGQSNVAAARNVSTWQATCFLMPLGGAVVADSYCGRYRTMVVSCFIGVAGMLMTAFSAYLPLLVENGVSFRGLTSSNMVSVQEFVLFLGLYMIAVGLGGLR

SEQ ID NO: 139304 - protein, 370 aa, Triticum aestivum
  unsure (1)..(370): unsure at all Xaa locations
  Clone ID: PAT_TA_33722.pep
MATMRAAAALPGAVVLLCALRHGGAQRYDAIYSFGDSISDTGNLCSGGCTSWLTTGQSPYGETFFKRPTGRCSDGRVIVDFLAEHFGLPLLPASKATVTGTDFKKGANMAIIGATTTDFRLFQSXSDLAPRIWNNGPLDTQIQWFRKLLPSACGKGGDCKSHLSKALLVVAEFGGNGYNAAPCSGWAMTVLAGYGPRVVSHFVRGLEAIIALRPMDVVVPGVLPIGCFPIYLTLYGTSNAGDYDGDGCLKSYNELSAHHNSLLRRSLANLQRTYPRTRIMYADFYAQVIQMIRAPQNFGLKYGLKVCCGAGGQGKYNYNNKARCGMSGASACADPQNYLIWDGIHLTEAAYRSIANGWLKGPYCSPRILH

SEQ ID NO: 139305 - protein, 101 aa, Triticum aestivum
  Clone ID: PAT_TA_33723.pep
MSGVTADEDKKPAGDGGGAHINLKVKGQDGNEVFFRIKRSTQLKKLMNAYCDRQSVDLNSIAFLFDGRRLRGEQTPDELEMEEGDEIDAMLHQTGGGFPRP

SEQ ID NO: 139306 - protein, 78 aa, Triticum aestivum
  Clone ID: PAT_TA_33724.pep
NHAALRSNKIRNPIDNIYLQQNCVSRKTICKVHSKVENGVIKVCSHETSSNTSALSSIQVTCEGLPSICLILDPEMSS

SEQ ID NO: 139307 - protein, 101 aa, Triticum aestivum; identical to SEQ ID NO: 139305
  Clone ID: PAT_TA_33725.pep

SEQ ID NO: 139308 - protein, 162 aa, Triticum aestivum
  Clone ID: PAT_TA_33726.pep
SDLRSRQTAGFCCVNIITALYFEACRTYACCLGSVSGWIPAGEVRRYLDEKSRCCSHDRCKFVGSYEQLREHARTAHLLAKPALVDISRKRSWDRLEREQEFGDVISAIRSQNPGAVIVGDYVIETRDAMSPDEDSGEESGDDWWAPAQDQVESPDNRHRAP

SEQ ID NO: 139309 - protein, 255 aa, Triticum aestivum
  Clone ID: PAT_TA_33727.pep
MAVRVWLSAILLAFLLAASPFAQVARAQSEEDAAMQEVVDGADLGYVGDDTPVSSEEPLSPAPGVETVCVFPKNAGKIVPAGEETELLVGLQNEGESTLNVVAVHSTLHLPYDHKMYGQNLTVQSFYNASVPVSVQATFPYTFAVSKFLQPGAYDLVGYIVYEIDQHPYQNVFYNGTIEVVEVGGLLSVESVFLITLGIALLGLLGLWAYGQVQQLSKKTKKGPKVELGTGTTDANMDEWLEGTAFAKDKAKKNK

SEQ ID NO: 139310 - protein, 191 aa, Triticum aestivum
  unsure (1)..(191): unsure at all Xaa locations
  Clone ID: PAT_TA_33728.pep
MSGSTLWTHENPPAPVAHAPGRCPAGGVVRRGGARGLTTRAIGSWPPLNFAMVPPQHLPPPVPPAPLHCVPLTGPEPAIHWVLLERAVPRLHQFGIEGGKEPFVEIPEERXRKALKVVQNVRNQPLLIHCKRGKHRTGCVVGCMRKLQKWCLSSVFDEYQRFAAAKVRSTDLRFMELFDVSSLKHLTNSHC

SEQ ID NO: 139311 - protein, 358 aa, Triticum aestivum
  Clone ID: PAT_TA_33729.pep
MATALVAGALRRGRSGARGAAERTLRRLVSTLVVAEHEGGLVKPSSLSALAAAEAIAKENKVSLLLGGSGPTLHKAAEHAASSHPLVNEVLVADSDVFAHPLAEPWAELLRSVQQKGGYSHVIASSTSFGKNLLPRAAALLDVSPVTDVTAISEPRVFVRPIYAGNALCTVRYTGESPCMMSIRSTSFSPATESVSETKVAPITQVDLSFLSEASSRKSSWVNLTSQDTERPDLANARVVITGGRGLKSAENFKLLEQLAEKLGAAVGATRAAVDAGYVPNELQVGQTGKIVAPELYIAFGVSGAIQHLAGMRDSKYIVAVNKDADAPIFQGRGITGIVWGSVSQVLEELLEKIPDKK

SEQ ID NO: 139312 - protein, 204 aa, Triticum aestivum
  Clone ID: PAT_TA_33730.pep
IFFYTAHIHILFTQPFISVLPHCTPRSAPRGAPHVALRNGTWSGSSATSNRTAPRSAPLPFREGRRGCRAGRAGLRLRVRPCAATRRRRPPPSPTRSVPSGSSAGPPPNYTTMRPVLHAWPTELHMCSAPHRRIAFTALGQGTKIALLFLLGEECRSADCTWHVTKLHDQGTGQPLSYTTTTTRVHHSNYPECTALLPSSPARS

SEQ ID NO: 139313 - protein, 166 aa, Triticum aestivum
  Clone ID: PAT_TA_33731.pep
ARRLTGREKGISELQRIGAGLTMPVLAMAAAALLETVRLRAAKAAGLAPCSTSVLWQAPQYVLVGVGEVLTTIGQLDFFYGQAPAAMKTVCTALALLAVAAGGYLSSVLLTAVQWATTTGGAPGWIPDDLNEGHLDRFFWMMSGLGCLNLIAFASCAMRYKSRKGC

SEQ ID NO: 139314 - protein, 227 aa, Triticum aestivum
  unsure (1)..(227): unsure at all Xaa locations
  Clone ID: PAT_TA_33732.pep
MARKKIREYDSKRLLKEHLKRLAGIDLQILSAQVTQSTDFTELSNQEPWLSSMKLVVKPDMLFGKRGKSGLVALNLDLAQVRQFVKERLGVEVEMGGCKAPITTFIVEPFVPHDQEYYLSIMSDRLGCTISFSECGGIEIEENWDKVKTIFLPTEKPMTLDACAPLIATLPLEVRTKIGDFIRGSFSVFKDLDFSXFMEMNPFTLXVNGEPYPLGXMEXELDDTAAF

SEQ ID NO: 139315 - protein, 160 aa, Triticum aestivum
  unsure (1)..(160): unsure at all Xaa locations
  Clone ID: PAT_TA_33733.pep
VLNPKGXRIWTMVAGGGASVIYADTVGDLGYASELGNYAEYSGAPNQEEVLQYARVVLDCVTADPDGRKRALLIGGGIANFTDVAATFSGIIQALREKESKLKASRMHLYVRRGGPNYQTGLAKMRKLGAEIGVPIEVYGPEETMTGICKQAIECIMAAS

SEQ ID NO: 139316 - protein, 428 aa, Triticum aestivum
  unsure (1)..(428): unsure at all Xaa locations
  Clone ID: PAT_TA_33734.pep
MARKKIREYDSKRLLKEHLKRLAGIDLHILSAQVTQLTDFAELVNQHPWLSTTKLVVKPDMLFGKRGKSGLVALNLDVAQVKEFVKERLGVEVEMGGCKAPITTFIVEPFVPHDQEXYYLSVVSERLGSTISFSECGDIEIEEDWDKVNTIFLPKGNPMTPDXCCPLIATLPLEXIGDFIRGSFSVFHDLAFXSLMEMNPFTLXVNGEPYPLXDMRGELDDTAAFKNFXKWGDIEFPLPFGRVLSPSESYIHELDEKTSASLKFTVLNPKGRRXTMVAGGGASVIYADTVGDLGICFXLGNYAEYSGAPKEEEVLHYASGVVVCATADPDGRKRALLIGGGIANFXTNVAATFXGIIRALREKXESKLKAARCEHMFVAGCGPNYQTGPHAKACSKGSELGLPIEVYGPEASMTGICKQAIDCVMAEA

SEQ ID NO: 139317 - protein, 301 aa, Triticum aestivum
  unsure (1)..(301): unsure at all Xaa locations
  Clone ID: PAT_TA_33735.pep
MLPYATAGEAEAALGRALTWAEAAWLRYSASVPDRYLHWPNIAITLVVYTLAPLPLALFDLAAPAAAAPYKLQPKVQHPPATFLRCYMDXVRVSLLIIGPYKLISYLAANYMDIRTGLPLPLGGEISAQLTVYFLVEXYLNYWLHRLLHTKWGYEKIHHVYHEFTAPMAYAAWYGHWAEMLILXVPSLAGPALVPCHVTTLWIWFAARLVESLNIHSGFKLPFNAEKYIPFYGGAEHHDYHHYIGGQSKSNFAPVFTYCDYIYGTDKGYRYHKATLAKLKELAGSDVQKGVDNGFNNGKQD

SEQ ID NO: 139318 - protein, 112 aa, Triticum aestivum
  Clone ID: PAT_TA_33736.pep
MSTSELATSYAALILADDGVDITADKLQSLIKAAKIEEVEPIWTTLFAKALEGKDVKDLLLNVGSGGGAASAPAAGGAGGAAAGGADAPAEEEKKEEEKEESDDDMGFGLFD

SEQ ID NO: 139319 - protein, 310 aa, Triticum aestivum
  unsure (1)..(310): unsure at all Xaa locations
  Clone ID: PAT_TA_33737.pep
EPRHNSLGGVYRVVPSXPLSPAATSNAVPDIVPTDPGAGEAEDDRGEDIAEEDAVCPSCMVELSEGGGAIDPCGSCRGELALAHTFCALKWFGIKGTRLXYLCKWEVQNLPVTLLDVQIPRGGGDASRARWTGPRHVRYRLWHGTPILVVISILAYFCFLEQLLVAHNGFAALAISLPFSCILGLFSSLTTTSMVARRYVWIYAAIQFLFVVFFTHLFYRYLHLQAVISIILATFAGFGVGMIGNSIIIEVLRWRTMAPAQPRHARRPPRVAQQQQTAPASGEPSGQPSAADEIQRNASGDVENPTVPQA

SEQ ID NO: 139320 - protein, 113 aa, Triticum aestivum
  Clone ID: PAT_TA_33738.pep
HVYFLNAFFSSHVCLIFPTYVSHVSRRRQAKGRPVQLCCKFYKQHNLQRSSHCAVQETWLVSESYKRSNTNFFCIRSREMNNFIAIVVLRLEVKICIGDHCLSWCCGRSDMEI

SEQ ID NO: 139321 - protein, 85 aa, Triticum aestivum
  Clone ID: PAT_TA_33739.pep
ATAMEVSSSALSRKLLLLRSAHKFSPTSLREQGVYHLKYVISETITTSWSSLNSMCKICGCNMSPLRFLPKRTHIDNLDCTQKDH

SEQ ID NO: 139322 - protein, 91 aa, Triticum aestivum
  Clone ID: PAT_TA_33740.pep
TSALQNFLKILLDRYSASVRIWGCNIGGLHLRPVCLDTGKSHPRTLYACRPPHFIDMRNRTTELLHQAKITLRLGPFRPQKTHDILHGKSG

SEQ ID NO: 139323 - protein, 207 aa, Triticum aestivum
  Clone ID: PAT_TA_33741.pep
KPQQSHNFKAGAMNVLTRVSAVMTNAPIMLNVDCDMFANNPQVALHAMCLLLGFDDEIHSGFVQAPHKFYGGLKDDPFGNQMQVITKEIGGGLAGIQGTFYGGTGCFHRNKVIYGMPPPDTVKHESRCSPSYKELQAKFGSSKELIESSNNIIACVLLARPTVDISSPVEMAKQVGDCNYEAGTCWGQEIGWVYGSMTEDILTGQRI

SEQ ID NO: 139324 - protein, 235 aa, Triticum aestivum
  Clone ID: PAT_TA_33742.pep
MGRPGGEDGDGSDVGDGAPPAAPHRSATANGPADNMQAEARRQYHECLRNHAAAAGGHVLDGCCEFMPASPEDPLACAACGCHRSFHRRDPSPRRAHLPLLAASARAPLLLPPAASKHPHQRLPFPYGLAASGGTGTTTESSSEERRGASPAPRKRSRTTFTREQKEQMLAFAERVGWRLQRQDEAMVGHFCAQAGVRRQALKVWMHNNKQSSSGRRQQQEKQQLQEHRQEQQQQ

SEQ ID NO: 139325 - protein, 169 aa, Triticum aestivum
  unsure (1)..(169): unsure at all Xaa locations
  Clone ID: PAT_TA_33743.pep
MRGLTRAGKRASEMAFNAGGGAINWFPGHMAAASRAIRDRLKLADLVIEVRDARIPLSSANEDLQPVLAAKRRILALNKKDLANPNIMNMWLDHFQSCKQDCISLNAHSSNSINQLLGLVELKLREAILKEPTLLVXVVGVPNVGKSALINSIHRIANSRFPGMANISI

SEQ ID NO: 139326 - protein, 252 aa, Triticum aestivum
  Clone ID: PAT_TA_33744.pep
MRVFGLLALAGAALLLAAAVPASGSVASIVTRDTFYSMLRQGHHGGGDGGCDGGAFFYSYYAFVEAASTFRGFGTTGDQATRRRELAAFFAQTSHETTGYCWVKQRSPAGDQYYGRGPMQLTHEHNYRRAGDALGLDLVRRPDLVSTDPVVAFKTAIWFWMTPRHGAHKTPSCHAVMTGGWRPSRRDRRAGRLPGYGMTTNIISGGLACGKRHGTPQGRDRVGYYKRCCRLPRVRLGRNVACINQKPYGHGG

SEQ ID NO: 139327 - protein, 90 aa, Triticum aestivum
  Clone ID: PAT_TA_33745.pep
GTACLSSASYELNFCINLMHQFSLHFVTVENCPVLILKLRMGLAACSGVSPYLCNPSLILPTNHLQVIDSHYDADLDGIIWYVVLAIRAP

SEQ ID NO: 139328 - protein, 174 aa, Triticum aestivum
  Clone ID: PAT_TA_33746.pep
MACFQTRPSAAVVVVITMFLLQACYEGSQASASSSLQLQLPRHQMRKMLSVSAPSMSSSGGGGRSTEPLELEECSKDLLEVFQINAPSMAGGIPAYSVEFTNTCMECLVCDVHVACGDFASNDVIDPAKFRRLGINDCLVNDGKSIEPSFPVSFQYGNSFPYPMTVASASCDCN

SEQ ID NO: 139329 - protein, 258 aa, Triticum aestivum
  Clone ID: PAT_TA_33747.pep
SSIELGHEKDQKTIIVCSVVGSLGVLSAILGFSAEGTKLTVSDLYVDGGVCLYPQNPALGLGVCAAIFLIVAQIAFAVVGGCCGCCRSRAIPSESNRIIGVVCAVFSWIMAIIAFSLLVTGAAWNTTGTRDPSPFGLCYVLKDGIFAGGAVLTLVATALGLTSYVMLRGQPATAAPKEGEQMPAGAAVISMGQPQFQQQPPQGQGYGQAPNPHYAPPPAQGQGYGAHTANQQQQQQQLPPPPGRGYGQYPPPKGHEQV

SEQ ID NO: 139330 - protein, 165 aa, Triticum aestivum
  unsure (1)..(165): unsure at all Xaa locations
  Clone ID: PAT_TA_33748.pep
WYMGLLAFGLLVAGAAXDDHRXRERSPFGQFYVLQDGTCAGGAALAPVATALGLTSYVMLPGQQATAAAAPKEGEQMPPRAAGTTTGQPQFPQQPPPGAGATQLPAALSAAPRGRGTAKRRTLTTRLLREAGQGYRSARSPNQQQQQHAIPRLIGIGNCSVTFTP

SEQ ID NO: 139331 - protein, 275 aa, Triticum aestivum
  Clone ID: PAT_TA_33749.pep
FERPPGQVRRRASIWLSLPVPLLRVDQGCPARSNASSDGAAGRRWIWRGARVFLVYIRAAVVLVCLGFMPWSGVMPWGCKPLELSSGVWWWPPSFSFLPPWWWKVEDAGSGKIPLNKLVLVLWCSLIWRASNCYCLFSQATMVVDEKQDSCRILKFIGRVRAYQQRSLWWSDGAHRWLPVFVGALFLLAEWRLTIFLPACVPDGRQFQWRLGGYGEQVMLPWRFRRAKWFVPGDGEVQSGRRLSRTRSRFLLSVWGPPCKSQGLNVMFLSILVLL

SEQ ID NO: 139332 - protein, 115 aa, Triticum aestivum
  Clone ID: PAT_TA_33750.pep
MPCLNVSTNVNLEGVDTSAVLADASSTVATIIGKPENYVMVVLKGSVPMAFGGTQEPAAYGELVSIGGLNPDVNKKLSAGIASILESKLSIPKSRFYLKFHDSKRSDFGWNGSTF

SEQ ID NO: 139333 - protein, 111 aa, Triticum aestivum
  unsure (1)..(111): unsure at all Xaa locations
  Clone ID: PAT_TA_33751.pep
PRTVKPAPGWTPPAVLADASSTVATIIGKPEAYVMVVLKGSVPMAFRGTQEPAAYGELVSIGGLNADVNXKLSAXIASILESKLSXPKSRFYLKFHRFKALRLWDGMDPPF

SEQ ID NO: 139334 - protein, 67 aa, Triticum aestivum
  Clone ID: PAT_TA_33752.pep
NTQVNSSGPFTPATVANLSRGIDFFSYAMADASLSLGNIMMATVNPALPAGMVAVARITFPSSSVDP

SEQ ID NO: 139335 - protein, 127 aa, Triticum aestivum
  Clone ID: PAT_TA_33753.pep
PRSWSRQQASSYSRRHRSPSTSPPSSKKVRRRRTCHRPLGLSPFTPATVANLSRGIDFFSYAMADASLSLGNIMMATVNPALPAGMVAVARITFPSSLCSPTVSRTTRSTTTRLLNADGGIPSNKAS

SEQ ID NO: 139336 - protein, 127 aa, Triticum aestivum
  unsure (1)..(127): unsure at all Xaa locations
  Clone ID: PAT_TA_33754.pep
MRRRQRFNNSDALYVQYLVCEVQRTLCSTAMEFTGNLDEDNELESLIDSQLVALRKVFRIPHKPLDESHGPASKKLLTKFXWGNLGPVTLDHFPGQECTGKIYLPIIACLWQSCGNSLLVKLWMVSQ

SEQ ID NO: 139337 - protein, 186 aa, Triticum aestivum
  unsure (1)..(186): unsure at all Xaa locations
  Clone ID: PAT_TA_33755.pep
PARHAAAECRPDTWSRIQIPTFLLPLQAGADSPTLYSSIPSPPAESASESPSVSERDSPTLAALYSMKEAALLDTDGNFYDVTAYLDDHPGGADVLLAVTGMDGTEEFEDAGHSKDAKELMKDYFIGELDLDETPDMPEMEVFXGKSRDKDFASKLAAYAXVQYWAIPVAAVGISAVLAILYARRK

SEQ ID NO: 139338 - protein, 104 aa, Triticum aestivum
  unsure (1)..(104): unsure at all Xaa locations
  Clone ID: PAT_TA_33756.pep
GGGGGVETKSYTENLNLQLLLCVPIPCVVRAHCLRGVLHPQPAGVLPXXEEGGGGXXXPXXALFLGAAGIIADAYLPPSWAHEMIHQHLLCVSMKALSFSHISG

SEQ ID NO: 139339 - protein, 261 aa, Triticum aestivum
  unsure (1)..(261): unsure at all Xaa locations
  Clone ID: PAT_TA_33757.pep
WEDEAVGSAGQRGGNAGEDALHVLPEDVEAGTDARGGGLQPLPDRFKRHRQCVGRAPERRDEAVEAAVYELPQTVEAETDARGCGLDPLPERFERHRQSVGRAPERGDEVVEAEAHASDGGLQQVPERLERHHQSVGRAPKRGDEAVEAEAHAGGGGLQQVPDGRERQDDQVGHGGDGRLQPVPEHLERQDEQVSHAREQAGDEXLPQAVEAEAHADGGGRRFLEQHRRLRRAGASVLLRQRRPLLALTQPSLLFPRTIFL

SEQ ID NO: 139340 - protein, 174 aa, Triticum aestivum
  Clone ID: PAT_TA_33758.pep
PTLCSAIEKHALALAIAPTGVNTSTTSTATMQDIGFDPTGWELALVTTSSSNTNSLAVDSNLGGGFDKLTLDSLYDDGTYRQMQQQLPYGSVPHNPFMASDPFAVSNQVASPPSVQMAAMAQQPQQMQPNPFGPPSHPQPVPNPFLDAGFGPFPAANGNGMHAQANPFGTAQLL

SEQ ID NO: 139341 - protein, 228 aa, Triticum aestivum
  unsure (1)..(228): unsure at all Xaa locations
  Clone ID: PAT_TA_33759.pep
PRILSXFSKVFKFKFVHLGGDEVDTSCWTTTPRIKSWLVQHGMNESDAYRYFVLKAQKIAISHGYEIINWEETFNNFGDKLDRKTVVHNWLGGGVAEKVVSAGLRCIVSNQDKWYLDHLDATWEGFYMNEPLTNIYNPEQQKLILGGEVCMWGEHIDASDIQQTIWPRAAAAAERLWTPVEKLAKDTTAVTARLAHFRCLLNERGVAAAPLAGYGRTAPSEPGSCVRQ

SEQ ID NO: 139342 - protein, 152 aa, Triticum aestivum
  Clone ID: PAT_TA_33760.pep
MSTPSRKRLMRDFKRLMQDPPAGISGAPQDNNIMLWNAVIFGPDDSPWDGGTFKLTLQFNEEYPNKPPTVRFISRMFHPNIYADGSICLDILQNQWSPIYDVAAILTSIQSLLCDPNPNSPANSEAARMFSENKREYNRKVREIVEQSWTAD

SEQ ID NO: 139343 - protein, 158 aa, Triticum aestivum
  Clone ID: PAT_TA_33761.pep
EQNGESRVCSYQGPRAEFQGSDWRSIDGPFVGVCVYNVPWAAENAMAAPEAKFSDGYMDAVILKDCPKADLLALLLKMSDGSYVKSPHVTYLKVKSFRLSPGQLVEDPKRGGIVDVDGEVVARGEGTYGMNQDQYFMAYGPSVQLTVHQGLATVYRPK

SEQ ID NO: 139344 - protein, 382 aa, Triticum aestivum
  Clone ID: PAT_TA_33762.pep
PRNLGSIRHSSAAAMAAIFSASGHRLLSTAAAAAEFPVPMARIRNLARAGRLDDIDAAVAPLVPTNPKAVISALSVVGLSDRASAILSTIPSPTAEHLNALLAPLLRRRRLAERVPALLDAHPSAPRDAFTWSILAKSLCINERADRAVYLLHGEEPPSLHLYTDIIDSYYKQKKPHSAEELWREMVEERGIAPDAAAYNVRITYKSATGTVEEVQELIRAMGEDSGLRPDVISYNGLIRVLGRHKRVDEALEVYRSLQEKGAEGNTEAKSAPECATYACMVGALCSEGRLSEAEHGFYEGVKRKKVADLGTVRKLVVALKEAGKGRAARRVVVGLRKKFPDQFDGPWKELEKDAGLTPGASNEEEEVEEDEQQPEKTAAAA

SEQ ID NO: 139345 - protein, 408 aa, Triticum aestivum
  unsure (1)..(408): unsure at all Xaa locations
  Clone ID: PAT_TA_33763.pep
HRTGRHLIILRDWDRVPIAARGLDFSRLRSLTVFGKWESFFVSKSMRLLRVLDLEDALGVKDEDLEKMVKRLRRLKFLSLRGCGEIFHLPSSLGDLRQLQTLXDVRHTSILKLPASITRLQKLQYIRAGTTARESAPPASSSRLPKFHRRRGLFGIKVPKGSXKLTALHTLGVVDVGASGGKAVVEELRKLTQLRKLGVSGINRHNSKDFFSATSGLVHLESLLVRLGKDSQGCLDEITLPWENLRSLTLHGLQDKLPPSKNLRKLMKLDLEMDALKEDDIKFLANLPELCILRLRVGQLQDGKLHFHAEMYGEELVTFKKVKILEIASGASELHVTFGSRSMKSLELLKIDCSSASYHLTGLNFLSELKEVLLQGTNDEAIKSNLETQLANHPKAPTVKLEELPRSS

SEQ ID NO: 139346 - protein, 217 aa, Triticum aestivum
  Clone ID: PAT_TA_33764.pep
MQSLARTVCRAGTRGNPLKLMDCAAPRVEQSFAEPLRSCSWIRQIVSPIIPRDGVQAYGFCTRALAARGFSTVGTAEVSVEDEDSSSPMVEHPPRIKFKRPDKTARHIMNILNKEAVDKVRTERTIPDVQPGCIVQMRVQVPENKRRESTLKGIVIARRNAGIATTFRLRRLVAGVGVESVFPLYSPNIKEIKILDRKKVRRAKLYYLRDRMNALKK

SEQ ID NO: 139347 - protein, 218 aa, Triticum aestivum
  Clone ID: PAT_TA_33765.pep
ADSAKPNPSTVHTLSSSRQAQNSSFPFSPPSFPLTSPHCAAWPLPVQSAHSLFPRPPLSRCVSLLRLWIKKPHENPAASAVCCRISRGPALAGSFLAIALHALFLIFDADWFHFRRVAGGGIRGGGILAGRGRRGTMVGGGAQSASAAEVEDIELGERRRADEFVDDDEEGSQYFTDAEDRSWPSHSRQESAAFEDCISRCASTRASSCGGADSDADI

SEQ ID NO: 139348 - protein, 138 aa, Triticum aestivum
  unsure (1)..(138): unsure at all Xaa locations
  Clone ID: PAT_TA_33766.pep
MRRLEESTVPDSALDLCNETEILLYLQAHADCHTLLFACXNCQHKGIPTESCVXKRSLRKSADEPKDTLKEPAGVACLPCTRSVNCYNCGPPETAYLQPPTKXHLVQALYFIHGGPTYGQRWRDWVTDQGGPLVRTEC

SEQ ID NO: 139349 - protein, 140 aa, Triticum aestivum
  Clone ID: PAT_TA_33767.pep
PASAPPAAGCAGRPWQLVGQSPHTESTSLFPPSGVHQAPAPLPITSTTPVPPPPPPPALLLPRRSASSRTRGVGTGRGRCCDRCHLKLESRGAAPASPGRGAGTTAMSCYDGQTRCWNRPWRELQSAAFFATTVLLFCWN

SEQ ID NO: 139350 - protein, 95 aa, Triticum aestivum
  unsure (1)..(95): unsure at all Xaa locations
  Clone ID: PAT_TA_33768.pep
MASGAQKKXVAVGMVLAILFISAANAEPAPAETCIDKTEKVGLVTDCICSKNCACAGKCILEGGDGGEIQKCFVECVLKNDCNCNAKHHSAAAPQ

SEQ ID NO: 139351 - protein, 111 aa, Triticum aestivum
  Clone ID: PAT_TA_33769.pep
TWWTLIGLQDHQINVDVRSLQIARESPISLTGTAGDNVELTLMRGCSQFSAPQVVQSTSVFRQPSPPKEDSLFCKHTPPGASSICGKTTFFFLVNGSFLRRPTLPVLQHSR

SEQ ID NO: 139352 - protein, 211 aa, Triticum aestivum
  Clone ID: PAT_TA_33770.pep
MHLGEKERYGRGREQDIRRVGEKGGRRQSGSGHCTVWRRNPSAIGQVSHRSPGRCGSGSRKTATTSMGYSGRCRPSMEEVRAAAGRDHAGRKGELVGARRPRGGSAPSGRELAGRREGARGLGRERTDRGEGARRPGSERASRGEGARRPGSERASRGEGARRPQGGSALAGEGAHMPWGGSASTAEEWRRQHRSWGGGGEIWCAQGEGGG

SEQ ID NO: 139353 - protein, 180 aa, Triticum aestivum
  Clone ID: PAT_TA_33771.pep
MGAMAEEAEHEGCVENRQPLAASSESVSEGSSYGGAGGPARMSPPVSGSVNSISGLRRTSGPIRRAKGGWTSQEDETLRKAVETFNGRSWKKIAEFFPDRTEVQCLHRWQKVLNPELIKGPWTQEEDDKIIDLVKKYGPTKWSVIARSLPGRIGKQCRERWHNHLNPDIRKDAWTAEEEQ

SEQ ID NO: 139354 - protein, 87 aa, Triticum aestivum
  Clone ID: PAT_TA_33772.pep
NVIKINIAPNILHQPVVDPENTRRRRASPTVLRAVPRRWISTGGETRASAAGPEPRLDARLLLSQPLAPLLRFRYCSCSISEESARR

SEQ ID NO: 139355 - protein, 147 aa, Triticum aestivum
  unsure (1)..(147): unsure at all Xaa locations
  Clone ID: PAT_TA_33773.pep
DTPASKAQELVPALEAFWRWLKDAAXVAPPYVMAIPAVVCVAPVAWYCWQILCTPPAQVXKALVQVLSSCWGWLYGVAMLVGPCCGHVTMAAPGVAGGLMSRVAFETAPRLFFQISRPAGGPVATAVFSTPTIAPAAAAPVAALLGG

SEQ ID NO: 139356 - protein, 258 aa, Triticum aestivum
  Clone ID: PAT_TA_33774.pep
MMLDKGSLDLVLVPCGLLIMFGYHLILLYRILRHPAVTVIGYENHNKLAWVRRMAQAAPEETGLALSVISSSIAASTNLASLSIALGSLIGAWVSSTSKVFMTELVYGDNSQATAAVKYISLLVCFLVSFTCFIHSARYYVQASFLVTTLDSDVPASYMQHAVIRGGNFWSMGLRALYFATTLLMWIFGPIPMFVCSVFMVVILHMLDSNSLPLHQYQFTVRKRPDQGALASILATSQPSPRNAIINNPILPPVTFFS

SEQ ID NO: 139357 - protein, 116 aa, Triticum aestivum
  Clone ID: PAT_TA_33775.pep
PRRSHAPSAANETVAKAHKSIKSSKFRDSTLSSKHRSTKRQEYAEFYGSTETPQASAKVPKDRLRHRHREKSGEVTYGTGHPEPKPLEMKAADYSDPKYDHYNMRSKYGADSGFRY

SEQ ID NO: 139358 - protein, 65 aa, Triticum aestivum
  Clone ID: PAT_TA_33776.pep
ACNVVVLGDPEFVEQSNESNTTAAGHTFPNETRRFWQGHRFLNFLLACMVFAFVISWLFHFNVPG

SEQ ID NO: 139359 - protein, 98 aa, Triticum aestivum
  Clone ID: PAT_TA_33777.pep
GKMCSADFSRIIELSRLFKLQRERCVHLRIAVGFIWVIQRPTYSCSSYINCILRKTDYNMKQETREKGSNMNFLLKNPYIGRIKLKFSTEYHTNKHNF

SEQ ID NO: 139360 - protein, 105 aa, Triticum aestivum
  Clone ID: PAT_TA_33778.pep
LVEVSPVVLYLRGGQRLRAAEENAARFPFVLDGWALEIILKRSLESFTKLAMMSRTAICCRMTPLQKAQLVGILKSSGSLTLAIGDGGNDVRMIQEANDAVPPYH

SEQ ID NO: 139361 - protein, 68 aa, Triticum aestivum
  Clone ID: PAT_TA_33779.pep
VLLTILPVEIHGHRFVQNQIALHVSSAIEAPTRETSIRRCSDNCTVSFIWVIHGPLTAVQVWSFEGSS

SEQ ID NO: 139362 - protein, 91 aa, Triticum aestivum
  Clone ID: PAT_TA_33780.pep
PGTWTSIPVIVGPADFQKLVKMCSSSVNYVIFDSSAVSPKLVKMYSSLVNYVLFDSSAVSPWLVLVHTLLYATHNFILSKSIFNLLNYFFP

SEQ ID NO: 139363 - protein, 120 aa, Triticum aestivum
  Clone ID: PAT_TA_33781.pep
RGQRVACHRGERGNAPTRFPPRGLRGRVGPSSREAGKPGSTRARRRRSLHRRRVNSRPPGTPRSAAGHQIGNRSESPDGQIGRCSRLASRSKIAASPARRSTRNLRTRERTGVSRRKKSW

SEQ ID NO: 139364 - protein, 80 aa, Triticum aestivum
  Clone ID: PAT_TA_33782.pep
HEALFIKVAVVHLRRGHPAIVKFCSQRCLLLCSFRNPSGKNAKEKWSRSHRPQALSPLHGFLFSKHKLLLLLLVNCFCSL

SEQ ID NO: 139365 - protein, 94 aa, Triticum aestivum
  Clone ID: PAT_TA_33783.pep
TPLPMRPLFSYELLALWFKSFYSWASSIAELLSVKYTSCNEQSKIFYRATIKPNLKTVFVHPLLREMAGWACIGPSLFSPSIRLRKSFSSKSCV

SEQ ID NO: 139366 - protein, 186 aa, Triticum aestivum
  Clone ID: PAT_TA_33784.pep
HFGKMLKDKSRADVTFKVRGEMFPAHRAVLSARSPVFKAQLSEPMKENKMRHITVDRMEPVVFEALLHFVYTDSLPTMDDLDRSERNAVVQHLFAAADQYGLDRLKLMCERILCLNLDVDNVAVVLRLADRYDCQKLKEACVDFLVPSERIDAVVASREYESIKLVSPSPLADLWEKNTRPPKRSF

SEQ ID NO: 139367 - protein, 242 aa, Triticum aestivum
  Clone ID: PAT_TA_33785.pep
MPSRLLPIRVPSLAKPTALRFAKHMASNTGKKLIQIDVSSDTVCPWCFVGKRNLEKAMEQTMDKFDFEVRWHPFFLNPDAPKEGVKKSDFYKTKFGPVQFERATARMREMFRGLGFEYDMSGLTGNTMDSHRLITLAGHQGYDKQNALVDELFVSYFCQGKYIGDRQVLMDAARKVGIEGAEELLLDPSKGVDEVKEELNKYSSGISGVPHFVINGKYQLSGGQPPNIFMRAFETAAKDAAE

SEQ ID NO: 139368 - protein, 467 aa, Triticum aestivum
  unsure (1)..(467): unsure at all Xaa locations
  Clone ID: PAT_TA_33786.pep
LLTMLYKSNQNFIGKHVVKCERFLEKKXPAQVIIPKARVEDEEFLFSMRLKTGGKPSGSVIILSGDGKATVAIYWRGSTRLYQFDLPWDAGKVFDASIIPSAEDRDEGAWVVLTEKAGIWAIPEKAVLVGGVEPPERSLSRKGSCNEAVAEEKRRSQAFSASIVPRRVSSEAWSAGDRQRPALTGVAQQAVVDEEAEMLLNRLFHDFILSGAVHEALQKLRVAGAFEKEGEMNVFVRVSKSIVNTLSKHWTTTREAEFLASTIVSSLAEKRQKHEKFLQFLVLSKCHEELSSKQRAAMLSVMEHGEKLSGMIHLRELQNALSQQSSSTRLSPQSKTPTAGALWNLIQLVGEKARRNTVLLMDRDNAEVFYSRVSDIEDLFYCLSHQLRYIITGEEHPSVQMQRALELSNACVTLVQAALHYRAEYKDWYPSPEGLITWNSQPVVRSGIWNLASSVMELLREPGSAGM

SEQ ID NO: 139369 - protein, 144 aa, Triticum aestivum
  Clone ID: PAT_TA_33787.pep
HTCLVLTSSTRKMASSKVMWVFCLLALLAFTSCSYHVRAEDHATKEKNEVMEYCKRYIFKNYGDQFPDPHRKCCQTVRESRHIHAIRQKFTHADLHKISLAKWLMLHIGVATDCTQGLIAQVSSFQIIVRHHLQNTKRKAGPVK

SEQ ID NO: 139370 - protein, 118 aa, Triticum aestivum
  Clone ID: PAT_TA_33788.pep
MATPGDGEDAPPPPPVSAAGAGSSLIAKLREQWRSTKEHAETYPYVWGSYILVYGGLGAYITWRWCKLRRTEDRVRALQARLRQLAAAEESQAASTPPTPSPPLPPPPTGPGKPASAP

SEQ ID NO: 139371 - protein, 302 aa, Triticum aestivum
  Clone ID: PAT_TA_33789.pep
MARPMGSSGFEAALAVCPAAAQAYSKYCGIVSGCTNANPREGLADLSRTIDNMEGMRDGIFGDIHKLMSVLEFDDVSQFNSFYDFVFFISRENGQKNITVQKALAAWRIVLVGRFRLLDRWCNFVEKYQRHNISEDAWQQLLAFSRCVNEDLEGYDPRGAWPVIIDDFVEHMHRIYRPSDCSSAMESQCSISNTFRGLNLLPGSKRKCPTQFNSSEESVELSEALRHSVQLTPSKRLKESSAPTRYGVWERDASTPFFNSTPDCREDMNLQNSRGCLQNSPRVIEDGFSKGFEGCISMKCSF

SEQ ID NO: 139372 - protein, 165 aa, Triticum aestivum
  Clone ID: PAT_TA_33790.pep
NVRHFLSHMQNLKKPCILVQRCLPTWQNSLRLIGIRTGVRLTNLQPQRNREQLRRKGTSKTTSRPQTSQICKSRQSVARRRIQSLARLFLLPYPGHSRGATTTRRRKKRRGRRWWRPARADRWGAARSQTDPTHPARDQARPQQAAPPPRGAHTAGLHCPRMIGF

SEQ ID NO: 139373 - protein, 166 aa, Triticum aestivum
  unsure (1)..(166): unsure at all Xaa locations
  Clone ID: PAT_TA_33791.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGGYGGQGGGGYGQGGGGGYGQGGGGYGGQRGGGGYGGGGGGXCGQRGGDSGGQWRN

SEQ ID NO: 139374 - protein, 139 aa, Triticum aestivum
  Clone ID: PAT_TA_33792.pep
MAMAALREASRRLAFTSTRVLAGAATRPLLLTHSRGITHKLFIGGLSQFATEDSLAEAFTRYGQVLEATIVTDKMTSRSKGFGFVKFASEEEANKAREEMNGKVLNGRVIYVDIAKAKQDRAADVVPIARGPPKPVGNT

SEQ ID NO: 139375 - protein, 308 aa, Triticum aestivum
  unsure (1)..(308): unsure at all Xaa locations
  Clone ID: PAT_TA_33793.pep
ELRRFEAAEXDCTEALNLDDRYVKAYSRRITARKXLGKLKEAMDDAEFAVSVDANNPELRKQYSEIKALLMEKMAKRSSVQAKHTISEFDKAGDRKNITSHAPSDPQKDSFMEVDPPGRAAAGIRELSGGASKGGSGVSLKDNNMQKPGPEISVQELASRAASRYISNTVKSVKTPKTAYDFEVSWRAISDDLTQQIQLLKSIRPERLPEIFKDALSSAFLIDIVKCTASIFRDDAVLAVSILENLAKVSRFDLIIMCLSPMHKSELRKIWGQTFLVETASPNQVEALRRLQAKYVQGGWHDDMFTMS

SEQ ID NO: 139376 - protein, 102 aa, Triticum aestivum
  Clone ID: PAT_TA_33794.pep
IGVLVDSITIDNTDCLHNEKRKISSEAILCRPGGNGWRNWHQNSWRTIRQALHSFNSSLIISITAVNLAFTMDRWDSSSFPFNRACHSASPKKSLTSTASCL

SEQ ID NO: 139377 - protein, 161 aa, Triticum aestivum
  unsure (1)..(161): unsure at all Xaa locations
  Clone ID: PAT_TA_33795.pep
MSKEDVLKIQTCVLKVNIHCDGCQKKVKKILSKIDGVYQSTIDPEEGKVMVPGLAHPDTMRNKLNKGGNPAVLWGSKRARVGNQCQKLHLDGNGGGRKGAAPKDXRGKGHPKDAGGKAHKGGGKDAKMAMPQPTPQQIQQMQQQMQMKGAPTPQQLQQLQQ

SEQ ID NO: 139378 - protein, 330 aa, Triticum aestivum
  unsure (1)..(330): unsure at all Xaa locations
  Clone ID: PAT_TA_33796.pep
FGTRASCVDISDSGESYVDISDSDGDEEDDDEEGSSAGNEGEAEADRPGADLSEAACTKIADLLRRGRNLDGIKLAECKAYLKNNGLPQVGDIATCVERIMLHRRFKDEDPEKIYPRSSFCINCKGDVCRGDTVLFKQKXHEKSGKRLSKCMGKRIVAGKVIKESYGKDKQQHTFTIQVFWSKGVGKLPPLYLLLVKGRNLYRMMTFRQAWANEANRLKALEEKHSRGDAARRVRASNRRNSSGHALKGKKSKEKGKHQSQPGGPDGGSNITKGRKRAMQTSNSDHPAKKIQKEEHQVPSGKNTLVIIGRQRQILPPWIRTLAPALAVLS

SEQ ID NO: 139379 - protein, 69 aa, Triticum aestivum
  Clone ID: PAT_TA_33797.pep
CWLLILTKCVLTNDCRAAEKRVSTNVPKLMDLTTGIALLFYRYRCIALSNCKSVLNSKPDVNVMEDWAI

SEQ ID NO: 139380 - protein, 181 aa, Triticum aestivum
  Clone ID: PAT_TA_33798.pep
RQRDQRREGAGREQGAAMAGLLDKAKGFVADKIAHMPKPEASLDKVSFKGMTREAITVHSHVNVTNPYSHRIPICDIAFTLKCGGKEEVASGTIPDPGWIEDSGEVTKLEVPAKVPYDFLISLMKDLGRDWDIDYELLVKLTIDLPIIGNFTIPLETAGEFKLPTLSDFFGGAAKTEEATA

SEQ ID NO: 139381 - protein, 163 aa, Triticum aestivum
  Clone ID: PAT_TA_33799.pep
MASLMDKAKGFVADKIAHMPKPEASLDKVTFKGMTREAITVHSHVNVTNPYSHRIPICDIAFNLKCGGKEVASGTIPDPGWIEDSGEVTKLEVPAKVPYDFLISLMKDLGRDWDIDYELLVKLTIDLPIIGNFTIPLETAGEFKLPTLSDFFGGAAKTEEATA

SEQ ID NO: 139382 - protein, 181 aa, Triticum aestivum
  unsure (1)..(181): unsure at all Xaa locations
  Clone ID: PAT_TA_33800.pep
EEAEETRGGEEEAXGLPAMASLMDKAKGFVADKIAHMPKPEASLDKVTFKGMTREAITVHSHVNVTNPYSHRIPICDISFNLKCGGKEVASGTIPDPGWIEDSGEVTKLEVPAKVPYDFLISLMKDLGRDWDIDYELLVKLTIDLPIIGNFTIPLDTAGEFKLPTLSDFFGGSAKTEEATA

SEQ ID NO: 139383 - protein, 199 aa, Triticum aestivum
  unsure (1)..(199): unsure at all Xaa locations
  Clone ID: PAT_TA_33801.pep
MAGLLDKAKGFVADKIAHMPKPEASLDKVSFKXCTRDGHHGAHATSTSPSPYSHRIPICDIAFTLKCGGKEVASGTIPGPGXIEDSGEVTKLEVPAKVPYDFLISLMKDLGRDWXIDYELLVKLTIDLPSIRNFTIPLXHAGEFKLPPLRRFSRRRPPDRGRHRLATRSRMLVPASLLLQPACLFSVDGGRNNEGKYFR

SEQ ID NO: 139384 - protein, 253 aa, Triticum aestivum
  Clone ID: PAT_TA_33802.pep
MVSALSHVIRATPDQQQAYYPAGSAAVSGEQQHQHDAAAAAAIAEEQGRKRHYRGVRQRPWGKWAAEIRDPKKAARVWLGTFDTAEDAAIAYDEAALRFKGTKAKLNFPERVQGRTDLGFVVTRGIPDRLQQQQHYPATVGAPAMRPPPHQLQTVVPYPDLMRYAQLLQGAGSAGGAVNLPFGAMSPPSMSSSAPHILDFSTQQLIRVSPASPAAAMSSSGTTGPSTSSSTTTASSPGAAWPYTGEHKNNKDS

SEQ ID NO: 139385 - protein, 201 aa, Triticum aestivum
  unsure (1)..(201): unsure at all Xaa locations
  Clone ID: PAT_TA_33803.pep
MAAMWSRIIGLLLLLPLGPSSAIKFPLIGNVYPDGHFYATLQIGHPLKPYFLDIDTGSNLTWLECDLPHQRCKGCHPRPAHPHYKPAAHNLMVRCHSWICAELRKDLPGSPKCPKNDPDRCHYDIQYVSGKSKGVLVNDMMFINGRDDKNCFFGCGYEQEEPVDQXSPSPVDGILGLGRGNVGFVEQLTVHNKITKNVIGH

SEQ ID NO: 139386 - protein, 98 aa, Triticum aestivum
  Clone ID: PAT_TA_33804.pep
RLLRCLCFFFFFQLELFPAETLFGLYDVHVLLGVALTYASYMHRFRSSIIQLLLHGSYVFSKYTMLHIISWCSTHIDIIYELMQIIVFIIQQLLLLHG

SEQ ID NO: 139387 - protein, 121 aa, Triticum aestivum
  unsure (1)..(121): unsure at all Xaa locations
  Clone ID: PAT_TA_33805.pep
ACWTNXADQDDWVELSQASVSEGWSDEVIQESLQGTVLFNASRLCYSSDAVVFDGTFEEVLPVRKEDVHARGLEAKCFSVEEVLMQHDAFPDAGKLMMTAVVMGKELSYAAPADEPVDMDS

SEQ ID NO: 139388 - protein, 301 aa, Triticum aestivum
  unsure (1)..(301): unsure at all Xaa locations
  Clone ID: PAT_TA_33806.pep
MGAGVSSFFFGAAAEAAPGAAGLGDLPELCAAQVLLRLDAPEICRLARLNHAFRGAAGADFVWEAKLPENYRHLIGYVEGGGGQGRRRGRRAGTREIFARLAWSATFDDGTKXFWLEKSNGRVCMALSXSKSLVITGIDDRRYWTHMPTTESRFQSVAYLQQIWWFEVVGELDFCFPVGTYSLYFRVHLGKFSKRFGRRVCSTEHVHGWNKKPVRFQLSTSDGQNALSQCYLDEPGSWVLYHAGDFVSTNPGQALKLKFSMAQIDCTHTKGGLCVDSVLVYPKGFQQEKVVTGKISEMRSS

SEQ ID NO: 139389 - protein, 128 aa, Triticum aestivum
  Clone ID: PAT_TA_33807.pep
GIFPSITTYMLSWTMVCCFASVTFLLQQSCSFGPSTTVHRLVYQSAAAGNTSGEGSEGRRRSSKHQQTPHTRRGVLEGPRYGWQRKLARPAASGWQQREARVKDLVDLREGGEQRTGRFRERRTDKVW

SEQ ID NO: 139390 - protein, 221 aa, Triticum aestivum
  unsure (1)..(221): unsure at all Xaa locations
  Clone ID: PAT_TA_33808.pep
KDGILLKEXDRLLRPNGYFVYSAPPAYRKDKDFPIIWERLINITSAMCWKLIAKHVQTAIWIKPEDESCRQKNSDTGILNICDPSDTSSWQSPLMNCVRLNTDQPKIQKLPSRPERLLFYSRSLEIIGVTPEKFDNNNQFWRDQVRKYWSFLGVEKTSIRNIMDMNANYGGFAMALSTDPVWIMNIVPYTTINTLPVIYDRGLIGSYHDWCQPFSTYPRSY

SEQ ID NO: 139391 - protein, 62 aa, Triticum aestivum
  Clone ID: PAT_TA_33809.pep
NHHDRGQMIPSVNLMPSIVYSSSTEELAHATLMACPCAACRCSPGARRGAASSACTPPPPSP

SEQ ID NO: 139392 - protein, 89 aa, Triticum aestivum
  unsure (1)..(89): unsure at all Xaa locations
  Clone ID: PAT_TA_33810.pep
MTARRSPPLAPRALLLLPSSSYGPVGPPAPSRTDTAADEAVAAAETKVDEATAEEEAWGHGKEEEEXVPRRLRHDAPLDDIXAQHKGRP

SEQ ID NO: 139393 - protein, 325 aa, Triticum aestivum
  unsure (1)..(325): unsure at all Xaa locations
  Clone ID: PAT_TA_33811.pep
MGSLGSEVDHGGREMFHGHADPVVDELNKLENLLREKERELGHAYSEIKGLKVTEALKDKAIAELSKELKKQDEKLSILEKQLEQKNLDVKRICNERKEALSAQFAAEASLRRIHSAQRDEEVVPFDAIIGPLESDIKKYKHEIAVLQDDKKALERHLKLNEAAFVEAGDILRSALERALIVEDVQNQNIXLKKQMEIXGEENMLLEKSNRQKVLEIEKLTHTVGELEESILASRDVANAVHFYQNQATRLNEEKKTLERELARAKVYVNRVATTTANEWKDDADKLMPVKRWLEERRLLQGEIQRLRDKIAIAERSAKVEAQLN

SEQ ID NO: 139394 - protein, 193 aa, Triticum aestivum
  Clone ID: PAT_TA_33812.pep
KGFQLPGSSLWLLPPANHTLSTVLPCLIDKTSKQFGSPHRFIPHITLSSEITASKHEPDPQAWLDSLDLPPIKDVIVKFERLGSEDVFFRKLYIKCEKLDGIKQLAKQSRKQVDGFEEESKAKAWAEDEYNPHLSLMYHDIPQIDDTGLASVDLLGVNLDGTGDLGGWTGGRVVIVPTDKSIDQWQPIGERVF

SEQ ID NO: 139395 - protein, 80 aa, Triticum aestivum
  Clone ID: PAT_TA_33813.pep
MLSAKAPTPPVPHAPKGAEVSSEVTERELELEAQLVEARSIIQEQASIMFKHFSKFDKPSRRLSGLDAEREAIHFASTDV

SEQ ID NO: 139396 - protein, 392 aa, Triticum aestivum
  Clone ID: PAT_TA_33814.pep
MSVSSRFELRASSNLHQQPPPPVGMSGDVGTFADAGNLEHCAKYLNQTLVTFGFPASLDLFATDPVSIARTCNCMYALLQQRQRDIEFRESTNDLRQRMQSDISRLEAKIERMDAQLAAKDRELATLTRTEAKNTAALKAHIEKLQQERDEFQKMVIGNQQVRTQQIHETKKKEKEYIKLQEKLNQVLMEKKKESSRSGMEIMNLLQKEGRQRGTWTGKKNDNDYYKMIVDAYEVKKQELVQENADLRALLRSMQMDMREFLNAPTGSSQPAVAGNGRQEAGSPQSPLGGKTDVFDLPFHMARDQIEESLRTKMASVKARMTQLQDAQKGAEVTSEVTERELELEAQLVEARSIIQEQASIMSKHFSKSDKPRRLSGLDAEREAILSASTDV

SEQ ID NO: 139397 - protein, 197 aa, Triticum aestivum
  unsure (1)..(197): unsure at all Xaa locations
  Clone ID: PAT_TA_33815.pep
MVHVNFYRNYGKTFKKPRRPYEKERLDAELXKLLVGEYGLRAKRELYRVQYALSRIRNAARELLTLDEKNPRRIFEGAALLRRMNRYGLLTEEQNKLDYVLALTVDNFLQRRLQTIVFKNGMAKSIHHARVLIRQRHIRVGKQLVNIPSFMVRVDTEKHVDFSLTSPLGGGQPGRVKRKNQKKASGGGGDDGEEEED

SEQ ID NO: 139398 - protein, 292 aa, Triticum aestivum
  unsure (1)..(292): unsure at all Xaa locations
  Clone ID: PAT_TA_33816.pep
MAAAAAKPVPVERLGQRLVAPAAPTPESPLRLSWLDRYPTQXMALIESLHVFKPDMAREGDSPARAVEQALARALVEYYPLAGRLTVTDAGELQVDCSDGGVWFIEAAVRCRLEDVDYLEYPLAVDKDELLPHPRPKPSREEESKLILLVQVTTFDCGGFVVGFRFSHAVADGPGAAQFMGAVGELARGAGRISVAPVWGRDAIPDPASALVGSLPDPAGAKRLEYLAIDISADYINHFKGQFAAATGGARCSAFEVLIAKAWQSRTRAACFDEDSPVHTFLAMNXKXAGAP

SEQ ID NO: 139399 - protein, 115 aa, Triticum aestivum
  Clone ID: PAT_TA_33817.pep
APQEEMFITLMTDVISRSGVLGYHSGRELLLLGAVHAAHAGGTFSLLLDGDGTRRASGLTAPLSTTAPGDATLLTKNPPPERSATAVLLAILTSAIFTQIPPAPNPARQSLPFRR

SEQ ID NO: 139400 - protein, 86 aa, Triticum aestivum
  Clone ID: PAT_TA_33818.pep
LAGVGIPVRRNRRSLFPLWKCWNPQEAEQPYKAVFAKRENFRDIAVTPSMFMDHLPWRCRFAMQRTLEGQPSQRLANSDSPVQHLV

SEQ ID NO: 139401 - protein, 63 aa, Triticum aestivum
  Clone ID: PAT_TA_33819.pep
SSFFCLFFNFQHGYSKKKKKKKKKKKKKKKKKKKKKKKKKKKKKKKKKKKKKKKKKKKRGGPF

SEQ ID NO: 139402 - protein, 130 aa, Triticum aestivum
  unsure (1)..(130): unsure at all Xaa locations
  Clone ID: PAT_TA_33820.pep
SNVCIFIHKSPXNIPEVKIPEDMTVNIALSLRHEINRGFFTLREIGHGRDLKKFLIVTGGLWLLSVLGSCCNFLTLSYIVFVVLYTVPVLYEKYDDKVDAFGEKAMIELKKYYAIFEEKVLSKIPKNKKH

SEQ ID NO: 139403 - protein, 262 aa, Triticum aestivum
  unsure (1)..(262): unsure at all Xaa locations
  Clone ID: PAT_TA_33821.pep
MAEHKEEPVAESMMDKISDKFHGGDSSSSSSDSDDEKKGSAAGVKAKIYRLFGREKPVHAVLGGGKPADLVLWRNKKVSGGVLAGATAIWLLFEVMEYHLLTLVGHCLILSLATLFLYSNVCIFIHKSPPNIPEVKIPEDMTVNIALSLRPXINRGFFTLRETGXGRDLKKFLIVIGGLWLLPGRGSCCIFFTLEFLVFCLTXSYIVFVVLYTVPVLYEKYDDIGVDAFGEKAMIELKKYYATLEKRRSCRTSLRALFRRTY

SEQ ID NO: 139404 - protein, 93 aa, Triticum aestivum
  Clone ID: PAT_TA_33822.pep
ITSYCVFPKYSALQNKEILNTSFTMDDSVKQYIIFSFSWEHHGPTCQCNLGLYTTSTSLSMNMCTIELSMHLHLYEDTYTTASWMNTIVSLLA

SEQ ID NO: 139405 - protein, 243 aa, Triticum aestivum
  Clone ID: PAT_TA_33823.pep
TRPVNTFIHREHFCFLVILSLSGLAVALQLTTPCNAAQAQPPPVYDIDGHELTGNNMYTIMAADRNLSDHCISVGSFRSEECHKHATLTPCKQFGGMRGVHVSIKPAEASDGSSKEASIRLSTDVVIEFKGVVTWCKHHLRWYVHGENTNQTHVSASCFRGMNGCQPSAGTCMEQSFLFRVERHGTGYKLTSCFNAPCRDLVLFDYAGQRWLTVKKDGREPPVVVFKKFPLASLPPASAPQLG

SEQ ID NO: 139406 - protein, 158 aa, Triticum aestivum
  Clone ID: PAT_TA_33824.pep
YGATTNTPIHLLSSPHPSRCYRHTRARRSSSCSSWSPRRARGGARRRTRRLRRAGSSAPGSGSSAQRRGDPALTGCKQQCGGQRQFGAEERRYCVAACDEYGRMKSRREEDEGRRSTEKERDRCLHECRAGPRKPGCEQRCIDEYERATHQGTKTDDA

SEQ ID NO: 139407 - protein, 364 aa, Triticum aestivum
  Clone ID: PAT_TA_33825.pep
LFNMLSDSSHEIRQQADAALSEFLQEIKNSPNVDYGRMAEILVRRAGSPDEFTRLTSITWINEFVKLGGEQLVPYYADILGAILPCISDEEEKIRVVARETNEELRAIKADQAEGFDIGAILVIAKRELNSEHEATRIEALHWFSTLLVRGRAEFSAYLDGIFEPLLNALSDPSDAVVLLVLEVHARIAEEYHHFQHLMSYLIHTFHNNHVLLEKRGALIVRRLCVLQGAEKVYREFSTILQTEGDLDFASTMVQALNLILLTSTELAELRSLLKKSLVDTCGKDLFLSLYASWCHSPMATISLCLLAQAYNHASSVIQSLGEEDINVKFLVQLDKLIRLLETPVFAYLRLQLLEPGKHTWLLK

SEQ ID NO: 139408 - protein, 305 aa, Triticum aestivum
  Clone ID: PAT_TA_33826.pep
KCIDAAPAELPILPPLVDILNKGMSTSEDTAAAASVAFKYICEDCRGKFSGSLDGLFQIYHVAISGVGGYKVSSEDSLHLVEALSVVITTLPQDHARRALELICMPIINSLQEIIQQGESALQQVPARHLTVHIDRLSTIFSNVKLPEVVAEAVNRYWSTLKIIFDHRAWDTRTMESLCRSCKFAVRTCGRSMGITIGAMLLEIQTLYQQHNQSCFLYLSSEVIKIFGSDPSCASYLTCLIQTLFNHTIQLLRTIQDFTARPDIADDCFLLASRCIRYCADLFVPTEIFPRLVDCAMAGVTIQHR

SEQ ID NO: 139409 - protein, 207 aa, Triticum aestivum
  Clone ID: PAT_TA_33827.pep
MGGVGWRRLGSKLRQRWGWESRLRARGFSSAPAAPPPPHMESVGFIGLGNMGSHMARNLVRAGYRVSVHDINEDAMNKFSDDGIPTKRSPLEVSESSDVVITMLPSSAHVLDVYSGGNGLLGNGGHLGPWLYIDSSTVDPQTSRKISMDMSRCMPWTRKVRRKTDYDGCPVPRRSCRKSGTLTSGVKNIIATKSFRKGGKLAGGWNG

SEQ ID NO: 139410 - protein, 328 aa, Triticum aestivum
  unsure (1)..(328): unsure at all Xaa locations
  Clone ID: PAT_TA_33828.pep
MDITEVTVVHHVALVLAALWAAGNAGWAHPALFLLALVYIFAVNARYTMRLKKRLQFEEKKSANQRRLLSDAETVRWLNYAVEKMWPVCMERVASQQFLLPIFPWFISKFKPWTARKAEIQSLYLGRNPPMFTDIRVVSQSTDDDHLVLELGMNFLAADDMDARMAVQLRKRFGFGITANMHITGMHIEGKVLVGVRFLQQWPFIGRVRVCFVEPPYFQMTVKPLFSHGLDVTELPGISGWLDRMLDVAFGQTLVEPNMLVIDMEKFCLKXSESTDNWFTVXEKPPIAHAKVESWRGADMKLXDPNGLXGPXXXKGNFGPYRFQDKDQ

SEQ ID NO: 139411 - protein, 196 aa, Triticum aestivum
  Clone ID: PAT_TA_33829.pep
MARQRTCSASALALAVALVVGVLASIPVEVESIGVCNGMQGDSQSLPSRADVVQFYGTKGISAMRIYAPDPETLQALGDTGIDLIMDVGNGNLSALASDAGLAASWVQENVLAYPRVSIKYIAAGNEVEGGDTQNIVRAMTNLNAALSKASRPDVKVSTAVKMSVLASSSPPSSGVFKDAYMPGVQVAAPKGTTLF

SEQ ID NO: 139412 - protein, 247 aa, Triticum aestivum
  Clone ID: PAT_TA_33830.pep
HADKVVAQLFSFSLLNPAKRVRLAAGAVKSLLSRQDVGVPEIDRVVEILEVVSGDLKEFLMLLQNCQPIQRPLATNIFVEGQMFGRHVEKERIINFLLHDGGPSTGGKLGVLPIVGSMGVGKTTLAQHVCDDERVRNHFPIILYSNFSYTRAMARDEAVFVLGSKHTVGDAQKFIESLHVLKEKCLTKRFLMVFEDVDMGKKQMLEELLPILRHGRFGSRIIITTDTGGCRQLGNCAANQSEGYAAS

SEQ ID NO: 139413 - protein, 169 aa, Triticum aestivum
  unsure (1)..(169): unsure at all Xaa locations
  Clone ID: PAT_TA_33831.pep
NPLPTQARSPTPLSIPPLRTPFLLPHRGPRRRXPATSARGRRGEVLAGDPATSARXARRGPGRRPGNERERARRRGPGRRQTRPPAPPTTERTTRAQQSGGGSLSRARRDDVLAGDGLARPLLRRSAGGRQRPHRRRPQRRRPRCLGLGLPPLHRPLHKEVQSDTPSQA

SEQ ID NO: 139414 - protein, 87 aa, Triticum aestivum
  Clone ID: PAT_TA_33832.pep
LSRPRQYWQTLSIGYRRSTMVNTVRQMPGFANTMNYEGDMQISTMRSYLKSARESVHQSVNSRNKSDVSAEDKFHSVDFDGTIEEYG

SEQ ID NO: 139415 - protein, 161 aa, Triticum aestivum
  Clone ID: PAT_TA_33833.pep
MDALSSMLDKAKDKVKSNPDVMEKVNSVLDKVKNHPEVMEKVAEVLHLGKRESKEKEPEAEDKTKEGETSADKTQDSNILDQAVEEIQAVVAAVQQQETTGDETQVPVEAAAETDAPAQEEKREVEKDNPKNRIDFLGFFAMIFERVCSPADRKKTSSVSA

SEQ ID NO: 139416 - protein, 156 aa, Triticum aestivum
  Clone ID: PAT_TA_33834.pep
MDALSSMLDKAKDKVKSNPDVMEKVNSVLDKVKNHPEVMEKVAEVLHLGKRESKEKEPEAEDKAKEGETSADKTQDSNILDQAVEEIQAVVAAVQQQETTGDETQVPVEAAAETDAPAQEEKREVEKDNPKNRIDFLGFFAMIFERFCSPADKKKD

SEQ ID NO: 139417 - protein, 210 aa, Triticum aestivum
  Clone ID: PAT_TA_33835.pep
MESMLLRASRDFARAASKIASAGRWAAPVTAARSAPSDLRSRLSFHSGTGGNTPISTDAPPDEMSSPASFTPLPGKVKILPSDEDVESEEALWALYLRWCNTLNQKRDHDEMVRRFDVFKDTVRMVHRVNKAKLPYTLKVSEFADGKLQESMSPKVFDEFATHAKGGGSRPLANRRKEGDLIIETGEDVPEYPQMYFKFSESGDSIIPLE

SEQ ID NO: 139418 - protein, 195 aa, Triticum aestivum
  unsure (1)..(195): unsure at all Xaa locations
  Clone ID: PAT_TA_33836.pep
DDVXKTHDYSGPEQHXSNRKKLPPRQYPENPTIRMTSPIPLAKSILQLTLTSALSGYGLFLSYQNITRLQQYEQQSEKAAEWSNTAAERLHKTRTTQTSGTISLIVSFLTPIIALSTSNSTYLVSAAAANTAVLMFSRQHMANFWNEKEQTRIPFVQKFNDAVRGSEQVVQILGLLGASWAVTAVGWGVMGQGWL

SEQ ID NO: 139419 - protein, 140 aa, Triticum aestivum
  unsure (1)..(140): unsure at all Xaa locations
  Clone ID: PAT_TA_33837.pep
MVAFGGGLLRGRREGAEAAMASSGGAVREVGSKAELDTAVGGALAAAVHFWAAWCEASKXMDEVFANAVDFPHALFLRGEANLNTFRGILAITQLLTKIEGLVVPVVPSTHGVSAFAYLPEGPAKRVANISVLCATEMDF

SEQ ID NO: 139420 - protein, 199 aa, Triticum aestivum
  Clone ID: PAT_TA_33838.pep
RADSQGICMNINGWENMIFIGINAAISVRVSNELGAGRPMAAMHAVIVIIAESLLIGLLCMVLVLIFRDNFAIIYSTDLELQHAVSKIAGLLGLTRYLNSVQPVVSGVAVGGGWQGLVAYINLGCYYVLGLPLGYLLGYKFNYGVGGIWAGMLCGIALQTLILLFIVWRTDWNAEAALASSRVQKWGGTDGTKPLLEDD

SEQ ID NO: 139421 - protein, 131 aa, Triticum aestivum
  Clone ID: PAT_TA_33839.pep
VFGACVYTSDVELRQAVSKIAGLLGLTMVLNSVQPVLSGVAIGGGWQGLVAYINLGCYYIFGLPLGYLLGYKFNYGVGGIWAGMLCGVALQTLILLVIVWRTDWNAEAALASSRVRKWGGTEATKPLLEEN

SEQ ID NO: 139422 - protein, 163 aa, Triticum aestivum
  Clone ID: PAT_TA_33840.pep
VGGLEETYIAAKPLLLAMGKKLIYCGGAGNGSAAKMCNNRAMAISMLGVSEAFALGQNLGIKASTLTDIFNCSSARCWSSDTYNPVPGVMAGVPSARNYDGGFTSKLMAKDLDLAMASASGVGFKCPMGSEALDIYRKLCDEGCEFKDFSCAFRHFYTGKDEK

SEQ ID NO: 139423 - protein, 158 aa, Triticum aestivum
  Clone ID: PAT_TA_33841.pep
RLVRYIPLMCQPKTSFSNAGGIRLIFTDTLRLTQQKDATLSILQRSLVHVTTYKRQPLCTTTQILQRFVLAVSQGLRSITHSAPACRKRINSRHIEIAFLLVSPFVFLALVKALPAEHALQVMSGFPCMFHHMRRLLPQLSLCRALVPGPLGAGVRVI

SEQ ID NO: 139424 - protein, 359 aa, Triticum aestivum
  unsure (1)..(359): unsure at all Xaa locations
  Clone ID: PAT_TA_33842.pep
MERYELLKDIGAGNFGVARLMRNKETKELVAMKYIPRGLKIDENVATEIINHRSLRHPNIIRFKEVVVTPTHLAIVMEXYAAGGELFDRICNAGRFSEDEARYFFQQLICGVSYCHFMQICHRDLKLENTLLDGSPAPRLKICDFGYSKSSLLHSKPKSTVGTPAYIAPEVLSRREYDGKTADVWSCGVTLYVMLVGGYPFXRDPDDPKNFRKTIGRIMSIQYKIPEYVHVSQDCKQLLASIFVANPAKRITMREIRNHPWFLKNLPRELTEAAQAMYYKRDNSAPTYSVQSVEEIMKIVEEAQKPPPSTTPVAGFGWAEEDEQEDGKKPEEEAEEEDEEDEYEKQLNEVRASGEFHIS

SEQ ID NO: 139425 - protein, 87 aa, Triticum aestivum
  Clone ID: PAT_TA_33843.pep
NDLLMKCTIYHAPGRSSIPLCNESQYPSRHAYLGGLESMHLELVLSINLISKNLPSLINFTLLSMSSLFTVISPTSKVGRQAQSCYR

SEQ ID NO: 139426 - protein, 103 aa, Triticum aestivum
  unsure (1)..(103): unsure at all Xaa locations
  Clone ID: PAT_TA_33844.pep
ALPQHCLQHRAGDFLPAVLANLAREPMXGRFGRFVPLPMAMAVPFLVGASFAIDMCVGRAAARXRSAVASGLICGDGIWIFPSSLLALAKIKQSICIYFTPAR

SEQ ID NO: 139427 - protein, 218 aa, Triticum aestivum
  Clone ID: PAT_TA_33845.pep
LHKHSMFWLVHRDLKPHNVLLDCNMLPKIADFGSARALSSELAEERTSRVVGTSGYKAPEYASRGVYSMKTDVFSFGVLVLVIISGRKNTILDKRGVGDLVRDAWRMWKDQKLHELVDPLLGDGYEVSEITKCAQVALLCAQEDPTDRPTMTDVAAMLNSESISLPMEPKQPAALIHGCAERDTTSTYVSQSSRTIDITITSSAPMSTRVRIILDPEV

SEQ ID NO: 139428 - protein, 310 aa, Triticum aestivum
  Clone ID: PAT_TA_33846.pep
WRQDNAAGSGGGGVKDYVMEWIRSEIKKERPKSDWISGASTTTPTTSAEKKKPKRRAREWWREEYAEELTKKQKRQAIAKSKSDAGVMTGLQWWEKDCDLEEKGRSRWRMMKSWSRRSSNGNGNSTIDWWADGVRSSKDWASTEFVPKSGGAVSSTPSMRGTVCYVAPEYGGGGPLSEKCDMYSFGVLVLVLISGLSRRILTSSPLSDLVTACPMSEFDHPSLISWALDLAHVGRLLDLVDSALLDVNREQALLCLTVALLCIHKSPIRRPTSHEALEKLSGEGEPPYLPVQFSTSPPGGFPFRSLTKCL

SEQ ID NO: 139429 - protein, 594 aa, Triticum aestivum
  unsure (1)..(594): unsure at all Xaa locations
  Clone ID: PAT_TA_33847.pep
MAMVDEPLYPIAVLIDELKNEDIQLRLNSIRRLSTIARALGEERTRKELIPFLSENNDDEDEVLLAMAEELGVFIPYVGGVEHCSCFSSHHWQTLILRLEETCVRDKAVESLCRIGAXMKENDIVDYFIAVVKRLAXAGEWFTARXVSSCGLFHIAYPSAXPDSVEKQNCELFKAHLCQDDMPMVTRADVSNLRKFAATVGQSHLKIETIYIFDGLTRDCQDYVILLAMKHSAGFVKSIQCQDCGPNILPVIVCFFQVQSLPLHYMVADHLYELCEAFGPECSRAEQLPAFVRLLRDNEAEVRIAAAGKVTKFCRILSPQLAIQHILPXVKELSSDSSQHVRSALASVIMGMAPXVLGKDATIEQLLPIFLSLLKDEFPDVRLNIISKLDQVNQVIGIDLLSQSLLPAIVELAEDRHWRVRLAIIEYIPLLASQLGVGFFDDKLGALCMQWLEDKVFSIREAAANNLKRLAEEFGPEWAMQHIIPQVLEKINNPHYLYRMTILQAISLLAPVMGAEITCQKLLPVVINSSKDRVPNIKFNVAKVLQSLVPILDQSVAEKTVKPCLVELSEDPDVDVRYYANQALQACDQIMMSS

SEQ ID NO: 139430 - protein, 279 aa, Triticum aestivum
  Clone ID: PAT_TA_33848.pep
MAEHLASIFGTEKDRVNCPFYFKIGACRHGDRCSRIHNRPTISPTIVLMNMYQRPDMITPGVDAQGQPIDPRKMQEHFEDFYEDIFEELSKFGEIETLNVCDNLSDHMIGNVYVQFREEDQAAAAHTALQGRFYSGRLIIVDFSPVTDFREATCRQYEENTCTRGGHCNFMHVKQIGKDLRKKLFGRYRRSQRGRSRSPSPHHRRERRDRDDYRGRDDFRRGGGGGGRRGGSSRHERHDDGGRRRYGGSPPRRARSPVRENSEERRAKIEQWNRERETK

SEQ ID NO: 139431 - protein, 70 aa, Triticum aestivum
  Clone ID: PAT_TA_33849.pep
DGWRCRSYVERSCDTLYSTQADMHVACRCGHLRICNVCCPSMNPDPVNPFCLLRARCLIKMMSLLVVFKI

SEQ ID NO: 139432 - protein, 116 aa, Triticum aestivum
  Clone ID: PAT_TA_33850.pep
MSSTKEQRIMTQPINLIFRFFQSKARIQIWLFEQKDMRIEGRIIGFVEYMNLALEDAEEINIKKNTRKSLGRIILKGDNITLMMNTGKGSFSLQYGWALSFLVLKHSCDTLCSNPG

SEQ ID NO: 139433 - protein, 203 aa, Triticum aestivum
  unsure (1)..(203): unsure at all Xaa locations
  Clone ID: PAT_TA_33851.pep
AELIARSAYHGVGLVKLMGRSTGFIAMHASLSSGQIDVCLIPEYLLHLXGEHGVLAHLEHLLETKGFCVVCVAEGAGQDLLQKSNATDASGNVILSDFGVHMQQKIKKHFKDIGVLADVKYIDPTYMVRACRANASDAILCTVLGQNAVHGAFAGFSGITSGICNTHYAYLPITEVITTPKHVNPNSRMWHRCLTSTGQPDFH

SEQ ID NO: 139434 - protein, 52 aa, Triticum aestivum
  Clone ID: PAT_TA_33852.pep
TKIRVYCLVVWEIWYEPSRRIFHNLELSAVTVAGHATSQGRCWKDDDAWHVI

SEQ ID NO: 139435 - protein, 109 aa, Triticum aestivum
  Clone ID: PAT_TA_33853.pep
SRADYVQTQRARGRLIREVQESFTVDAFIGNATDWELVCLGNLVGLPIVVVPTGFKSIEHPPKGNTRRRTTVTTGIYAPPDHDHIALALAMAYQSVTDHHKQRPPIDAN

SEQ ID NO: 139436 - protein, 294 aa, Triticum aestivum
  unsure (1)..(294): unsure at all Xaa locations
  Clone ID: PAT_TA_33854.pep
TRPPPPTPPHPTPRSTPINPNPNSTPWRRRCAALPTGSCTTGSRGSTLSVRRLRRLPATPPAARPAAAEALLLRRRGEHPEYLPHHARRRGGAGARSTTGSSQPRHRTGSRRASPPRRTTGTPPRSDSGIPPRARLRSSGGNLLSSIRTTSSGEALGGLRRCSTLRRPSPSPRSRPRETLSXRRARARATPRRGSRSRATPSWRRARASAKPRRRSRPRATPNWRRARARAKPRRRSRSRARPSXRRARARTTPMRRPRPRATPRCRSRATRPHATSPTSPASSMARTSSSVRF

SEQ ID NO: 139437 - protein, 180 aa, Triticum aestivum
  unsure (1)..(180): unsure at all Xaa locations
  Clone ID: PAT_TA_33855.pep
MDDDERIDRHGPGPQVHGHGGKPDKTKHVQFGMEDDERIDRRGHHDQGHGQGHGHGHGNGHGGKPKVVTTTAMSRNEAPRAQQPASMTAMAPMRMPTPAPSMTMMPQAMATPSIWPAAPXWGYSAPAYGHGYAGGAPAGGYYGGPVYDHGAYGAYVGGYGRNPYQPQCYEEEPSAGCSVM

SEQ ID NO: 139438 - protein, 213 aa, Triticum aestivum
  Clone ID: PAT_TA_33856.pep
RKKIATTKIIIPRYFERFNFPRKHTPHYSQDCKEDENKIKCATDQPWTSTSFEVTGGAVERSPVSSSTLGSAASPSKAEGSAGGISTGFSCSCCTFSLETFGFVLDVFCFVAIGLVSAFAVIDATEGAFVTNLRPGPLAVTRGLLLSPPLFTLAGLLVRRRLSHETELSAEAAVTEPDGLCRPGFGALARGGAVCFNSKLGGAYGWKLGAGAE

SEQ ID NO: 139439 - protein, 81 aa, Triticum aestivum
  Clone ID: PAT_TA_33857.pep
MILLVDKTIVPKSANDVKLISGGKILENDKNIAQCRAPFGDLPSTVITMHVVVQPSSAKSKPEKMITNKLPKTTRCSCTIL

SEQ ID NO: 139440 - protein, 141 aa, Triticum aestivum
  Clone ID: PAT_TA_33858.pep
MAEGEETKVEGTREEERADAGAGAEEEEVEVKFRLFDGSDIGPIRCNAAATTVAALKDRVVADWPKDKTIVPKSANDVKLISGGKILENDKNIAQCRAPFGDLPSTVITMHVVVQPSSAKSKPDKKTNKLPKTTRCSCTIL

SEQ ID NO: 139441 - protein, 351 aa, Triticum aestivum
  Clone ID: PAT_TA_33859.pep
LPAIDYRITDSLADSPNTNQRHVEELVRLPESFLCYTPSPEAGPVCPTPAISNGFVTFGSFNNLAKITPKVMQVWARILCAVPNSRLVVKCKPFCCDSIRQKFLSTLEELGLESLRVDLLPLIHLNHDHMQAYSLMDISLDTFPYAGTTTTCESLYMGVPCVTMAGSVHAHNVGVSLLTKVGLGRLVAKTEDEYVSLALELASDVSALEELRKSLRELMIKSPVCDGESFTRGLESAYRSMWHRYCDGDSPALRRLEVLAGEDLDKTAVKLVDLKAQRANATAEEDNQSPIKKVDAMSKGGEPQIMANDVSSPEGNQALVTAKAQPQIMVNGVSSPHSPSGRCEANGHSSR

SEQ ID NO: 139442 - protein, 224 aa, Triticum aestivum
  unsure (1)..(224): unsure at all Xaa locations
  Clone ID: PAT_TA_33860.pep
VADAGGXVARXINHAPWFGVTLADFVMPAFLFIIGVSAALVFKKTPNKIATTKKAAFRAIKLFILGVILQGGYIHGRHKLTYGVDLDYIRLLGVLQXIGYFLAAISEIWLVNNTSVDSPVSFVKKYFVEWIMAIIISALYIGLVFGLYVPNWEFKVQTSNSTFSNPSNDVGFKTIQCGLRGSLGPPCNAVGFVDRVLLGESHLYKNPVYKRTKECSINSPDYGP

SEQ ID NO: 139443 - protein, 317 aa, Triticum aestivum
  Clone ID: PAT_TA_33861.pep
MASSTTAARADAAPPGLKEGIAGLYDESSGLWESIWGEHMHHGFYDSGEAASMSDHRRAQIRMIEEALAFAAVPDDPTNKPKTIVDVGCGIGGSSRYLANKYGAQCSGITLSPVQAERGNALAAAQGLSDKASFQVADALEQPFPDGQFDLVWSMESGEHMPNKQKFVSELARVAAPGATIIIVTWCHRNLAPSEDSLKPDELNLLKKICDAYYLPDWCSPSDYVKIAESLSLEDIKTADWSENVAPFWPAVIQSALTWKGLTSLLRSGWKTIKGALVMPLMIQGYKKGLIKFSIITCHKPQAAIEGEPEAASPSVE

SEQ ID NO: 139444 - protein, 70 aa, Triticum aestivum
  Clone ID: PAT_TA_33862.pep
GPHEGGVLVLVSGSFTVPDAMKRRFTQSFFLAPQKGGYFVLNDVLRYIPVEPETPPVKVQVLPLIDYFWV

SEQ ID NO: 139445 - protein, 103 aa, Triticum aestivum
  Clone ID: PAT_TA_33863.pep
GQPIAGRRHRTKDSVNVHISAAFAGGKDTKELHVLTEGTHQKSRGNLVDARTAESKVTVGKHARGHWGSLQTNFQHSCLMVCRSEFTSLLYYELLFACLSPLR

SEQ ID NO: 139446 - protein, 158 aa, Triticum aestivum
  Clone ID: PAT_TA_33864.pep
AIGWFLWPEGMHSSKFCLHPAGDTPSACRLFDALVSLCVPVIVSDHIELPFEDVIDYSNISIFVDTSKAVQPGFLTSMLRRVSSERILEYQREIQRVKHYFEYEDLNGPVNQIWRQVSMKAPLIKLLINRNKRLVERGTNETDCSCICSTPSEISTAG

SEQ ID NO: 139447 - protein, 472 aa, Triticum aestivum
  Clone ID: PAT_TA_33865.pep
SQYDATKVRAVTRLLLSPKRADSSLLRTKFEIGLSDNPCEALVLSHQDRLVSNIRLLRSTYGFIPPARAPPINVCCSDRNFAYKLTDEMHDPWIKKLFLGFARISEFNGPRIPNGHNTLIQEVCTDLPIPEPMLQLPYRIFGSSPPMSNFDPAKMLTDSGKLHTLDKLLRQLRAENHRVLLFAQMTKMLDILEDYMNFRKFKYFRLDGSSAISDRRDMVRNFQNRNDIFVFLLSTRAGGLGIDLTAADTVIFYEIDWNPTQDQQAMDRTHRLGQTKEVTVYRLICKDTIEEKILQRAKQKNAVQELVMKGKQVQDDHLMRQEDVVSLLLDDTQIAHKLKEISMQAKDRLKKRRAKAIKVDKEGDLKLEDLDDPTEEPVEQDNTTSKKKKGSHKKPPKSQDNNGADGDVPESGPVEDEEHIASLRPKRSKRLVRSTGEDKEPVAACDVEKPADAAENNDNNDAEELQYQTPSA

SEQ ID NO: 139448 - protein, 259 aa, Triticum aestivum
  Clone ID: PAT_TA_33866.pep
MAYTSSLHLSKHLLLPKPHRARPSSSRSPSFVRAARVVNGAPHVNGHSKKAPNGKVQINGDGKKGAGVVNGKTHVNGHDRIHLSVTTGGGGQDGTGLRVAYQGAPGAYSEFAAKTALPGCETVPCRAFADALAAVDRGLVDRAILPVESTMEGTALRNYDLLLRHDLVVAQEINLFVHYCLLAMPGVRATEVRRVISHPMALAHCGRRPSRASGVSAARPGDAGAPRRGPGAPYIAALHSRHRQARRAADLYGPPTSSR

SEQ ID NO: 139449 - protein, 219 aa, Triticum aestivum
  Clone ID: PAT_TA_33867.pep
MAPVKVFGPAASTNVARVLVCLEEVGAEYELVDIDFPGKGHKRPEHLARNPFGQVPAFQDGDLILFESRAIAKYVLRKYKSEQVDLLRESNLEEAAMVDIWTEVEIHQYHPALSPIVLECFIYPTLRGLPTNQRIVDESLVKAKKVLEIYEAHLSKHKYLAGDFVSFADLNHFACTFYLMDATPYASLFNSYPHVKAWWEDLMSRPSMKKLGAGMTTRV

SEQ ID NO: 139450 - protein, 62 aa, Triticum aestivum
  Clone ID: PAT_TA_33868.pep
LEMNKPIHSSRENLVLAHENITKVSTTSLANLPTQTTIPVLDVIVRQSQLADTISCLHTYDT

SEQ ID NO: 139451 - protein, 162 aa, Triticum aestivum
  Clone ID: PAT_TA_33869.pep
WSDHLMVLDTRTLRFSIVDNLTGYHAELSDLPDQSFGYRRANALVMGREGALEMFSLVCQHGSFAIYHTSLQNNSQEWKLEKIIQLPGQYHDYNISTVGAAEGFLFFRGAPEGIHIGNVDSYSMEVKTYEITKVCTEMDNIYNPRRALPFFSFPPLLSEPTI

SEQ ID NO: 139452 - protein, 92 aa, Triticum aestivum
  Clone ID: PAT_TA_33870.pep
PFPGRKSHLTCKPHYDNSDLTNRLCDAMCFFIQYTCFSVDREGERYLFIWLLRSPTIYMGIYMDYMQSPTYNCWINVVLRLVCGNQHGKSLS

SEQ ID NO: 139453 - protein, 227 aa, Triticum aestivum
  Clone ID: PAT_TA_33871.pep
MVNSAEPPPAAFPPDLTKEGGVREAGGGAAKVDPTPSSAHRGRLMSLPSMLKPWGSQRRLRCVPVNRHGETIAPDTGSSSNQQYEVSERLQLGLGNVAEASGTGNPAVNKYPEVTEAVSPQPLKARRGRPRRLAMPSLAAMTVASASPQAFERERRSVRADALKRPRFSISLSKEEIEEDIYGLTGALPRSRPRGRPRKVQKQIDLLFPGARLSHINMESYRVPDNR

SEQ ID NO: 139454 - protein, 239 aa, Triticum aestivum
  unsure (1)..(239): unsure at all Xaa locations
  Clone ID: PAT_TA_33872.pep
MRTMGLGLGAPFFLLVLLLLAAGTGAVPQDKRVRRNYVLLDLNTIEIRPNDKEEIASSKIPVSGESGSTVCSTCENLTNKAVSYLSDKQTQDEIMEILHGACSQTFSLEQKCLEMVDSYATLLFAKITEIKPDEFCKQYGLCRDVSFLSVAKSESTCTFCRHLVDEVLSKMRDPDAQFEILQLLIKECNKVKGHVQECKRMVLEYVPLILVNGEKLLEKXDVCTLMQACDASKTRAGGS

SEQ ID NO: 139455 - protein, 272 aa, Triticum aestivum
  unsure (1)..(272): unsure at all Xaa locations
  Clone ID: PAT_TA_33873.pep
NRAGAIAEFRPLSQPDHSRFLVRTRATCLRSPCFLLAPFLLAAGSGSYAAGQAVSQELSFSKNYGLLLLDTIEFHPNDKGEITSSKIPASVESGNPVCSTCENLTNKAVSXLSEKQTQDEIMEILHGACSQTFSLRXKCLEMVELLCNSSLEIKPDEFCKQYGLXRDVSFLSVAKSESTCTFCRHLVDEVLSKMRDPDAQFEILQLLIKECNKVKGHVQECKRMVLEYVPLILVNGEKLLEKKDVCTLMQACDASKTRAGGSFFDGELRSDA

SEQ ID NO: 139456 - protein, 127 aa, Triticum aestivum
  Clone ID: PAT_TA_33874.pep
MMGRKALDYEELNENVKKVQYAVRGELYLRASELQKEGKRIIFTNVGNPHALGQKPLTFPRQVVALCQAPFLLDDPNVGLIFPADAIARAKHYLSLAPGGLGAYSDSRGIPGVRQEVAEFIQRRDGY

SEQ ID NO: 139457 - protein, 485 aa, Triticum aestivum
  unsure (1)..(485): unsure at all Xaa locations
  Clone ID: PAT_TA_33875.pep
MMGRKALDYEELNEXNVKKVQYAGARGXLYLRASEPTERRARCIIFTNVGNPHAVGPGTPLTFPRXVVALCQAPFLLXSDPNVGLIFPAGAIARAKHYLSPRAXGGLSAYSDSGGIHEVSHGVAEFIQASDGYENYPELFNYTEEACDGDTQMLNAIKRYKREGFCVPSXQYSCYSIAMSLIGGTLVPXYLEEEANWGLDLVSTRQSVAEARSKGITVRAMVIINPGNPTGQCLSEANIRELLNFCYQENLVLLADEVYQQNVYQDERPFISARKVMFDMGPPVSREVQLISFHTVSKGYWGECGQRGGYFEMTNIPPKTVDEIYKVASIALSPNVPGQIFMGLMVNPPKPGDISYLKYSAESKSILESLRRRAQIMTDGFNSCRNVVCNFTEGAMYSFPQIRLPQRAMDVAKSAGKAPDVYYCLKLLEATGISTVPGSGFGQKEGVFHLRTTILPAEEDMPAIMSSFKKFNDSFMEQYQNHSRL

SEQ ID NO: 139458 - protein, 93 aa, Triticum aestivum
  unsure (1)..(93): unsure at all Xaa locations
  Clone ID: PAT_TA_33876.pep
FLFLFPPSDLFLLSEFVHDIKFSVPSCSSFLSGAPSYFNYIIPKLHLNHCKDHLVLSTSLPFYHSFITGVLHGGSTWWAIXDXFILNCSSXIL

SEQ ID NO: 139459 - protein, 98 aa, Triticum aestivum
  Clone ID: PAT_TA_33877.pep
NNTTYTKCQYSIMLMSESKRPWNGPHGCFKFLSVYVIFACYDENGARKCNMTCCLKLQPYRGIDSNLQRRILYHACVAQSVAGEAWEVTMTNDMVVSR

SEQ ID NO: 139460 - protein, 192 aa, Triticum aestivum
  Clone ID: PAT_TA_33878.pep
PPNAPDWCLAPFDPEGLLSTLMAAVSCFVGLHFGHVLIHCKTHSQRMMSWLLASTVLTVSGFLLQLLGMPFSKPLYTVSYMLLAGRVSGFLLLLLYCIVDVIHIKKPLILFQWMGMNALIVYVLAACELFPALIQGFYWRSPENNLVDATECLLQAIFHSKRWGTLAFVLVEIIFWCLAACFLHMKGVYLKL

SEQ ID NO: 139461 - protein, 305 aa, Triticum aestivum
  Clone ID: PAT_TA_33879.pep
MSSSTTSGQTSGEGDEAPDLVCVVDCVHGMVDALSCVRWNKHQGAVVELSEHGIVVTVEESGCLQAKVYLKTELFAEYDYGAEGRPRFGLSLGLLVDCLNMFTVPGFASPVEIRYPGPDMQLLLRSVGSPDACIHAEIRTRIPDTVAWDYHFEHAGNTPVTFTVKSAILKESIDDLEWPGSSIQIHFHPDPPSVIFKGEGHGDLEIEFSYYANTDLLIAFQCDQELSYRYKYKFLRATTSNVPSSVLKENRGSKVTIGRGGMLKIQHLVSVARLGTQSYHNFAGGAQQPSRIAFIEFFVKPEEDD

SEQ ID NO: 139462 - protein, 177 aa, Triticum aestivum
  Clone ID: PAT_TA_33880.pep
MAGRDRDPLVVGRVVGDVLDPFVRTTNLRVTFGNRTVSNGCELKPSMVAQQPRVEVGGNEMRTFYTLVMVDPDAPSPSDPNLREYLHWLVTDIPGTTGASFGQEVMCYESPRPTMGIHRFVLVLFQQLGRQTVYAPGWRQNFNTRDFAELYNLGPPVAAVYFNCQREAGSGGRRMYN

SEQ ID NO: 139463 - protein, 268 aa, Triticum aestivum
  Clone ID: PAT_TA_33881.pep
DSGLDCDTPSASDSSSQSSNSTKPSGQSGENTNMDEEDYICSTPSSSRTDTKHQHQYNAANYSKKPLQASLAFWPQWAYEMYDPYSLACRAADLWRLIIKTPSIDELVKKPDLLSFYIGNQLPVSETVRQKLLEINGVSYRLRREIQLLKACDLIKCGYCKSEIAKHSDVVVMSSDGPLGTYVNNHGYVHATITVNNATGLALEGDPTEEHSWFPGYAWTIASCASCGSSIGWLFSTTKRHLHPKSFWGIRSSQIADVVDVEQQQEEE

SEQ ID NO: 139464 - protein, 231 aa, Triticum aestivum
  Clone ID: PAT_TA_33882.pep
MPTLHGPVLFVRPGAYQELKPFPKNAAGSCSNLLGCNTICSSVEDHHVQKPHIVSSFRVNFTRVSHYLQRSLNERTTRHWLHRFHVNASSDEDFRSSRNIATSLFKQYKNVIDRGPLNVLQGFVSAGVQAYALGCTEEGLRKELMDIKNSGVKIEGLQSYGGTSLSFKVRSFEVKECILWLSIVFITILCTPQPTVIRWSTTPPVSADVLHQWKGFCALIANAYYTKGMAW

SEQ ID NO: 139465 - protein, 136 aa, Triticum aestivum
  Clone ID: PAT_TA_33883.pep
WNWACVWDKEKTNLISLDFPSSGQDVKSKHVLVKKLEAVREHPFQWWSVFVCGRGRTFGLANVLWIGSDGTMSVASPGPMCLLLFLRVVLCAACPGSNKVVRIVMLSETNGYLQNTLGQIVLLSAVVVICECNCSS

SEQ ID NO: 139466 - protein, 393 aa, Triticum aestivum
  Clone ID: PAT_TA_33884.pep
TRFPGQFSHNPLPSPARARSGRAPTSPRAMSSSVSVAAEWDLLSDRFYRRITIYSPLPWSSPATTTASPAAGGSSGVGRLDLSTHIVAAAPFGGPIAAVRDDSKIVQLHSEPSRRRLLLFSSSGHPLASSPWTPHLPRLHSLAFSSSLNLLALLSDGSLLRFRLPDLNPITSSSPVPLLPPASGGVADAVFWGGGVAILTEDNRVVVTTDIEVDDPHPRELADPGVAEDEQVLCMAVVEPQLVMSGSPEVLLAVGDRVVAVDEDGVQVLGEALEIGPVQKMAVSPNGKLLAAFAHDGRLLVIPTDFSRIIFEYECDSALPPDQIAWCGLDSVLLYWSEVLLMVGPNGDPVQYNYDEPVMLIPECDGVRILTNSSMEFLHRVPDSTTLIFGIGS

SEQ ID NO: 139467 - protein, 367 aa, Triticum aestivum
  Clone ID: PAT_TA_33885.pep
HASGVFDRILHAINSAIEAEHDVRTLAYWLSNSSALTVLLQRSFKTTRTALSTPQRRRFSSERTFHTSQTSNAGLAYLGGQSVVGATGLPQVEAKYPALLFKQQLVDLIEKVYGMISDSVKKELNPLLELCIQDPRTSHSNLAKSNTNGLGQQNQLAHWLSIVKVLANYLDVLKANHVPSILVHKLFVQIFSLIDVQLFNRLLLRRECCSFSNGEYVKAGLAELKHWSDNATREFAGSAWEALKHIRQAVDFLVISLKPMRTLREIRADVCQALSIQQLERIVGMYLDDVNGSNTISAEFASSLKAAAREEANTVTTFSILLDDDSSIPFSLDDITKTMPIIEMADDDLLPFVRENPGFAFLLQRGE

SEQ ID NO: 139468 - protein, 87 aa, Triticum aestivum
  unsure (1)..(87): unsure at all Xaa locations
  Clone ID: PAT_TA_33886.pep
ITSHRXSSSTSRLCLSCCALDPYEASTSLFSRGSGRATRVGGGGELVYIKDIGRRRGGMATSCTAGCKPRWCYYMIQPAGWGAATPG

SEQ ID NO: 139469 - protein, 74 aa, Triticum aestivum
  Clone ID: PAT_TA_33887.pep
MRQQRGVGRGGGRRDPGLLTRVVDKVFRFVRLAEFEILFVLFFFIAFILFKDLMSRPDYNQIFVKKPDQDDRWP

SEQ ID NO: 139470 - protein, 176 aa, Triticum aestivum
  Clone ID: PAT_TA_33888.pep
PWGRYAAEIRDPAKKARVWLGTFDSAEDAARAYDAAARMLRGPKAKTNFPLSLPHHHQLQASYSPYPVAAAAAVPTSVAAAAARPACSSLSSTVESFGGPRARPVLPPRPPPPPILDGDCHSDCGSSASVVDDDCADAAASPSCGLLLPFDLNLPPEFGGVACNDDDELKLTALRL

SEQ ID NO: 139471 - protein, 220 aa, Triticum aestivum
  Clone ID: PAT_TA_33889.pep
MEGGGADGVTRVLLVDDSPVDRKVVELVLGSNTFAGSFHVVAVDSAKKAMEFLGLKDGKEQAVDMVLTDYCMPEMTGYDLLKAIKAMSPLKPIPVVVMSSENEPQRISRCLKAGAEDYIVKPLQSKDVPRLRSCSNVKPKDPPCSTVSKSADHIAAVDGKSSLRRRAHLTDIAMVLHSSSAGLSHYFPFLFKFILLVYAILCVGELLHRWSNGCFLSYLR

SEQ ID NO: 139472 - protein, 175 aa, Triticum aestivum
  Clone ID: PAT_TA_33890.pep
PTSPPPLQPKPISARPSPSSSPLDTTANPRRRRPPRPQDQLMEQLDQEAQSRAHLEEELVKERQANALLQEQLRKKNEDEAAYKQQIATLTQRNQAEAKKSKSDVAKLQDEIRKLTGVLKARHEEDKLSWERIQGVLKAWDDRKAAREASTSSGDKGPSKKNAGAGVKTSRTGGK

SEQ ID NO: 139473 - protein, 226 aa, Triticum aestivum
  unsure (1)..(226): unsure at all Xaa locations
  Clone ID: PAT_TA_33891.pep
MAPSSLLVASTATALLLLFLSACSCRAAGNSPSAVVLPVRKDGATGQYLTGFRQRTPQVPVTAVLDLGGGTLWVDCDAGYVSSSYARVPCASKLCRLAKTGACATSCVGKPSPGCLNDTCGGFPENTVTRISTGGNLITDVLSVPTTFRPAPGPLATAPAFLFTCGATFLTEGLAAGATGMASLSRARFALPTQLAATFRFSRKFALCLTSXSATGVVVFGDAPYA

SEQ ID NO: 139474 - protein, 79 aa, Triticum aestivum
  Clone ID: PAT_TA_33892.pep
RCLFCILFNSEKTPVEKLKPAHYIRDTHADQILLLIGLVQIQTNQTKSSNRPILLFRFKSSRTDSKDYVLGLSNCKETK

SEQ ID NO: 139475 - protein, 125 aa, Triticum aestivum
  Clone ID: PAT_TA_33893.pep
EEDEIEEGEVIEEDHQDTAPNRKPNKPRNTALKSVIEASSGGQLEMINATSKDICDNGATRECDEKHILKVMEKMQKRRERFKEAVTVTQKEQDNGKDELLAVACGADDVKNQRPARKRRWGGNG

SEQ ID NO: 139476 - protein, 132 aa, Triticum aestivum
  unsure (1)..(132): unsure at all Xaa locations
  Clone ID: PAT_TA_33894.pep
FIAGXXAPXGKXRKAXKKNEDEFRDADILDHRPYRNDRKVPERDRASKRRTPADMTDYAPSAKRRRGGEVELSNILEKIVDHLRNQTAISLLFLKPVTKKVAPDYXDVIQAPNGSRVPSRDKARKMEYKKQV

SEQ ID NO: 139477 - protein, 688 aa, Triticum aestivum
  unsure (1)..(688): unsure at all Xaa locations
  Clone ID: PAT_TA_33895.pep
MATFTSQVSAMAGASPSCSLFVSRRRPAVMPLQMRVARGGRPRGLAMRVTCEKVVGIDLGTTNSAVAAMEGGKPTVITNAEGQRTTPSVVAYTKGGERLVGQIAKRQAVVNPENTFFSVKRFIGRKMAEVDDEAKQVSYNVVRDENGNVKLDCPAIGKQFAAEEISAQVLRKLVDDASXFLNDKITYTQLSVLVDAGSTDAATEPGAGSRTAXMDQINELLSTRISQIANKGWTMKSGVLYVDPGTFDDCXLGLGDGVFEVLSTSGHTHLGGDDFDKKIVDWLASTFKNDEGIDLLKDKQALQRLTEAAEKAKMELSTLTQANISLPFITATADGPKHIEATLSRAKFEELCSDLIDRLKTPVNNALKDAKLSVSNLDEVILVGGSTRIPAVQETVRKITGKDPNVTVNPDEVVSLGAAVQGGVLAGDVKDVVLLDVTPLSIGLETLGGVMTKIIPRNTTLPTSKSEVFSTAADGQTSVEINVLQGEREFVRDNKSLGSFRLDGIPPAPRGVPQIEVKFDIDANGILSVAAVDKGTGKKQDITITGASTLPKDEVERMVEEADKFAQEDKEKRDAIDTKNQADSVVYQTEKQLKELGDKVPAPVKEKVDVKLQELKDAIAGGSTQNMKTAMEALNQEVMQIGQAMYNQTSAGGAGSTDAETEPGAGSTSSGKGPNDGDVIDADFTDSN

SEQ ID NO: 139478 - protein, 143 aa, Triticum aestivum
  unsure (1)..(143): unsure at all Xaa locations
  Clone ID: PAT_TA_33896.pep
PKLERAPYTVXRPPSHKAVKDALAAETAIIXXVRPVAPFKLCYDGSKVGSTRVGPAVPTVELVLQSEPASWVVFGANSXMVPVKGGALCLGVVDGGAAPRTSVVVGGHMMEDNLLEFDLQRSRLGFSSSLLFRQTTCNNFRLG

SEQ ID NO: 139479 - protein, 168 aa, Triticum aestivum
  Clone ID: PAT_TA_33897.pep
PRPSSPTRLHPAESRPIPSASARLRGAEAELLRPPPTLPLLPASPPQPHPRISPAAAGSGDPGLKVADEFIKRRTETEWFIEGDFDTYVSQIRKPHVWGGEPELLMASHVLQMPITVYMREEAAGGLIAIAEYGQEYGKEDPIRVLYHGCGHYEALHIPGNSEPRSRL

SEQ ID NO: 139480 - protein, 109 aa, Triticum aestivum
  unsure (1)..(109): unsure at all Xaa locations
  Clone ID: PAT_TA_33898.pep
CYLLFLTASGEETLDERKAARSASGSWHAKHTSNKSGTSNKHELEDASAEFLHPTDDAINKSGLGYSLGDRCIKKIKLSKDVRFGNLTSKTVQQAPKRPRTDTAKRXXE

SEQ ID NO: 139481 - protein, 374 aa, Triticum aestivum
  Clone ID: PAT_TA_33899.pep
MLSSKSSLHVALILVVTLTDVLPLVSSSRGLVAVPTDGALEDSLLMMERFHGWMAKHGKSYAGVEEKLRRFDIFRRNVEFIEAANRDGRLSYTLGVNQFADLTHEEFLATHTSRRVVPSEEMVITTRAGVVVEGANCKPAPNVVPGSINWVNQSKVTPVKNQGKVCGACWAFSAVATIESAYAIAKRGEPPVLSEQELIDCDTFDRGCTSGEMYNAYFWVLRNGGIANSSTYPYKETDGKCERGKLQEHAATIRDYKFVKHNCEEQLMAAVAVRPVAVGFDSNDECFKFYQAGLYDGMCIKHGEYFGPCSSNDRIHSLAIVGYAGKGGDRVEYWIARNSWGEKWGKKGYVWLKKDVDEPEGLCGLAIQPVYPIV

SEQ ID NO: 139482 - protein, 220 aa, Triticum aestivum
  Clone ID: PAT_TA_33900.pep
RALNENGQLQLHVSCLTAIDKGELLGMPRVEQAGEVKMIQTIISDEDLLKVMGRSDLTGARAAADAAPHFPLKGPGWEVVGGCRAAACSRRSPAEPRARPSHRAWQRRPTPSVSWCSDGFVRSPVFKADVFVHTDVPPERTCLGPRVGPPGRWSGGPGAHLLSPVTAAHPRRLTTSGDSSGSQLATCRCWVSLVRRSLPRPHGICDTVWGNISRKESKSK

SEQ ID NO: 139483 - protein, 115 aa, Triticum aestivum
  Clone ID: PAT_TA_33901.pep
WPHPNSVEGRIIKKAFGKLKLEHVVIGKGQFQQDAAKPNALDEGELLALLRDEQAEEDRMIQTDISDEDLLKVMDRSDLTGARAAADAAPHFPLKGPGWEVVVAAGGGMLSALTS

SEQ ID NO: 139484 - protein, 409 aa, Triticum aestivum
  Clone ID: PAT_TA_33902.pep
DLAAKNGDVFFITEVMAKEGEEMDQGRIKLEEEEEARKREEAARQAFDPKAKFSKLDELLTQTQLYSEFLLEKMEQITDVKPTAVEIKDEEEPVEEQKKGRGRKRKAENSKPQYNDKKAKTAVVAMLSRSREDRSADDGTLTEEEKWEREQANLVPLLTGGKLKSYQIKGVKWLISLWQNGLNGILADQMGLGKTIQTIAFLAHLKGNGLHGPYMVIAPLSTLSNWLNELTRFAPSINGLIYHGDKVARTELRRKHMPKIVGPDFPTISASYEMAMFDAKFLANYKWKYVVVDEGHRLKNTKCKLLRELRRIPMDNKLLLTGTPLQNNLAELWSLLNFILPDIFSSHEEFESWFDFSGKADEELEEETDEKKRGLVVSKLHSILRPFLLRRLNEDVEHILSRKKEIIIY

SEQ ID NO: 139485 - protein, 104 aa, Triticum aestivum
  Clone ID: PAT_TA_33903.pep
MPLPRSKARRKGFRSQLEQEVLRLQEVLREETALHAILDNALDHAAVTLADMSYLPTHAQELLSNISAMEAAVSTLEEEMVALHFQLIQERNERRLVEYRANAK

SEQ ID NO: 139486 - protein, 252 aa, Triticum aestivum
  Clone ID: PAT_TA_33904.pep
RRPLAPPLASASMEKLRWMPVVLRSLRSYSAKAPISTRAPRLPTGKQVLQGVASDHLKLRDSMETLDKGYLFSRRDACNLGTSQRGAISRLTHMPTHRSTNQWPTPIRRHLLTRSYSSKGTDPKDDFDWHTHIATGNFSYRGQLTLGIKMISLQEHLVKNPMLETRPVYGDRNGKYKTFVKDIAKSHCWNMINSLSEFHRIGLCIVDLDHSKIVICDGVARFSPDILFVAATEQLIKDNFLKLAKIIKHVLF

SEQ ID NO: 139487 - protein, 98 aa, Triticum aestivum
  Clone ID: PAT_TA_33905.pep
WPPGSLQFYALLPDHPYLIIGLTDGTLHLSSSASFRLVRIIDLRCPKDRSANLMGSDTAVIEQERHCQSWIYTLYNIVGLSVKGRLYMVDAARLDVAW

SEQ ID NO: 139488 - protein, 438 aa, Triticum aestivum
  Clone ID: PAT_TA_33906.pep
ASLVIDSGSTAAMEKETSSSSDVSASHVGRVRNRRRANEVTTDGNKADGQTLLVSDRNKYKSMLIRTYSTVWMIGGFAFLVYMGHLYIWAMVVVIQIFMATELFNLLRKSSEEKQLPGFRLLNWHFFFTAMLFTYGRFLSRELVNTVSSDHLLYKLVSGLIKYQMFICYFLYISGFVWFILTLKKKTYKYQFKQYAWTHMILLTVFAQSSFTVANIFEGMFWFLLPASLIVINDIAAYLFGFFLGRTPLIKLSPKKTWEGFIGASVTTIISAFLLANVMGRFQWFTCPRKDLSTGWLTCDPGSMFKPEHYFLGDWVPQWFPWKEVFLLPVQWHALALGLFASIIAPFGGFFASGFKRAFKIKDFGDSIPGHGGITDRMDCQMVMAVFAYIYHQSFISPHNFSVDTILDQIVRNLTYEEQKSLYQQLGEIFRERQFMQS

SEQ ID NO: 139489 - protein, 110 aa, Triticum aestivum
  Clone ID: PAT_TA_33907.pep
PDNVSIVLPSKTAFYTKCSFQMTMGHECTNLTYLCANVSGCRRRWTSAAGRRCGAEAATTTVTSQSESLLLLPCTYSRCSGTTTCSLRLVVQLIRAFFFLLTPVNYALFL

SEQ ID NO: 139490 - protein, 348 aa, Triticum aestivum
  unsure (1)..(348): unsure at all Xaa locations
  Clone ID: PAT_TA_33908.pep
MSRPALSILAPPAVSSAAAAPPGLDARALAGDVATAVDAAMASRHDKWMAEHGRACADEEEHAAAAFIDSFTAAKVSGQRLATSRFADLTGQESRAARTGLRSPVAGRGERRXGFRYENFSLADAAGSMDWRAMGAVTGVKDQGSCGCCWAFSAVAAVEGLTKIRTGRLVSLSEQQLVDCDVNGDDEGCAGGLMDNAFEYMVRRGGLTTESSYPYRGTDGSCRRSASAASIRGYEDVPANNEXAALMAAVAHQPVSVAINGGDSVFRFYHSGVLGGSGCGTELNHAITAVGYGTAGDGTKYWIMKNSWGGSWGEGGYVRIRRGVRGEGVCGLAQLASYPVKLATLPYG

SEQ ID NO: 139491 - protein, 225 aa, Triticum aestivum
  Clone ID: PAT_TA_33909.pep
MNGEKSLNNQIMAPSQGHFQLRDEKSDGTPRPWANANSPNRTDFLGETSQPGGPVTKIDLDSRGLSSPGKSPDVEILYEVKKDDRLNNFIATSDVIYNDKINSHSASKSGRELSRYGPKRILNPSKYNASPYVNQKSSRYPVTTRMIQLHDAIVTLSLDEDYKYKTCIDYGKVTVTYFSVGTSFATNGLVDTYTINAWCHKLSLDNRPKESKVHHFFTLSLNIYY

SEQ ID NO: 139492 - protein, 150 aa, Triticum aestivum
  Clone ID: PAT_TA_33910.pep
MEGEYYDSLVARFGEQGSLIEGFGREAEGPDAYRTQLRQRMSQDFLLRNLEERRRAADDVCSDPASKKAMLGLQVLTVGETREQDCAVCLEEFVDGGKKLRMMPCYHSFHQRCIFDWLRLNRICPVCRFALAPQSDDDSNKDLGLPEKVE

SEQ ID NO: 139493 - protein, 112 aa, Triticum aestivum
  Clone ID: PAT_TA_33911.pep
WSEESRPPTIAALCVLLLLVLLPGEVAAKSKFCKCFDDCFPGCTNDHVPRFLCQLFCANKCSPNQAAVSGDAMCRMACNKLNIKICGWSAAPADAADAASCEENCNKKWSQN

SEQ ID NO: 139494 - protein, 140 aa, Triticum aestivum
  Clone ID: PAT_TA_33912.pep
PSPRISSLLSSLDPEEEEEAVACTRKEMEAKRSRPAAMAALCVLLLLVLLPGQVAAKSKFCKCFDDCFPVCVDDHVPRFLCKVFCANKCSPNQAAVSGDAMCRMACNKLDIKICGWSAAPADAADAAVCVENCNKKWSQN

SEQ ID NO: 139495 - protein, 300 aa, Triticum aestivum
  Clone ID: PAT_TA_33913.pep
RAVLQYLPSVAGVLLCGQLKLIEPDRLNLRTMWKFLPAAVMFYISIFTNSELLMHANVDTFIVFRSAVPIFVAIGETLYLHQPCPSFKTWLSLSTILGGSVIYVFTDNQFTLTAYSWAIAYLASMSIDFVYIKHVVMTIGLNTWGLVLYNNLEALLLFPLELLIMGEFNQMKVDSSKMTTNWLSFDVVLPVALSCLFGLSISFFGFSCRRAISATGFTVLGIVNKLLTVVINLLIWDKHASLVGTIGLLICMSGGVLYQQSATKPKVPKIEPKEEDDEEGQNLLQIQPGHESNPSQKHSS

SEQ ID NO: 139496 - protein, 501 aa, Triticum aestivum
  Clone ID: PAT_TA_33914.pep
MEVTANVASPPSRPLSVRVSAETEGADNSTAEEPMSPTGRILEEMGVCIVIVMGLSTPVNLPVFRSGIETELITRSSRFCSIQIMDGPKDGKPRWVQTAVNVDEHIIVPTFDPAAVASNPEKAVEDYVAMLSTLPMDRGRPLWEFHFLNLKTSGAASTVVLRLHHSIGDAMSIMTLFMASACSTADPTRLPAMPPPPRRTGAIYQQRTRPPLSLSSHYLAWVWSYFVLAWHTLVDVALLAATVLFLRDPRTMFTHMPDASGSRRRKRFVHRSFSLDDIKLIKTVMNCTINDVLVGVTSAALSQYYFRKSGDTNTKRICLRSILPVNTRPISSRQTYVTKVERGNRLSSLIYPFHIALHNDPLEYVRKAKRSMHRKKSSLEVKFIQVVVQFLVKYFGAKTGAFIFRLFATRTSTLLSNVVGPSEHITLCGHPISFMAITAYGQPQALIMHFLNYGSTIRVTLAVDDEQFPDCHKLLDDFADSIRLIKDAADLKTLTTSIMND

SEQ ID NO: 139497 - protein, 93 aa, Triticum aestivum
  Clone ID: PAT_TA_33915.pep
QVAGQHVTTSASFLDKKQLSNTAAGPSWPSTEKEGVNLCSLKLADRVKAILHICLVFWELRIHNILKHMLCIQNLPCSSIHAIIHLMKTHRHL

SEQ ID NO: 139498 - protein, 63 aa, Triticum aestivum
  Clone ID: PAT_TA_33916.pep
MAVPKKRTSMSKKRIRKNIWKKKTYFSIVQSYSLVKSRSFSSGNEHPKPKGFSGQQTNNKIFE

SEQ ID NO: 139499 - protein, 83 aa, Triticum aestivum
  Clone ID: PAT_TA_33917.pep
YGSSRNLNWRNWTTHFIDVPKQSNELDCGIYTTLFLKHWKPRILMHDIVKDEDIANIRIRMANEMMFTDHNIKNDHKKLVLEF

SEQ ID NO: 139500 - protein, 174 aa, Triticum aestivum
  Clone ID: PAT_TA_33918.pep
SHRSAGSWSQPRRRTSHRPLLQRRRVGDVAPGRAWQTTRCTAPRGLRQRCRVMVAGALLALGGRLRGRGEGAPSPWWRPVPWRFAPPAIVVIPSTGARSGHLWPRCRWMWQIPTNLGVAAETLATGEGCGRVLESADLGVGSMVRVVGGGGGRRWVAVGVGDGGRRWIGRVGGR

SEQ ID NO: 139501 - protein, 86 aa, Triticum aestivum
  Clone ID: PAT_TA_33919.pep
MGNGQPNRVDSLRIAFRKAGEAAKGAALASDAFFPFAWKDAVEEACENGIGTIAQPGGSMRDKDAVDCCNKYGVSLLFTGVRHFRH

SEQ ID NO: 139502 - protein, 519 aa, Triticum aestivum
  unsure (1)..(519): unsure at all Xaa locations
  Clone ID: PAT_TA_33920.pep
MVCAAVSLAGGSATATATSLSRRPALGLRSRRLLWARAMSHVAPRLSSATVGAPTPDHDQRPGRARAVAAQAGPRQALISLSDKTDLANLGNGLESLGFSIISTGGTASSLEAAGVNVTKAEQITNCPEMLDGRVKTLHPSIHGGILARRDQEHYLKALNEHGIGTFDVXCGXNLYPFYDKVTSGTISFEDGIENIDIGGPTLIRAAAKNHKDVLVVVDHHDYPALLKYLQEKQADPQFRRMLAWKAFQHVASYDSAVSEWLWKQSSGGEIFPPSFTVPLSMKSTLRYGENPHQKAAFYGDRSLSLVNAGGIATSFQHHGKEMSYNNYLDADAAWNCVSEFENPTCVVVKHTNPCGVASRQDVLEAYRLAVRADPVSAFGGIVAFNTTVDEDLAKEIREFRSPTDGETRMFYEIVVAPGYTEKGLEVLKGKSKTLRILEAKRSGENMLSLMQVSGXGWLAQESDDLTPEDITFTTGSERAPTDSELSDAKFAWLCVKHVKSNAIVIAKDNCMLGMGSGQ

SEQ ID NO: 139503 - protein, 174 aa, Triticum aestivum
  Clone ID: PAT_TA_33921.pep
PRPPPHPSTHLPPVSFREVVAGEQEQKAMADVQMGSGTETETFAFQAEINQLLLLIINTFYSNKEIFLRDLISNSSDALDKIWFESLTDKSQWQTMRTTWAPSWARAPRSSWRLCRAGAVAAPAGVKQALISLSDTTDLANLGNNLQSLGFSIISTGGTASSLEAAGVNVRKVE

SEQ ID NO: 139504 - protein, 239 aa, Triticum aestivum
  unsure (1)..(239): unsure at all Xaa locations
  Clone ID: PAT_TA_33922.pep
MFFEAYRLAVKADPVSAFGGIVAFNTTIDEDLAKEIREFRSPTDGETRMFYEIVVAPGYTEKGLEVLKGKSKTLRILEAKRSGKNMLSLRQVXGGGWLAQESDDLTPEDITFTTGSERAPTDSELSDAKFAWLCVKHVKSNAIVIAKDNCMLGMGSGQPNRVDSLRIAFRKAGEAAKGAALASDAFFPFAWKDAVEEACENGIGTIAQPGGSMRDKDAVDCCNKYGVSLLFTGVRHFRH

SEQ ID NO: 139505 - protein, 83 aa, Triticum aestivum
  Clone ID: PAT_TA_33923.pep
MVGSTAASSQTLKTNSDNMGWEFATLIYPLDLSRVKCKLCGKEMFGGINRMKQHIAQIRGQVTPCTVANADQQKRCREACEAS

SEQ ID NO: 139506 - protein, 98 aa, Triticum aestivum
  Clone ID: PAT_TA_33924.pep
SVVAAEEITKLHEEFWRGTLGEANEAFASRQPKGEITILIDGNSVSIDETPSDDFLEHELRELMAKGHALSTAVKLVAEATSAKKKDVYALALRVFGK

SEQ ID NO: 139507 - protein, 81 aa, Triticum aestivum
  Clone ID: PAT_TA_33925.pep
MYHQSAPPQTNGIDAMNGASMVNRDTKTRPTRPCAYFNGPRGCRNGANCTFLHESSATSRQQEQQNGSKRIKLDSRITGRN

SEQ ID NO: 139508 - protein, 201 aa, Triticum aestivum
  unsure (1)..(201): unsure at all Xaa locations
  Clone ID: PAT_TA_33926.pep
VASEYFRSGADKISXGSDAVXAAEAYLQTGVKTGKSSLEQISRVYGNQAVVVSIDPRRVYVKSPDEVQFRTVKVSSKGPLGEEYAWYQCTVSGGRDSRPIGAYELAKAVEELGAGEILLNCIDCDGQGGGFDIDLIKMVSDAVTIPVIASSGAGSVEHFSEVFEKTNASAALAAGIFHRKEVPILAVKEHLVDAGVEVRMQ

SEQ ID NO: 139509 - protein, 206 aa, Triticum aestivum
  Clone ID: PAT_TA_33927.pep
MRGSRWCCCCFGRGGGGAGRSGSVGDDGLVWDVGLKAHASGEYSVAVAQANEALEDQAQVLVSPAATLVGVYDGHGGPDAARFVNARLFSLIQEFASQSGGISAQVIKRAFGATEEAFMGMVEKSWPSQPRLLSVGSCCLVGAIEDGTLHVANLGDSRAVLGRLASTGGKKRRAVVAERLSRDHKTAPTKKGAGREVGGRTRTNPS

SEQ ID NO: 139510 - protein, 195 aa, Triticum aestivum
  unsure (1)..(195): unsure at all Xaa locations
  Clone ID: PAT_TA_33928.pep
MESVEAANGNSGRVGIIVWTNAMTKTMLGFLAGLVADVKRTSSGFRDVHHRXCAAVLNEQFKLFVTGEQVKNHLKKWRKIWTKVVNLKNLSGALWDEDTCTIRLSEEHYAGHCXANAPFLNAPIEHYHAMAGIYGTIGAKGMNARSGNDLLSTDLEDEENGEVNTSPNVGESSLPKAPPKKKAKSTHCQVLMKST

SEQ ID NO: 139511 - protein, 210 aa, Triticum aestivum
  Clone ID: PAT_TA_33929.pep
MARTALISSCRSTGAAASSSSPSPRARIYTRASSSSSRPPLLASPPPPRSTPRRCSIKTLAAVKGASLSGWRSAREEKELEMTIESSVRLAGGELSVRGRTVLSGVPDAVSASPAAARGPVDGVFLGADLAGPASRHVVSLGHMRGVRFMACFRFKMWWMAQRMGDKGGDVPHETQFLLVESRAIGGEEDDASYVVFLPLVERRVGPASR

SEQ ID NO: 139512 - protein, 363 aa, Triticum aestivum
  Clone ID: PAT_TA_33930.pep
LGGYYDAGDNVKFGFPMAFTTTLMSWGLIDFGKNFGSHGGEARAAVRWATDYLMKATATPNTVYVQVGDAFHDHSCWERPEDMDTPRTVYKVDPQHPGSDVAAETAAALAAGSIVFREADPAYSKRLLDRAISVFEFADKYRGAYSSSLYSAVCPCYCDYDGYQDELLWGAAWLHKASRQRVYRDYIKKNEVALGASDSINEFGWDNKHAGINILISKEVLMGKDSFFKSFRVNADNFICTLLPGISNHPQIEYSPGGLLFKVGNSNMQHVTSLSFLLLAYANYASHANARVPCGGSSASPVVLRRVAKRQVDYILTDNPLRMSYMVGYGPAFPRRRRQRPVSLLSQVDYILGDNPLRMSYMV

SEQ ID NO: 139513 - protein, 314 aa, Triticum aestivum
  unsure (1)..(314): unsure at all Xaa locations
  Clone ID: PAT_TA_33931.pep
MEKPSHVATADGKQASHRIAVVTGGNKGVGLEVCRQLAAQGVTVILTARDEKRGKDAVESICRESNLSNVVFHQLDVRDDSSVASLARHIESRYGELDILVNNAAVVGVAADEEELRVLNRYVGERPSGEVGNLLKGMFQQTYEVARDCLDTNYYGCKRVTEALLPLLKLSXSGAKIVNASSLASELKRMPNEELRKDLSNIDIWDEARIEAVLNTFMDDLKNGRLEEAGWPAMLPAYSVSKMVINLYTRILARRYPEMRVNCVRPGFVRTDINWNLGTLTPEQGARGPVMLALLPQDGPTGCYFDQTEMVNVW

SEQ ID NO: 139514 - protein, 191 aa, Triticum aestivum
  Clone ID: PAT_TA_33932.pep
RARSVPPYPLLASTLPPVTPRAPLLAAGVDSYKPRQGGRVRAARAKERGQASRRGGFCLECGPYCNGQPEVRRRLWSQAWIGVAKSNEVIAADLRATSRRASPACRRCTRARSTPSVWRATATSSCTEGTHPSASRGAGTSRVRACTPRPRGVRLELTGESAKVHTVPAEAMLFRLCCAIVDSACTTAAGV

SEQ ID NO: 139515 - protein, 123 aa, Triticum aestivum
  unsure (1)..(123): unsure at all Xaa locations
  Clone ID: PAT_TA_33933.pep
MAPAGNRGARAVAPAVLVLALALAPRGDLAAFACATGNDGLMPGLGCLQWGGAVPRARGAGIGGAGAGAAGHXPRAAPACACLTTVAAAAAGGPYLGRAAGLPGRCGVQPPFKIDPNVNCNAV

SEQ ID NO: 139516 - protein, 116 aa, Triticum aestivum
  unsure (1)..(116): unsure at all Xaa locations
  Clone ID: PAT_TA_33934.pep
MEKMSSSVQSWVDQHKLATVGAMWTTAVGASVACGRRRGKAAGFTXRCRARAERRWRTTTTQRNGGRRRRGASSWTSTRSXGGHRRRRPGERAVDLLADQTFRSRPAGRPWIETRR

SEQ ID NO: 139517 - protein, 112 aa, Triticum aestivum
  unsure (1)..(112): unsure at all Xaa locations
  Clone ID: PAT_TA_33935.pep
LHLFMCNNIAEYSIENSAIKPMYMLTCEGATEXLYMNLKQEEEPRILQEASSIRAQWRRSQGSIDTWCVSIAYLPKGYAGALPTSMCFVLQKWIFKNLQHMVSWEFLDMSTC

SEQ ID NO: 139518 - protein, 393 aa, Triticum aestivum
  unsure (1)..(393): unsure at all Xaa locations
  Clone ID: PAT_TA_33936.pep
LRGKANRSRSAPPLLPAYTAFLRSAAEIPSGSSPSPALPPLVLGRFLFPVPERAGDSSFRGRSLVVSDLSSTARVGASGPWAGAIWRTAXPPSNLQRFLDCTTPTVDTHILPKTNGRLSNDAWHHADADSVEYFNLADLWEQYYEWSAYGAGATVQLHGGDKVVQYYVPYLSGIQLYTNKVLNASRSFGEDYGMDFWSDDDDNEKMSRSWSSTSDDSFNCDVVGGNRRRPGHLYFEFFEVCSPYGRIPLMDKVYELSQGFPGLTSLKSVDLSPVSWMSVAWYPIYHIPYQRNVKDLSACFLTYHTISSSFQDHTPETMTYGSAASGKQNDQKANTVSLAPFGLAANKIQGSLWTNPRTGDHKRIVSLFGAADSWLKQLGVRHHDFNYFVTHPM

SEQ ID NO: 139519 - protein, 300 aa, Triticum aestivum
  unsure (1)..(300): unsure at all Xaa locations
  Clone ID: PAT_TA_33937.pep
MSSAAQQLPRTESRTLSGHEGAVLAVRFNHDGKYCLSCGKDRTVRLWNPHTGAHVKTYKSHGREVRDVNASSDNAKLVSCGGDKQIFYWDVASGKVIRKFRGHNSEVNSVKFNEHNTVVLSAGYDRSVRAFDCRSQSSDPIQTIDTFQDSVMSVNVTNTEIIAGSVDGTVRTFDIRMGRETVDNLGHPVNCISLSNDRNCXLANLLDSTVRLLDKNSGEMFQEYKAHICKSFKMDCGLTKDEAFGIGGIQDGFGFLWGISGCXLVATFRALSAVVTSVTYHPTKTCMLTSSVDGTIRVWT

SEQ ID NO: 139520 - protein, 71 aa, Triticum aestivum
  Clone ID: PAT_TA_33938.pep
KYESIAAIEKGRRRRFHDDITVVVLFLDSRCEGTPQPTAGAGGIDGTRAPVDVFSLGPDDHGDDPTRPVLR

SEQ ID NO: 139521 - protein, 507 aa, Triticum aestivum
  unsure (1)..(507): unsure at all Xaa locations
  Clone ID: PAT_TA_33939.pep
QSEHGAQSVALSGGYIDDEDHGEWFLYTGSGGRDLSGNKRTNKEQSSGPKWDQANAPRPLCCSEGCPVGGGPAPXCSVRHPLRVLRSPMVEPSALAPAAGGRVVGVHTRAAGCSSFGAPGTHLLGPVLFVRSGHDPAPGSRGRQGLRPWPLPRIQELQGATDITERAGSPSWDYVENEGWKWVKPPPISKKPAQSGDPETDKQFRKYQKRAHMSMNERLLKEFGCSICKNLMNEPRPPPCGHNFCKACLTAAFGDEGSMRERSRGGXTLRAQKIVKNCPSCPTDICDFLENPQINIEMKDLIDNLLAKAAKEKPDAEGSAEENDDEEDALEKEEEDDSSLNEEENDDGAENKAGEEDAVVTIVVEAKDELKKPLKRKGAEEEAKDEKKIKTTAAAPDVENAAEEDAEMVEKEEEEGAQKAQKKRKGRAGAAGTAAGGGKRKRAGPAAAEEKAAAAGGGKRKKASPAAAAEETPAAASTPRRATRSGGVVVAGGSPASRTRSNTKADN

SEQ ID NO: 139522 - protein, 196 aa, Triticum aestivum
  unsure (1)..(196): unsure at all Xaa locations
  Clone ID: PAT_TA_33940.pep
KFVIIDDGWQSVGTDKQSPDLDSAGEAGKSPPLPRLTGIKENSKFQSGDDPATATGIETLVRAAKEKYGLKYVYVWHAITGYWGGVRPGVAGMEAYRSSMQFPKISPGVAENEPNMKTDVLTLQGLGLVHPQAVHRFYDELHAYLAAAGVDGVKVDVQCVLETLGAGHXAXQSQEYTRARRSVPSRGYRLMKALSS

SEQ ID NO: 139523 - protein, 128 aa, Triticum aestivum
  Clone ID: PAT_TA_33941.pep
MRTTGILIVVVVVVMYAISTSATRCGDSMGHQLMGHQVEDGWEPIVNINDDHIQELGEWAVSEFNKHVNCTVKFNKVLSGRQKQVSDMNYELIIDVTHFRGEDGNYKAELYEQELTKKRQLLSFTKVK

SEQ ID NO: 139524 - protein, 176 aa, Triticum aestivum
  Clone ID: PAT_TA_33942.pep
EPWLRDRGNLSRLFLAGDSAGANIAHNMAMRAGSGSGLEGGAAILGVLLLDPYFWGKRPVGAETRDPATRRRYEETWSFVCGGRYGIDDPLINPLAAPASALRRLACARVAVTTSGLDNFEARGEAYAAALNGSGWRGEVVRYETAGERHVYFLDQPASPKSARELAFAAAYLSRE

SEQ ID NO: 139525 - protein, 210 aa, Triticum aestivum
  unsure (1)..(210): unsure at all Xaa locations
  Clone ID: PAT_TA_33943.pep
SLGGLTQMNFSNNQLTGXEPAGLGSMPVLTLLDLSSNQLSGSIPRALGSLRLNQLNLSSNNLAGEVPEALAVPAYDRSFLGNRALCTGAASSGNLAGVSSCAARSSDKVSPGLRTGLVAAAAALLVVIAALAFFIVRDTKRRKGLAPPEEAWKLTPFQPLDFGEGPVLRGLADENLIGKGGSXXVYRVECPSRSGASGGTVVAVKRIWTG

SEQ ID NO: 139526 - protein, 223 aa, Triticum aestivum
  Clone ID: PAT_TA_33944.pep
RRPPGGPARGRSRSLSRSDSDRRSPSPKRRRHDVHASRSRTRSRSRSRSRSRSRNRSRSRSYTRNRRASRSRSRSPGARRRPERRAGSGSTRPDSAHPVEKKSSPNAHPSNDHKSRSVDPSNDYQAEDGKMGKVDLDRSPSPQEQDDKSAPYSPVYNGEGGRGSMSPNGEPVVDAKPVEVSVSSKKREDEEEGMRGEYDEEGVIADDDTRARPAVQCSCEERR

SEQ ID NO: 139527 - protein, 271 aa, Triticum aestivum
  unsure (1)..(271): unsure at all Xaa locations
  Clone ID: PAT_TA_33945.pep
SYIPRPSRFPATSAMSYQTLELTLISASDLKKVTFFSRMHIYAIASISGGDSRMPTHGIGTQVDHTNGPNPTWNAMLHLPIPACVDTRGLVLHVSLRSEALFFGHHDVGEVFVPLNDLLAGTNNTNDPKTMSYQVRRPMSGRAHGVLYFSYKFTGIKAAPASATENKQGQYVKYSGDSGVAMPRPMVPVTAYPQPHATFSYPPNAVYPPPYMYNTAPAPAKMYYVYAPATTMAAPARHAGGIGMGLXLGLLGGAAGGMMAXMLGDLESDAV

SEQ ID NO: 139528 - protein, 146 aa, Triticum aestivum
  Clone ID: PAT_TA_33946.pep
ARGLARSAVDYMVCLLSDIFMPTYDGPSNFANNLMGHRLYYGFRTTITPNRKALAPIFMDMEEGRASGYEERIRQVMFNTHFGAPHKRIHPESFYTNSWPECFCQMKAGNQADRCPPDNVNDVLESQFQNKEDVEAEATNQTDSTS

SEQ ID NO: 139529 - protein, 68 aa, Triticum aestivum
  Clone ID: PAT_TA_33947.pep
MDTAKAPVKLVKVTRVLGRTGSRGGVTQCRVEFMDDQTRSIIRNVKGPVRENDILCLLESEREARRLR

SEQ ID NO: 139530 - protein, 255 aa, Triticum aestivum
  Clone ID: PAT_TA_33948.pep
MKILVAVKRVVDYAVKVRVRPDRTAVDTGSVKMSMNPFCEIAVEEALRLREAGAASEVVAATVGPAQAADTLRTALAMGADRAVHVLHDPDPARPLLPLAVAKILRALALQETPGLLILGKQAIDDDCNQTGQMLAALLNWPQGTFASKVIIDKDKQKATVEREVDGGTETICLDLPAVITTDLRLNQPRYATLPNIMKAKSKVIKKVTPADLNVDVRSDMEVLRVDEPPKRKAGVILSSVDELLDKLKHEARVL

SEQ ID NO: 139531 - protein, 58 aa, Triticum aestivum
  Clone ID: PAT_TA_33949.pep
CCHHLAEFMPTVVRMEPYAYCCSNGTIIQTSEHALLYQMRIKVGMIFECCKINETYIV

SEQ ID NO: 139532 - protein, 439 aa, Triticum aestivum
  unsure (1)..(439): unsure at all Xaa locations
  Clone ID: PAT_TA_33950.pep
GPSIWDAFAHVPGNIAGNQNADVTTDQYHRYKEDVNLMKGLNFDAYRFSISWSRIFPDGDGKVNKEGVAYYNNLINYLLQKGITPYINLYHYDLPLALEKKYGGWLNAKTVGLFADYADFCFKTFGDRVKHWFTFNEPRIVALLGYDVGSNPPQRCSKCAAGGNSATEPYIVAHNFLLAHGYAVARXRTKYQAAQKGKVGIVLDFNWYEALTNSTEDQAAAQRARDFHVGWFVDPLINGHYPQIMQDLVKERLPRFTPDEAKLVKGSADYIGINQYTASLMKGQKLTQQTPTSYSADWQVTYAFERNGKPIGPKANSNWLYIVPSGMYGCVHYLSQKYGNPAIVITENGMDQPGGLTRDQYLRDATRVRYYRSYLGELKKAIDGGANVLGYFAWSLLDNFEWISGYSSKFGIVYVDFNSPNLYRHPKGSAYWFKDLLQH

SEQ ID NO: 139533 - protein, 507 aa, Triticum aestivum
  unsure (1)..(507): unsure at all Xaa locations
  Clone ID: PAT_TA_33951.pep
MAARSAVLLLLALVAAACHGVGAAGAGASPRRPNWLGGLSRASFXPKGFVFGTAASHGQAAGGAAPGHRGTSFAHAFANVPGNIKADVTTDQYHRYKEDVNLMKGLNFDAYRFSISWSRIFPDGDGKVNQEGVAYYNNLINYLLQKGITPYINLYHYDLPLALEKKYGGWLNAKTVGLFADYADFCFKTFGDRVKHWFTFNEPRIVALLGYEVGSNPPQSCSKCAAGGXLATEPYIVAHNFLLAHGYAVARLAXEGPEIDAGKVEQLLNXWEVTYSFERNRQTRIXKSRGFHLGFDFXDPLINGRDPHTTQDPGREETHAYSPXTRKRARGQRRVPSPTNQYTASLRTGDKVPHETQLSYXGARRPMTXHFERNGRPIGPXANSKLVSDIVPWXVYGCVQNFRXQHGTPPKVVSVNGMDSPGSITREHYMRVPMSLRFYRRSLGGLKKAIDGAANVLGYFARYLLDSFRXSTQYCYNLGRLQHDLTWPPQAQPPKASAFWFRVLLQP

SEQ ID NO: 139534 - protein, 110 aa, Triticum aestivum
  unsure (1)..(110): unsure at all Xaa locations
  Clone ID: PAT_TA_33952.pep
DDGRPTPXFAAYGATNEGVVHLTKSLQPGMVTTDLLMSGATAKQAKFFINILAETPDVVADYLVPNIREIPTKQSMKPTYIRFLTGLKAYSRIFSRIAFGARRNKYVAED

SEQ ID NO: 139535 - protein, 186 aa, Triticum aestivum
  Clone ID: PAT_TA_33953.pep
LRLERLLWLDRALDLLARPPVAWVPCQGPLPFFVASLPRLPTCWIRRLHWRLPVLPRGSARPSRCRGPLGLLRHPSVSSAAWADPARLQAPARLRRQPPPSAPSAASAATIGDSLSSTTATQIEAAVTCRRVTIASHRFLLRQWLIQPNFRRGPVSVDKHRLLPQEPPPIPNPSRTTPCYPILWRA

SEQ ID NO: 139536 - protein, 166 aa, Triticum aestivum
  Clone ID: PAT_TA_33954.pep
EYFVARVTEYAVVGRLLVPSAAEAVLSAAKADGYRAPELQTMKRCAPRTDVYAFGILLLELLMGKKPSSAANGGDDLPSLVKAAVLEETTTEVFDPEVAKGVRNPAEEGLVQALKLAMGCCAPVAAARPSMAEVVRQLEENRPKSSRSALYSPAETRSDAGTPLYS

SEQ ID NO: 139537 - protein, 112 aa, Triticum aestivum
  Clone ID: PAT_TA_33955.pep
MLGMKWKLPCMSAKKKKKKKKKKKKKKKKKKKKKKKKKKKKKKKKKKKKKKKKKKKKKKKKKRGGPFKRTKFYFPGLGRKNFFFGAPKFNSLGGFLKRGDWKNPGVTQIKSF

SEQ ID NO: 139538 - protein, 73 aa, Triticum aestivum
  Clone ID: PAT_TA_33956.pep
SMISSTREANGPIWLFFLSTITTRYKMYTYSHSHLLVYTIDKHQAEIQIPATAEKQSQASTLSLPAKMPCSIT

SEQ ID NO: 139539 - protein, 124 aa, Triticum aestivum
  Clone ID: PAT_TA_33957.pep
PRLLPFAAPAPGQRPRARGPRGAPPLPQPPQRLLPAPAPSAPPAPRPLPRLRPRLPRRLPPRRPPRRAPPPSPPARLPAPRPPSPGPAPASKPVPPTWGSRARAWSCWPRIAPARPDNSSAMES

SEQ ID NO: 139540 - protein, 231 aa, Triticum aestivum
  Clone ID: PAT_TA_33958.pep
TALWASPCSVLLLTMLFMAVTSAGSAELVAVSSLFTYDIYRTYVNPGASGKQILLVSRAVILAFGCSMGVLAVVLNLVGVSLGWMYLAMGVLVGSAVIPIALLLLWSKANAFGAMLGTISGCVLGVIVWLTVAKVQYGRVNLDTTGRNAPMLAGNLVSILLGGAVHGVCSLVSPQNYDWESSRRITTVESVAAEDDDELQEAKLVHAKRWIVKWGLVFTVVIVVLWPALSV

SEQ ID NO: 139541 - protein, 152 aa, Triticum aestivum
  Clone ID: PAT_TA_33959.pep
GSGSLPAEKKDQLPAVRVKLEHDPLDMLVKAFEMSGRLCLAVKVPGFPPTLQLWVMSLPPQDQWADSDDKKLCWDLHYSFTAYYTNNNVPTSVWFDNGEKTLCVRQEDVLFKHGMRGRSPEPSRYSYCPECDQRLELHMEHFEGLSPQLALK

SEQ ID NO: 139542 - protein, 176 aa, Triticum aestivum
  Clone ID: PAT_TA_33960.pep
LHEQFRSVGGPPRPERRDRDGQYATCRKGSNALAVRSRGWSSSRRHETYITKDKLLSALMQLLVRRRSRQSTSVVLPLQEHLPLLSVRAGTHELLHPLSPGTPPEHPPTRAPSPCYGVGCRRRRRGDATEGVGSTPMAGSCWRVRASPSSTRWGAGTPEHQLRPKNTTASPSAQPL

SEQ ID NO: 139543 - protein, 360 aa, Triticum aestivum
  unsure (1)..(360): unsure at all Xaa locations
  Clone ID: PAT_TA_33961.pep
RRDDQGRGDGGADAAARAPSPAPPPAPLRRRRAGDDGVDHDGKQLRTASAWTASAHIGSGVLSPAGLSAQLGWVVGPVTLRLFAAITYYTSGLLAYGYLAGDAHTGKPLNTYRDSVAMDAVPPQVWACGVFQYVNLVGTAIGYTITASISAAAINKANCFHKXGRAADCGVYDSMYMAVFGVVQIFFSQVPNFHDLWWLSILAAVMSFTYASIAVGLSLAQTISGPTGKATLTGTEVGVDVDSAQKIWLAFQALGDIAFAYSYSMILIEIQDTVRSPPAENKTMKKATLVGVSTTTAFYMLCGCLGYAAFGNGAKGNILTGFGFYEPYWLIDFANVCIVVHLVGAYQVFCQPIFAAVEGF

SEQ ID NO: 139544 - protein, 128 aa, Triticum aestivum
  Clone ID: PAT_TA_33962.pep
MRTSSFLLIVAAAFLYAIASPATGCGEWMGNQLRNTTIENGLEPIRNINDQRIQVLGNWAVLEFGKYTNCVLKFNKVVSGRQQHAFLLYYKLIIDASDVRGVDGKYKARVLVQEGVHRPHLFSFAKVN

SEQ ID NO: 139545 - protein, 98 aa, Triticum aestivum
  Clone ID: PAT_TA_33963.pep
RKQGSLVTLFVAIWHTCWSTIYLPIIRRTTDEVSVSASSVTCFGCDSPSSWLLLQMAISKNLCHCKIWEQVTSKVFIHRNSQLRHLAHFSRHLAHDFK

SEQ ID NO: 139546 - protein, 96 aa, Triticum aestivum
  Clone ID: PAT_TA_33964.pep
MDRIVQLVLEENNRLLTQIDTNIQAFQAQNNIDLFNRVRRNIDGLLKIMSQMPGKMSQMPQLGVAVNENLASYLLPDLTMAQVLGNSHLKEEPRGW

SEQ ID NO: 139547 - protein, 301 aa, Triticum aestivum
  Clone ID: PAT_TA_33965.pep
HEPSPRFRFRFVAAVAPSPRRRSRPHSLRAGTMSRRSNGRTIYVGNLPEDIREREIEDLFYKYGPIVDIDLKIPPRPPVYAFVEFEDPRDADDAIYGRDGYDFDGHKLRVELAHGGKGPYFIRPSSYSSSGRHGAVRRSDYRVIVTGLPSSASWQDLKDHMRRAGDVCFSDVYPEAGAITGIVEYTNYEDMKHAIRKLDDSEFRNAFSRAYIRVREYNARRSRSYSRGRSRSCSYSRSRSHSYSRSKSPRSRSASRSPSPVKARSSSRSLSPAAPAHDKSASRSPVRSRSLPRSQSPVKSE

SEQ ID NO: 139548 - protein, 109 aa, Triticum aestivum
  Clone ID: PAT_TA_33966.pep
WAWRHLQSGKSIADAADECIGDARQSDDFEVVFKLGIICTGAQPSTRPTMKDVLQILLRCEQAHRKTVDEKTAVSEYDAAPLLPAVRGGSRRKQLSDAADGKGSFDDVV

SEQ ID NO: 139549 - protein, 126 aa, Triticum aestivum
  Clone ID: PAT_TA_33967.pep
MSFQILRGEDNCPGLVVLSKLKLSIELWGRKSSSDGIVSWVLQKCVQLDELFSRPARRKNVILLAGYDEDTNAIFLSSDSHDFILQLESVQFRYIGRRECTHFRMYYPYTNFYIAERPRESRIKEE

SEQ ID NO: 139550 - protein, 137 aa, Triticum aestivum
  Clone ID: PAT_TA_33968.pep
MDAGGADLRSSIKKWKIIYPVYLNSKKTVAEGRRIAAAKACPDPTCIEIADSCAYLKIPRAIELDKAYPRDFFQVGRVRVQLTNDDGSPVNPAIRTKKQLMIQIAELVPKHHGRTKKQEPVAGPSVTTTNKKNKKKK

SEQ ID NO: 139551 - protein, 140 aa, Triticum aestivum
  Clone ID: PAT_TA_33969.pep
MDPGGTRIGADRRRGGADRRSSFPVCLNIYPVVPKSRRTAAARRRSAAACVCPDPTCVEITDSCGYLMITRPIELDNSHPRNCYRAGKQRGQLTNDDGPPGNNASTTKKQLIIQIAKLVRRNNGRTKMQEPVAGPSNYKY

SEQ ID NO: 139552 - protein, 232 aa, Triticum aestivum
  Clone ID: PAT_TA_33970.pep
APPAPIWGNDAAAKRAAEEEEDEVDAVHAALPEEIESEDEEHDDEAEDGAEDEPEHEVEAADPDVKKVAAAPKETERQLSKKELKKKELAELDAVLAELGISENTSDAAQDGNNNAEKKGASQAGDGERKEDAPAPLESKNAKKKKNKKDKSAKEAKEAEVSEEAASAEPEEDTAVDVKERLKKMASMKKKKSGKETDTAAKIAAAEAAARTARLAAAKKKEKSHYNQQPVR

SEQ ID NO: 139553 - protein, 78 aa, Triticum aestivum
  Clone ID: PAT_TA_33971.pep
FCHVSCMYVCDSYLVDRYPWNLDVRCEFMHVSELNMLGFGVSLEVWIVKCGRPDLDPGWNLILLPIWSFTACLHKKSK

SEQ ID NO: 139554 - protein, 59 aa, Triticum aestivum
  Clone ID: PAT_TA_33972.pep
TFQQTCEKFIFRWHMEIYIQMIWLLHIREIFSSGEHIKLPSVFLTYQIDVGTVCIGNVN

SEQ ID NO: 139555 - protein, 337 aa, Triticum aestivum
  unsure (1)..(337): unsure at all Xaa locations
  Clone ID: PAT_TA_33973.pep
LPLNWATQVFRFCRGVKAAATVRVRPMHRKALLEALAEELPPGTIRFSSKLASIATEKAQGSPEIAVLRLDDGTVIRSKVLIGCDGVHSVVSQWLGLSEPASSGRSAVRGLAVYPDGHGLKKELRQFLSEGLRAGMVPISDTDVYWXLVNNTVPAEQEAGTDPAKILREVTDNLGRHMPAEYLDVARHSDSGNLSWAPLLYRAPRAILRGPAARGPVTVAGDAFHPMTPDMAQGGCSALEDAVVLARALSRAATPADGVASYVAERRGRAAWLVAGAYLSGWVQQGGTNVRGVRGYMVRLFRDWIFYRFLFPRLADTMWFDCGDLVEPNAEGKTHSE

SEQ ID NO: 139556 - protein, 128 aa, Triticum aestivum
  Clone ID: PAT_TA_33974.pep
MVQLRSSLSMTRARTRSDSDDADDRGWSQLHVAARKGNLKEVRRLLNEGMNVNAPTWGPKSPGATPLHLAAQGGHVKIMDELLERGANIDARTKGACGWTPLHIAAKERNKRVVRFLVENGAFLPPDL

SEQ ID NO: 139557 - protein, 160 aa, Triticum aestivum
  Clone ID: PAT_TA_33975.pep
MTRARARGGDSDDADDRGWNQLHVAARKGNLKEVRRLLNEGMDVNAPAWGPKSPGATPLHLAAQGGHVKIMDELLERGANIDARTKGACGWTPLHIAAKERNKRVVRFLVENGAFLPPDLNDHRFNPPLHYCSGLEWAYEMKRMQDESDSGGEASFSSSN

SEQ ID NO: 139558 - protein, 79 aa, Triticum aestivum
  Clone ID: PAT_TA_33976.pep
ITLVCFHQIHIVVMGENTRFQEIALMSFIRTHHTWLFYIYTRTGNSKVVDYSISTVPTVREASHGLYARLPSEFLLSMG

SEQ ID NO: 139559 - protein, 78 aa, Triticum aestivum
  Clone ID: PAT_TA_33977.pep
SAHGAGGAHAAVGGCSDDGSLSSLSGYNNNQKADFAGYLDADALHGGVIPSAVAELEHKHNPRGDHWLKGSKLMGGRG

SEQ ID NO: 139560 - protein, 165 aa, Triticum aestivum
  Clone ID: PAT_TA_33978.pep
MPSACAAYNETSPLPSPRPPPAQVQLDERFGWSSARTPRVRVCVSVGPVGLSPSFMALVPILVARGGSEGTTGPNLDEELKAILGSSWQQLQTGHVCSCYSVMIQEEDRSVQSSREVASSDVSAAAPAGSPGTSVAMAVAANDNKAIATTSADNKRRRLHFPQRQ

SEQ ID NO: 139561 - protein, 624 aa, Triticum aestivum
  Clone ID: PAT_TA_33979.pep
MAPTGGAARAGSPVRTPLGSLIGLVNRDQQACAVLGDHGGGAGGSRSEARPSVAGVGGQSSGKSSGLDSIVGRDFRPRGSGIVTRRPLVLQLHKTEGGQEYAEFLHAPRKRFSDFAAVRKEIADETDRMTGKSKAISNVPIHLSIYSPHVVNLTLIDLPGLTKVAVEGQPESIVQDIENMVRTYVDKPNSIILAISPANQDIATSDAIKLAKEVDPTGERTFGVVTKLDLMDKGTNAIDVLEGRSYRLQHPWVGIVNRSQADINKNVDMLAARRKEQEYFQSSPDYGHLAHKMGAEYLAKLLSQHLEAVIKAKIPSIISMMNETVDEIEAELDRLGRPIGGDAGAQLYTILDMCRAFDRVFKEHLDGGRPGGDRIYGVFDHQLPAALKKLPFDKHLSLQNVRKVISEADGYQPHLIAPEQGYRRLIDSSLSYFRGPAEASVDAVHLVLKELVRRSIAATEELKRFPTLQSDIAAAANESLERFREDGRKTVIRLVDMEASYLTVEFFRKLPTEPDKGANNNTPANDRYQDNHLRRIGSNVSSYINMVCDTLRNTIPKAVVHCQVKEAKRNLLNRFYAHVGSKEKKQLSAMLDEDPALMEKRDSLVKKLELYKSARNEIDSVAWK

SEQ ID NO: 139562 - protein, 146 aa, Triticum aestivum
  Clone ID: PAT_TA_33980.pep
ADPCRLILGGERKLPVPWAKLQRVFWFADFDSDESMNERVLLQKFFEHIAIKTLSETLPNLQVVLIMNNTKFVHLQAERLARECFYFLRESFMFDEGTLGWFSDAPSYPNGMQVSAPVAYVFNMHPPTGIQFGDYQTELRKALRRA

SEQ ID NO: 139563 - protein, 216 aa, Triticum aestivum
  Clone ID: PAT_TA_33981.pep
QEDIPTAVCCAKLLPAGGDGHVLIMNDKNLQFSYKICHYYDPTKIVTCTPGLHSMESDSVTNGIMILQNVADPCRLILGGERKLPVAWAKLERVFWFADFDSDESPRVRPRVRGRVGHIAIKTLSETLPNLQVVLIMNNTKFVHLQAERLARECFYFLRESFMFDEGTLGWFSDAPSYPNGMQVSAPVAYIFNMHPPAGIQFGDYQTELRKALRRA

SEQ ID NO: 139564 - protein, 89 aa, Triticum aestivum
  Clone ID: PAT_TA_33982.pep
TSTWGYDSHVLNDWVKLEKDPSVWSREVHSLSCTTCVVHLTDIDLTGRYRRMNQSLKKTDLTGRDVKFTWILALEFQVFPVLYVCMTLV

SEQ ID NO: 139565 - protein, 140 aa, Triticum aestivum
  Clone ID: PAT_TA_33983.pep
LTCCFGCGIHLIFSLIATVMTWNSGDQRVRWGIILTFLVFVGGGIFHKIQRQALGWMGVALSVLSHSFRIGSTVYYAKINRYLFVASMVGSVNGFLWLIHPQLCISKEYKNYVTISLMVTGDPPTSWRIKMNSLVIKVVI

SEQ ID NO: 139566 - protein, 106 aa, Triticum aestivum
  Clone ID: PAT_TA_33984.pep
PGSLNRVADAVKTGVTTVTESLESADKMTTLLEKVVAAPTRVQDLRKSYEENKAIVSAMRKSYEDNTEVGSSFKSVVAGVVTSSLLLARQALKDLVRGGGGDGDAE

SEQ ID NO: 139567 - protein, 307 aa, Triticum aestivum
  unsure (1)..(307): unsure at all Xaa locations
  Clone ID: PAT_TA_33985.pep
MEETEAKKPTPASPLFSFSNPSASFGFGFGAAPGPPHPPPPPAVEVLLSEESPVAAGNLEPVVVDDSLSIYKGRVNTSDVFGVKNSDLVPGKYEGGLKLWEGSLDLVKTLNSDIKDDRLLMEGKHVLELGCGHGLPGIYAGLKGAGLVHFQDFNAEVLRXCLTIPNVKANLLKESSQGTFTSRSVGFYAGDWSEIDKLLLCGDAVQDKTTNLRTGNEGYRGYDIILMAETVYALDSLPSLYRLVKKCLHYPSGVVYMAGKKHYFGVGGGTRQFLRLVREDGAMQSDLLAEVTDGSSNVREVWKFSFK

SEQ ID NO: 139568 - protein, 90 aa, Triticum aestivum
  Clone ID: PAT_TA_33986.pep
MKKKGGRKIFGFMVKEEKEENRGSVEFQVFSFTNKIRRLASHLELHKKDFSSERGLRRLLGKRRRLLAYLAKKNRVRYKKLIGQLNIREQ

SEQ ID NO: 139569 - protein, 243 aa, Triticum aestivum
  Clone ID: PAT_TA_33987.pep
MTKRYDPEQVTHPLDVAQSAASVGVATAVPGLAIGSFYGTLKTTTPVLFSIASGAQCFAIGTTFWTARTAILNQDGLQNWWNFTRGVPLIPRNDQSPSLSDKVRASTIAGAFTGISLGLLLRGPRNVVPGTIMFTLFGWGGQKGYNFLDKRNSQELREQAQLKALGEDRPKETLVQKFAKSKWSPMSILTDEQYEEMLQEKLLKVEADIAIIDERIEAVKKMAIEEEGQRALREQEPPPQEKR

SEQ ID NO: 139570 - protein, 129 aa, Triticum aestivum
  Clone ID: PAT_TA_33988.pep
TCVKECPEPKHLCLAESSASLSMALSFLVRVVRGTFHLPPLQDVGQHLLRCMHPRAVAARGLGQAPDRPCPPLSTLATGHGPCFPLRPNRSTIMVVACHDEPNILARRGNGSDTSSRSGPRGRQFSQQY

SEQ ID NO: 139571 - protein, 226 aa, Triticum aestivum
  Clone ID: PAT_TA_33989.pep
MAEGARFHGMVGGGGKGMQENEFNGFFSMPYYQKIGPRGSHMSVDSTDNYNLAGGSVTMSVDNSSVGSNESRTVILKHPGLRDAPTASYSVGNSVFRPNRVAAHTLNEDALARVLMDPNHPTEILSKYQQWAIDLGRLDMGVPFAQGAFGKLYRGTYIGEDVAIKLLEKPENDIERAQSLEQQFVQEVMMLSTLRHPNIVRFIGACRKSIVWCIITEYAKGGSVRQ

SEQ ID NO: 139572 - protein, 328 aa, Triticum aestivum
  Clone ID: PAT_TA_33990.pep
LQQRHLSHKAAASVLKEDALARVLMDPTHPTEILTNYEAWTIDLGKLDMGAPFAQGAFGKLYRGTYNGEDVAIKLLEKPENDLERAQLMEQQFVQEVMMLSTLRHPNIVRFIGACRKSIVWCIITEYAKGGSVRQFLARRQTKSVPLRLAVKQALDVARGMAYVHALGFIHRDLKSDNLLIAADRSIKIADFGVARIEVKTEGMTPETGTYRWMAPEMIQHRPYDHKVDVYSFGIVLWELMTGMLPFTNMTAVQAAFAVVNKNARPAIPQDCLPALSHIMTRCWDANPEVRPSFNEVVTMLEAAETDVVSNVRKARFRCCISEPMTTD

SEQ ID NO: 139573 - protein, 345 aa, Triticum aestivum
  unsure (1)..(345): unsure at all Xaa locations
  Clone ID: PAT_TA_33991.pep
MLGQRCCRHLPWRRKSVGKSATDSTKPLIAIMSADASLQALKSPRHPTKLXTSSGARTLNLWTMAVRHPSAPASSGPRKPAETNGEDDAIKLLEKPENDIERAQSMEQRFVQDVMMLSTLRHPNIVRFIGACRKSIVWCIITDYAKGGSLGQFLAKRQNKSVPLRLAVKQALDVARGMAYVHALGFIHRDLKSDNLLIAADRSIKIADFGVARIEVKTEGMTPETGTYRWMAPEMIQHRPYDHKVDVYSFGIVLWELITGMLPFTNMTAVQAAFAVVNKGARPAIPHDCLPSLTHIMTRCWDANPEVRPPFTEIVCMLENAEMEVVSHVRKARFRCCVAEPMTTD

SEQ ID NO: 139574 - protein, 306 aa, Triticum aestivum
  unsure (1)..(306): unsure at all Xaa locations
  Clone ID: PAT_TA_33992.pep
PRVRGRVAASRLPQVEVFKKTTRMLQVQLDILDKKLGDELGKAKRDITKQFDDKGTDLVAKSLAVLGDVGFVAKSLADLSLTRLISKKGVXRILTRLKRRRGLDGSRSEIAVDDVRVFAKEIVEMEIARHAAGRAGGQSGLXHSGSFPRKAKSMLPRRSERSQNAGGPSFGQPRECFALEGSVGFVEIRLRTGIVPEAVTLEHVDKSVAYDRSSAPKDFQVSGWYQGADDDSDKQPRTPTSLGEFTYDLEKSNAQTFQLDRTTADASVVNIVRLDFSSNHGQPELTCIYRFRVHGSEPGSLGTAAS

SEQ ID NO: 139575 - protein, 101 aa, Triticum aestivum
  Clone ID: PAT_TA_33993.pep
RPSVPAHEVMHVFYVALLCTEEHSVQRPTMREVVQILSELPKPAANQDGEEELPLSCEGPESNPPAPTSYTEAPAGDAKDQQPQQRHTSSESSPPPDLISI

SEQ ID NO: 139576 - protein, 125 aa, Triticum aestivum
  Clone ID: PAT_TA_33994.pep
PGSVTFRFRQARVVNIKVTDADKDQLLSVALDAGADDVIEPNFDDEDDSEEVLERFYKIVTTSENYPVVLSKLQEEGLKFETDNGYELLPLNPIEVDDEAMELNKDLVLKLLELDDVDAVYTDQK

SEQ ID NO: 139577 - protein, 805 aa, Triticum aestivum
  Clone ID: PAT_TA_33995.pep
MEDPCLSTQLQDGDGVFNVSGLESFMKEVKLAECGLSNAVVGSMGPQRKGKSTLLMSLFRTNFMEMDAFRGRSQTTKGIWMAKAQNIEPCTLVMDLEGTDGRERGEDDTAFEKQSALFALAVSDIVLINMWCHDIGREQAANKPLLKTVFQVMMRLFSPRKTTMLFVIRDKSKTPLENLEPILREDIQKIWDGVPKPHAHKDTPLSEFFNVQVVALNSYEEKEELFREQVSNLRDRFQQSIAPGGLAGDRRGVVPASGFSFSSQQFWKVIKENKDLDLPAHKVMVATVRCEEIGYEKVATFTADEEWQQFEEAVQSDYVPGFGKKISSLLDRCLSEYDMEAIYFDEGVRTSKRHQLESKLLQLVNPAYQSLLGHLRTRTLEAFKESFDKAVEKEGFAVAARDSTQIFLEKFDKGSEDATIQQVNWDPSKVKDKLKRDIEAHVVSVRATKLSELCATYEGKLTKALAEPVEALLDSASEDTWPAIRKLLQRETKAAVSGLESAISTFELDEATEKELLLRLENHGRSVVESKAREEAARILIRMKDRFSTLFSRDADSMPRVWTGKEDIKAITKTARSASMKLLSTMAAIRLEEDGDNIDTTLSLALVDAARPGTTDRSIQSLDPLASSSWERVPEERTLISPVQCKSLWRQFKAETEYTVTQAIAAQEANKRNNNWLPPPWALAAMAVLGFNEFMTLLRNPFYLAVMFVVFLVGKAMWVQLDIANEFRNGFLPALLSLSTKFVPTIMNILKRLADEGAAPAAPERQRETELQPRNNSSNSNVTSAGSSSLTSSENGPEYSSPVAQ

SEQ ID NO: 139578 - protein, 110 aa, Triticum aestivum
  Clone ID: PAT_TA_33996.pep
VTHKLLEKLGCRVFSVSSGIQCMTSFAGGESSFQLVLLDLTMHTMDGFEVALAIRKFRSNSWPPLIVALAASSDDNVRDRCQRSGINGLLQKPVTLAALGDEVYRVLQHN

SEQ ID NO: 139579 - protein, 111 aa, Triticum aestivum
  Clone ID: PAT_TA_33997.pep
IAGSTAVINAEGQVCELAASVGSGKESSPPELELSAGKLNPQAPWLAMRIRIGSASPFRGSVVKLAGLWAPAIIKEIGRPCRPAHCKNHGVQGHSRFFLYKPGEMRLGSGA

SEQ ID NO: 139580 - protein, 135 aa, Triticum aestivum
  Clone ID: PAT_TA_33998.pep
KLMGDAIRTGAASSKPKEAPKAASKPKSAPKRNTRSIPAAEKNNAPVPEVATDEDDEGQVLRKLKPKIPDHNDAHPVAENMQIRRDSGLRKWREIDPYATRRRTVVDYRFHTKEQQDFYETVLLEKKPIVCEMRW

SEQ ID NO: 139581 - protein, 245 aa, Triticum aestivum
  Clone ID: PAT_TA_33999.pep
RATMAAAGTLVVYRAVFAALGCLMVGTLVYTCITDGSPFRTELLTPWMVTTLVDLYVNIAAISTWVVYKEGNWITSIFWVVLLICFGSATTCAYIVSKLFEITSSGLSQNPLDLLLLRQNNLPERKCSFVVIGRTIFSILGILMAALVTYTVITDGLPFRKDLLTPWMAATLIDFYINVFAISVWVVHRESTWISAVIWICLLICFGSITTCGYIVVQLLQVSYQDPVYHLLLNSHSKYGIAPLQ

SEQ ID NO: 139582 - protein, 263 aa, Triticum aestivum
  Clone ID: PAT_TA_34000.pep
ESGSGKRRSQPIWQAQKPTISRFWAMSWARVVIMKNRVLALMAEEDLRRQLKVFIHGGSLGSVSFGGGGCCKGSSSAAAAAHLPNGDTALQDFKSAVLRLAEANQRRLLPRSIHGGRPFPVRSMYSDSAAWYGGAAAASPPNGSTTLQQTCAKPAPAVDSEREWAYRQITEIETTKHHLFYLLAEMDKRYPGRRYTSNNKELIHHLFKHVEANPSDPLWRHTLGRERLNNCVIYGMPTLMATWLYLDWEGWKNMFAFLLGIGH

SEQ ID NO: 139583 - protein, 182 aa, Triticum aestivum
  Clone ID: PAT_TA_34001.pep
LILGKHNLSAPMTSYSRPEVMVKSQSYFFTHSVKAMAVTQTAKGITSKQLLIGTIGDQVLALDKRFLDPRRSLNPTQQEKEEGIIPLTDSLPIIPQSYVTHSLQVEALRGIVSIPAKLESTTLVFTYGVDLFYTRLAPSRTYDSLTDEFSYALLLITIVALVAALFVTWILSEKKELRDKWR

SEQ ID NO: 139584 - protein, 427 aa, Triticum aestivum
  unsure (1)..(427): unsure at all Xaa locations
  Clone ID: PAT_TA_34002.pep
RSVAPGVLCVLDSYSGEELNSLSFDHSVAQIIPLTLKDSSEQRLHLIVDSNSNALLDPSSPVALNSFITEMSNQYFYSVDIQKNAIRGYXLQKSCDFNSDDTYCFSTKLLWSIIFPSDAERISVSEARKMNEVVHTQAKIIADQDVMYKYLSKNLIFVATVSPKAAGEIGSAAPEEASLMAYLIDAVSVRLLQRVAQLGAQVPDHAVASENXLLYHYFFLXLSDLKLQRLMTMRNVRGLXRNAANDIIGLADHAGLLICYSLXSFTLDSTIIFVTFXSRNLVLRMTLHNVLVKQQILGMNGEELVALDKRFLDPRRSLNPTQQEKEEGIIPLTDSLPIIPQSYVTHSLQVEALRGIVSIPAKLESTTLVFTYGVDLFYTRLAPSRTYDSLTDEFSYALLLITIVALVAALFVTWIWSEKKELRDKWR

SEQ ID NO: 139585 - protein, 258 aa, Triticum aestivum
  Clone ID: PAT_TA_34003.pep
TGPDFPVDPRVRAVSRDDPPPRLVDLADAEVGKARAAVTTADAGPRREGVGDAEEGTGYEQAAPPYGGVRRKRVGDSLEPAGTDNAAPQFRFVRRKNVLLSIDSDKTDEAELQAAVERAARLLAPYGASIVEYTSEADATTIPGHYVVYWELMLKDCREGLWPEAAVFERCCLEMEEALNSVYRQGRNGDAIGPLEIRVVRGGTFEEVMDYAISRGASINQYKAPRCVSFGPIIELLNSRVLSKHFSPACPKYGPPKK

SEQ ID NO: 139586 - protein, 123 aa, Triticum aestivum
  Clone ID: PAT_TA_34004.pep
RGAGRRTPGCIKLPCRRRRHQCRLRRRHQWPRHRIMRVASREARNRGRPLLAARNPRTQPRDQGRHKGGDRRSESLFHLLLDNLRNPRHLCLEFLNLSRLAFRAGLFLLPHTSGIVCPPFFDP

SEQ ID NO: 139587 - protein, 254 aa, Triticum aestivum
  Clone ID: PAT_TA_34005.pep
SARGGRTPRLNELSVLRVLDLEGCQGPLCLDGLYKLLLLRYLNLKGTDVSNLPAQIGELRCLETLDVRSTKVKELPPSILRLEKLMHLLAGNAKLPSGITKMKSLLTLSCSNIGKSADADIIQELSNMASLRELELFCNVPRASEDKKQVAFPSDGFQSLKKLSIRCSLPSVTFVTDALSKVEVLELKFEEGLSKESSGVSGVEHLSGLKHMIIEFSQHNVGAAAAMAAVKKTTEKVPPNCQVIIMSVDKKIGK

SEQ ID NO: 139588 - protein, 442 aa, Triticum aestivum
  unsure (1)..(442): unsure at all Xaa locations
  Clone ID: PAT_TA_34006.pep
MNFRKKVQLLEFQLEEADQSLILKGKSLDSVMEELDETSTLLKDKESEAAVLHDNVGSLEDEVTRLKEEIDVTSERLDAAEKDAADLIAEIEELRLKLQAVEDEKAEALNNDQLASSEIAALTEQKNELAKELEASKDEVEKVKKAMEGLASALHEMSAESAEALAEDRLSQELIEHARAQVEELNNSLHEXRRASEVMLDEVNYEKVCLKKSVERMGAEAKNVSEEWQSKELSFVNSIRKSEEEIVTIKAQMDKYLAVVNEKEAENTELLEKMNHLEAQLVEANKASEEAKAETRQLKDKLLDKENELQNIQEENEDLQAKESAASEKIKELSYLVPNGTTNGGNKEEDNENGGGVDDEPVVVVAKMWENSKVTDYDSSKEKENDGESEVDLESNKGDSALDSNGLQSAKMNNGITSPTKQQQQKKKKFKFSGLLKKKSSN

SEQ ID NO: 139589 - protein, 134 aa, Triticum aestivum
  Clone ID: PAT_TA_34007.pep
LASPKDATSVRPERKPRSKSLNENLAVDDGGFDDLSSPKTKEIICSEIRPPHERKFSADGGGDDSESCYSHPTPVAPPAKPSVVSGSCKKEAAAKAVSLAVVPSKQKGNPNLLKRILTGRRRDAIIKPKVVLSA

SEQ ID NO: 139590 - protein, 64 aa, Triticum aestivum
  Clone ID: PAT_TA_34008.pep
PFSLSSWPLLSLIASLGLYKVGFLLVHQNPETQVIPDESTIPTYMRYYPAVLSKFACATSKNFK

SEQ ID NO: 139591 - protein, 136 aa, Triticum aestivum
  Clone ID: PAT_TA_34009.pep
RFTLQSRKRLREEQQRRRSWREFIPLDGCQKKNDRPVRFIDMWEPAVLAIKREGYSIKCNGQRGVVITEKFQQATAINIPYGHPTEFSIQSADGAEYNLKPGENSPSRDSIVLILRLFRMKAVEKSKGRKKGIFFK

SEQ ID NO: 139592 - protein, 250 aa, Triticum aestivum
  Clone ID: PAT_TA_34010.pep
RVDRLVNPSKDMTVPELCIVEEINAEFKESVLARVGLKGTIILRTLPPKKAAGRETEFSFRLEGASGMKRAALQSTVLSSLENGLFHVKTPSKEEPIPIMKYSFLPKHSPLPLRLRLVKRHSGTLLSLMIHYASNPMLPQPLSNVTFIVKLPVDPTLLNVSPKAVLNRAERELRWHISDIPLKGPAGRLRARMPVDQDSKDGELEVVGMVKFAYQGPFTLSGIKLCPAINSTAQFNEVGHTFSSGSYRCI

SEQ ID NO: 139593 - protein, 47 aa, Triticum aestivum
  Clone ID: PAT_TA_34011.pep
VLHSCSQNAQSEDEPDRSWTICCCLGTKLFLYDTHGGAIVLLQCFHV

SEQ ID NO: 139594 - protein, 116 aa, Triticum aestivum
  Clone ID: PAT_TA_34012.pep
LDSRLAKRKSSPISHMWDPNPRAEKAVSHQCCVSSYWYGDNIKECPECNVYADAWADAWGEVVRTSVLCEIMLIWVKYKRMPIMNCIPANARTKEQTMLLVEHPDCRIEMITKRLY

SEQ ID NO: 139595 - protein, 298 aa, Triticum aestivum
  unsure (1)..(298): unsure at all Xaa locations
  Clone ID: PAT_TA_34013.pep
NSPEPSHSSDLESKISRRREEPGTQQHGCQPRRRETTRGDAGSAIASRCREDKPAARRLHTKATLTQTCSIXRRRLHGEHDAPGAAAXQSGEDFELSLGSKVGGGQGGSSTAPPGRKAAPLGVAAAEAGPAGLGFPPDPDLSHQPLTSQRAGSQGRRTPWVGRRSEPERWRSHTFRSDEKKASRRDHQPPGPHRPDGRGTWPPAPTEAASRTPTPRHLGPPPRRPQPSARKTERRDPRRHRHRRPRGLARRPPRVATREVGGGVGVAARRNPSRRPSRPSGRRGGHSLGDFLRGRVGR

SEQ ID NO: 139596 - protein, 59 aa, Triticum aestivum
  Clone ID: PAT_TA_34014.pep
RLPVPVREPGSTSWLIYTMLVALHVNLLSTGLCNASCASLMSFDVWIACFSSLYSAAML

SEQ ID NO: 139597 - protein, 189 aa, Triticum aestivum
  Clone ID: PAT_TA_34015.pep
ARIVDNPSIQVRLHEEITQQVGPARAIDDKDIESMPYLQAFVKELLRKHPPTYFSLTHAAVKPGSKLAGYGVSTDAKLDIFLPTISEDPKLWDRPTEFDPDRFLTGGETADMTGSAGIRMIPFGAGRRICPGLAMGTTHIALMVARMLQEFEWRAHPSQPAVDFKDKVEFTVVMNQPLLATVKPRKMSL

SEQ ID NO: 139598 - protein, 125 aa, Triticum aestivum
  Clone ID: PAT_TA_34016.pep
SPLLRATASSRPTPHGHRRGQVLAGLAPGAPGTSLLPPWPAPVPRRPRFTSPWYHLVSLMDGLGSFDLNSQWRARLSRAPVPCVSTLSRWRRLTSNSCTCRRTHQIRLGNGGFCPRAPNQRGELY

SEQ ID NO: 139599 - protein, 86 aa, Triticum aestivum
  Clone ID: PAT_TA_34017.pep
MASGWGINGNKGRCYDFWLDFSSCMSRCRQPSDCGLLREDYLECLHHSKEFQRRNRIYKEEQRQIRAAARKAKEEAEGAPAVAAHH

SEQ ID NO: 139600 - protein, 126 aa, Triticum aestivum
  unsure (1)..(126): unsure at all Xaa locations
  Clone ID: PAT_TA_34018.pep
MASGWGINGNKGRCYXDFWLDFSSCMSRCRQPSDCGLLREDYLECLHHSKEFQRRNRIYKEEQRQIRAAARKGKGGSRKELLLLQLTTSIPFQFFSYCFCLFKCFHLFGYEQGNNSPKHSTLPASN

SEQ ID NO: 139601 - protein, 100 aa, Triticum aestivum
  Clone ID: PAT_TA_34019.pep
LYMEDLKAFVKDSGFVEADDQTHHDLTSGYNIDEVDSSGGLDSHPLQVKLERRHARDYQRRDDAGSESDIICVSAGRSKGGKKRTVSHTSNRRIISKKVS

SEQ ID NO: 139602 - protein, 53 aa, Triticum aestivum
  Clone ID: PAT_TA_34020.pep
KFTEGVLHSKRNIRQSKKVSYYYIIKPWVFQFAKHAGTILHINILYKKVAWVL

SEQ ID NO: 139603 - protein, 216 aa, Triticum aestivum
  Clone ID: PAT_TA_34021.pep
MGRCLFNLAASTFDVVPCPSWFARWSSRNRCRAFVVELEGVLCAVLADPVADKLDVWKLEHGRWDRAYTIHLEASPGYSLKTCVVVPLAVDPDRGKILLNTVRKIGLYDPVEQTIENLYSLDQVPVASSAHLKFLDMPSTSSGDSLTCSKEESVAEMNRMDSKLITSVPMLYEESLACYSFVRKAQLLVVRHFQSTHATFLYKIPMCNILPACLAN

SEQ ID NO: 139604 - protein, 253 aa, Triticum aestivum
  unsure (1)..(253): unsure at all Xaa locations
  Clone ID: PAT_TA_34022.pep
LLRLPXNIGSKIDILCGLAWIGKGLLMRGDEKVKEISMFLLKCLSSEASLASAAADAFHVMMGDSEVCLNKKFHARIKFLYKQRFFSILMPIFLSKIKETSELTTKLVIYRAFGHIISNAPVSAVITEAHQILLVMVDILAKLSVDNQDKDLVYSLLLVLSGMLMDEKGKECIVENIRIIISVLAQLVSYPHMMVVRETALQCFVAMSSFPHSKVYRMRPQVLQAAIKALDDKKRAVRLEAVRCRQTWQSSFA

SEQ ID NO: 139605 - protein, 163 aa, Triticum aestivum
  Clone ID: PAT_TA_34023.pep
MTSSASSSPSRKVLSKIACLRLQKELGEWQASPPGGFTYKVSDNLQRWVIEVSGAEGTLYAGETYRLQVDFPEQYPMEAPQVIFMHPAPMHPHIYSNGHICLDILYDSWSPAMTVSSVCISILSMLSSSPAKERPSDNDRYVRNCRNGRSPKETRWWFHDDKV

SEQ ID NO: 139606 - protein, 206 aa, Triticum aestivum
  unsure (1)..(206): unsure at all Xaa locations
  Clone ID: PAT_TA_34024.pep
QPGCPGPRAFQPQTPAIARAFHTKYARLRAYXYAPPYNLLIPHYLGNGSLHSALHGGPTASPTPLPWSVRLSIVQGAARGLAYLHECSPRRYVHGCIKSSKILLDDELRPHVSGFGLARLVAGAHKTAQSRKLGSAACALRSGALSALSYVAPELRAPGGTAAAATQKGDVFAFGVLLLEAVTGRQPTEGEGGLELEAWVRRAFKE

SEQ ID NO: 139607 - protein, 178 aa, Triticum aestivum
  unsure (1)..(178): unsure at all Xaa locations
  Clone ID: PAT_TA_34025.pep
LRALAXACHQKGGKXIFDLGEEPGDPKDLKLQCSPKANNLTWCKQPVVYSKNRSDELQQWGSNLINRFQIGGRTVFEQARDTEDWKVESSCDANNLSGGKDKGGSYEVQQGRSKPINRRQRKRNQARGREAGRDERLVVPYCRQLEQYVLIFLCLLFIAYICAPITMKWLGHGPLVSY

SEQ ID NO: 139608 - protein, 69 aa, Triticum aestivum
  Clone ID: PAT_TA_34026.pep
WCGRSRSCAPFSVVAVLQNEINPPLLRLCVLHCENLKVIGFAKDGPKELNIAGGMHVLFSVRKYRCTAN

SEQ ID NO: 139609 - protein, 295 aa, Triticum aestivum
  Clone ID: PAT_TA_34027.pep
MAGAAQGKQSREAHGNNDIGVAKDYLDPPAVRLFDASELGQWSLYRAIIAEFMASLLFVYVSVATVIGHKRQTDAEACSGAGVLGIAWAFGGMIAVLVYCTAGISGGHVNPAVTFGLLLARKLSLPRAFLYTSAQCLGAICGAAMVRAVHGARYYELYGGGANEVAPGYSKAGGLLAEAAGTFVLVYTVFSATDPKRMARDTHVPVLAPLLIGFAVVVAHLATIPVTGTGINPARSLGAAVVYNNSKAWSEQWIFWVGPFSGAAVAMAYHQYILRGGAAAKPHFNFDNGFRRLGC

SEQ ID NO: 139610 - protein, 117 aa, Triticum aestivum
  Clone ID: PAT_TA_34028.pep
IRLEHPSSQSHSTAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 139611 - protein, 85 aa, Triticum aestivum
  unsure (1)..(85): unsure at all Xaa locations
  Clone ID: PAT_TA_34029.pep
TNXXIVXXXXNXXVGVRNWGGGAPEIIQGIAIGVKAGLTKQDFDVTVGVHPTSAEEFVTMRSPTRKVRRKTAAEAESKDEVVTQK

SEQ ID NO: 139612 - protein, 223 aa, Triticum aestivum
  Clone ID: PAT_TA_34030.pep
MKLHVAFFLLVTMAATARAVTFDASNTASGTTGGKRFDNAVGLAYSKQVLSDASTFIWSTFNQRAAADRKPVDAVTLVVEDIDGVAFTSGNGIHLSASYVGGYTSGDVKKEVTGVLYHEATHVWQWNGQGAANGGLIEGIADYVRLKAGLAPGHWRPRGSGSRWDEGYDITARFLDYCDSLKPGFVAQLNAKMKSGYSDDFFAQILGKNVQQLWQDYKAKFGG

SEQ ID NO: 139613 - protein, 226 aa, Triticum aestivum
  Clone ID: PAT_TA_34031.pep
MKISIALLLLGLAATAGAVKFDVTNEASSTAGGQRFDQEYGADYAKQVLSDASSFTWGIFNQPDPSDRRPADGDTVTLAVRDTDGIAATSGSTVELSARYVGGITGDDLKEQVTGVLYHEVAHVWQWGLQDYGAHSGVFEGIADYVRLKAGYVPGHWVKEGGGDRWDQGYDVTARFLDYCDSLKPGFVAEMNGKLKDGYSDDYFVQILGKRVDQLWSDYKAKYPGV

SEQ ID NO: 139614 - protein, 231 aa, Triticum aestivum
  Clone ID: PAT_TA_34032.pep
MKTAIAAAAPLLLFLALAAMAGAVTFDATNTVPDSAGGQRFDQDVGVDYAKQVLSEASSFIWTTFNQPNPEDRRDYDSVTLAVVDNIEPVAQTSGNAIQLRAQYVAGFDEGDVKKEVKGVLYHEATHVWQWNGQGRANGGLIEGIADYVRLKADLAPTHWRPQGSGDRWDEGYDVTAKFLDYCDSLKAGFVAEMNSKLKDGYSDDYFVQILGKSVDQLWNDYKAKYPQPQG

SEQ ID NO: 139615 - protein, 242 aa, Triticum aestivum
  unsure (1)..(242): unsure at all Xaa locations
  Clone ID: PAT_TA_34033.pep
NKHPRHRPASLQHPLQKDDADSPLHAVAPVVLVLAGAARAGAVAYDATGTVXSRRFGRAFGLPYSKKALSAASAFSWSPCPPRXTGDRNPVAALNMXVEDTTXVASAGANRHPPQAAQHVGGICGDVREXVHDVLDLEARHVWQWNGQGXANDGLIEGIXADYVRLKAGVAPGHWVKPGQGDRWDQGYDVTARFLDYCDSLKPPGSSRSSSAKXKSGYTDDFFAQILGKNVQQLWKDYKAKV

SEQ ID NO: 139616 - protein, 81 aa, Triticum aestivum
  unsure (1)..(81): unsure at all Xaa locations
  Clone ID: PAT_TA_34034.pep
FXVGKXGVFXDGXLIHFRPLHCPAFQTLWSLHDHELSVRRWQTGTTPWDRRQDVGGHRPSGAERGAASYRAQQRNGQLTTK

SEQ ID NO: 139617 - protein, 632 aa, Triticum aestivum
  unsure (1)..(632): unsure at all Xaa locations
  Clone ID: PAT_TA_34035.pep
MAGNREAFRVAVGNTLERRLFYVPSFKIYGGVAGLYDYGPRGCAVKANVLAFWRQHFVLEEGMLEVDCPCVTPXEVVLKASGHVEKFTDLMVKDKKTGSCYRADHLLKDFCKEKRVNDITLSPQKVEELNFILAVLDGLSAEQLGAKIKEYGXIAAPDTKNLLSXDPYPFNLMFQDXPLGPSGLSAGYMRPRDXAQGIFVNFKDLYYYNGNKLPFAAAQIGQAFRNEISPRQGLLRVREFTLAEIEHFVDPEDKSHPKFSDVSDLEFLMFPREDQLTGRSATRLRLGEAVSEGTVNNETLGFFIGRVYLFLTQLGIDKDRLRFRQHLPNEMAHYAADCWDAEIECSYGWIECVGIADRSAYDLRAHSDKSGVPLEAHEKFAEPREVEKLVITPSKKELGRAFGASLVPGLGAWGAVRGSEPLGSRAACEAXPGGEFKVCTLGKDVTIKRNMVSINMEKAGEHQXXFTPSVIEPSFGIGRIIYCLFEHCFYQRTGKTDDEQLNVFRFPPLVAPIKCTVFPLVKVEKFDVVAKKISKALTTAGISHIIDITGTSIGKRYARTDEIGVPLAITVDSTTSVTVRDRDSKDQIRVEVEEVASVVKEVTDGQSTWADIMWRYPAHTALATDEEEASET

SEQ ID NO: 139618 - protein, 186 aa, Triticum aestivum
  Clone ID: PAT_TA_34036.pep
MLGHSFSDSEYGGLSSASLEITDSVSGGDTSSTGVFSGNLSLDMSEGSPWRIRRSGFCGMRSKKFDGYIDLDSYDTIAMKLRGDGRTYISTIYTENWVNSPGQEEDNSWQAFVCVPHGSWRILKIPLDSYLPTWKGNVIEANMEMNPSRVVGMSLSLNAEGGVPGAKTGPGDFRLDVDWIKAMRSL

SEQ ID NO: 139619 - protein, 147 aa, Triticum aestivum
  Clone ID: PAT_TA_34037.pep
DPATDFRSGGFMSLENLIYFARNYPDSFHRLLHKADGERAEWEYPFAVAGVNVSYMLVQMLDLQSENRRSSKARVGFAQLLEDDEMAFDNLFCLAFQMLDAQWLARRASYMEFNEVLKSTLGQLEQELTIGGVSSVQNLPSFRMLRR

SEQ ID NO: 139620 - protein, 82 aa, Triticum aestivum
  Clone ID: PAT_TA_34038.pep
GSTDFILCDSHFFSIKNNGGSRKQGVRLSLWQCYVWLATCMHAMFRHVMYGPWMGHTYIIVELSSLMDMSTQMRNERSHTFV

SEQ ID NO: 139621 - protein, 194 aa, Triticum aestivum
  unsure (1)..(194): unsure at all Xaa locations
  Clone ID: PAT_TA_34039.pep
LSDQRVREGIEASEREPHITWRTAWARRRRRXRRAGHADGGAGAGVPALRRQRRRQDLGGRAGVRAARAGRAPGARGGAEHDGGDGRRQGRLRRPPRVRRLSLRPLQGQRGRRRQGAGGRHGGRAQGGLPDVRRRPQRAHLRAGASPCAPPARGEVLRCXLLAHDTIRRRRRRRQRQLRGIQEDDGRRREELGW

SEQ ID NO: 139622 - protein, 196 aa, Triticum aestivum
  unsure (1)..(196): unsure at all Xaa locations
  Clone ID: PAT_TA_34040.pep
RPGCHGAKQPTVAREGIEASEREPHITWRTAWARRRRRXRRAGHADGGAGAGVPALXRQRRRQDLGGRAGVRAARAGRAPGARGGAEHDGGDGRRQGRLRRPPRVRRLPLRPLQGRRGRRRQGPGGRHGGGAQGGLPDARRRPQGAHLRARASRRAPPARTEVVRCGPPAQNSIRRCPPRRQRKLLGVGDEDGLRK

SEQ ID NO: 139623 - protein, 136 aa, Triticum aestivum
  Clone ID: PAT_TA_34041.pep
GPFFFFFFFFFFFFFFFFFFFFFFFFFFFFFSKQTLLFFSFFFFFFTGSGIRPRAEPPQIQLPRLPLLQSSLGHQRQGHLSSLLEQQCQPLSSLLEQQCRPLSSPPEQQCQPLSSLPEQQCQLLSSLQPNCQPLPL

SEQ ID NO: 139624 - protein, 181 aa, Triticum aestivum
  Clone ID: PAT_TA_34042.pep
RLRENPSRQRLLSKDGQGNPGPTGEQSTRERRQQWTDSSRCFLPCGASKGRFRGRRQARRGETTTGEAKRGTNLVSVCLGWSPAFALRTVSVFNLTAPVIVGPFRILHSLLSYEVLQGSRLVYAASVIIIICNLLECTLISGGHRHNTYAAVVVKKTKKTIKNKKKKHKKKNQNYNKKINN

SEQ ID NO: 139625 - protein, 272 aa, Triticum aestivum
  unsure (1)..(272): unsure at all Xaa locations
  Clone ID: PAT_TA_34043.pep
MASEGEHAAAAAAAGEQTPLKKAGEAEQGEELQAPSGWTKKLNPTRGGKFEVVFVAPTGEEVKTKRALTTYLKAHPGXGPALSEFVWATGNTPRRSSRLSAKPKATESPEDEKPSRRSGKSKATESPEDEKPAKRGKPSSSKKGKKGKQEDAEDAEAESGDHADAEEAKGTEVEMKDAEGAKVTDLDLQMKEADNAQEEKKEEGANRLTVEHREANKAADAETQEDETAADTVAKEETKAADTVAQKEEKAADPVAQRREESGVTLLLKKRR

SEQ ID NO: 139626 - protein, 260 aa, Triticum aestivum
  unsure (1)..(260): unsure at all Xaa locations
  Clone ID: PAT_TA_34044.pep
YFGSKKSGVSTESAPKNGAPDSGHGSGHNHPKHHNQSSQPPKPHNPVTPRPHNGPGNFHTSNLHRSSSCPPQAPQAGHTGVPTAPLQSWPSAPPPPYHVPPVNYPDMSRLNISGYPIGAHDNQGSNVSYHPNYSGAVQPPYNNYSYRHPTPPNISSNMQNAGQWGANTGCPQPSSDSQILIRNILSALEVLKTEKLAPTEQHISDCVRYGGANLPQFDVKKALEVAIQHQAIVTKKLDXVSFFLGKDENLWKCVNIWITC

SEQ ID NO: 139627 - protein, 315 aa, Triticum aestivum
  Clone ID: PAT_TA_34045.pep
PCVRVFSPSNFNASTCPGSHGSGPGPAICSAPIKYQFANYSSGYNKSGQGALRFQLINQRQDFSSGFFTGGLSNPALVAVSNRIVFANPKAPVYPRLALGKTWNEMTVTWTSGYGISEAHPFVEWGMKGSHPVHATADTVTFGRESLCGEPARSVGWRDPGFIHTAFLKNLSPEKEYYYKIAHTLHGGKVIWGKPKSFRAPPYPGQKSLQRVVIFGDMGKDERDGSNEYQNYQPASLNTTDALIRDLDNTDIVFHIGDISYANGYLSQWDQFTQQVEPITSKVPYMIASGNHERDFPNSGSLYNGTDSGGECGVP

SEQ ID NO: 139628 - protein, 511 aa, Triticum aestivum
  unsure (1)..(511): unsure at all Xaa locations
  Clone ID: PAT_TA_34046.pep
RGALPPSCPTGANPLSLSPLYSAPPPRLLAPAHASAANPSRLGRERDRSAAAAAALSIDVVQSTSKNQRIATHTHIEDLGLDANGTAVGMSAEFVGXTGAREAGGLVIDMIRQNNMARRALLLAGPPAMGKTALALGSSQELGSMVPFCPMXEHEGYSSDVKKTEVLLDYSRRGIGSRIKQNVLCYEGDVTRLSPEEPESPLHKYSQLSAQVTGLSSPTLTWQAGALTSRAQLGALFVXQVHSGLDFHWFNSGAVXRVGSCDAFATEYDLEAEEYVPIPKGEXSTKKKQIVQDVTLHDLDAANAQPQGGQDILSLMGQMKXSRKTEITEKLRQEINKVVNRYIDEGIAELVPGVLFIDEVHMLDIECFSYLNRALESPLSPIVILATNRGICTVRGTDMTSPHGIPVDLLDRLVIVRTQIYGPIEMIQILAIRAQVEEIEIDEDSLAFLGEVGQQTSLRHAIQLLSPASVVAKANGREKICKADLEEVRVLYLDAKSSAQLLHKQQGSYIT

SEQ ID NO: 139629 - protein, 79 aa, Triticum aestivum
  Clone ID: PAT_TA_34047.pep
IMPDALHGAQSNDSYTLTMKFMFYNVNVKLFGSRQLGPHSPLCNQQLGLILHLAINNLAPILHLAINNLTLILHLASTT

SEQ ID NO: 139630 - protein, 192 aa, Triticum aestivum
  Clone ID: PAT_TA_34048.pep
AAHGIVLIAIHDINPEKDKVPLKKVIDACTACFEQRTVFTQQVLEKALNKLVDNVPNPLLFMRTVIQALDAFPALVDFVMGILSRLVNKQIWKMPKLWVGFLKLAYQTQPRSFDVLLQLPPPQLEVALNKYPNLRPHLSSFVNRQNLHNKLPRHTLNILGFVNEPQQAPMPFAPAALQTADTTSSLPGANIM

SEQ ID NO: 139631 - protein, 431 aa, Triticum aestivum
  Clone ID: PAT_TA_34049.pep
LRFENDLNLGVDTVGAIASKFEPRSSFEKQMAGVFNNTEIMEAHKNDGAKILELNKMEVEDVRERQNRLAKMRSLLFRHEMKAKRVKKIKSRTYHRLMKKDKLKAADLEADPEAAKDSAKKLEFKRAEERMTLKHKNNSKWAKRILKRGLSVQDDGTRDAITAQLQQHALLTRKMNSIKDGSSSSDESSDDDDDDEEDESKLEAKLLNRGKEKIRKVIEEDNEIPKSGVFSLPFMERAMKKRADATYEETRLDYEELEESLRKLEDDNTEENVDSMKVTGKRTFGPVKRAHEEANKRPKLGDADKNSDSEYDSDSGQHFDSSEVNKKAEYANNKADDVQLGTALLDDEQQNDLYVSFDGTRKSPGPKTDIEVRMLADNSWKKVKNSKTNGGNNIKESGNNSKVQIPSVDSNPKPHNSDSDSEEEMVDGFLT

SEQ ID NO: 139632 - protein, 66 aa, Triticum aestivum
  Clone ID: PAT_TA_34050.pep
MARFRLHWLEAMLPLGIIGGFLCIMGNGQYYIHRAAHGRPKHIGNDMWDVAMERRDKKLVDKPAAN

SEQ ID NO: 139633 - protein, 211 aa, Triticum aestivum
  Clone ID: PAT_TA_34051.pep
ILLSYFDAKFPARGLDIRYQFIPQLIFLNSLFGYLSLLILIKWCTGSKADLYHVMIYMFLDPAGDLGENQLFWGQKELQILLLLLALVAVPWMLFPKPFILKKLHKERFQGHSYRFLGTSEMDPDSEPDSARSRHDDFNFGEVFVHQMIHSIEFVLGAVSNTASYLRLWALSLAHSELSTVFYEKLLLFAWGYDSLIFKVVGLIVFAFATA

SEQ ID NO: 139634 - protein, 377 aa, Triticum aestivum
  Clone ID: PAT_TA_34052.pep
QGCFSLTGSCGLHCPNGIMVETKREPAGEGLPDGWLKEYRPRKPRPGSRFRRDKFYIDPTNSYEFRSLKEVHHYLESQDTSDSVVTPKKKKIEDLQVSGNKSQHAGRPSSEPEGVSKGRLADLELQVARKNDQRLNHESAAREEANVEPKPKGKKQKTEPVKQIAAPVRSSPRLTALKRNEEANNVPRDPLVDAQTDIADQVQPTEQVKNPKSKAISSPVIQNKDGAHAPSTSGNAEDKYPSAPEQILGASAACSLTDVGCQNAHAPPQQNGLVGTADAMPGYSLSSLFRSIWSDPCLEFAFRTLTGDIPVLDNNVAVANYFLPPQDLNKGTVPPNCSSSTYDGARKNHGQVDRVRLPMPMPKPSDKLYSSGWFPPQ

SEQ ID NO: 139635 - protein, 273 aa, Triticum aestivum
  Clone ID: PAT_TA_34053.pep
LRRFHMAANGDLSILVSSVKKTIRWRETFHILTLQELEKWSHLVFWHGFDTTLRPCLVIRLGLACSSIAPRDRPCFGQAVVSQIDHGIIHLTNEEDPRITVLLDCHGISPFKFPMQMMRSLVNLVQENYPNRLGVLIVVRLPPVVRVIAQTFIQLLKPSTKQKLRFEGESYKKTLAEFLQIVPAFLGGKCNCSRCKKPRDSSLIQAGEGSRSRSLTSAGSRSPVSDMDLDEELEELPSPYNCENAIRAAVVGLLMVWIFVAFLAGMNDPQSIP

SEQ ID NO: 139636 - protein, 125 aa, Triticum aestivum
  unsure (1)..(125): unsure at all Xaa locations
  Clone ID: PAT_TA_34054.pep
SQVVFPFPSXXVNQCASSXSSFPVXFXIAGLHRLAPRYIPDTTVTLGASSCMPACMELAPFQGKYVYGVSACLVKQTCMTHVMCNLYNTYMHGQLALTIFQCGTANMRLCKCVSSSIYCIVHKCK

SEQ ID NO: 139637 - protein, 207 aa, Triticum aestivum
  Clone ID: PAT_TA_34055.pep
IDNVKAKIQDKEGIPPDQQRLIFAGKQLEDGRTLADYNIQKESTLHLVLRLRGGMQILVKTLTGKTITLEVESSDTNDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 139638 - protein, 280 aa, Triticum aestivum
  unsure (1)..(280): unsure at all Xaa locations
  Clone ID: PAT_TA_34056.pep
MAGPLADSNIQKESXFHLVLRLRGXQIFVKTLTGKTITLEAAVRNERKIPNQSRRRSTLGSXILLPRRLKMQIFVKTVTGKTITLEVESSDTIDNVKAKVQDKEGIPPVKHRLILAGKQLEDGRSLADYNIQKEYTRHLVLRLRGGMHIFVQTLTGKTITLXVESSDTIDHVMAKIQDKEGIPPSQQRLIFAGQQLGNGRTLADYNIQKESTLQRDPRLRSSIQFFVKTRSGKTVTLVATTTDTMDTLNPRIPDTEGILNDQQLXIFAFAQPVVGLTLAD

SEQ ID NO: 139639 - protein, 94 aa, Triticum aestivum
  Clone ID: PAT_TA_34057.pep
SVVAAEVHAWNICYSFDGPVSSPYVCYKKLETAQCSADMEQCHICLTEYEDGDQIRSLPCKHEFHLQCVDKWLKEIHRVCPLCRGDVCEGVVAS

SEQ ID NO: 139640 - protein, 112 aa, Triticum aestivum
  unsure (1)..(112): unsure at all Xaa locations
  Clone ID: PAT_TA_34058.pep
VQQHFNSCGTVNRVTILTDKXGQPKGFAYVEFVEAEAIQEAVKLSESELHGRQIKVAPKRTNVPGLKQPRGGRGFNPYGGHPYMRPYPPPFYNPYGGYGRAPRFRRPRRPFY

SEQ ID NO: 139641 - protein, 211 aa, Triticum aestivum
  unsure (1)..(211): unsure at all Xaa locations
  Clone ID: PAT_TA_34059.pep
MEDEEHEXVYGQEIPVDGEDVDMGAGGDDAAKLHELDEMKRRLKEMEEEAAALREMQAKVAKEMQGGDPNATTSEAKEEMDSRSVFVGNVDYACTPEEVQQHFNSCGTVNRVTILTDKFGQPKGFAYVXEFVEAEAIQEAVKLSESELHGRQIKVAPKRTNVPGLKQXRGGRGFNPYGGHPYMRPYPPPFYNPYGGYGRAPRFRRPRRPFY

SEQ ID NO: 139642 - protein, 104 aa, Triticum aestivum
  Clone ID: PAT_TA_34060.pep
TSQLPETQMAHAACHQQQNICIIRKKEARNISKASDSTLRSQVSPASTSSVTNLPSPAPARAWALGAARGEREDLRPQQHERGPEAAPVVVEAELAGIHELAQQ

SEQ ID NO: 139643 - protein, 94 aa, Triticum aestivum
  unsure (1)..(94): unsure at all Xaa locations
  Clone ID: PAT_TA_34061.pep
VTGMNNMGFFLSGSIYVEASLKPSLCSTQDLGATGIIILSKKYFFRLCFEQTRLNRCLQQSCPGIISFYNPTMVVIINRQFYIFKPAXXQLKIP

SEQ ID NO: 139644 - protein, 76 aa, Triticum aestivum
  Clone ID: PAT_TA_34062.pep
MSSLGTSKGILEIAKFGVYVAVPVTLTYLVATDSKAIKKLMGLRPYVVYPPEGPRPPPPEELRERAREIARSRRQE

SEQ ID NO: 139645 - protein, 97 aa, Triticum aestivum
  Clone ID: PAT_TA_34063.pep
MSGEMVENRKQILSRVFLKSLQTDDTVFRKVSRSVYCAFRAVALGGNGTKGRKLAEAALGRIGATKLTDRVVKAAEVLIRVATISEQVHGPWYSHLL

SEQ ID NO: 139646 - protein, 162 aa, Triticum aestivum
  Clone ID: PAT_TA_34064.pep
MSSEELTTSLSNLAVASQAPMASQIGSSGDLSSEGGAQVTCFSEDLHDVTLHFQIIRFSKQIYAWIGCNNSAKFGHLYAAATTRLGDGVSVTSVLGGTSDNTGSSMARRLVLKTGLNVILACNIPKDSPMLEAAAERKLVEKLRSLGYIKSKTGEASASITP

SEQ ID NO: 139647 - protein, 359 aa, Triticum aestivum
  Clone ID: PAT_TA_34065.pep
AAAPPSSGMDFGRSNEQRLLLARSKMPFTPSQWMELEHQALIYKYLNAKAPIPSGLLISISKSFRPSSDRMPWRPVYQGFTNADSDPEPGRCRRTDGKKWRCSKEAMAEHKYCERHINRNRHRSRKPVENQTRKNAKETPDAGSISAAVSHGGCNKKAKAGDELKPGSVSYWTDNLNRAMVSKARGNNPEEGNSAPLLNSTNQQHTLSLFSQLKQQSKPDKFSPAVDSESISSNTVLKPWERSNQQSSKDVSSTTLHDRGCLQSVLQDFSMHKNDKIESQKINASVPSTFYSSTEGRHISCLASNMMQVQEDCISSSWEIPQGGPLGEILTNSKNTDDLTNKCESRSYGWLLSLDEHEM

SEQ ID NO: 139648 - protein, 304 aa, Triticum aestivum
  Clone ID: PAT_TA_34066.pep
MLRRTLPRLASVKDRVAGAAKSAVKGDEHFPALKGHPAARVDAREAAEKQAGLAAGEEEKKSGGKAATVKEFQIYRWNPDAHGRPFLQSYFVDLGTCGPMVLDVLQMIKSEHDSTLAFRRSCREGICGSCSMNIDGVNTVACLKPIDTDTSTATMITPLPHMYVVKDLVVDLTNFYQQYKSIEPWLKTKRGAPEGREHAQSPGERRKLDGLYECILCACCSTACPSYWWNSEDFLGPAALLHAYRWVSDSRDDYGEERIQALSEGWDKLYRCRMIKSCTATCPKSLDPATAISALKTMHQLRKA

SEQ ID NO: 139649 - protein, 226 aa, Triticum aestivum
  Clone ID: PAT_TA_34067.pep
MDAPAMLTRKHVPENIAAEGEGGQQQMHRDEKQHKPVLKKVKDKVKKIKNTIAGHGHGNGNGHDHDHDQDTGGSNSTDEDEEDAAMREAKVEKGGYQQDVEDKPIFADSSPELHGAPMYDSERIPAAAKEVKHNDAPGVRFGDIGGPAAAHEVNREDAAGVRVGDFGGPAAAHEVKRDDAAGERLGDFGGRASAKEVQRDDTRGCGSAISAAPSSRTRPRPTRGRP

SEQ ID NO: 139650 - protein, 275 aa, Triticum aestivum
  Clone ID: PAT_TA_34068.pep
TCLQIQGQSNAQTRSAREEKKPVEPNEVKQSRPQKMMDFRNIKISQVELLLTYEGLPFAVSDVRLLMDTFHREDFTGTWPRLFSRVKKHIVWGVLKSVTGMQGKKFKAKSTSQKEPTAGLIAASDLNLSDSDGDESGNSDQLPAFLRKPSDGAGDGFATSVKGLFSSQKKKAMHFVLKTMKGDGDQDFQGERSENDIEFSPFARQLTITKTKKLIRKHTKKLQSKVPQNAGNQQEHGSELPPRGPSGHHMDSSSSSSSSSSDNDEPSQVEMSPKD

SEQ ID NO: 139651 - protein, 128 aa, Triticum aestivum
  Clone ID: PAT_TA_34069.pep
FTRSGPEDKKRSSLLLEFMGSYLAELSLLDYSCLRFLPSVVAASSLFLASLTIGPDTNPWGKEMHKLTGYKASELKDCIIAIHDLQLNRKGPSLPAIRDKYKQHRFKCVSMLLPPVEIPASYFQDLTE

SEQ ID NO: 139652 - protein, 97 aa, Triticum aestivum
  Clone ID: PAT_TA_34070.pep
EVPLYCQGWKKVPHHHNFLVGKLHFLRNKSFFLKIAQQKQPVLKHGLCFQISPLVTTLIYQQGGRRVLLTSISSIVSFICFETILLIKNCNIKRTSS

SEQ ID NO: 139653 - protein, 356 aa, Triticum aestivum
  Clone ID: PAT_TA_34071.pep
RGRVDTRDLATQTLKFTHQLGKFSDLKTGLIVGGGSMESQFEVLADNPDIIIATPGRFEHILSSARGLSLRSVEYVVFDEADSLFSLGFAEQLHKILHKLSDTRQTLLFSATMPKALAEFAKAGLRDPQVIRLDLDKKISPDLKLAFFTLRQEEKLAALLYLVRERISSEEQTMIFVSTKYHVEFLNILFREEGLEASLSYGAMDQEARTIHISRFRARKTMLLIVTDVAARGLDIPLLDNVVNWDFPAKPKLFIHRVGRVARQGRTGTAFTFVTSEDMPFLLDLHLFLSKPLRPAPTEEELLKDMDGMNLKINQSLADGETIYGRFPQTILDLCSDGEKKSSMEHRSDCIGKTMR

SEQ ID NO: 139654 - protein, 108 aa, Triticum aestivum
  Clone ID: PAT_TA_34072.pep
MASNRGMVAGSHNRNEFVMIRHDGDAPAPGKEVKGAGGQGCQICGDTVGVSATGDVFVACNECAFPVCRPCYEYERKDGVKCCPQCRTRYKKLKGSPRVPGDEEEEEC

SEQ ID NO: 139655 - protein, 217 aa, Triticum aestivum
  Clone ID: PAT_TA_34073.pep
DDEVAAVDLAVERREGEAGEGEDEAAAVHSAASQEIFRGSKLFQVYVVMGTTVGLFLPLAHVLGGFARGDDAAVRSATPHLFLLSCQILTENIVGSLGVFSPPLRALVPLLYTVRRVFVIVDWVYDVWTNKLITRTAPVQDKAWVWFGRYLAVANLVYFSINLFVFLIPKFLPRAFEKYFHTRNEVYAKTAEDKRARDLSSLDDDSAAKSEVSKKAD

SEQ ID NO: 139656 - protein, 267 aa, Triticum aestivum
  unsure (1)..(267): unsure at all Xaa locations
  Clone ID: PAT_TA_34074.pep
MATKGRKVVEVRDASRTDGKGDAADVHVVREGKSDHDTAGGVGHRGASRTDGHGDAGGKVGDFRGIDGKDSLKIVAMQAPVTVERPVRGDLEEHVPKPYLARALAAPDMYHPEGTTDDHQHHNMSVLQQHVAFFDRDNNGIIYPWETYDGCRAVGFNVFMSAFIAFLVNLVMSYPTLPGWLPNPLFPIYVHNIHKSKHGSDSGTYDXRGRFMPVNFENIFSKYARTYPDRLSYRELWRMTEGSGEXFDFFGWVAMKLEGVGPCTCWL

SEQ ID NO: 139657 - protein, 381 aa, Triticum aestivum
  Clone ID: PAT_TA_34075.pep
MATRAGRSGSSGPSAGRTPLRSSPCRPRSPWSAPSAGRRRRHRPHRLFGEGFPGSRAFSGRWGGRHHGRAVPAGGARPGRARARRRGRRGLRDATRGPALGPAPRGGHGRARAPLYRRRGGRWCRGSNTWAGCGASASMARNVRRIDGTDAVPLVAMQAPRGAARPVRGDPEEPIPKPYLASALAAPDLSRPEGTTDDHQHHNMSVLQQHVAFFDRDNNGIIYPWETYDGCRAVGFNVFTSAFIAFLVNLVMSYPTLPGWLPNPLFPIYVHNIHKSKHGSDSGTYDKEGRFMPVNFENIFSKYARTYPDRLSYRELWRMTEGSREVFDFVGWVAMKLEWSFLYVLARDDEGYLSREAIRRMYDGSLFEYMERQRMEHVKMS

SEQ ID NO: 139658 - protein, 145 aa, Triticum aestivum
  Clone ID: PAT_TA_34076.pep
MFGSTNPFGQSSASAFGQTSSNPFGAQSGFGQTSTTTNNPFGSPTTAFGAQTGTTSPFGATSSTAGAFGQPSAPAFGATSTPAFGAAPTGGFGQPSTPAFGTPSSSPFGSSTPAFGASPAPAFGAGATSSGFGSGSLFGQNPSLG

SEQ ID NO: 139659 - protein, 116 aa, Triticum aestivum
  Clone ID: PAT_TA_34077.pep
GGGRRWRRPRRTRRRSEGGRGAEGEERGGGRRPWRERRRRPVGRGGRRLGRLLQVPRGHDEPEETLPPWSQGRRVPERLNKNCSNHLARSMLYPFPAYRCTTNGGDPSCVALFSLL

SEQ ID NO: 139660 - protein, 346 aa, Triticum aestivum
  Clone ID: PAT_TA_34078.pep
VVVYPPGGNVSRTRVVPALGDSVLLCPRSRFFSFLATRYLEESPQSPSSSFHGSSPPLPPRPPSSSLLRSSSSLGSSPRPPWPPPPSSPSLLRRSSSSSLGSSPPPPWPPPPSSSSLRRSSSSLGSSPPPPPWPPPPSSSSLLLLSSSSSCSLLFLSSSSRFLCSSSSRFPPSRSLLASSALLVLGSGGIHLVAAADHLLHSKSESKEGVLTGLAVLRDTSLKTTSGGVDDEHSTVSLGGTGDHVLDEVTVTRGVNDGAVVLGGLKLPQGNINGDTPLALGLQLVKHPGVLEGPLVHLSGFLLEPLDHTLVDTSKLVDQMASGGRLARVDMANDHDVDVSLLLTHG

SEQ ID NO: 139661 - protein, 104 aa, Triticum aestivum
  Clone ID: PAT_TA_34079.pep
EGAFLEAVGVLERMGSSGCPEIVELVDETKDARPGGVTHLRVRVKPVGQEHGGRSCSVEDDLDRLLRSFNVRTSARASGQTSTDKRLIALGKGPDVELGDRGSL

SEQ ID NO: 139662 - protein, 198 aa, Triticum aestivum
  Clone ID: PAT_TA_34080.pep
MRFPIMINVVAVCLVLSTLAAAGVWSPAPPPPAQQHGEHVLREGRRVVIVEYERELPLTPGQGSAKETHVLPPHALDGVEAKETVSEEARGAVSNAADKVAGAAEDGKEKLSNAKESATGKVFGAVKRCKDRLCGAAKGLEEGARVGVSRVKDGAEDTVTAAGETLSGAKDKAEGKVFHAASEAKGAAMSAKDKVSEA

SEQ ID NO: 139663 - protein, 308 aa, Triticum aestivum
  unsure (1)..(308): unsure at all Xaa locations
  Clone ID: PAT_TA_34081.pep
MSSPPAPVFERLAGIRPLAESGRFKAWFLDQFGVLHDGKKPYPGAILALEKLAGNGAKMVIISNSSRRSSVTMEKLQSLGFDTSCFLGAITSGELTHQYLDKRDDPWFASLGRKCIHLTWGNRGAISLEGLGLQVVNNVDDAEFILAHGTEALGLPSXGDPLSKSLEELEQILVLGIQKRLPMVVANPDYVTVEARNLRVMPGTLAAKYECLGGERKXMGKPDKVIYTSAMSLAGVEAHECTTVGDSLHHDIKGASGAGMTSAFITGGIHAAELGLGEFGETAGDDAVSALCCKHSSYPSYVLPSFAW

SEQ ID NO: 139664 - protein, 93 aa, Triticum aestivum
  unsure (1)..(93): unsure at all Xaa locations
  Clone ID: PAT_TA_34082.pep
MGWRSAAGRLLAILLVLHLLVASSXAARFTRKLQDXSAVEAPSLRGAGGDSAESNRRESDAIVEEMFGRMALQTTDYPGSGPNDRHTPKAPGT

SEQ ID NO: 139665 - protein, 234 aa, Triticum aestivum
  Clone ID: PAT_TA_34083.pep
RDCSKAPTSQGKGFSLSMDDFPVLGSRNSASNSQQGQISGRWPTIASGIVATQDKEGKNPITGTGEVILSCSYEHEIISRMDYVCKGDDPIPAAKLIRGAEQAQLHDPQVPNICIPPPLLDYWHRPPDQPPDENGKLHSGEVPYGPYKHADPPAFAVESLAHRDQFALNEEALAKQDTGHGGYYPDKRDISHAHMPADCCVINQSCHVLGKVKNGHADVLEIEKQPIIKKDVAL

SEQ ID NO: 139666 - protein, 250 aa, Triticum aestivum
  unsure (1)..(250): unsure at all Xaa locations
  Clone ID: PAT_TA_34084.pep
SVRLWRTIKGTSEGWRSLSWLTACFFPGXVMFTVLTILNFVLWGSKSTGALPISLFFTLLALWFCISVPLTLVGGFLGTRAEQIEFPVRTNQDSXREIPARKYPSRLLVLGAGTLPFGTLFIELFFNLSSIWLGRFYYVFGXFLLIVLXMLVIGCAEVSVVLTYMNLCVEDWRWWWKAFFASGSVALYVFLYSINYLVFDLRSLSGPVSAMLYIGYSFLMAFAIMLATGTIGFLTSISFVHYLFASVKID

SEQ ID NO: 139667 - protein, 584 aa, Triticum aestivum
  unsure (1)..(584): unsure at all Xaa locations
  Clone ID: PAT_TA_34085.pep
TRPGNPAFLHRAVQGIEFSDPVAVRHALSIISEIAVRDPYSVAMALGKNAQPGGALQDILHLHDVLARVYLAKLCHSISRARVLDERPDIKSQYSSLLYQLLLDPSDRVCFEAILCVLGKVDNTESTEDRAGGWIRLTREILKLPEAPSVASKVFCQKLXEKSSKARRPQPLIKLVMRRLESSFRSFSRPVLHAAARVVQEMGKSRAAAYSLGAYDEGANLQAYSDNVESLDSDENSQPEATRKAKPLSNGHGGMDTVAGLLASLMEVVRTTVACECVYVRAMVIKALIWMQNPHESLDELKSIIACELSDPAWPSSLLNDVLLTLHARFKATPDMAVTLLEIARIFATKVPGKIDADVLQLLWKTCLVGAGPDGKHTALEAVTIVLDLPPPQPGSMSVLTSVDMISASDPKSAMALQRLVQAAVWFLGENANYAASEYAWESATPPGTALMMLDADKMVAAASSRNPTLASALTRLQRCAFSGSWEIRIAAVQALTTIAIRSGEPYRLQIYEFLHALSLGGVQSNFSELQLSNGENQGASGTGLGSLISPMLKVLDEMYKAQDDLARDIRQHDNSKQEWSDDE

SEQ ID NO: 139668 - protein, 447 aa, Triticum aestivum
  unsure (1)..(447): unsure at all Xaa locations
  Clone ID: PAT_TA_34086.pep
MAHFQGQQHGHPATRVDEYGNPVPAGHGVTGTEGLGHFPGQAQQHGHNTTRLDEYGNPVTAGHGVGLGSTGTGVHGGYGSAGTGTHDTGGHGRQVGYGATGTGTHDAGGYGGSGIAPRHGATDAGLHDAGGLGTRHAATGTHGTGHTAGLGGTGTGMTGTDGEDQGEAPSGAQGHPGAHXATGGYAHGTTATGGGSGTGXTPTSWATRAGMTGTHGTGHPAGLGGTGTGITGTHGTGHTAGYDATGTDGTGHTAGYGATGTGITGTHGAAGTHPHGGVAEQKTRGILHRSGSSSSSSSSSEDDGMGGXRRKKGMKQKIKEKLPGGNKEQTTAAGGYGPGYTGTTGTGGPGYTGTTGTGGAYGATEGTHEKKGVMEKIKQKLPGGHKDTQPHTTATGGYGPGTTGTTGTGGYGTGTTGTAGTHGATEGTHEKKGMMEKIKEKLPGGHH

SEQ ID NO: 139669 - protein, 79 aa, Triticum aestivum
  Clone ID: PAT_TA_34087.pep
ERIFLKLVQQNHSTIYISRSLSACFTRVPLFHSLMLSRSKQDIGGHTLSLSAHGWSQIRPDHLDQGRGVGASFTLSWTR

SEQ ID NO: 139670 - protein, 316 aa, Triticum aestivum
  Clone ID: PAT_TA_34088.pep
MVQLDALTSDREMSTHMDLDIINEETERAIMDWRNLELATMKLSQELAEQLRLVMEPTLASKLQGDYRTGKRINMRKGIPYIASQFRRDKIWVRRTKPNKPNYQVGIAVDDSRNMSEGKCGKNAIEALVTVCRAMSQLEVGQFAVASFGKRGNVKVLHDFDQIFNAEAGVKMISSLSFEQDNKIEDQPVADLLMHLNIMLDAAVARSRTPSGQNPLQQLILVISDGKFHEKENLRRCIRNVLNRRRMIAYVLLDSHEESIMNSLEACYEGDKLILGKYMDSFPFPYYVMLKNIEALPRTLADLLRQWFELMQSANE

SEQ ID NO: 139671 - protein, 145 aa, Triticum aestivum
  unsure (1)..(145): unsure at all Xaa locations
  Clone ID: PAT_TA_34089.pep
PSLSCHRRQSLCLGYFVYLLFWNHRLGHLCGSSLSSLVRQGLLXICLWRCVFRLLVCRLSKQVNLHYPHSEIVSHRPFDLVHFNVWGPGPFASKGGHRYYIIFIDDFSRHTWIYFMXSSSEVLSISKNLPPCFSTQISTPIVCLP

SEQ ID NO: 139672 - protein, 233 aa, Triticum aestivum
  unsure (1)..(233): unsure at all Xaa locations
  Clone ID: PAT_TA_34090.pep
MSGLLNSNLNSSTSNLPDSSGRPFTTSFSGQSGSVQGFHHSGLHNIHGNYSLPNMPGSLAQRNAAMSGLPSSGVQQPGGSISGRFASNNLPVAMSQIPHAHSGVSGRGLNVGGGQAFSSGMNMGATILGLSSXLGANGSRNSTGVPGNPACGVRRPRRSGCGGCCVAARSCARXIAAGRPSVPPLFPPLALLGTGGTGDPSRPGSCLVAGAFLPKDFVVDRCSLGGLVKRLNS

SEQ ID NO: 139673 - protein, 250 aa, Triticum aestivum
  Clone ID: PAT_TA_34091.pep
MSSSDQNPAPTPASGTGGTAPPPGRPTTVSSQAIDMGAQVLQPLKPVRQMKQHACSFALYAHDMHRQLEVHHFVSRLNQDVLQCAVYDSDKPSARLIGVEYIVSDKIFKDLPPEEQRLWHSHAYEVKAGLWTDVGVPEMLQTSEMARMAKTYGKFWCTWQVDRGDRLPLGAPALMMSPQAVEPGRVRAELVRARDERCKVDSSARGLKAQRVEMDEPEWINPNADYWRLHGKGFAVDVTATEMKQHAPFP

SEQ ID NO: 139674 - protein, 218 aa, Triticum aestivum
  Clone ID: PAT_TA_34092.pep
MPGLTIGDTVPNLELDSTHGKIRIHDYVGNGYVILFSHPGDFTPVCTTELAAMANYAKEFEKRGVKLLGISCDDVQSHKEWTKDIEAYKPGSRVTYPIMADPDRSAIKQLNMVDPDEKDGQGQLPSRTLHMVGPDKVVKLSFLYPSCTGRNMDEVVRAVDSLLTAAKHKVATPANWKPGECVVIAPGVSDDEAKKMFPQGFETADLPSKKGYLRFTKV

SEQ ID NO: 139675 - protein, 218 aa, Triticum aestivum
  Clone ID: PAT_TA_34093.pep
MPGLTIGDTVPNLELDSTHGKIRIHDYVGNGYVILFSHPGDFTPVCTTELAAMANYAKEFEKRGVKLLGISCDDVQSHKEWTKDIEAYKPGSKVTYPIMADPDRSAIKQLNMVDPDEKDAEGQLPSRTLHIVGPDKKVKLSFLYPSCTGRNMDEVVRAVDSLLTAAKHKVATPANWKPGECVVIAPGVSDDEAKKMFPQGFETADLPSKKGYLRFTKV

SEQ ID NO: 139676 - protein, 202 aa, Triticum aestivum
  Clone ID: PAT_TA_34094.pep
EAHKLDPSAVLFVNDYNVEDGCDSKSTPEKFVEQIVDLQERGAPVGGIGVQGHISHPVGDIICDSLDKLAILGLPIWITELDVSAENEHIRADDLEVCLRECFAHAAVEGVVLWGFWETFMFRNHAHLVDADGTINETGKRYLALKQEWLTKTDGDIDHHGEFKFRGYHGSYTVEVVTPSGKVTRSFVVDKENPVQVVTLNI

SEQ ID NO: 139677 - protein, 129 aa, Triticum aestivum
  Clone ID: PAT_TA_34095.pep
ARAPMLSRVYIASSVTRTENKIVKASWGPGGQAVCGVSVVVAKKHAQTSPRGTFSIGSGWTSKTTYCRLGTRVCSSSLICVNTLLEIDSFAFAKKRQIHGELQNIRLQIPIVALDLAMDGWTLNDHKCL

SEQ ID NO: 139678 - protein, 178 aa, Triticum aestivum
  unsure (1)..(178): unsure at all Xaa locations
  Clone ID: PAT_TA_34096.pep
NLQRPITMEAGSVVLMDLLWSDPTENDSVEGLRPNARGPGLVTFGPDRVXEFCNNNDLQLIVRAHECVMDGFERFAQGHLITLFSATNYCGTANNAGAILVLGRDLVVVPKLIHPLPPAITSPETSPEHHIEDTWMQELNANRPPTQKRGLTQAADNDRAGPYAWAYRLRGMLKQSVR

SEQ ID NO: 139679 - protein, 158 aa, Triticum aestivum
  Clone ID: PAT_TA_34097.pep
PRVRKEVPCSRGLTDAPREGALCHAVSGVDGKFSFRSMPCGTYDLLPYYRGENTVFDVSPSSLHVSLEHSHMTIPQKFQVTGFSVGGHVVDGYGAGIEGAKVILDGQLRAVTDNLGYYRLDQVTSKKYDIVAEKDHYKFNRLENFMILPNMESIGDIK

SEQ ID NO: 139680 - protein, 145 aa, Triticum aestivum
  Clone ID: PAT_TA_34098.pep
LLPHASHLIASMNPSPQWMGRHTLTPPQQPPNPPPPPDPRRAATEASLSGDGGNLQAEKMGERERRNERREVRRRTGEGQRPVPARSGVTWQTWQLMAATPGSFFHFPTAYHQARVREHGIDDGGRKPGWLAEEEGCYGDCSLQG

SEQ ID NO: 139681 - protein, 105 aa, Triticum aestivum
  Clone ID: PAT_TA_34099.pep
HKYCKGTTNLDQDLRILHKCVLWIWPDAIMDLIIIFCFWHHIIILHLQERKWNDILLEAIRCNVHTAFLTLTSSCRGRSHRYCLASTSHLIAAAPSDGQLDPIIP

SEQ ID NO: 139682 - protein, 124 aa, Triticum aestivum
  Clone ID: PAT_TA_34100.pep
MSLPDVVYSCGSCGYALNLSSSNRSTSDVGSSYQKSLKKGLISFTSIDLSRFTQVDEISCFPFLTWRSYRPKTKLLCRKCGSSIGYGYGEPPVLCSFDPASSSSGTSQNYLIKIQALRLSDGTQ

SEQ ID NO: 139683 - protein, 116 aa, Triticum aestivum
  unsure (1)..(116): unsure at all Xaa locations
  Clone ID: PAT_TA_34101.pep
GGLFPQFFSPPLPSRTRPIATPPSPPAPAPARASXFPAPPPPSARIGGAPVGDVAVLCWAGSSGSSRRAAGPGRPRPRRPTPRPRRPPTPPRTPKPPPLRAATGCSGGATSRAAPR

SEQ ID NO: 139684 - protein, 209 aa, Triticum aestivum
  Clone ID: PAT_TA_34102.pep
LLKLVFLSTSSGSEVQASLATTLQLYSQSEIVAAFSFLSEKKFTVSGHGTKPYTLSRKFFFKASHSPFPFGSGKKASEFSNWLIGQQRNTADNRIYLYPDVECGEIVYLFSLVSSGGLFISPSLPSEGVGDADGSNSSSPLVEDTSGLNDGTHKRKADTVEQESSAAKKNKLCYRREKGFPGIQVALNQDRIQTNHLTQELHDKEVPYF

SEQ ID NO: 139685 - protein, 71 aa, Triticum aestivum
  Clone ID: PAT_TA_34103.pep
RSLCFNEAQRWASAKYCSRWADDPVYHRPSFRPFWPLERHPIEQHMFINMGVRVGLSAPHMFTVRVGGHPV

SEQ ID NO: 139686 - protein, 72 aa, Triticum aestivum
  unsure (1)..(72): unsure at all Xaa locations
  Clone ID: PAT_TA_34104.pep
LIPXSSKLTLTKGNKSWSSTAVAAALELVDPPGCRRSAPPHRAPPGPSAPDLAGSPPTSPDAIARRYLPRRR

SEQ ID NO: 139687 - protein, 238 aa, Triticum aestivum
  Clone ID: PAT_TA_34105.pep
MGFMGAKLFPSCESMCVCCPALRPSSRRPVKRYKKLLAEIFPKTPEGPPNERKIMKLCEYAAKNPLRIPKIAKFLEQRSRKELRAAHLNYVKIITEAYSKLLFICKEQMAYFAISLVNVLTDLLESKQENIHILGCQTLARFIYSQVDNTYARNIESLVHKVCTLSRQQGVEHSLLRAASLQCLSAMIWFMKEHSYIFADFDEMVQSVLENYRMDGTAGGDDDRHASQHNWVDEIVRR

SEQ ID NO: 139688 - protein, 351 aa, Triticum aestivum
  Clone ID: PAT_TA_34106.pep
MTMLMGRLAGVALELALAALLVLFLPPYYVYRLTASFLGSVFPDSVSGKVVLITGASSGIGEHLAYEYAKRGANLALVARREASLREVADHASALGSPSVLVLPADVSKPDDCRKFIDDTVAYFGRLDHLVNNASIWQVCKFQEVEDVNYFRTLMDINFWGHVYPTRYAIPHLKKTHGRIVGVTSNSSYIFIGRNTFYNASKAAALNFYDTLRMELGGEVRITEIVPGVVESEITKGKMLTKEGEMKVDQDERDAILGPTPAEPVAAFAKTAVKDVCRGERYVFEPRWYMAVYLFRVCFPEILAWSSRLLTVKTLGRPATTDTVGRQILDMPGVRWLTQTASLRSPEIQAR

SEQ ID NO: 139689 - protein, 63 aa, Triticum aestivum
  Clone ID: PAT_TA_34107.pep
FPQKKKNKNEDSSSENQARTLRKWDSFSLSPSLSLLMITCFPRFLVYFGYPCHRVLSVILFPK

SEQ ID NO: 139690 - protein, 285 aa, Triticum aestivum
  unsure (1)..(285): unsure at all Xaa locations
  Clone ID: PAT_TA_34108.pep
KLFSTLQGFVSVNGIERSACNKMLRFTIWTVFFANVLTGSVLNQLNIFLDPKEIPERLAVVVPAQASFFIAYVVTSWTSITSELTQTSALLYHLWGSCAKCCKREDSEAPSMHYHSEIPRILLFGLLGLTYSIVAPLILPFVLTYFCLGYFIFRNQLCNVYAPKYDTGGRFWPIVHNATIFSLVLMHLISIGIFGVKEFPFGSSLLVPLPILTLLFYAYCGNRFYPIFEAYSTESLXNKDIQEQSKPEMAEFFSSLETAYCDPALKPIQRSLNSDERTAPLLSSV

SEQ ID NO: 139691 - protein, 194 aa, Triticum aestivum
  unsure (1)..(194): unsure at all Xaa locations
  Clone ID: PAT_TA_34109.pep
QYVEELEGKVKAMQATIADLSTRISCVTAENAALKQQLAGAGGAGVPPPLPMYPGLYPLPPPWMHPAYAMGARGSQVPLMPIPRLKTKQPASAAAEPPAKKSRKTKKVASVSLLGLLLLMMLCGCLVPAVNRMYGAFDTQEGVRTGRPISRHATLMAVVGPRDGKSGLPDYKLPHNSSEKPPAXLYIPRNGKHV

SEQ ID NO: 139692 - protein, 179 aa, Triticum aestivum
  unsure (1)..(179): unsure at all Xaa locations
  Clone ID: PAT_TA_34110.pep
MVDNKNDGSEGVKFNTSHLMQSTEEVARAFIAAASAATVQPTRPSVVYSSGEESGSPMQKLQQQFSKIMKGFSNSPEVSGPYNPEVLTTHKRQWSRFQQKSLGNRCIKEPSHLFESIVIVGLPPQADIHELENIALGRNDDDAKKSRHIFGNNHHQXHAVSNMEPQVLFAYPPGEVSFA

SEQ ID NO: 139693 - protein, 98 aa, Triticum aestivum
  Clone ID: PAT_TA_34111.pep
NIYSPIRSEKGPHHPWRAWIFTRGNAFPRSPTASGLYERHGYTCSRPSSPFQFLYSAPDMNSLFERSSDKGYAPTNGWHVHLHWRIISCSYRLADAAR

SEQ ID NO: 139694 - protein, 155 aa, Triticum aestivum; identical to SEQ ID NO: 111377
  Clone ID: PAT_TA_34112.pep

SEQ ID NO: 139695 - protein, 145 aa, Triticum aestivum
  Clone ID: PAT_TA_34113.pep
CPPPPHHKLMHRRHLMDSPDAPSVAKASFRYPDWVMLDPHTRLNYPVPTIDSDYPMEDFHATKAHAETSMGDPIDVFFRAVPPPGASRLYVNWTPRRFTKGSSSSSGGRGEEKIAGMDFTDGNPLSWPPMAIRFLLRLTLSNTPG

SEQ ID NO: 139696 - protein, 224 aa, Triticum aestivum
  Clone ID: PAT_TA_34114.pep
AGGGGVEPARSLEIAAKLLAARDLVGCKRFAEHAVDADPLLPGADELLAVADVHLAAQRLLPSGRPDPLAILQLQPNPDSADVKRAFRRLANLLAPRRNPHPGADTALRAVEEAFAHLSESTSTGAAPAPAVPGGASAAEDTFWTVCPHCCHVHHYERLLVGRSLMCASAGCRRAFVPTELPAVPPIVPGTDSYYCAWGFIPKGVAKPADLSTDWKPVFSMARD

SEQ ID NO: 139697 - protein, 80 aa, Triticum aestivum
  unsure (1)..(80): unsure at all Xaa locations
  Clone ID: PAT_TA_34115.pep
LVYGLCCKAKILHQPPPPDPHPPPESXAGTAFLALPHPESSPAAPGVVAAPQPPAPPSVVAAAAAAGVPQPPVPPSGQQV

SEQ ID NO: 139698 - protein, 167 aa, Triticum aestivum
  Clone ID: PAT_TA_34116.pep
QRPPRRRSRLSSNTTHPAAAERSQPWPSRGASAAKTLAPSAPAARPPPRPRPSPPPPKTTSAASRGSSGASAAARSCASSASPRRPTRPTATSAPASASSAGDRLVLTSALVAALRRIRPSLVPRSLRRAGRRWGLALRAWRQHGAGSGTHDRMCSCGNEDGPEMWC

SEQ ID NO: 139699 - protein, 181 aa, Triticum aestivum
  Clone ID: PAT_TA_34117.pep
PDPELLLPCGSSPASLPPPNLHQPRLPPHPAGSPETSRRLPPLPSSTTPTTSTTRVVALLPRMATSVRSNHRRALHRQPPPTALDPVVPDHLPPSSTLSRRRDPPSLCSSALEARLMDHAAVTGWAVLLLPSSSHASMRNSHVAHFSVEEVSSCSTAFLRLSPSRHPPTRWTAVNNSAISR

SEQ ID NO: 139700 - protein, 106 aa, Triticum aestivum
  Clone ID: PAT_TA_34118.pep
NGGCDEDLIDEVASAERVSQETADGMDANCMHGRLNCGADCVWQASLVVSFGVWCIRRVLGLSLAESRPELWGKYTYVLNRLQVILLSCYFAPLPLKKGLQHAPYR

SEQ ID NO: 139701 - protein, 127 aa, Triticum aestivum
  unsure (1)..(127): unsure at all Xaa locations
  Clone ID: PAT_TA_34119.pep
VRNSRVDIKGRTFYFLDSFYDENSSYHMNIKKKIISSFICTWYEARLQPMDFNAFPVVYPKVPQQDNDIDCGIFTMKLMXWCPKNPTPIVFSPKDAPDARIRYAVDLMFSHYNTLDDEKKRVKEFRL

SEQ ID NO: 139702 - protein, 241 aa, Triticum aestivum
  unsure (1)..(241): unsure at all Xaa locations
  Clone ID: PAT_TA_34120.pep
MLMRFTHLWVAMPEPESDASPEVIDDIRSESLVKLAPSSVDVPLTESNEKAQNAEDQVVASGTVENVGVQEPTDREGEAVDDEIVLAAADEKDGSGNEGDEDDDEVSFDRSPARVAIIENSEAAKQIMKELGEGSSSGSPVSGLSSSREYTNSMDGQIVLDDSEDDDDDDDNEDDDEKGFDSPALAALLKAATGASPGWETXTVXFAKNGSKKSFPXGRPAGLGSSAPSLRPTAPRQPARS

SEQ ID NO: 139703 - protein, 106 aa, Triticum aestivum
  Clone ID: PAT_TA_34121.pep
HENQMIKPDLVRKEGEEEGDGGLDSHIDHRREQVWVKDQGPCGRTSTLVLFTLASGSSFLALTHAITFRLRPPCNKPIIYEKTRPSCAKTIGAFGSHPLILGLLNR

SEQ ID NO: 139704 - protein, 231 aa, Triticum aestivum
  unsure (1)..(231): unsure at all Xaa locations
  Clone ID: PAT_TA_34122.pep
MASSDEKPVPTPASTGGDGGPPGKPTTTSTMLLDKGAAALQSLRPVKQMKQHVCTFALYAHDPHRQVETHHYVSRLNQDVLQCPVYDSDDKHARLIGVEYIVSRKIFESLPAEEQKLWHSHAHEIKTGLWANPWVPSMLGKAELDHMAGTFGKFWCTWQVDRGDRLPLGAPALMVSPQGERDGAVRPDLVRKRDQKYSFSTEELRAARXDVEVPAEPRPGQADYWVRHHKG

SEQ ID NO: 139705 - protein, 86 aa, Triticum aestivum
  Clone ID: PAT_TA_34123.pep
ISGLVCWLIRIFQRDQDCLINQRETRSVLGSWDWCATVDLGMCTSRSLQGCVILDTLQTFCKLVSVAHFLFISISMMTTYSKASPR

SEQ ID NO: 139706 - protein, 80 aa, Triticum aestivum
  Clone ID: PAT_TA_34124.pep
VPVAGEVKEVPEGEACHPDLDPPCLGRSQLRLDHLNKLLPSSRRPAAAAAPMLTSYHCRRRKGGRSRMREPTAQGRRGGG

SEQ ID NO: 139707 - protein, 125 aa, Triticum aestivum
  Clone ID: PAT_TA_34125.pep
RIESIIAPSSHDSSTIFVLPTAPRANPLPRPNPSHAFIDRTTQLPIIISRITTLAGCYHSRSPPQLMSTAWQRHLSAPFPVLYFYTFRNSATGPVERQVTATNGRPPPAGVAAASGSAPSGTGAG

SEQ ID NO: 139708 - protein, 321 aa, Triticum aestivum
  unsure (1)..(321): unsure at all Xaa locations
  Clone ID: PAT_TA_34126.pep
PRVRGYSRKTLADEDLRSMIEANLTCRVDHHENCEEKLNEFLKRTYYVDAGHDNKDGMAKLNSKMAQIEGTCAANRIFYLAVPQEALLDVALPLSDSAQTKHGWNRIIIEKPFGFTSLSSQRVTQSLLSRFEEKQIYRIDHLLGKDLIENLTVLRFSNLVFEPLWSRKYIRNVQVVFSEETSAETQGRYFGNYGIIRDIVHSHILQTIALFAMEPPVSLDGEDIRDEKVKVLRSMRKVDIEDVVLGQLKXSSGDVDRYTKSMTPTYFAAAMYIDNARWDGVPFLIKTGMGLMENRAEIRIQFHHVPGNIYRERFGHDIDLD

SEQ ID NO: 139709 - protein, 171 aa, Triticum aestivum
  Clone ID: PAT_TA_34127.pep
FETIPNKLEAQAYAELLEENDISIPAWFSFTSKDGANAASGDPITECAAIADSCRRVAAVGINCTAPRLIHGLVISISKVASKPIVVYPNTGETYVAETKEWVDSAAAGGGAAGTDFVSCVGKWRQAGASLVGGCCRTGPATVRAIARALREADAASDADADDDYPAVAVL

SEQ ID NO: 139710 - protein, 353 aa, Triticum aestivum
  unsure (1)..(353): unsure at all Xaa locations
  Clone ID: PAT_TA_34128.pep
MGRGDGHDDALRRWLREAGGWLVVDGALGTELEAHGADLQDELWSARCLVSAPHLIRKVHLDYLDAGANIITTASYQATLQGFQSRGVSREQGEALLRRSVQIAQEARAIFXEGRSKGPYAARDEARRPVLVAASVGSYGAYLADGSEYTGDXGRSVTKEALKNFHRRRLQVLADAGPXDLIAFETVPXNQLEAQAFAELLEGERHQDSRPVLLHLHGRGRRRDRGPPALADRRRRLVAVGISCTAPRLIHGLILSLRPVTTKPIVVYPNTGETHRGDXYVAERTEWVDSAAAGGGVAGTDFVSCVGRGSRSGASLVGRCCRTXPAIARALREADAAAXGRSTDDDYPAVAVL

SEQ ID NO: 139711 - protein, 75 aa, Triticum aestivum
  Clone ID: PAT_TA_34129.pep
VQEFSVEIVARRHLCPVLAKFYWSRHWTIYALVSHLIFGTFEYSSNMHTLHIFSDSLKICIYTVQQHIGNIQVLV

SEQ ID NO: 139712 - protein, 194 aa, Triticum aestivum
  Clone ID: PAT_TA_34130.pep
SKPFVCFFWAAYKCLASWSSRRPPPISLLFAISPKKSPQPYLLALQPGNPPSRGWRGRRAPLPVSRRPPLISLSPSAEEPTDGLAAVPRRLGSPSLDEVERERRLPNNLPAAPAACRSWNSTSRPATGCRPAPMMWVPSILPLPGCVHPLPPRLSRPRGAELENERSGCGEASKERARRDIGQVFSSSNHTLCM

SEQ ID NO: 139713 - protein, 59 aa, Triticum aestivum
  Clone ID: PAT_TA_34131.pep
MTPHIKLAIRGNAMARTASRGHATQVRSKLLYDHIRLIMMNVKGSCFCECADILTLLES

SEQ ID NO: 139714 - protein, 186 aa, Triticum aestivum
  unsure (1)..(186): unsure at all Xaa locations
  Clone ID: PAT_TA_34132.pep
ALRELVPAVVGWGGKLDQILRVLLSHILASAQRCPSVSGVEGTIDSHLRVLGEQERWTIEVLLRMLTELLPFIHQKAIETCPSIDPSRXTTFKNPALKLYATGETEWSAFEWMHTECLPDLIKLXCFLPAKEDSLRTXITKYLLALSGPYGKXYPTHIMLLVFLMGNDNGLQRPCNLFFWFNQVRA

SEQ ID NO: 139715 - protein, 171 aa, Triticum aestivum
  Clone ID: PAT_TA_34133.pep
KGNANGRNLLKDAYVDELHRRIAVMGAETAELKAEMSRYLPLLASLSDQISMLEGGTHLLSDKEGNLELVQDDRRGSEFLDIPSGVLELDSLIARVKALRVVILDVKDRQDKEFTEFTAKLESANLEIQDLKSRKGSCIRHKEQYMEDDRQKYDADNSKGKQAQIMKDIEL

SEQ ID NO: 139716 - protein, 142 aa, Triticum aestivum
  Clone ID: PAT_TA_34134.pep
MEVEAARRDASALDPELLQLPELAPGALRENSSIAEALYLQWLVLPESSKLVKSLIEDAKAGATLNVAGSSASTNAASSSSLPSMFPAGSAPPLSPRSTAGSPRVMRRGSSAGPSSLGSPLKLVSEPVREVIPQFYFKHGRP

SEQ ID NO: 139717 - protein, 243 aa, Triticum aestivum
  unsure (1)..(243): unsure at all Xaa locations
  Clone ID: PAT_TA_34135.pep
QRYANLAGKHVVVEYDTKDLKPPILTVEQAVQNNSYFEVPPGKYPKQVGDFSKGMAQADHKILSTEVKLASQYYFYMETQTALAIPDEDNTIVVYSSSQYPELAQNVIARCLGIPFSNVRVITRRVGGGFGGKAFRSFTVATAAALCAFKLRRPVRMYLNRSTDMIMIGGRHPIKAYYTVGFKSNGRITALHLDILINAGISPDASPLMPDTMMSGLKXYNWGALSFDIKVCKTNTTXKSVMR

SEQ ID NO: 139718 - protein, 156 aa, Triticum aestivum
  Clone ID: PAT_TA_34136.pep
MTIDLSTMPGSSSSRLLDAAAARKDMNFFKNRYVLGLTGVAGIGGFLFGYDTGVISGALLYIRDEFPAVKDNLFLQETIVSMALLGAILGAAGGGWINDAYGRKKSTLLADLMFALGSLVMCAAGGPYVLILGRLFVGLGVGIASVTAPVYIAEAA

SEQ ID NO: 139719 - protein, 124 aa, Triticum aestivum
  Clone ID: PAT_TA_34137.pep
KLEPSAEDPRGRCIEPAAYKTDEEATPPESYVQNNHGQFDQLMNKPNGANQSTHKNSKTTSIYKSACTDSLQNCTSKRKLPQKETGGSRWGPIHLQGRGTHQWRLPPMRSGSTRGFAAGTAQGV

SEQ ID NO: 139720 - protein, 498 aa, Triticum aestivum
  Clone ID: PAT_TA_34138.pep
YDQVTELTGAEGVQNALRRNNGLGWVTSAASAFDAVKDIMEALRSKHTNLANELELLLSEIGSRFVTLPEERLLAVVNALLHRCYKYPTATTGEVPQSLKKELSGVCRACFSQDAVNKHVDFVKEYKQDFERDLDPDSATTFPSTLAELTERLKHWKNILQSNVEDRFPAVLKLEEESKVLRDFHVVDVELPGQYFTDQEVAPDHTVKLDRVGPDIPIVRRHGSSFRRLTLIGSDGSQRHFIVQTSLTPNARSDERMLQLFRVLNKMFDKHKESRRRHLAIHTPIIIPVWSQVRMVEDDLMYSTFLEVYEINCARHNREADSPITIFKEQLNQAISGQVSPEQVVELRLQAYNEITKSIVNDNIFSQYMHKILPTGNHLWTFKKQFAIQVALSCFMSYMLQIGGRAPNKILFAKNTGKIFQTDFHPAYDPNGLIEFSELVPFRLTRNMQAFFSNFGVEGLIASAMCSAAQSVVSPKQTQHIWHHLAMFFRDELLSWSW

SEQ ID NO: 139721 - protein, 200 aa, Triticum aestivum
  unsure (1)..(200): unsure at all Xaa locations
  Clone ID: PAT_TA_34139.pep
LPDHLLLNILERVETLDALRTCILSRGMLELRPMLSXLILRLSLLRVTSSPMSTPLIVFFQYNIAVAATTDKILGARNPEIPIRELRVRFCLRHDECLSISQAVARTMATHKLDVAEFVVLTEKTSWRCTQHDLLSFAKRFNTWFGDCPVVFAGLTHLWLRNLRFGELDIHNILNTCKRLESLRLTHCEPGVRSVLQVQH

SEQ ID NO: 139722 - protein, 149 aa, Triticum aestivum
  Clone ID: PAT_TA_34140.pep
MADRGGYVQVQHGQYGGGHHGGQQQHGRQMGEQMKGMFQEKAPSASQALTVATLFPLGGLLLVLSGLALAGTVVGLAVATPVFLLFSPMLVPAALTIGLAVTGFLTSGALGLGGLSSLTVLANTARQAFQRTPDYVEEARQRMADAAAL

SEQ ID NO: 139723 - protein, 192 aa, Triticum aestivum
  Clone ID: PAT_TA_34141.pep
MADRGGYVQVQHGQYGGGHHGGQQQHGRQMGEQMKGMLQEKAPSASQALTVATLFPLGGLLLVLSGLALAGTVVGLAVATPVFLLFSPVLVPAALTIGLAVTGFLTSGALGLGGLSSLTVLANTARQAFQRTPDYVEEARQRMADAAAAAGHKTQQAGHAIQSRAEEARAGGGGHTGATGGAGAGTGTRASS

SEQ ID NO: 139724 - protein, 211 aa, Triticum aestivum
  Clone ID: PAT_TA_34142.pep
TRSPYSRRLSDFSTADFSLSVIHDPAAHRMGMGMGMEKLAFRAQASSFWRLAKMNSPEWGYALAGSVGSMVCGSFSAIFAYILSAVLSIYYTPDPRHMDREIAKYCYLLIGMSSAALLFNTVQHLFWDTVGENLTKRVREKMLTAVLRNEMAWFDMEANASAHIAARLALDAQNVRSAIGDRISIIVQNSALMLVACTAGFVCRWGLSLVL

SEQ ID NO: 139725 - protein, 197 aa, Triticum aestivum
  Clone ID: PAT_TA_34143.pep
MSTWNYVVTAHKPTSVSHSCVGNFTGPHQLNLIVAKCTRIEIHLLTPQGLQPMLDVPIYGRIATIELFRPHNEAQDFLFVATERYKFCVLQWDAEKSELLTRSMGDVSDRIGRPTDNGQIGIIDPDCRLIGLHLYDGLFKVIPFDNKGQLKEAFNIRLEELQVLDIKFLYGCLRPTIVVLYQDNKDARHVKTYEVAL

SEQ ID NO: 139726 - protein, 80 aa, Triticum aestivum
  Clone ID: PAT_TA_34144.pep
LARLLFPSSFSLRILLTSTAVAKQRIICIMLDDEYLLRNNVAKYRHKKAKCQLSKLTNRQKFRGHGGWLSMVAGKKSTKQ

SEQ ID NO: 139727 - protein, 106 aa, Triticum aestivum
  Clone ID: PAT_TA_34145.pep
PYPDPFPPLSGHVGKHGSTPERRCGGGGSEEPAKRSARTGIAAPPSLPPKFSVRSWSNAVGVVVDPSRVRDVGCPPIRNYWKNTLAASVPKSKGGDDVAAQGGLTT

SEQ ID NO: 139728 - protein, 494 aa, Triticum aestivum
  Clone ID: PAT_TA_34146.pep
MSYNKTASITAETINPKVKIFDYEPCGEIARHAERLAQEMEKSPGSRPFPEITYCNLGNPQALGQRPITFFREVLSLCDNPALLRRDETRMLFSPCAINRARKIIESMPGRNSGAYTNSQGIRSLREAVASGIAARDGFPSRPEDIFLTDGASSAINLSMQILIRSQEDGVLCPLPEYPLYSASIILHGGTMVPYNLSEDGDWGLEIFEVKRCLEEARIAGLTVRAMVIINPGNPTGQVLSVTNQEEIVEFCRKEGLVMLADEVYQDNVYVEDRKFHSFKKVARSLGYDENDISIVSFHSVSMGFSGECGRRGGYMEICGFGDDVMGEICKVASVTLCPNIGGQILTSLAMDPPKLGDGCFENFMAEKEDIRLSLAKRAKTLAGAFSSLEGMTCNRVEGAIYAFPRIHLPAAAIKAAKAEGMSPDLFYACRLLDATGIAVVPGSGFHQVSGRNKATGTWHIRCTILPGEDKIKVMIPRLKEFHESFMNEFRDRS

SEQ ID NO: 139729 - protein, 224 aa, Triticum aestivum
  unsure (1)..(224): unsure at all Xaa locations
  Clone ID: PAT_TA_34147.pep
MHSQNHWGGAFDIDGAEDDQSRNMDIDRRRAAAPAPAGTRPQQSWXLLGPPGGQERTDRYVDLGCVVGKAQVPLGWDALLGAGAFVLIGLPIIIAKNIPKKKPHAPPPDKYTDALHKALLFFNAQKSGKLPKNKGIPWRGTPGMKDGADLPDVKGGLVGGYYDAGDNXKFHFPMAFSMTLLXSWSVVGVPXRYKAIGEYDHVREPLQGGTRLXLLXFNSSASNI

SEQ ID NO: 139730 - protein, 167 aa, Triticum aestivum
  Clone ID: PAT_TA_34148.pep
KVLLWCGTRSSNLLRHLHKGFLPAVCHLPVPGYMFGRAIVCSDAAAEAARYGYTAVDRPEGYLVLAVASLGKEIKEITGTPGAEDVKSLEEKKLGVKGVGRKTTDESEHLTWRDGVKVPCGKLVPSGNEHGPLEYNEFAVYDPKQVSIQFLVGVRYEEQNMEVVPDE

SEQ ID NO: 139731 - protein, 159 aa, Triticum aestivum
  Clone ID: PAT_TA_34149.pep
MSDEEVMESGTAFSQRFAAKRLRGVAKTKLNPTKRHYINETGFGDLMTISHFKAPPDLMEWLTMNIDTEKRELRLSRTKVIVFTRDMVKKVFNIPSGNRPVELFKRHEQCELRNIYHKNGRAPIAHTVTVLHRARNDDGDTTKRSWVLLALATVLTPST

SEQ ID NO: 139732 - protein, 211 aa, Triticum aestivum
  unsure (1)..(211): unsure at all Xaa locations
  Clone ID: PAT_TA_34150.pep
MAARALVAPPLPPTPPLGTMRATPRVAAGLSSALTGHRGRHTLCSVQLTESPSGNLQVEANSSHSPTQLMSTGHDDSAITCKGFCTISWSVKADVMDGYIIFITGDPVTLGCWEPDMAGQLNPSVKSSNKWTAVIKVPYGGHFKYNYFGREEKNSSNDIIWRPGPECSLSIPFCXQXNHVILVKDQWMETSVAGYFPLLPGGSWADKLISG

SEQ ID NO: 139733 - protein, 415 aa, Triticum aestivum
  Clone ID: PAT_TA_34151.pep
MASDDLFEGLPPPAAPAGEDRAASPAPPPPPPEAPAPRRSALKSSLKRDKPSPSSAATSSCSPATAAASVAPPDVAAEGRVPEKRLRFRTTVDASEMQIIEAMQKITSHIGNPSKFSKASKLALQLIEAGSVKPETIGHFFAVLEAAMSSPGACNEPSVRADYQALFNAAEGVTECFNQEQKNQFDVWMLHAVVANDLCTDDSFVFSKAVGKIKDAISALPVATVDDDNDEAAALAALAEIQSGATENKAADSNTPAAASNSGEESSDPFGLDNLLEHKPKKSEKSQDKGAGALSRKADEESRRLLRSRREALLKCLETAARRFRIPWTQTSIDILGRHAFESVGRFTARQREAVEKLWNSIKEQQIRRKHGKSASGKLDVNAFERLQEKYSHEKISIRRAVGGAGDRRATQWLG

SEQ ID NO: 139734 - protein, 409 aa, Triticum aestivum
  unsure (1)..(409): unsure at all Xaa locations
  Clone ID: PAT_TA_34152.pep
MSAKDKVSEAAGGGQPTPAQTSVGPGGRQHTSRMERLRTVRSAQGQGRSEAAGGAKEKAADVKDKAAETVTNAKGKVSEAAGEAKEKASHVKDRAAETVTSAKGKVSEAAGNAKDKVSDIAERAEDYAGDAAESAAEKVARAEEVAKAKAGEVTKNLTDIARRAQEVAXSDAAGYLLGAPMEAARTATAVMHLLGFATAYGACVWVTFVSSHVLAASLPRQQLGVVQSKLYPVYFRAMAYCVGLALAAHLLGRERSSFAARAQSFNLLSALGLVLANMLLLEPKATKVMFERMKVEKEEGRGRDMSDIVDPPAVTVATAATTTTATPTAAGARSPVDGTTGTVRAAKTTTTTTSVTAPDAEMAKSKVVRLNKRLKQLNSYSSLCNVLSLMVLTWHLVHLARRLQMSTAC

SEQ ID NO: 139735 - protein, 122 aa, Triticum aestivum
  Clone ID: PAT_TA_34153.pep
THLHHHMDHNAHRHIDHDNHRHRHHHPCHRSRFLRYCFPLLFSFILMNIISSPFKYDFLYLSSKALHCCSSDRPNGHHHRSQPCHHLHLPGIQLEPQEQILVQAGEGRSERVLHGGIRWPLG

SEQ ID NO: 139736 - protein, 219 aa, Triticum aestivum
  unsure (1)..(219): unsure at all Xaa locations
  Clone ID: PAT_TA_34154.pep
MASQGAATAAWTNEEDKAFENAVAAGAPPPLDGPPEECWFAALAASVPGAXTEEVRRHYEALVEDVGAIDAGRVPLPRYAGEDSSAAAAAAAPSKDRREDRKSFDSDSGKGCSKAEQERRKGIPWTEEEHRLFLLGLDKFGKGDWRSISRNFVISXRTPTQVGQPRARSYFIRLKLHEXGNRRRLQSTDIQPVIQQRPPKARRPSPARPPPRWGGRPGA

SEQ ID NO: 139737 - protein, 291 aa, Triticum aestivum
  Clone ID: PAT_TA_34155.pep
MKQHESSGAPPLLVKDELAVSNFVKQASFLEKTEDCCLSQNNGMHKSQLRLWIESGHNMKCESVSASNSKGHDTPNKANRKRSRPGESSKPRPKDRQLIQDRIKELRELVPNGAKCSIDALLEKTIKHMVFLQSVTKHADNLKDSNESKILSGDNGPLWKDYFEGGATWAFNVGSQSMTCPIIVEDLDRPRQMLVEMICDDRGIFLEIADFIKGLGLTILRGVMEARKNKIWARFTVEANRDVTRMEIFLSLVRLLEPSCDGSGSGENQENGKMPLGIAQHQIIPATGHLR

SEQ ID NO: 139738 - protein, 125 aa, Triticum aestivum
  Clone ID: PAT_TA_34156.pep
MDAYEGTKVVFARVQALHPDLASKIMGMLLIQDKSEEDMIRLAFGPEHLLHAVVARARAYSPRRRPPQASPPLRPPRPGAQGCQAEDAPFPGVDARYEGGERFYPPEEFGCWSPANGGTTTELFA

SEQ ID NO: 139739 - protein, 97 aa, Triticum aestivum
  unsure (1)..(97): unsure at all Xaa locations
  Clone ID: PAT_TA_34157.pep
YLHELRVNIYCRNYICCYEYMYHXLVRVARKEKNRRGGGPRYPNSPLIXEVRITAPLNLXGRFLQTXLNWGKXPXXXYPNFNPPLXATSPLFAXLGX

SEQ ID NO: 139740 - protein, 315 aa, Triticum aestivum
  unsure (1)..(315): unsure at all Xaa locations
  Clone ID: PAT_TA_34158.pep
MLSCQAQDLTNQTAKIDDVDIIPKLTLFGHSARIWDCCISDSIVITAGEDCTCCIWGMDGKLIKTFKEHIGRGLWRCLYDPSSLVLITAGFDSAIKVHHLCNSSFHDILEENVAPDGLKYDSEVFEISSPIVSGQHGALDSKSEYVRCLHFVQENVLYVATNNGYLHHAELSDTKDPRWTEVIQVTEKAPIICMDVMTVCSDISLDKEDIIALGDGRGNVTIVRLSSPSVEPKIDLSFTWPAEKDRQLLGLYWCKSLEXIFTADPRGTLKLWNIRNALLSNGHGITTTQEASLIAMLESPFGGRIMCLDGSLQDE

SEQ ID NO: 139741 - protein, 141 aa, Triticum aestivum
  unsure (1)..(141): unsure at all Xaa locations
  Clone ID: PAT_TA_34159.pep
SIRISXTGWPSAGDANEKAATPESAARYNSNVMRLVAEWKGTPLKPNVPLRVYVFALFNENMKPGPASERNYGLFKPDSTPVYPLTYKPAHGDFTSGGNSTGGDNDYYDISAASREPTGRRWTWAQAAVAGGAAAALMVAA

SEQ ID NO: 139742 - protein, 101 aa, Triticum aestivum
  Clone ID: PAT_TA_34160.pep
RQQVKLLLPSYKPKVMKKSGDKMLGDYKIHALFTHGGGNPTSCYGSQQRKESRNPHHGRVIQGHLDKVRHYIVYIWSEYMTIFYIQCTQSILCCTLLNLSC

SEQ ID NO: 139743 - protein, 127 aa, Triticum aestivum
  Clone ID: PAT_TA_34161.pep
RPGRTRRCWSPELHRHFVAALHQLGGPQVATPKQIREVMKVDGLTNDEVKSHLQKYRLHNQRCPSSSSASHPVMLVGDLWAHQEQSSSQSRSPEGPLQLSVSGVAVSALTGSDSSEEDGRSVGYSRR

SEQ ID NO: 139744 - protein, 254 aa, Triticum aestivum
  Clone ID: PAT_TA_34162.pep
AALLLVVLAAAARLLPLAQCDGPNPEIRNTGGLSRQGFPAGFVFGTAASAYQVEGMARQGGRGPSIWDAFAAIPGTIAGNGSADVTVDEYHRYKEDVGIMKDMGFDAYRFSISWSRIFPDGTGKVNQEGVDYYNRLIDYMLQQGITPYANLYHYDLPLALHQQYLGWLSPKIVGAFADYAEFCFKVFGDRVKNWFTFNEPRVVAALGYDNGLHAPGRCSKCPAGGDSRTEPYIVTHNIILSHAAAVQRYREKYQ

SEQ ID NO: 139745 - protein, 187 aa, Triticum aestivum
  Clone ID: PAT_TA_34163.pep
MARSAMSGLVLLLLCATCRLALGITDGLLANGNFERGPQPSQLRGTQVVGASSIPSWRTSGFVEYIPSGRKQGDMVLVVPEGAYAVRLGNEASIAQRLRGAVPGARYSLTFSAARTCAQAERLNVSASGQSGVLVMQTMYSSNGWDSYSWAWDATADEVEVVVHNPGVTEDPACGPLINSVATKTLT

SEQ ID NO: 139746 - protein, 147 aa, Triticum aestivum
  Clone ID: PAT_TA_34164.pep
GTRHCKHVLLSALVLLSILAAAVATIACRPGVGIPPKPLPSCRAYVVQKTCKDTQQTTPGKVASKDPCCRELEAVSEECRCTAMEDFMQGMLRLEGVPEGCTRKDLWEFTLSLVKPELCNLKTITGGPYCGLPPSNDARLADSVQDV

SEQ ID NO: 139747 - protein, 184 aa, Triticum aestivum
  unsure (1)..(184): unsure at all Xaa locations
  Clone ID: PAT_TA_34165.pep
MAGAAALRRAARSAVRKLANAPSPARTFVLPERLLSSQASPEHRPRSGVSASELGQYPPERIRKFSIIAHVDHGKSTLADRLLELTGTIQKGHGAQYLDKLQVEKERGITVKAQTATMFYKHTVENSESHGTDTSSYLLNLIDTPGHVDFSYEVXRFLTVXQGALLVIDAFXGVQVRTVADGYL

SEQ ID NO: 139748 - protein, 274 aa, Triticum aestivum
  unsure (1)..(274): unsure at all Xaa locations
  Clone ID: PAT_TA_34166.pep
KLKFNSKQRPLDACRCQARQPSSSTASRRPSPWPASSAPPARSCPSPWSPPRRRPTSSAPPPCSLNRPSPSPLARPPLWLPRRPAPPASPSRRAPARSPPPCSRPPWSSPPPSPRRSWCPPRPCPWPRRPCPWRPPPPPPFXPWPRPPSPWPCRSPAPSSPXPSPSSPPPCPRPGLPSPSVSCXPSPSCGRPSLRLPPPSPWPSPSSPPPCPRPGLPSPWSRASPSPSCGRPSRRRPRPCPWSRRPCATPGPSRSPWHGRWHPWPAPPRPCTCP

SEQ ID NO: 139749 - protein, 299 aa, Triticum aestivum
  Clone ID: PAT_TA_34167.pep
MPSVQVQRKVGNQDDGLHGAEQEAVRATGRGKSKASARKVTYGFHLVEGKMPHGMEDRHVAEFRRLDDGNEVGLFGVFDGHSGADVATYLRNHLFDNILGEPDFWEDTMGAIRRAYHRTDRKVLKKKKVTADGEEIVRPRRGGSTAVTVILLNGETLVVANVGDSRAVVCESGRARQLSVDHEPLRERDAIESRGGFVTEMHGDVPRVDASLAMSRAFGDRKLKEHISSDPDVAIEHVGDDTEFVVVASDGLWKVMSNQEVVDEVRSTRDARKAAVKLVDAAVDRGSKDDIACVVVRIH

SEQ ID NO: 139750 - protein, 75 aa, Triticum aestivum
  Clone ID: PAT_TA_34168.pep
PSPTPATWRRAWPPPSPCAAPPPPPRAPGPRPAPAAASSRTRSPAPSASSPPPDASSSTMTPRTTTTPSPSPGPS

SEQ ID NO: 139751 - protein, 258 aa, Triticum aestivum
  unsure (1)..(258): unsure at all Xaa locations
  Clone ID: PAT_TA_34169.pep
MSRASLSPSSSGDEEEEDDEGVDGYRKGGYHAVRPGDQFAAGRYVTQRKLGWGNFSTVWLAFDVESQKFVALKIQKSAPEFAQAALHEIEFLSEITKRDPSNCKCTIQLIDHFKHAGPNGQHICLVFEFLGDSLLKLVQYNRYKGIGLGRVKEICRSILVGLDYLHGELGIIHSDLKLEXNVLLVSTIDPSKDPIRSGLKPNLEKPEGNPNGEAGLNPIDKKLKMRARRVLAKLAEKRKSAAEFARSERSLDGIDMTC

SEQ ID NO: 139752 - protein, 85 aa, Triticum aestivum
  unsure (1)..(85): unsure at all Xaa locations
  Clone ID: PAT_TA_34170.pep
SPGVLXHFGCMPHCPVGNTLQEAQGVLLXLEGWGEDRXPHWTMGMPTRWLQLHSSGELPRGKFGALTNTSDGYLLTATFICQAAL

SEQ ID NO: 139753 - protein, 81 aa, Triticum aestivum
  Clone ID: PAT_TA_34171.pep
RRSSRGQGQSSFNVPADTVSEDTIRSATPGSVRQQRVVHPPPAEDYEPEVRATKEQIQLYDIVKRFCNARASSKHMKELKA

SEQ ID NO: 139754 - protein, 357 aa, Triticum aestivum
  Clone ID: PAT_TA_34172.pep
KVGKFRSGKNAARPPRPKGPKKPRVAAPPVDAEINDTIPLVGSEAEFRRGKYLYYMRGGDHCKSMNQFIWSFLRRLGEAKFLNRTFVMDLNMCLSGAHTEDGKDVDGKDFRYYFDFEHLKESVSLVEEGDFLKDWRRWDKKKGPGRISVRKVPTYKVTPMQLKRDKSNIIWRQFDGHEPENYWYRVCEGRAAKVIQRPWYAIWKSKRLMNIVTEIAGRMDWDYDGLHVVRGWKAMNKKMYPNLDADTSPDAIVDKVTKLIKPWRNLYIATNEPFYNYFDKLRSHYHVHLLDDYKELWSNTSEWYNETTAINNGKDLPFDAYMKVIVDTEVFYRSKAKVETFNNLTRDCKDGINTCNL

SEQ ID NO: 139755 - protein, 75 aa, Triticum aestivum
  Clone ID: PAT_TA_34173.pep
FNLHSFFNAGLQLCSSWEVANWEVEYVPVGYLYVSINCNFLILLLTIVSISLQICTITSVFDQQICCYARYWNDT

SEQ ID NO: 139756 - protein, 81 aa, Triticum aestivum
  Clone ID: PAT_TA_34174.pep
NRRPFILNPKAKSLRIRLIFTDLTTDRSQIPQYYTPNNHGAPQKGEEGEESPDLEAVGKEDSTSLGSIGDEISWGFVGSVA

SEQ ID NO: 139757 - protein, 484 aa, Triticum aestivum
  Clone ID: PAT_TA_34175.pep
HASGTEETNSGLSTQTPALPISRESNLSMGDKQGVGVYTIHGQTKMVLAAELASANDEHKLHEVHDKTADGNILQHSAANDTLQDKTDSIAGLDLASRHRIGDLEMEKGDSNTVMLPDCQTPFDASVKDIKDTLAPTEADVSDLQSEAAAIDVTSPKQDTMVVEALHTNSGGSASHLPAALQSTDSNQHAERKGSSENSGSKFFASGKKTEEMEGTLDKNTDHNLIQANADIALGRHSPSEDKREDSCAHVVDGGLLGSKQTLPEVVSAVNTDGSEEALNASSTHSNKDATLVCEVTKDPESHVSVSVLASAAMNAGDDCEEVHNVPSTHSDRGGSMVEVDASRDDATSICEVRKDPESNVSGELSMPVGLAELELELPNQSKSSSQSSAVKADETKASINIQTTSLVESGEQKSPRNGAHEEMELAGPKIECTIQMLSPDDKSSEAHSLAQREMVSGAEQASMKDDRENKMVDVIFLIGGLQK

SEQ ID NO: 139758 - protein, 95 aa, Triticum aestivum
  Clone ID: PAT_TA_34176.pep
PLKAQLPSHRSFDSRTEMTSTSRPFEPTDAMRSSVDRVSRRLLCSPLTRMLARKDRISDLGHLACLQLEMDSAVVARNETAFCLMDLLEEMVETR

SEQ ID NO: 139759 - protein, 82 aa, Triticum aestivum
  Clone ID: PAT_TA_34177.pep
LRLDMPCRALREPLHGLVLAFAVPCMACAGCRPRRGAVRYEPRRAPRGPRRLPAPPRPDLCWLRPPMAVTAAPCWCVWALRD

SEQ ID NO: 139760 - protein, 270 aa, Triticum aestivum
  unsure (1)..(270): unsure at all Xaa locations
  Clone ID: PAT_TA_34178.pep
MDGCGGDGRRPRAVFMAFGTHGDVFPIAALAAAFAKDQQQYTVVFITHSAHQSLSTHLAASNVRYMPVASPPALAAEQLDNISYDSVQSNAGPESFSRRKEIIQTEHRKACLASVEEVFGNDPSIHSDFTVINFFALEGWHLAELFQVKCIIAAPYFLPYSAPSSFERQFKQSFPLLYKYFQEAPPNTVQFHPGAPHGXWTDITHWMWALFMESWGLWRNDCLNLSPIPYTDPVSNLLFWHVRDPATYLPLWHVRAESPLLLYGLQYATV

SEQ ID NO: 139761 - protein, 383 aa, Triticum aestivum
  unsure (1)..(383): unsure at all Xaa locations
  Clone ID: PAT_TA_34179.pep
MTTIVTGYNLALMSGAELIVSDDVCLTHKQVTLLRRDEWHAXLRDVDVMDTVLXPYDARHLERAIVMPNLKPPDTTTGRASRYRDDIPAMPTGRSFVPPSARPXLMALYLTDRTSPEEIKIARKSGVVFAVKLYPAGATTNSQDGVTDILGKCLPVLEEMVKQEMPLLVHGEVTDPHVDTFDREKVFIEKILAPLVQKLPQLKIVMEHITTMDAVNFVESCKEGHVAATVTPQHLLLNRNALFQGGLQPHNYCLPVLKRETHRQAIVSAVTSGSRQYFLGTDSAPHDKRLKECSCGCAGIYSAPVALSLYAKVFEEAGALDKLEAFTSFNGPDFYGLPRNTSKTVLRRSPWKVPATYAYGSGVIVPMSTGNTLEWLPPDQPEE

SEQ ID NO: 139762 - protein, 211 aa, Triticum aestivum
  Clone ID: PAT_TA_34180.pep
QRPISCERAKRTVSSTTQTTIEIDSLFEGGSDTITRARFEEMNTYLFRRIMDSVEKYLRDTMMDNSTPHNVALVGGSIRIPGVQRFSRTSSKVSLKNRQIYCSHTTAWWTTSSTAITQHLHRFWCLPGLRRGIHQANGTTRNHQTHYRIQGFQWEGIRQASGTTRNHLTHHRPGRYRRDASMTCDYSDSLEGRRGELPLLVMNARFDSSAY

SEQ ID NO: 139763 - protein, 248 aa, Triticum aestivum
  Clone ID: PAT_TA_34181.pep
EHLLDMLVHYNQTSDILYYEVLDIPLPELQFLKTLKVAFHHATKEEVVIHSIRLPKNSTIADVIIDLKTKVDLSSPTAELRVLEVFYHKIYKIFPLHEKIENINDQYWTLRAEEVPEEEKNPSQHDRLIHVYHFTKDPLQNQQIQNFGDPFFLAILEGETLAEVKGRIQRKLQVPDEEFSKWKFAFISMNRPDYLQDSDVVSARFQRRDVYGAWEQYLGLEHTDTAPKRAYTANQNRHTHEKPVRIYN

SEQ ID NO: 139764 - protein, 203 aa, Triticum aestivum
  unsure (1)..(203): unsure at all Xaa locations
  Clone ID: PAT_TA_34182.pep
NSARETLRSLFVSGSHNKNIGLCNVIWPEKKKKGETETKQKETEREEAYRGLQTAGLDFEVFWDLQDFLNVCKLTSNDIHAMLRTYGVEAAXRATIINEVKAVFEPFGIKVDPRHLSLAADYMTSGGSYRPMNSLGMARFCTSPFGKMSFEQATRFITEAAYHGEVDNLTGPSATVSLGKPAKTGTGAFGLMQNITLEERAVM

SEQ ID NO: 139765 - protein, 136 aa, Triticum aestivum
  Clone ID: PAT_TA_34183.pep
MAQPPAKKTLSVYLYIPNIIGYFRIIINFIAFAVCYTNRTLFAILYFFSFFCDGLDGWFARRFNQASTFGAVLDMVTDRVSTACLLALLSQFYRPGLVFILLLGLDITSHWFQMYLGRDHAKTSHKDVKHTGNGLF

SEQ ID NO: 139766 - protein, 233 aa, Triticum aestivum
  Clone ID: PAT_TA_34184.pep
RDRDRPLKVEEGELGNLKAENMKHAFTKFIAKFTDKGGLPHAEAVEKLVQFMQVDRTERKIDLGGRVALAHIISATESPVCLGRFVQLRGLPILNEWLQETHKGKSGEGGSPKETDKRVEEFLMALLRALSRLPINLNALQSCSIGKSVNHLRSHKSAEIQKRAKCLVENWKKRVDAEMKSNEAKPLVSGQAVSWSGKGGAAEVSNGGNRRSASSEASPNPVSRTAKPGASDA

SEQ ID NO: 139767 - protein, 109 aa, Triticum aestivum
  Clone ID: PAT_TA_34185.pep
ALAAAASRGQDEINKMKEDPIAGWNFFSFDPMPAMDRLMNISGSSGFSAYKIADFGWGKPTRTEPIRMNTDGQVALMGSRDDRGVQVSVALLQAAQMDEFKSNFLALLE

SEQ ID NO: 139768 - protein, 287 aa, Triticum aestivum
  unsure (1)..(287): unsure at all Xaa locations
  Clone ID: PAT_TA_34186.pep
DARRPGNSTRPLRYQASRCAPAPPAHLIPAHKKPLPFREFRGHEKTLKLYSHRCAISPIGARRHGLRLLPLPGLPHPSTAPSRPHSLLPRCPARPIPASTGGPPSQWGAPTIRSDSRGVSLLIPVVLLPFRVVEGFDYPSLXRSCPVFKGCSTSGYDTGSVVYSNGDVLLXHCVVDAILGALGLPDIGQIFPDTDPRWKGADSCVFMREAVKLMHQAGYELGNLDATLILQKPKISPFKETIRSNLCELLGADPSVVNIKAKTHEKVDSLGENRSIAAHTVVLLMRK

SEQ ID NO: 139769 - protein, 289 aa, Triticum aestivum
  unsure (1)..(289): unsure at all Xaa locations
  Clone ID: PAT_TA_34187.pep
TKSQLLKELETLVSCGMFERVDLEGKAKPDGTLGLTVSFTESVWSAAKQFKCINVGLMAQSGQADFDQDMTEREKMDYLRKQERDYQQRVRGAMPCILPESVRGEVLAMMKKQEKVSARMLQKIRDHVQKWYHNEGFVCAQVVNFGNLNTSEVVCEVVEGDITKVEYQFQDKLGNFVEGNTQIPIIDRELPQQLRPGHIFNIGAGKQALKNINSLALFSNIEVNPRPDETKEGGIVVEIKLKELEPKSAEVSTEWSIVPGXVKGRPTLGIHSNLGGTGVHFEHRNIYGP

SEQ ID NO: 139770 - protein, 154 aa, Triticum aestivum
  Clone ID: PAT_TA_34188.pep
MEEPMSRLDHDLMAEILSRVPYKSLCICKCVCPAWRDLIADPANRKKIVQSLAGFFYHIPADSAESRGLAVNYADLSAFPWSSVPSTYPRLPLPPDSADCFLTVKDSCDGLFLTRIGRGTPEPQFGYMVSNPATSEYTLLPHSGYAGECCGSYL

SEQ ID NO: 139771 - protein, 69 aa, Triticum aestivum
  Clone ID: PAT_TA_34189.pep
SFCFQDRKLMSCPVYIHGLLHDEHLLKDVVLYVRLLLWILLGVYVFLFAIIVCRQSAALVCKNLRSLTA

SEQ ID NO: 139772 - protein, 131 aa, Triticum aestivum
  Clone ID: PAT_TA_34190.pep
DAEPVHHLHRLHPSLPQARPARAFHALSRRSPTPLLRWPVSCWMCRRSPAPLAPLSSPTSLWPVWLQDGELLAGALYIHGLLHADHLLKDVVLYVRLLLWILLGVYVFLFAIIVCRQSAALVCKNLRSLTA

SEQ ID NO: 139773 - protein, 198 aa, Triticum aestivum
  unsure (1)..(198): unsure at all Xaa locations
  Clone ID: PAT_TA_34191.pep
NGQKERRQIFITDGQQRAVVTLWGQHARSFDAVGLRNSSVKGPIIILFVGVTVGHYLGLLAFMSSSNTXWYVNASVPETDVVRESTKNISHLIEMAGPKKEQVSAIDDTVANVASRDPEEILKERYRFTIQITELVSTEDWWYQSCKDCWKKIKSDGDVYKCSRCSNTKPIPRCNMPICLFNLFLIFLFVKYLDFLHN

SEQ ID NO: 139774 - protein, 96 aa, Triticum aestivum
  Clone ID: PAT_TA_34192.pep
MATSKEDIKHGTAQARLTVDDELRTGYFNGTPLEGGKIADSDPVDLFAQARHVADASQQQPRRDLGEEEGRKAGSEEPRAQARQGMGAGGRQLGRQ

SEQ ID NO: 139775 - protein, 86 aa, Triticum aestivum
  Clone ID: PAT_TA_34193.pep
GSTGQTVPGEAQRSSNERSWLGQLREMAKASFSRDGEDPSSSTAVKGKRSGSSSVASQSADSKAKGEWRPKSKALYKDLEAIFSNR

SEQ ID NO: 139776 - protein, 106 aa, Triticum aestivum
  Clone ID: PAT_TA_34194.pep
CAEAAVVGVEHEVKGQGIYAFVTLVDGVPYSEELRKSLIAKVRTQIGAFAAPDRIHWAPGLPKTRSGKIMRRILRKIAAKQLDELGDISTLADPGVVDQLIALKDC

SEQ ID NO: 139777 - protein, 367 aa, Triticum aestivum
  unsure (1)..(367): unsure at all Xaa locations
  Clone ID: PAT_TA_34195.pep
MVYTATTFKYAFDYKPTDIYWCTADCGWITGHSYVTYGPLLNGAAVLVFEGTPNYPDAGRCWDIVDKYKVSIFYTAPTLVRSLMRDGDEYVTRYSRKSLRVLGSVGEPINPSAWRWFYNVVGDSKCPISDTWWQTETGGFMMTPLPGAWPQKPGSATFPFFGVQPVIVDEKGQEIEGECSGYLCIKKSWPGAFRTLYGDHDRYETTYFKPFAGYYFTGDGCSRDNXGYHWLTGXRVDDVINVSGHRIGTAEVESALVSHPQCAEAAVVGVEHEVKGQGIYAFVTLVDGVPYSEELRKSLISKVRTQIGAFAAPDRIHWAPGLPKTRSGKIMRRILRKIAAKQLDELGDISTLADPGVVDQLIALKDC

SEQ ID NO: 139778 - protein, 278 aa, Triticum aestivum
  unsure (1)..(278): unsure at all Xaa locations
  Clone ID: PAT_TA_34196.pep
ADRTYTIEAMMGDKXALQAGTSHNLGQNFSRAFETQFMDENGQLEHVWQTSWAISTRFVGGIIMTHGDDAGLMLPPRIAPIQVVIVPIWKKGDEKGVVMEAVASVQXNTLKEAGIRVKVDDSELRTPGWKFNFYEMKGVPIRIELGPRDVKNRSVVLSRRDVPGKQGKEFGISMEPSILVDHIKGRLEEIQASLLQKAITFRDSNIVDVNSYGELKEVISEGKWARGPWSASDADELKVKEETSATIRCFPFDQPEGAKKCFMTGNPADEVAIFAKSY

SEQ ID NO: 139779 - protein, 82 aa, Triticum aestivum
  Clone ID: PAT_TA_34197.pep
CDGLSTRGRDEVIADPPEHASGNASGQAGVQAEWPVNKNRVDLRVVDDRLQGRLNVWFLEMIRWCHVFDLRFVPPIVPMNAP

SEQ ID NO: 139780 - protein, 67 aa, Triticum aestivum
  Clone ID: PAT_TA_34198.pep
LRSKKKKKKKKKKKKKKKKKKKKKKKKKKKKKKKKKKKKKKKKKKKKKKKRGGPLKEQNFNRGDCEG

SEQ ID NO: 139781 - protein, 295 aa, Triticum aestivum
  Clone ID: PAT_TA_34199.pep
MRFTFGPIPSYARPHWTIQIFGIRVANLEDGLQRPLHVHGFVAARDTSDHNRNFLFNRTSDNCQVLTQQDPYLLLTGPSRAIVIIDPITIEFQLKVKSKTDPEEVEMLAFGIFNYPQTYLATHVIRSGILCDRCTIQLAYAPLDPSVEATVIHVRIIDGVWPEGLRGRVVAEVTTVREGEVLLLDSRDGKMPISPSTGAVELSRHVVSVDLEGGKLVVSVVASPQTAGKEDGDDGGGAAVVVARGEAVFTPERAGTSNGTCDLGFCKVEVAVAWSLVSSLWNEWRALAKLAKERA

SEQ ID NO: 139782 - protein, 226 aa, Triticum aestivum
  Clone ID: PAT_TA_34200.pep
GRVGAATQLAAKGARVLVLEKYIIPGGSSGYYRRDGFTFDVGSSVMFGFSDKGNLNLITQALEAVGCKMEVIPDPSTVHFHLPGALSVLVHREYNDFIEELVSKFPHEKEGILKFYGICWKIFNSLNSLELKSLEEPLYLFGQFFKKPLECLTLAYYLPQNAGDIARKFIKDQQLLSFIDAECEIFIVSTVNALKTPMINASMVLCDRHFGGINYPVGGVGGIAVS

SEQ ID NO: 139783 - protein, 287 aa, Triticum aestivum
  unsure (1)..(287): unsure at all Xaa locations
  Clone ID: PAT_TA_34201.pep
MPRPRPRGRGKTRSGSQRMDSEEGTAPPAPEQAACDPSQEESAAPVDEERADTDAVAGEDQGASENEAERTREELERTVTELSIQNEYLKSQIAGAQQLANSAEVGIGSGREDEDDSELVRSLKEQVERLSKEVQEQKQTQKVAEAALEHVNMSYAEADGKVQELTAKLNQAQLKIEKELKERDEKYVELDTKFQRLHKRAKNRIQDIQKEKDDLEARFNEINQKAMETASLQLAAQQELXERARHQASEALRAMDAERQQLRTVNNKFRCNFDETRLALDAMTNAL

SEQ ID NO: 139784 - protein, 507 aa, Triticum aestivum
  Clone ID: PAT_TA_34202.pep
MEVEASAHGDTAASKFTLPVDSEHKAKSFRLFSFANPHMRPFHLSWISFFTCFVSTFAAAPLVPIIRDNLNLAKADIGNAGVASVSGSIFSRLAMGAICDLLGPRYGCAFLVMLSAPTVFCMAAIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDIVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVALVHFPQWGSMFFPASADATEEEYYASEWSEEEKGKGLHITGQKFAENSRSERGRRNVILATSATPPNNTPQHV

SEQ ID NO: 139785 - protein, 180 aa, Triticum aestivum
  unsure (1)..(180): unsure at all Xaa locations
  Clone ID: PAT_TA_34203.pep
MGDSALSSSLIGDYPRKAGCVGRAVGWKRVFVQTDTGFVLPVQLDRGDSVHTVKRKLQVALNVPTEESSLTLGDHVLKNDLSSIRNDSPLLLTKTFMHRSSSSPCLSPTSKDLPAHKGLGAXPIGNLXFSNPVDLGQTXLLRXFLWXXKXGXXPKIXXXGLGGXXFFXNXXGXXXXFLPK

SEQ ID NO: 139786 - protein, 84 aa, Triticum aestivum
  Clone ID: PAT_TA_34204.pep
LASPPPRTARGVCTRVAKRDWRDQRGTDDDDDSIWLIMDGFGEMDGRGSGSVGPLTLSVRCALCVCVCAALCRFLVCSWLLSRG

SEQ ID NO: 139787 - protein, 192 aa, Triticum aestivum
  unsure (1)..(192): unsure at all Xaa locations
  Clone ID: PAT_TA_34205.pep
MDVPRRSGHLLFGSTVFGAKVVGSASFLVRCSTHHARQDPPRSPPAVSHAETSFLAPCSPHHARQDPPRSPPPGSHAETNSVSSFFLSXPPPGPSPASPPHRPAPRPPPTTAPPPVPRPAPLPPPTXPPAPRPPLPAPAAPPPRPGPWRRPPSPAPPPSPAPPPPTPLPPPPPPPHLLPLPPRHRRPDSDGQ

SEQ ID NO: 139788 - protein, 98 aa, Triticum aestivum
  unsure (1)..(98): unsure at all Xaa locations
  Clone ID: PAT_TA_34206.pep
GLQVSQILNILSCHPIIDASRGLEWGKRYLIIKGICEGLYYLKQESIINLDLKXSXNISVDNNMLPKIADFGLPRCYDENQNWINVSRLSLSKLINGF

SEQ ID NO: 139789 - protein, 346 aa, Triticum aestivum
  unsure (1)..(346): unsure at all Xaa locations
  Clone ID: PAT_TA_34207.pep
MVLPIRPVEDGSISSWVEREGERTEYSRPQLLEDIWCHIHSLLPMRDAARAACVSRAFLSLWRCHPNLTFSMEALGMNMNPCGEDEIGNFTKKVDHILKNRSRIGVKTLRIVFRYSNAMVSNVDRWLQTAVTPEIEELTVQLTPGIEELTVQLTPGIEELTVQLSSASGTYYNFPWSLLANGNGNSMQHLRLSHCVFSPSVELGLKKMTRIDLCYVCITEEQLGCLLHNCFVLQWMRLSQCSPLTCLKIPFHLQQLRYLKVFECRSLQVIGIEAPNLVSFNFHDSHQVQISFGVALQLKKLGMSHPGAVCYARADLPLSLPNVEDLSLXSXXEMXDTXXLARGCLP

SEQ ID NO: 139790 - protein, 141 aa, Triticum aestivum
  Clone ID: PAT_TA_34208.pep
RSDEQKQNGSFYTVRPPLPPPLAFSRREWLARNTAMLLCCSVITGWDGDLAFLFIVLSVATFFVQDHPDREVLQAMRLGMYCNADHMAKMVIAITEFRALCSSLNPDAETKRRVPWDHEVYKAKEELYHLLSGKILFFAGE

SEQ ID NO: 139791 - protein, 327 aa, Triticum aestivum
  Clone ID: PAT_TA_34209.pep
MPVQASKNSALVRTYDYGKLQAACDGLLIVSHGSMTDEFICNPVTRKSARLAKPLAQQGYYHQIIGFYRHQPSGGEFRVLWISSPAIYNAYNTNYRTFYYVIAVGSDNTRYMRQGCIPQPISSSPSLELALRRGLPDSSQYPPVHHRGGLHWKLGKYHGCDADYIMVFNTSAETFRLMCRPARLGNCLHESLLEMDDTLALCSISSDKHTIDFWVLQDYDAETWSFKHRINLIGVDPSALVDPEVIIAPSMAVLSGGEMLIRFTHRGVLHFDVDGKFLGYVKSQDGQEINLWVTGHYLQESIIPGPLFHEMREDDGANQEPPFFVGL

SEQ ID NO: 139792 - protein, 121 aa, Triticum aestivum
  Clone ID: PAT_TA_34210.pep
QRSSHPSPMPSPHQQCTRQSSSTSISPTPANVQRPAIPPLVYPLKNLGQPETRLRSPTRNPSHGGWACERAVEDGSGDSGRRGGRRGPWGARGHAGRRWRSPEKRPTWVVAAASEKGGESS

SEQ ID NO: 139793 - protein, 358 aa, Triticum aestivum
  unsure (1)..(358): unsure at all Xaa locations
  Clone ID: PAT_TA_34211.pep
MMMLVNCSGCRTPLQLPHGAPCIRCSICGAVTNVAAPPAPGPVVDPARGAQATAPAWGPPPPAAHGRKRAVICGISYRFSRHELKGCINDAKCMRHLLTTRFRFPDDSIIMLTEEQXDPYKIPTKHNIRMAMYWLLQGCQPGDSLVFHYSGHGAQQRSYSGDEVDGMDETLCPLDFETQGMIVDDDINAALVTPLPHGAKLHALIXDACHSGTALDLPFLCRMSRTGQYVWEDRRPRSGVWEGTSXGGEAISFSGCDDNQTSADTSALSKITSTGAMTFCFIQAIEQGQATTYGSILNSMRLTIRNTGSGASMAGGGAVTSLISMLLTGGSASTGGLRQEPQLTACGTFDVYAKPFSL

SEQ ID NO: 139794 - protein, 139 aa, Triticum aestivum
  Clone ID: PAT_TA_34212.pep
LPQPPQTLGPPLLPCSPPRRLLLPFTIPSSGRNRETTAALDLIRPAPLPLHCASASAAPCSAGARRPRSGLGRRSSPSRQEEGRSRIQEHGLLLALQQPALSCSRRRSSRRGAPIHKGSHRRGLLTPEPRSPWCWRPAT

SEQ ID NO: 139795 - protein, 245 aa, Triticum aestivum
  Clone ID: PAT_TA_34213.pep
RILRIEMSPLQKQYYKWILERNFQNLNKGVRGNQVSLLNVVVELKKCCNHPFLFESADHGYGGDSIGDRNKVERIVMSSGKLVLLDKLLLRLRETNHRVLIFSQMVRMLDILSEYLSLRGFQFQRLDGSTRADLRHQAMEHFNAPGSDDFCFLLSTRAGGLGINLATADTVIIFDSDWNPQNDLQAMSRAHRIGQQDTVNIYRFVTCKSVEEDILERAKKKMVLDHLVIQKLNAEGRLEKKEPKR

SEQ ID NO: 139796 - protein, 272 aa, Triticum aestivum
  Clone ID: PAT_TA_34214.pep
SGYGQSSGKPSEQNTYADIEAAYRCLIETYGASEENIILYGQSVGSGPTLDLASRLPHLRAVVLHSPISSGLRVMYPVKHTYWFDIYKNIDKVALVKCPVLVIHGTADDVVDCSHGRALWELSKVKYEPLWVKGGNHCNLELYPEYIKHLKKFITAIEKSPPLKDDSPESSGPSDLETGSESMESSRKSTDVRDKSRSSTDHRRSTDRREKPRSSIDRKDKGRKSVDHPDKPRASVDQSDKPRKSIDRFGGMMRSVKLCNIDCFKVTSTSGS

SEQ ID NO: 139797 - protein, 106 aa, Triticum aestivum
  Clone ID: PAT_TA_34215.pep
QSHRSPYRMPTWEGGSTNRSSVKLLFFPRRLQIKRLGQRCVTYVISPAQVLPISTDLATPPFSLSSRWAGLLPSLVQRRRSGDCFSPSEDKLSKHKTLFSLLKTTY

SEQ ID NO: 139798 - protein, 75 aa, Triticum aestivum
  Clone ID: PAT_TA_34216.pep
RLQLQLQVFDVTATLWCFMRERIVACLLLRRQLQVSPQAVAPWCFVRRGSCMCATRHAYASVPLTATLCCFCWGG

SEQ ID NO: 139799 - protein, 133 aa, Triticum aestivum
  Clone ID: PAT_TA_34217.pep
GWQRRNAAAGDQRRSSRVSEAATVLSRGWKKKQQAAHRSGEAAAGVEKEKQEQGKESGGAAGTSEKQGMRGHGRAGHQTTCLVVLLPSFFPLEVSQMDGMVLVVSFLDGRLWRSIRMAFVVEEFCALSHFSAK

SEQ ID NO: 139800 - protein, 317 aa, Triticum aestivum
  unsure (1)..(317): unsure at all Xaa locations
  Clone ID: PAT_TA_34218.pep
GEMGELELQYRTLQAGQQTGPTALKQHRHGAFTXAAAVSSAEPLRQRILEPAFLLQKAFPPPRKLPTDASLSRSCRHGRRTAEAYVDAFAPPTHTLGCVLLLQKALLEQNQAAKGANDTLPDSNGESDEWLQVQKLHTRITPFRNTEIDKWQRKTQVTTGAAALKGKLHAFNQNISDQVAGYMRDPSRMINRMYLRKSDVGVFGESAAEPATSVEGKDVEGDPELIDDSEFYHQLLKEFLESCDTGASESAFYALRKKQHKKRKLVDRRASKSRKIRYSVHEKIANFMAPVPMTVPPMASKLFENLFGMGNQKAPAV

SEQ ID NO: 139801 - protein, 348 aa, Triticum aestivum
  unsure (1)..(348): unsure at all Xaa locations
  Clone ID: PAT_TA_34219.pep
MGARVSKATSCCCLRGQLHGSTRLDDPGSEEDEQGEAYELPAFQEYTFEQLRLATAGFAVENIVSEHGEKAPNVVYKGKLDAQRRIAVKRFNRSAWPDPRQFLEEAKSVGQLRSKRLANLLGCCCEGDERLLVAEYMPNDTLAKHLFHWETQAMKWPMRLRVVLYLAEALEYCTSKGRALYHDLNAYRVLFDDDCNPRLSCFGLMKNSRDGKSYSTNLAFTPPEYMRTGRITPESVIYSFGTLLLDVLSGKHIPPSHALDLIRDRNFSMLTDSCLEGQFXNEEGTELVRLASARLPCEPRGRPHAWPTGQAWAPLQRGVATPAFVLMALPQAGASSVQSLPLSPLADA

SEQ ID NO: 139802 - protein, 416 aa, Triticum aestivum
  unsure (1)..(416): unsure at all Xaa locations
  Clone ID: PAT_TA_34220.pep
MHLPNNYVSNENSMSFPQQLAPSQQLGYSHHEERSSAGRPPHSLVAFGFGGKLVVMKETSSMTTNFDSGNQSNSRGTLSILNISEVVADKIDQQGIPNGSALSYFYALCRRPIPGPLAGGSAAAKDLNKWLDDIIGGYESSVSDFQEGXVQKLLISLLKISYQHYGKLRSPFGPDPSREGMDGPDTAVTALFSSCSSNSARMRDHCMKNIPSENQIQATAQEVQNLLVSGKRKDALQYAQEGQLWGPALILALQLGDEFYADTVKKMAYCHFKSGSPLRTLCLLIAGQPADVFKPENPVDANYATLHRQQQPAEGTPVGMLNDWQQNLAIITANRTKADELVITHLGDCLWKERNEVAAAHSCYLVAELNIDPYSESARMCLLGADHLRCPRTFTSPEAIQRTELYEYAKALGNSQ

SEQ ID NO: 139803 - protein, 112 aa, Triticum aestivum
  Clone ID: PAT_TA_34221.pep
DAKIPVSLVRLKPGTKELQKNHFQGVRTSMDFVHSRGGLGFSFVHHQKFTSNIIGNILDCHLHWGSKGLDEVFLKTKYTMGVEDVCGHGKPEKWLFSCENSLSLASSEMVVS

SEQ ID NO: 139804 - protein, 502 aa, Triticum aestivum
  unsure (1)..(502): unsure at all Xaa locations
  Clone ID: PAT_TA_34222.pep
MDLPLLKDINKQSFRWKVMARIARVWELKRKDTGTTYEVDFLLLDRQGGTMEGLIPEKRMAQFTKHITEGTIYTIEDFNLYDAKSKFRSSDHPLRVCFTFRTKLKKVEPQPVNFPIFAHNARPFSVLEARAEHNFILTNVIGVIVQVTELLPGSSANPDERCQIYITDGNQWAVVTLWGTHATTFTPVALVESSATQXSLXLFVGVTVSHYSGLLAFKSTSVTKLYVNIPIPEMETVRHNVTGIPSQIEMGLVTIEQEKSXDARIAEIAELEPNHIMDERYRFSILVTEVILSSDWWYKSCKDCRKKVQMEGDTYKCSRCITTVPMPRYKISLNAIDADAKRHEDSPFARFIFWGQQGEILTGKQVLILVAEANSRAEYTPPELTGLVGKKFTVIATATRDSLYGEHMFYQVESTEPLFEPANPENAQPPIEETQGENESQDNTLEATPPPSPSAAKEEENDSTGKRRKRNDHLSNKNKGGTKKDLFGQQPAHAGTEYTDQN

SEQ ID NO: 139805 - protein, 68 aa, Triticum aestivum
  Clone ID: PAT_TA_34223.pep
FLVHLQSKANFNLCTNLGGALTYHILLKRRCFSFFLSFVEALIYMLSSITKNGEIESATSPVGGFGNS

SEQ ID NO: 139806 - protein, 170 aa, Triticum aestivum
  unsure (1)..(170): unsure at all Xaa locations
  Clone ID: PAT_TA_34224.pep
MRGPLGRDASGAGAGGGKGGDDAAAGIIRHDRKCRDLPFLALFAAFWVAMIVNSSFGFNQGSPLRLTYGLDYKGNICGSKHGDPDLSELDVRYWVNPNQVYQSGLKNSTNDLADAKAICPEWNGPYPGGRPGLNFVXCDYPEGDIRLSVDDWIDRDYDYFEYLTPDMRNS

SEQ ID NO: 139807 - protein, 167 aa, Triticum aestivum
  unsure (1)..(167): unsure at all Xaa locations
  Clone ID: PAT_TA_34225.pep
SGWYGTYPWKVMQVLMFLNLLQFIQVKRMMRGFFERFHDHCSAMSADNDKIAEYLSPLGLQHVQNGNIKKISKQYMGNEXTHITQLCGVGKYAADAYAIFCAGRAREVVPDDHKLVKYGNYVCFELLMSQIVDIGSSLDDIIARRGCPRPSSRSPPLSHPLPDNIRG

SEQ ID NO: 139808 - protein, 223 aa, Triticum aestivum
  Clone ID: PAT_TA_34226.pep
PSGKSPLPLDPGQSRCVQSQGAKAPPEQEGENDGCKGIKKSNGRKTRVRVLSKHELIQEARKQPQPLPEGFVPFSDFVASCTEQNPDHSSPYSAFFDQFRYNPVCKDRKSPLPRTPDRLARLPPRGHSSFGSSQLAANEASRASRPDTILASKTKQQDSGSGSQEKVSVEVKENPENKTREKKQRKLSGKSLLPFDSSRTCCVQLQGTKALPEQDQETDAPKG

SEQ ID NO: 139809 - protein, 271 aa, Triticum aestivum
  Clone ID: PAT_TA_34227.pep
MPSAATRSSSMGAGDIEFALDLDDIAARAAKADCIGALACGRASFSYHRLPEPPLRLTVRKLDDSYFGVQVARSAAVWELKAAIQGVFIALYDDMENAVTWQHVWSHFCLCFKDEKMTDDRATLRAFGISSGDELHFAQHLSVDYSPCKSSKSQRATSHRRSRTSVEGFSVRPRSLMDDLIEEDEAEKKLAATRHSTSILDEDFCVYEHHEQHVEEDRKKGISVRGWFSYSRLRGNRRTHSENIEQPSCEKGSRPKLGKWLSSKMSKARSK

SEQ ID NO: 139810 - protein, 130 aa, Triticum aestivum
  Clone ID: PAT_TA_34228.pep
RPGWGSFPAPQYALQRENVFPERPDQPECIYYIKTGDCKFGAVCKFHHPRVRSQPPPDCILSPMGLRPGEELCKFYSRYGICKFGVNCKFDHPMAAPMGVYAYGYSASASPNAPMARRLLESPSGSAYAS

SEQ ID NO: 139811 - protein, 403 aa, Triticum aestivum
  unsure (1)..(403): unsure at all Xaa locations
  Clone ID: PAT_TA_34229.pep
MWQQMAKSSGATMQSGPYPVRPGEPDCTYYLRTGLCRFGMSCRXNHPQDRNTAIASARMKGEYPERVGQPECQYYLKTGTCKFGPTCKFHHPREKAGIAGMVQLNTLGYPLRXPNESKCAYYLKTGQCEYGNTCKFNHPEIFNAVASSRGSPIYPPVHNSGSTGPHSYTGTMASWTYPRGSFIPSPRWQSPSNYTPMIVPQGLVQVPSWNSYPGQMVPVSSPESRLQSPGAQQYYGTSRQGEASAGNQGMQSPYRSSSFPAPQYALQRENVFPERPDQPECIYYIKTGDCKFGAVCKFHHPRVRSQPPPDCILSPMGLPLRPGEELCKFYSRYGICKFGVNCKFDHPMAAPMGVYAYGYSASASPNAPMVGSPGVPRSLPQGRPGFHRRPGLRTPPKARRPGI

SEQ ID NO: 139812 - protein, 141 aa, Triticum aestivum
  Clone ID: PAT_TA_34230.pep
ERTRNFISRQRSRGAPRRRGGNPIYAGRPPHSDFKQESRTNPILPPIDTLPPRIASSDHLAANQDPHLPIRVYYDWYLVSSFERGWVRSALGGEHRMVPSLPVKPSRTWIDLPSPPAAAAAASTRLRTPRAHGPRPLTSKR

SEQ ID NO: 139813 - protein, 174 aa, Triticum aestivum
  Clone ID: PAT_TA_34231.pep
MAEKEAGNLEAVLKEVVDLENIPLEEVFDNLRCSRAGLTAEQAQQRLQIFGANKLEEKEESKVLKFLGFMWNPLSWVMEAAAIMAIALANGGNKPPDWQDFIGIITLLVINSTISFIEENNAGNAAAALMARLAPKAKILRDGRWTEEDAAILVPGDVISIKLGDIIPADARLL

SEQ ID NO: 139814 - protein, 182 aa, Triticum aestivum
  Clone ID: PAT_TA_34232.pep
MIKQILGRFPKKPSKSGDKDPIGRSGASVSNPPRGAERAASGHTPIISSSGLSYGSGQQHPGNGNNPRVNNGNSSAFEVLPGFKDVPNAEKNNLFVKKLNLCCVTFDFSDPTKSMKEKEVKRQTLLELVDYVASANQKFPEIVMQETTRMVSVNLFRTLTTPPRENNISAYDLDEDEPVMDP

SEQ ID NO: 139815 - protein, 156 aa, Triticum aestivum
  unsure (1)..(156): unsure at all Xaa locations
  Clone ID: PAT_TA_34233.pep
ESIGTLEGPCSSWRSLQAIRHCLITQEKDLQPGCIKAYARGNKSANKLGEPSVEEAALXLWRSKDNVDAMVDKMQDLEAVCTMCIIAAXRGGTDGEVVGRXPTKFKSVTYDAEDVLNDLDAADVCIKEEPIKGTPLVHSPGQRSGLPTSDSRGVTH

SEQ ID NO: 139816 - protein, 248 aa, Triticum aestivum
  unsure (1)..(248): unsure at all Xaa locations
  Clone ID: PAT_TA_34234.pep
WKFPAVVDQILGAAPQSVSRFEDFMTCIWFPGGIFSKPQHSWXVWWYEEQDHLRTTGLWGKILEILLDLRYFFFQYGVVHQLKIADGSRSIAVYLLSWICVAVIFGVFVLMSYTRDTYAAKQHLYYRVVQTAIIILGVLVLILFLKFTEFQIIDIFTGLLAFIPTGWGLISIAQVIRPFIESTVVWGSVISVARLYEILLGVIVMAPVALLSWLPGFQEMQTRVLFNEGFSRGLQISRILAGKKTNTV

SEQ ID NO: 139817 - protein, 162 aa, Triticum aestivum
  Clone ID: PAT_TA_34235.pep
ACTPPKSDAGDMESGAGKSGSMLQSKTDDTTGHLATNVSSFKVQPDICGKSPDGSRRCQDMPLLSYAEWESGASYLDFVRRQYKVSQAVKGVQKARHDSQKSDYLVLKYGLRWKRRACRKSSKSDFSKFALGSWVSDLILSSCSQSIRSEICTLISWLCPGY

SEQ ID NO: 139818 - protein, 275 aa, Triticum aestivum
  unsure (1)..(275): unsure at all Xaa locations
  Clone ID: PAT_TA_34236.pep
MSQGQQRRPSSDQAQAGGGGQGQGQGGGAVRYGDVFPAVTGGLAEKPVAPQDAATMQSAENLVFGETIKGGPAAAMQSAAMRNERMGLVGHDQATDATAEQGVSVSETRVPGGRIVTEFVAGQAVGQYLAPDDAADAGGAGGDDTKITIGEALEAAGYAAGGRPVERSDAAAIQAAEVRATGLXDVNIPGXLAAQAQSAAGANAWAARDDEKAKLGDVLSNATAKLVADKEVXEADDAARVASAEYPKQGMTRTVRPGGIAASVAAAARLNKQGA

SEQ ID NO: 139819 - protein, 118 aa, Triticum aestivum
  Clone ID: PAT_TA_34237.pep
PPSAPPPPRSADELLRPRCWYCCWCSAAGDGEGGRRGRRDSSSSPASRSAPMVIGRWRSGWIRGLGLSWAQLGGGDGWDYYNSLRISLSREGSESGPPSGNWLLPVCHVKSLPPTRRR

SEQ ID NO: 139820 - protein, 132 aa, Triticum aestivum
  Clone ID: PAT_TA_34238.pep
FSNTAHCDGDIHYNMYIQKFRHPHYNISYQSPILPVPGLTEGHHTNPVCKPVLPSTRGSSCPVCQTISYIQSHELMVCNLCYCTSSGMSLSRNEISRCVKFGVDAASFATWPGRSLISTSVSGTAIERVGER

SEQ ID NO: 139821 - protein, 128 aa, Triticum aestivum
  Clone ID: PAT_TA_34239.pep
SGRNSLEEAVKLCLASGMQGIVSEARAVFRFPTAIPKIKEADLSLLTYGTLNNVPEAVYMQHLMGVNGVIVDLVPEITGAVSDLIALPETDTEINDLSGKVVKDAASTPNFTQREISFLLRLMPELVQ

SEQ ID NO: 139822 - protein, 201 aa, Triticum aestivum
  Clone ID: PAT_TA_34240.pep
QDVCPIIFHDNFIITEEHGKISEKRVTDLQLEDFLQYGPQNKQGKNGKPLLRKMKDGRVLNWSVQSDDPLCTLQEAFEKVNPRLGFNVELKFDDNLVYQDEELTHILQAILKVVFECAKDRPIIFSSFQLDAAQLMRKLQSTYPVYFLTNGGTEVYADVRRNSLEEAVKLCLATGMQGIVSEARAVFKFPTAIPKIKEADL

SEQ ID NO: 139823 - protein, 159 aa, Triticum aestivum
  unsure (1)..(159): unsure at all Xaa locations
  Clone ID: PAT_TA_34241.pep
MALLKAARVADVPTLDVVVPDHLAAAARVLDAESAATMKRQQRGAGRRFAVIGHRGKGMNALASPDRRLQEVKENSVRSFNEAARFAVDYVEFDVQVTKDVCPIIFHDNFIITEEHGKISEKRVTDLQLEDFLQYGPQNKQGKNGXALLREIKEGRVSS

SEQ ID NO: 139824 - protein, 202 aa, Triticum aestivum
  unsure (1)..(202): unsure at all Xaa locations
  Clone ID: PAT_TA_34242.pep
MATARALRLFASGSPATRRGLPGAHGRALSALSSQASGAGDPAVHSGDHPSDDYAEGPPKFSGAEEAIEGKGQDKHPPSSATTRPTEGYAKEHRVPPFTPSGKLGSQELADPAAGSTFTQKRRWSSNSKPAGSDPLGDATPGDEEAAARKVREEDREYYRTHKPSALAEVEFADTRKPXTRATDGGAEDRLEQDGPGTMVED

SEQ ID NO: 139825 - protein, 250 aa, Triticum aestivum
  Clone ID: PAT_TA_34243.pep
MATARALRLFASSSPATRRSLLGAHGRALSASSQASGAGDPAVHSGDPPSDDYAEGPPKFSGAEEATSGGHDKHPSSAKATRPTEASAKERVPPFTPSGKLGSQELADPAAGSTFTQRRRWSSKPAGSDPLGDATPGDEEAAARKVREEDREYYRMHKPSPLAEVEFADTRKPVTRATDGGAEDRLEQDVPGTMVEDTADASLARAEAMFREAASRGNPAWPHSRALAAMLARQGGEGADGAGGAAPWGS

SEQ ID NO: 139826 - protein, 266 aa, Triticum aestivum
  Clone ID: PAT_TA_34244.pep
MASGIMFRRLSKTLTMSPATALASGMTSQHHQLQQRAPVSGTSKGKAKLKAGMPLRRSVIAKKGGAPATAGSGGAGRGRREAMERITQIAESCLKSSTPLRHLSPKERLREAKREELGLISKERQRELDAAKAKAKAKSKGASGGDGDRVLMGPPGLDYISLGLVDEETIPEYELTVEDGRRLAKEYSRVLMRRHRARQTAESTLLSLKKEAVAALPEKLRAAAMVPDMTPFPANRYMATLTPPIEGYIEKVRDAAKKYSVKEKLR

SEQ ID NO: 139827 - protein, 340 aa, Triticum aestivum
  unsure (1)..(340): unsure at all Xaa locations
  Clone ID: PAT_TA_34245.pep
MAKNAGGVLLPVSAEPGKGDGEAALFKGSAMTRRGAVAALSYMSCSVLLVMFNKAALSSYKFPCANVITLLQMVCSTCLLYVLRRLKIISFTNSEPSVPSDSLFFVPFRILLRTSPLSLSYLLYMLASMESVRGVNVPMYTTLRRTTVAFTMTMEYFLAKQKHTPPIIGSVALIVFGAFIAGARDLSFDARGYAIVFVANITTAVYLATINRIGKSSGLNSFGLMWCNGLVCGPAVLFLTYIQGDLKKXLNFLTFIPLVFRWVLLFSCILAFLLNYTIFWNTILNSALTQSMCGNLKDFFTVGLGWVLFGGLPFDLLNVIGQGLGFVGSGMYAYCKIKGK

SEQ ID NO: 139828 - protein, 106 aa, Triticum aestivum
  Clone ID: PAT_TA_34246.pep
LKHLFMALVMRYAVRVSGAQRARRRSSEIDRVGNFDLQVSAEGLYGTEEGRALRGSKLRQFSNLANHDCYSVLLFVLDDEGVKTRTWWAWTAAQIRQPTSTGPHLL

SEQ ID NO: 139829 - protein, 85 aa, Triticum aestivum
  Clone ID: PAT_TA_34247.pep
MHAYIHLRTAGQPLVLHLSRMHVCCVCQWNATAKLPSGKAVTGEDAAAAVEAEAADAPGKATKPYGVGAALTEAARRNQEGTCRK

SEQ ID NO: 139830 - protein, 77 aa, Triticum aestivum
  Clone ID: PAT_TA_34248.pep
MFMNLKNDFEFEQRKFTKEDIKEIIFREILEYLPQLLKDYMHGSENTYYVLCFYLDISCNFFASYFAYVAIVITYVG

SEQ ID NO: 139831 - protein, 289 aa, Triticum aestivum
  Clone ID: PAT_TA_34249.pep
MSPWRAVASRLSAPHLLSRAFSKPPPPLPQPLSRTFSKAAASAAATSHSPSAASSAGPRPEVRLNSMFLSKPSSLALPPDSPLRAEDPHYEGIKRLMLTLLLFYSKQSKSIRGANAVYHRITSHVDKPDIYEVFQLEKTFKTTFSLLVLHMWLVLRRLKEEGKDGVKFGQYIYETYNHDVELRVSKAGVNLLLTKWMKELEKIFYGNIVKYDTAISPEASQDDLVNVIWRNVYADEGSEPMDAAATPAVQALARYTRREATCLSLTDKEAVFSGNFKFTAVLPTVLPAQ

SEQ ID NO: 139832 - protein, 370 aa, Triticum aestivum
  unsure (1)..(370): unsure at all Xaa locations
  Clone ID: PAT_TA_34250.pep
SCVSHPNNLSPAGQGPTSQSNMVMQPTLVSDPFGTLPAIPRMSIGSRGSSPSSLDGISSLPVAEKPLLSRTFSMVVPRNLPXLGIKLLPRIYNATSDGKVPFFADDEESPVTPKADAFFIPIENPRSLIIRPADHWPSRSLVGQQSIPRDSTDNDKHKDAFVGREHNKAAMTPTRSGTVGNGIHIASSEPGAVARHVNGATVEKMVPRLSQADYFMEPSLEELAAKERAEPGYCSQVVDFIVGREGYGSIKFLGETDVRGLDLESIVEFNNREVIVYKDDSKKPPVGEGLNKAALVTLLNIKCMNKKTGEQYTQGPRLDKFKEMLVKKAEEQGVEFISFDGAKGEWKFRVKHFSSYGFGEAEADDLADSL

SEQ ID NO: 139833 - protein, 179 aa, Triticum aestivum
  Clone ID: PAT_TA_34251.pep
SIVCSTCTGRQRLEGEHDAGGVVSEGTMMLALKDRWRLDPCDAKAVPLLSSRGKPGACPPPEGDMNSSPAAMEPQVKVPHLPARSIEGGSPWVVFFLEENERKDDGLVLSLCGQTGGVDGQRRMAARPPLIILLLSAALLLLLRLVLILAVDGGRAGLEEGGSGPGWRGAARIRPARGC

SEQ ID NO: 139834 - protein, 98 aa, Triticum aestivum
  unsure (1)..(98): unsure at all Xaa locations
  Clone ID: PAT_TA_34252.pep
SVRLSGVARGCGWQKIGAWIQPGAYXKAGIPSAYLIAIVFQVGGTGLWLGIICGLMVQVLLLMAITICTDWDREADKAKDRVFSSSLPTDFATEDNAI

SEQ ID NO: 139835 - protein, 141 aa, Triticum aestivum
  Clone ID: PAT_TA_34253.pep
LIMGLVLICIRYVWGHAYSDVEEVVTYVAWMMLIISVSNFFDGIQCVLSGVARGCGWQKIGAWINLGAYYIVGIPSAYLIAFVLQVGGTGLWLGIICGLMVQVLLLMTITICTDWDREADKAKDRVFSSSLPTDFATEDHT

SEQ ID NO: 139836 - protein, 226 aa, Triticum aestivum
  Clone ID: PAT_TA_34254.pep
MELEAATRRFQLWLRGLRSLRRDLRTARWADDPAQLAKLVAGYVSHFADYCAARAELDPVWTLAAPWASPVERGAAHWLAGWRPTTLVHLLYTESGSRFEAQLPDLLLGVRSGNLGDLSPAQLAQIDELQRRTVAQEDELSREMARVQEGHGAVGAGGELVDVGGLVGRVGAVLAGADALRLRTMKRAVEILEPAQAAELLVAAADMEIRFREFGLKYDGVGAGGS

SEQ ID NO: 139837 - protein, 365 aa, Triticum aestivum
  Clone ID: PAT_TA_34255.pep
MPPATALMDDVVVEILLRLPPDEPGCLVRACLVSKPWRRLLTGNAFLRSYRKFHGAPPMLGFLHRLYDEDPCVARFVPTAKSFRPPRTDRRCWYALDARHGRALFYDSESEQKPAEFVVWDPVTDGHRRIPLPETPKSWNAAVLCAVDGCDHLDCHGDDPFLVAFVGTDKEEGIWITSACFYSSEASSWSSTSFVEHPDASIEMQPSALSGNAVYFLCDPSTRILQCDFVGERKLSVIDRPDVHENNIVLITAEDGTLGFAGVQESSIYLWSMEVDPDGAAAWVQHRVVDLGKLLPSRALMIMPDVSGFAQGAGVIFVRTIVGLFTIELKSGRVRKVSSRGRVCTAIPYTSFYTPDRAIRQLNGQ

SEQ ID NO: 139838 - protein, 233 aa, Triticum aestivum
  unsure (1)..(233): unsure at all Xaa locations
  Clone ID: PAT_TA_34256.pep
MPKKMGVNSKAEAARERRSAEESDRRQRAERAKEEEYWREAEGSKSRAARRREEEAEKRAEAAARKAENRRLAEAEAAAVASAVSKTDARKANRVGAPAPKVTEAELVRRREEERLRLEREAEAAKKRAARTAEEEEYERVVLVANTNRDDSVIEASGVDETIVRLSLVDTDAALPADRHPERSLAVSFSFKAFEELQSPRXEKPGLTLKQYKDMIWKLWKKSPDKPTHKATE

SEQ ID NO: 139839 - protein, 113 aa, Triticum aestivum
  Clone ID: PAT_TA_34257.pep
KIRFHTNGGASTRSSWRRRSSPVPSEMTSSGGDWIRWRCTSERDSGEGRDRKKEEWQGEGEGATSGGEVDWMLEEGGVDLAFLQLGKHHPWSFILLVFRCLRHRQATTGFGVS

SEQ ID NO: 139840 - protein, 388 aa, Triticum aestivum
  unsure (1)..(388): unsure at all Xaa locations
  Clone ID: PAT_TA_34258.pep
ASGHLXSGSLILMQAEMQFLSPLVPAREVVFFRYCVHNADEGTWSIVDFPADGFQEELLQQQQQTSSLVRCRRRPSGCIIQDAPNGYSRVVWVEHMEVVGEEKPLQPVFKDHVAGGAAFGATRWVSVLQRQCERLASELARSIADQGVIRTPEARTNMMKLSQRMITAFCANISASGSQSWTALSDSTDDTVRITTRKNTEPGQPSGVILTAVSTSWLPFSHQQVFELLADEQQRCQLEILSNGGSLHEVAHIANGSHPRNCISLLRINSASNSSQNVELLLQESSIHPDGGSLVVFATVDVDAIQVTMSGEDPSYIPLLPMGFAIFPATSPSPGATSSDTTSNGETSPGNADEPATGCLLNVGMQVLANAVPSAKLNLSSVTAINSH

SEQ ID NO: 139841 - protein, 430 aa, Triticum aestivum
  unsure (1)..(430): unsure at all Xaa locations
  Clone ID: PAT_TA_34259.pep
HEEESALLIFARLADYIAESLLDHLMTIHNLLASALAHPTSPDVRIAALSAAVNLVQCLPTNADRDKMQDWLPAMMRALTDCLNSSQEASAQEALELLVELAGAEPRFLRRQIADVAGAMLQIAEAAQLEDGTRHLAVEFVITLAEARERAPGMMRRLPQFVGRLFQVLMQMLLDVEDDPAWHTAETEDEDAGEGNNYGVAQECLDRLAIAIGGNAVVPIASELLPQYLSAPEWQKHHAALITLAQIAEGCAKVMLKNLEQVVSMILNGFQHPHPRVRWAAINAIGQLSTDLGPDLQVQYHQKVLPALPNAMDDFQNPRVQAHAASAILNFSENCTPEILTPYLDGIVSKLLVLLQNGKQMVQEGALTALASVADSSQDHFKKYYDAXMPYLKAILMNATXQSNRMLRAKSMGVYXSLVEMAVGKGKFKG

SEQ ID NO: 139842 - protein, 158 aa, Triticum aestivum
  Clone ID: PAT_TA_34260.pep
CSGWDRDALVRELEFVCKIFRLSEDPKGRNLFRKCANLIERLRNSSPDSVNPRMILHALRELEMDSPKSSENEESGRLITPQEACNRIAEVVQEAVRKMELVAEEKMGLYKKARTAVEACDRELDEKARQVQEFKAERLRKKHKVEELESIVRLKQAE

SEQ ID NO: 139843 - protein, 293 aa, Triticum aestivum
  Clone ID: PAT_TA_34261.pep
MAARLVVLLLLALVNVAPPRRHAGVSAEDVIRQVTDGGHGAGRPGLLPEAQFAAFVRRHGKEYSGPEEYARRLRVFAANVARAAAHQALDPGARHGVTPFSDLTREEFEARLTGLVGAGDVLRSVRAMPAAAPATEKEVAALPASFDWRDKGAVTDVKMQGVCGSCWAFSTTGAVEGANFVATGKLLNLSEQQLVDCDHTCDAVAKTECNSGCSGGLMTNAYKYLMGSGGLMEQAAYPYTGAQGPCRFDRSKVAVRVANFTAVPLDEDQMRAAIVRGGPLAVGLNAGFMQTYV

SEQ ID NO: 139844 - protein, 306 aa, Triticum aestivum
  Clone ID: PAT_TA_34262.pep
ELARALHALRPTTYRDANHKPEMAVAVTEFRALCGFVSVQELKDVLRTVPEVRMLVGKEDVVKLMTAKEHDGGIGVRSYLQSAFTKLMATSKEAVAEAISKLRSRLNGEIKIRTFTEKEQLVLSLEQQYPGDVGVLSAFFFNYVKLRPGEALYIGANEPHAYLSGECVECMATSDNVIRAGLTPKYKDVQTLCSMLTYKQMFPEILQGVLVQPYVIRYTPPFDEFEVDRYSLPQGESVTMLPVPGPSIFLVMTGEGEIQADGMPDEGVAKEGDVFFVPARTEVKLHASGPGCLQLYRAGVNSRFFC

SEQ ID NO: 139845 - protein, 286 aa, Triticum aestivum
  Clone ID: PAT_TA_34263.pep
MRSTAGGYCTQSGSSVVGKLGGGNGDSGDADVEDTFDEGGVGKGEMGLEMNSCANPFAESILSLQRTQEALENEIRNFVVIGKESTDDLDARDDEWSNSLHIEESVEEANEKRKDLESRVEQASILIKEKDSRILELEALSRTRAWRSAIQSANNQLLQPDLDQLLQEKMEAEIQCIILTRASQTWTPVAEDRKALYKEQKCLLGDYKQLELKLRSAENRAAILGEMVEKLEAQCKELSASAEILQLQSRTSSASLLCFIQFILLLIAIGIYVVRLSPSSAEFVPT

SEQ ID NO: 139846 - protein, 401 aa, Triticum aestivum
  unsure (1)..(401): unsure at all Xaa locations
  Clone ID: PAT_TA_34264.pep
MSEYQRGVSAWHFDIEDLKAQALLINDDDPPELKEDDDIARITEVDKGTSFESHFGQSTLLNGNNHSERTCTTAVNPGGNGPETSDVFTSDLGNADSPRMVDGHTKQGSENGSLSSTSKQGSEGGNHRSEVRQRQRTFSGPVMYSGTRSSSLIERGYIIDKDAGARSPNKQKSDTGRIDDLSGPLSLSTRASANSLSAPIRSSGGYVGSLGDKPRVEIKGRFSVTSENVDLAKVQEIPVVKISPKPQEVRTQVSTMKRSASVGAWPVKAKSMSNSHHRREFRDSSVSASILIPHLENLVQQTTFQQDIITNLMSNLQQNEKPNGPQTRVQTMVGDTGVETGSAERERKLLAKVFELQSRMIXLTDELIASKLKHVELQEELNRLYCQEETGETREDDSGDF

SEQ ID NO: 139847 - protein, 248 aa, Triticum aestivum
  unsure (1)..(248): unsure at all Xaa locations
  Clone ID: PAT_TA_34265.pep
KTTEGYRSIVFQEPRFVEYFRSATPETEYGRMNIGSRPSKRKPSGXIESLRAIPWIFAWTQTRFHLPVWLGFGAAFKHIIQKDIRNIHTLKEMYNEWPFFRVTLDLLEMVFAKGDPGIAALYDKLLVAEDLQSFGEQLRQNFEETKQLLLQVAGHKDVLEGDPYLKQRLRLRESYITTLNVCQAYTLKRIRDPSFEVTPQQPPLSKEFCDKEPAELVQLNRGSEYAPGLEDTLILTMKGIAAGMQNTG

SEQ ID NO: 139848 - protein, 443 aa, Triticum aestivum
  unsure (1)..(443): unsure at all Xaa locations
  Clone ID: PAT_TA_34266.pep
GILSAVREQAESAQEEASXWKRKYEYAANEAKTALEKXAASAQERTNKKVQEREDALRAELATQLHEKEELIATLNAKINQTEVHKTSLMSRLEVTEAKLKNHESDSVALKGEIRSLTDNLESIKTEAQSREKEVRILEQEKNHLQEKFLSECKKFDEADMRCKDAEREAKRAVELADLARVEAAAAQRDKGEAQRLAMERLTLIERMERQVETLEREKSKMVEEMERLHQSELDALSKVRMLDERVDEREKQIGEMLEQNNQQRSNTVQVLESLLATEREACAEANKRAEALSLQLQSTQGKLDMLQQELTSVRLNETALDSKVKASYSRRTRGEATESVHYMDVDNDDTGRRRKRSKSTTSPFKNNHTEDGGSVFFGEDTNNGSQQLEGTETETEDYTKFTVLKLKQELTKQGFGAQLLQLKNPNKKDIVALYEKHVVGGA

SEQ ID NO: 139849 - protein, 327 aa, Triticum aestivum
  Clone ID: PAT_TA_34267.pep
MGPGDWFKTIISKKKSKRGKSKHAKNVAAQRNGANLPQQKPSNAPSSSSDPEDNAALEDWAATRIQNAFRRHKARRTLRCLRGVKRLRIVGQSNPVTKQTSATLSYIQSWNKLQAELRNRRAFMVTEGRNRKKKQENQVKLDAKLQNLQVAWNGGSNTMDEIVARIHLREEAAVKRERAMAYAFNHQWRAKSATSQGNFNYGVGNGGWGWSWMDRWIAARPWEPRSMVTPENPKKGQSKKDNTSTNQSALKLQGAISLSNNTSDRKVPKKKSSPSPDKKKPVAKTEQKPVAKTEQKPKAAGPPKAKSKDMKRNQEKQQQPAVPAITA

SEQ ID NO: 139850 - protein, 146 aa, Triticum aestivum
  Clone ID: PAT_TA_34268.pep
QPKQWLARTRAQAGVQRGEQQLTRTIYKAGDPVSFLLHALDAAAAAAGTPYLPTNSSEAGATLHYILTTLFYCFTQLTQPRNPAQPHQINGPSGANSHTVDLGSCCSLQQQHHLPGSGTAHQKPQTDTSVVSNRRLCMIRRQLARS

SEQ ID NO: 139851 - protein, 133 aa, Triticum aestivum
  Clone ID: PAT_TA_34269.pep
SIHTPQKECPHEAAPIDSRGQLSKQIPHISTYSGEEEEPAAAAASPWPGPFTHAEEIGGSKLTLQKLPLLLSEERKMLRILSSVTMAARGLGFRARAGRDGWVWRWKEEGAVVAAVVVGGGGLLCRCMVVVAP

SEQ ID NO: 139852 - protein, 435 aa, Triticum aestivum
  Clone ID: PAT_TA_34270.pep
MGWHDPPAVMHQWPRTSPVRPRHATGWNPDIPAGPPSVPAQVRTGRTTWMDIFENARNSAIDATTDAGKKVKEMTDAVTPHVQSFLEASPDLEKVVVPLGGTLCGTLLAWFVMPIIFKRLHKYGSQNPISALLGNSVNTNASYSTSLWSALEDPAKYLITFMAFSEMAAVIAPSVSPYFPQALRGAFVLSVVWFLHRWKANFITKAMANQTALVTDRARLSAFNQVSSLGLIALGVMGLAEACGVAVQSILTVGGVGGVATAFAARDVLGNVLNGFSLQFSRPFSVGEYIKAGSIEGTVLEIGLTSTSMMSPEKLPFTVPNSLFSSQIIVNRSRAQWRVSVTKIPIKLEDIEKVPAVAEEIKSMLRSNPKVISETDAPYCYLSRLESSYGELVIGCILQKMRKDELIYAEQDILLGAARIIKSHGVEFGSTTQCC

SEQ ID NO: 139853 - protein, 167 aa, Triticum aestivum
  Clone ID: PAT_TA_34271.pep
MSQTNWEADKMLDVYIYDYFMKRNLQATAKAFQSEGKVSSDPVAIDAPGGFLFEWWSVFWDIFIARTNEKHSDVAASYIETQLMKARDQQQQLPQQRQQQPQHIQMQQMLLQRAAQQQQQQHQQQQHQHQQHQQQQQQQQQQQQQQQQQQQQQQRRDDSYLLNGTSS

SEQ ID NO: 139854 - protein, 175 aa, Triticum aestivum
  Clone ID: PAT_TA_34272.pep
MVVEGYEADKNIQIWKVKKLIKGLDAARGNGTSMISLIIPPRDQVSRVAKMLGDEYGTASNIKSRVNRQSVLAAITSAQQRLKLYSRVPPNGLVLYTGTVVTDDGKEKKVTFDFEPFRPINASLYLCDNKFHTEPLNELLESDDRFGFIAMDGNGTLYGTLSGHSREVVYKFSVD

SEQ ID NO: 139855 - protein, 93 aa, Triticum aestivum
  Clone ID: PAT_TA_34273.pep
IRTHLFSRKASSSAQKYFRRGTRLNWPEGAVTRESIRAVRKLHRLKDLVARNADHSKASLADLLYGLLRFEPSERLTAQEALDHPFFRIPGPT

SEQ ID NO: 139856 - protein, 109 aa, Triticum aestivum
  Clone ID: PAT_TA_34274.pep
AVLNSRVDNLNDVLNCDSGDIDSMDDDAGDTDEPTPIGHWIATSSHDVYMVDTPKGSDNEEKGDGTGNRPPEKQSKRQRKHRPKPRLNKNPAIEQDEPADDKQALEQPS

SEQ ID NO: 139857 - protein, 474 aa, Triticum aestivum
  Clone ID: PAT_TA_34275.pep
MAELKRLSESRDLTRIERIGAHSHIRGLGLDSSIEARDASEGMVGQLPARRAAGLILQLIRQGKIAGRAVLLAGQPGTGKTALAMGIAKSLGAETPFASVAASELFSLDLSKTEALTQAFRRAIGVRIKEEAEIIEGEVVEISIDRPVSAGSSGIPSGATAAGKTGRLTLKTTDMETVYELGGKMIEALGKEKVQSGDVIALDKASGKVTKLGRSIGRSRDYDAVGAHTKFVKCPEGELQKRKEVMHCVTLHEIDVINSRTQGFLALFTGDTGEIRAEVREQIDTKVAEWREEGKAEIVPGVLFIDEVHMLDIECFSFLNRALENDMAPILVIATNRGITTIRGTNYRSPHGIPSDFLDRLLIITTQPYTVEEIRKILDIRCEAEGLERSAEGKGRLTKIGTETSLRYAIQLITSAGLACQKRKGKVVEMEDISRVYHLFLDVKRSTQFLIDSQSDYMFSEVQGDSDGDDAMQS

SEQ ID NO: 139858 - protein, 100 aa, Triticum aestivum
  Clone ID: PAT_TA_34276.pep
RYMPKRGSLVTWPPFGISVRTFRPVSAASSVSSSHRRTSSTAILLATCLPESNGFPRYSRCFCVLLGGWAAWACWCWEVLVLSPFLVCVAFESQTGANNI

SEQ ID NO: 139859 - protein, 399 aa, Triticum aestivum
  unsure (1)..(399): unsure at all Xaa locations
  Clone ID: PAT_TA_34277.pep
DVTNAKEIVEELLQYLNTAEFAMREELALKAAILAEKFAPNLSWYVDVILQLIDKAGDFVSDDIWYRVVXQFVTNNEDLQAYAAAKAREYLDKPALHETMVKVSAYLLGEYGHLLAQRPSCSPKELFTIINDRLPTVSSSTVAIIISAYAKILMHTQPPDAGLQQQILAIFKKHESYIDVEIQQRAVEYFELSRKGPALADVLAEMPKFPERESALLKKAEDAEVDTAEQSAIKLRSQQQSSSAIVVAAQPPVNGPAPAANHLTLVKMPSQNIAEESNVIHEETAVEAPKENGAPVEVQRNVEIITEPAPVSKVEPPASRPASQADLLADLLGPLAIEGPPAAVEQTPAQGLEANQSPVGDLALATLEDQSNSVQPIVNVEEKFNILCTKDSGVLYEDP

SEQ ID NO: 139860 - protein, 70 aa, Triticum aestivum
  Clone ID: PAT_TA_34278.pep
MSKPCDGANPKTEWPELVGRTIKEAEEKIKADRPDLKVVIVPVGSVVTQEVDLNRVRVWVDTVAEVPKIG

SEQ ID NO: 139861 - protein, 62 aa, Triticum aestivum
  Clone ID: PAT_TA_34279.pep
NYFGIENSGKIILNKKGNRTEKNKKERTNLASLSSPPPAAQLPQPAQPTSSSLVLFLLCQED

SEQ ID NO: 139862 - protein, 201 aa, Triticum aestivum
  Clone ID: PAT_TA_34280.pep
MAAAAFSIRDYAASMRCKTAAEGLPLLGIEDLPPLRAPRCRWWADELASAVAAAAGAASPRRAPGKAKPTKKRSISDLFAAAPPLIVPPAGDAGCKEQTEVDGDEALCAIARRAKEEKKRKRKLQEEEAGQKEETAAVAAAPESSGGREPEGNFAASKEALESPNLFDGLDTHSSQKTEASQHHREEREKISERRKQGEDQ

SEQ ID NO: 139863 - protein, 137 aa, Triticum aestivum
  unsure (1)..(137): unsure at all Xaa locations
  Clone ID: PAT_TA_34281.pep
FHTAHTHTXLHSPPAERDVVSVVHFHQDKTIFFFFFFFFFFFFFFFLPSGPRKSYIANSAREQSELQSIHNYQTFYQSTHPYISASSFFRTTQNQTGYTFRSHLCISLQFLRHACKVQLSTTTKLGNGPSSRTTPLH

SEQ ID NO: 139864 - protein, 75 aa, Triticum aestivum
  Clone ID: PAT_TA_34282.pep
VLLCTVHLTSVTFNLILIVAKILMKRTAHEFQNNTIYRWGLAQNLIYIQMGIGQKIFFKKKKKKKKKKKKKKKKK

SEQ ID NO: 139865 - protein, 447 aa, Triticum aestivum
  Clone ID: PAT_TA_34283.pep
LVDASLQKVVLAPSVESVPEWASCIRYAVTGKERSGTRAPVLRQKVLDCLCTAVPQSVATSVLAKRYSFLSVALIEISPHKMSPAEEQYHVTILNELLDNMSHSSAQVREAIGVAMCVACSNVRLAGARSPGVLTEQTGNEYWYKRLTDGATELSVSIQNNSQSKQLELASDSSTANGLDNKEEADAKRMETIFHFMIASLKSGRSSVLLDVIIALFYPVLSLQETSNKDLSLLAKSAFELLKWRTLPRPFLETAIMAILSSVSDPNWRTRSALLSYLRTFTYRHTFILSGSEKSQIWQTIEKLLVDNQVEVREHAAGVLASLMKGIDKDLSKDFRNRSYAQAQRILDMRRRTPKSGHSVATIHGAVLALTASVLSVPYDMPSWLPGHVTLLAHFIREPSPVKSTVTKAVAEFKRTHADTWSIQKDAFTEDELEVLRDTSSSSSYFA

SEQ ID NO: 139866 - protein, 69 aa, Triticum aestivum
  Clone ID: PAT_TA_34284.pep
MADWGPVVVATVLFVLLTPGLLFQLPAQGRIVAFGSMHTGGLAILVHAVIYFALITIFLIAIGVHIYAG

SEQ ID NO: 139867 - protein, 106 aa, Triticum aestivum
  unsure (1)..(106): unsure at all Xaa locations
  Clone ID: PAT_TA_34285.pep
FLFFLLAPSFEARERCGVQRAWSKQADSRGADRRAEMTEWGGVVVATVLFLLLTPGRLFXLPAQRRIVAFGSMHTGGLATLXVHALIYFALTTLFLIALGGHIYAR

SEQ ID NO: 139868 - protein, 211 aa, Triticum aestivum
  Clone ID: PAT_TA_34286.pep
MPAPAALALAAALLLAAASICAEAVWLDMPQTGTKCVSEEIQANVVVLADYALMYESHPSSHPTLAVKVTSPYGYTLHENGNVTVGQFAFTTSEAGNFLACFWIDSAEKGSGVSVNLDWKTGIATKDWDAIAKKEKIEGVELELRKLEVAVQSIHQNMVYLKAREAEMREVSEKTNGRVAWFSIMSLGVCVVVSVLQLWHLQGYFRKKKLI

SEQ ID NO: 139869 - protein, 328 aa, Triticum aestivum
  unsure (1)..(328): unsure at all Xaa locations
  Clone ID: PAT_TA_34287.pep
AEFRVAPRPASSPSSSWSPPSPPPCWPPRSSTFSPAAAAAGPSLNPKRPAPTVIRASAGAVHPEESPQSEEKDVDSGAAALPKLKPLHWDKFRASSGRXTVWDQLKASSFRVNEEMIETLFVSNSTRRMPKNGFKEANGAPCNQENKVLDAKKSQNIAIMLRALDATKEEVCKALLDGQADSLGTELLEMLLKMAPTREEELKLREYREDAQSKLGPAESFLKAVLGIPFAFKRAEAMLYIANFDSEVDYLKTAFRTLEAACEELRGSRLFHKILDAVLKTGNRMNTGTNRGNAHAFKLDSLLKLVDIKGTDGKTTLLHFVIEEITKS

SEQ ID NO: 139870 - protein, 226 aa, Triticum aestivum
  Clone ID: PAT_TA_34288.pep
GRVGDEAPIDIKLSYLPRSFLAALVAVPLDVLMITGVALWKSPCMLLKGWQRLCEDLVGREGPFLETVCVPFAGLAIILWPLAVVAGVIASFLSSFFFGLHAGLVAYQEASFQMGLSYMISAVALYDEYTNDLLYLREGSCFPRPKYRKAGSAKYETGRDKDEHNVTAASAEKQHQGQRKHRRVLHRSKTFMETIQRLRPIQIWDWLFRSCEINGRILLSEVDAAA

SEQ ID NO: 139871 - protein, 134 aa, Triticum aestivum
  Clone ID: PAT_TA_34289.pep
MAYEISEIKKIGIGLVGFGILFSFLGVILFFDRGLLALGNIFFLTGVGLLLGWQSMWQLFTKKANIKGSVPFFLGLFLLFVRWPVAGIILELYGSFVLFSGYGPPIQAFLYQIPIIGWILQCPFQLFGLRRKRA

SEQ ID NO: 139872 - protein, 313 aa, Triticum aestivum
  unsure (1)..(313): unsure at all Xaa locations
  Clone ID: PAT_TA_34290.pep
MLKHEAATATTGIHSVQSAMCGAMQRQMHSLIGLLSVLQHDAADGMRSEQRLVVDAIARTSALSLSLANDADAETLTMSRVPFGLHALVREAMAVVRCMSGCSGVEFSHHSENSLPLPLPEWVVGDQTRVFHLLLHMVTTLLGRRCDGAAPGRLTFSVESCNVGEEERYSRDVIPMRPSAGCSMRVKFQVGMQTKFPRRSASSDMGLSFGMCNKIVQMMNGSMRSSGSDGGSIITVVLQFQLQQSGVXXKTSPXSIPRFDGLRVLLADSDGTSRGVTGMLLXKLGCQVMPAPSGAHLPSPAGERRGRFSWGFL

SEQ ID NO: 139873 - protein, 126 aa, Triticum aestivum
  Clone ID: PAT_TA_34291.pep
PTRPAAVVVLSRTVEKLGVRFRVLRRAVTDPISETATLAEKNSEATRILAAQGNLLEKEIGSIQKVLYAMQEQQEKQLELILAIGEASRILDDKQDFLGQETAISSSSAPDYANIRDPNINGTSDF

SEQ ID NO: 139874 - protein, 184 aa, Triticum aestivum
  unsure (1)..(184): unsure at all Xaa locations
  Clone ID: PAT_TA_34292.pep
TSLIEGGRAPRRIASRTPRSRYADFQNFTEWQKREEINKTMKTFKQLHPNCTKTDKVSMRGESIDXLTSRQLHLMMLMWGRGGTXMPPVLPPDLHKYMHYITTDPGCQPDAEPPPQPPRPXMITPHATPQRESDFLSHDARTTSNPSTKPQDQLPQARLKLQLYNPGSKRVIFSNNNWAAGFPK

SEQ ID NO: 139875 - protein, 95 aa, Triticum aestivum
  Clone ID: PAT_TA_34293.pep
MDAHVAELMKPEKFAGDNFKRWQSKVRHYLLSKGLWWIIPQVRPLTRQQVMDFELANDTVVAVILSLLENQLYDVYHGYTSAIELWDALDRKYAV

SEQ ID NO: 139876 - protein, 218 aa, Triticum aestivum
  unsure (1)..(218): unsure at all Xaa locations
  Clone ID: PAT_TA_34294.pep
MEALHMQEAAAMGDYGSAMTRGNPDGGSQGRPKGVPRANVQQLKLMGQGHPTGLTPNLLKLFEARPMLEHKPPVQKRKLPAYTGMAQFVSRFAEPGDPEYAPPVPTCETKAEKKDRIRKLKLEQGADKVAKELQNYDPQSDPNTTSDPYKTLFVARLNYETSESRVKREXEAYGPIKRVRLVTDKDTNKPRGYAFIEYMHTRDMKNAYKQADGRKVDN

SEQ ID NO: 139877 - protein, 72 aa, Triticum aestivum
  Clone ID: PAT_TA_34295.pep
MMQRPFRPEEYSLKETTPHLGGAAAGDKLTTTYDLVEQMQYLYVRVVKAKELPAKDLTGSCDPYVEVKLGEL

SEQ ID NO: 139878 - protein, 140 aa, Triticum aestivum
  unsure (1)..(140): unsure at all Xaa locations
  Clone ID: PAT_TA_34296.pep
QVISAIKVXLGEDGSNRGAKKLAQIRENSNFFRSELQKMGFEVLGDNDSPVMPIMLYNPAKIPAFSRECLRQNVAVVTVAFPATPLLLARARICISASQSREDLIKGLEVISKVGDLIGIKYFPVEQEKVASVDKLKKLE

SEQ ID NO: 139879 - protein, 818 aa, Triticum aestivum
  unsure (1)..(818): unsure at all Xaa locations
  Clone ID: PAT_TA_34297.pep
DPRVRKYPIEDSYXKYIAEHGGSTNAFTTSEHTNFYFDVNNDSLDDALDRFAQFFIKPWMRPEATLRXEIKAVDSENQKNILSDPWRMSQLQKHLCSNNHPYHKFSTGNWDTLEVKPKEKGLDTRAELINFYDSHYSANLMQLAVYGKESLDNIQTLVESKFCDIKNVGRKHFSFPGHPCSSKDLQILVKAVPIKQGHTLRILWPITPNVRHYKEGPCRYVSHLIGHEGEGSLFYILKKLGWAMSLEAGEGDWSYDFSFFSVVIQLTDVGHEHMEDVVGLLFRYITLLQTSGTPKWIFDELLAICETGFHYRDKSPPSNYVVNISSNMQIFPPEDWLIASSVPSKFSPDAIQKVLNELTTENVRIFWESKLFEGHTDLTEPWYGTSYCVEAVPPSIMQKWVENAPNEDLHLPKPNIFIPTDLSLKNVEEKTSFPCMLRKTLFSRLWYKPDTMFFTPKVFIKMDFHCPLSNSSPESSVHTDVFTRLLMDYLNDYAYDAEVAGLYYAVRPNDTGFQVTMVGYNDKMRTLLDTVIGKIADFEVKIDRFSVIKETITKGYENFKFQQPYQQAMYNCTLILEEQTWPWDEELAALSNLEARKKGENKPGMAAKTXIEGKPGGNKEPSEAEGAVGQSEGILFNSSTSVCKSLPPSQHLTKRIVKLERGLRYYYPAMCLNQQDENSSLLHYIQIHQDDLKQNVLLQLLAVVAKQPAFHQLRSVEQLGYIALLRQRNDSGVRGLQFIIQSTVKDPSNLDARVEAFLKMFEVTLHEMPDAVFKSNVNFLLGWIIIQYKKNKNQSTQSKRKGPEVQKRAKTREGALPR

SEQ ID NO: 139880 - protein, 157 aa, Triticum aestivum
  unsure (1)..(157): unsure at all Xaa locations
  Clone ID: PAT_TA_34298.pep
ASLATLDLXNVGLAGTIPESMAAMPRLRFLALDHNRLSGAVPAKLAALPSIGAMYLNGNNLTGALEFSARFYQRMGSRFASWDNPGLCTAETAGGAPTGVAVCKDAQEPPRVGVRDGMDAVGGKPEASSSFPASSSSFGLSGHKVAGLWCLVMVMVL

SEQ ID NO: 139881 - protein, 174 aa, Triticum aestivum
  Clone ID: PAT_TA_34299.pep
MPPRARPAPGRPRRGRGRGAAKDATGQAQGKGKEYDDVAAGKAPNVKDAAAEKAGATKQTAAEKAAAAKDTAAEKAAAAKDAAWKNAEAAKGTVGEKAGAAKDATLEKTASAKDAAWETAEAAGDTAWETAEAAKGKANQGYEKVKEKVGEVKDKVTGAAADGKGKQHRKDDEL

SEQ ID NO: 139882 - protein, 179 aa, Triticum aestivum
  Clone ID: PAT_TA_34300.pep
MGRTPCCESRQGLKKGPWTPEEDKLLVDSVQANAPGNWRMLPKLAGLNRCGKSCRLRWTNYLRPDIKRGPFTPEEHKSILQLHAIVGNKWSMIAAQLPGRTGHEIRNPSNTNLKKQRNKASINPLRRMGPAAPPPGPTAGCPAARHMAQWETARLEAEARLSLLSSSGAAATATTSGSA

SEQ ID NO: 139883 - protein, 159 aa, Triticum aestivum
  Clone ID: PAT_TA_34301.pep
PIKESLERWSSGRHPTTPRRGERCRTGTRWSREDPTPLTRLLMEESNHSNEWSSLEDMSKAAPPHRHRPHHRRPQPVAPPPPSDPQKAATTQIHQNDAFKKDCDTKMRRHRPFRKNQEQGFPLELRRESHLDSDASKEVSDTRGRRHRRLRSEQRLSPK

SEQ ID NO: 139884 - protein, 142 aa, Triticum aestivum
  Clone ID: PAT_TA_34302.pep
NLTSTLTLKLSPQSLILEVDLLYFCKWKNELPKSGCQSRMKMTYRAASLGRQRRCDRKQHRQHLTIKVDPTCLRETRSTPTSPGWTPTATAPSGSTSSFPPLSRFSLGPCYHSVAVDRSERSTSIGAKPSTVDGHPMAAPVS

SEQ ID NO: 139885 - protein, 229 aa, Triticum aestivum
  Clone ID: PAT_TA_34303.pep
PRFCPPARRCRTAAVAFSVLRHFRCTGPLSSSRVLGSDSPAPRRSLLRCSSLSAHSIPEHEQCEKKNRNLRSSGGDEGGITSGLSSRHPFSIPKRNGFVSVGESCILKTNHFKPSTYCDNIYRYEVFMNYEFLSSGPSHATAISCGVKRAVMRKLCKMYRESHLRGRRPAYDGRNRLYASGPFSFESETFVITLQNEEDSLDYGQTPQRPTTVVFCHHNLQCIFDRSHC

SEQ ID NO: 139886 - protein, 387 aa, Triticum aestivum
  unsure (1)..(387): unsure at all Xaa locations
  Clone ID: PAT_TA_34304.pep
VEGSVIYRPSHXESCLTQLFVASFDGRDLIATLPSRTIPVKKTGMYNMYFIHCDPALAGLEIDGKTIWKNPTGYLPGRMAPLKNFFGLMSFAFVILGIYWFYQYMKFWREVLPLQNCITLVITLGMLEMALWYFEYAEFNETGVRAKAITFWAVTFGTIKRTVARLIILIVSMGYGVVRPTLGGLTSKVVMLGGTFFVATEILELVENLGTVNDLSGKARLFLVYPVAILDASFIVWIFISLAKTLSQLQARRLMAKLDIYRKFTIALAITVLVSIGWIGYEIYFKSTDVFNERWQYAWIIPAFWHALSFSLLCVISYLWAPSQSSMRFTNDASEKFDREDSLSLIRPRPIISNNGWSVASSTDAKAKKNTDSVTSFDEDDEENKRE

SEQ ID NO: 139887 - protein, 172 aa, Triticum aestivum
  unsure (1)..(172): unsure at all Xaa locations
  Clone ID: PAT_TA_34305.pep
DHSTRSSIQKRNTIRRANYEDIIIKHTXKWRNSSALSIYFTGTCLTRIRVCKSSPVAMLPTMRRAAMRIEVDGNKRSSTSEEKHQINHSWRNTLIEGGKIVPPPLPWPSTFHQVCSSKLDTSSLAKRNISKAKQLARFLKSVPYEPNNNSKVQQFPTVNRIPRPLTNLQLHT

SEQ ID NO: 139888 - protein, 91 aa, Triticum aestivum
  Clone ID: PAT_TA_34306.pep
NTVDLKINMRLYTRSNSMRSSDHKKRPFNTKFDTKARTHKKSQLRRHIFKHTNKWLIHLPCRYTSQGPASHEPESANHHQWQCYPPCAELQ

SEQ ID NO: 139889 - protein, 133 aa, Triticum aestivum
  unsure (1)..(133): unsure at all Xaa locations
  Clone ID: PAT_TA_34307.pep
RASASRRFPDGSXVPPPAPTASAADGVESTKVAPSSSSSTSSWTSGSCPPSGGPWRTLLARFLSSHGMPPLAVAPLDGGSGDGGGGEAATAARKVPAMTMAHFTPQPCRITRGLCVRTCSRSVLCFVMANASI

SEQ ID NO: 139890 - protein, 339 aa, Triticum aestivum
  unsure (1)..(339): unsure at all Xaa locations
  Clone ID: PAT_TA_34308.pep
DTILKVLVKHFFIEKEVTXTLVMDSLYTGLKALEYKSKNQVGLSKLTETDARSTSMVLVEQDMFALADDVLILLERATLDTLPHQQLPTKDEKASQNRTKESSSGDDFNKDSIERDDRRLIELGWKTLEFFALAHIFSRIEVAYQEAVALKRQEELIREEEAAGLAEIELKGKXRSAAEKEKRIRKKQAKQKKNNRKNNKGKNERVDMKEVALEGSPSDDRNPDDLSSQAEEVTSNPDNPDEASDISDNRDDNSEVLNVDLEDCESSPVNWETDASETRGIVPEGGDVQNXAIRKEASFVDDSSSTCSSDSVPSVILNGLNTGGXLXKCQILIQRDHPE

SEQ ID NO: 139891 - protein, 406 aa, Triticum aestivum
  Clone ID: PAT_TA_34309.pep
MATATAAAVWEEEAEVERPMLEDERKGKQGKGRRYGLVDYRALPAYMRDNEYILRYYRCEWPLPQVLLSVFSIHNETLNVWTHLIGFFIFLSLTIYTATKVPNVDLHSLQNLPDILRNADLHKIQAELAACLPSLPHFSDLQKMKDELRSSWNSIDVLPSLSRWRLLELLSNCLPDRFTHSNETNLSVLESMKEDIVTVIAPHFIRPISRWPFFAFLGGAMFCLLASSTCHLLSCHSRRLAYIMLRLDYAGIAALIATSFYPPVYYSFMCHPFFCNLYLSFITILGLATIAFSLLPVFQNPEFRTIRACLFFGMGASGVIPVFHKLILFWHQPEALITTGYEILMGLFYGVGALVYATRVPERWMPGKFDIAGHSHQLFHVLVVAGAYTHYHAGLLYLKWRDQQGC

SEQ ID NO: 139892 - protein, 129 aa, Triticum aestivum
  unsure (1)..(129): unsure at all Xaa locations
  Clone ID: PAT_TA_34310.pep
RRRXMHGPPLFHPDAWTTGCCRPTSQEKLVPGNPPDGIFKIKGGDPLPLLLKAAVPPQDPARDRADPSSGGAVPRQSRDPRRRGGEPREIMTVRMSCVYMKRVAHRLRFAKGEYREGERLWNVPSVSQR

SEQ ID NO: 139893 - protein, 450 aa, Triticum aestivum
  Clone ID: PAT_TA_34311.pep
MGQGSPGGMGKQGGLPGDRKPGDGAAGDKKDKKFEPPAAPSRVGRKQRKQRGPEAAARLPPVAPLSKCRLRLLKLDRVKDYLLMEEEFVASQERLRPSEDKTEEDRSKVDDLRGTPMSVGSLEEIIDESHAIVSSSVGPEYYVSVLSFVDKDQLEPGCSILMHNKVLSVVGILQDEVDPMVSVMKVDKAPLESYADIGGLDAQIQEIKEAVELPLTHPELYEDIGIRPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTAKMTLAEDVNLEEFVMTKDEFSGADIKAICTEAGLLALRERRMKVTHADFKKAKEKVMFKKKEGVPEGLYM

SEQ ID NO: 139894 - protein, 94 aa, Triticum aestivum
  Clone ID: PAT_TA_34312.pep
DGVDSPEAKPRGFSLGHNLLQPLFFLPNVDHLCQFELSYIVECGVGHMRCPPIMLCHESQTYDDSYNFEQIHAELYCYMRSSHYAMFNRLVIIR

SEQ ID NO: 139895 - protein, 223 aa, Triticum aestivum
  unsure (1)..(223): unsure at all Xaa locations
  Clone ID: PAT_TA_34313.pep
PPSEDSIAGGGCPSPWWYLVSPRSGSASVNEVICHGIAPTRKLEDGDIVNIDVTVYYAGVHGDLNDTYFVGNVDEASEQRVXWTYESLEHPFANGIPELKFREHDCLLRRQASNVGAAVMKSYCSHGIGVWFHCAPNIPHYSRNKAVGIMKAGQTFTIEPMINTGLWRDRLWPDEWTAVTADGKRSAQFEHTLLVTETGVEVLTARLPSSPDVYPWLKPGVSK

SEQ ID NO: 139896 - protein, 342 aa, Triticum aestivum
  Clone ID: PAT_TA_34314.pep
RLFAYDGHPTQAGKEVLIRAVAQSIPTYIMSVFKLPLEVCDDLNRMVRNYFWGAEKGKRKTYWYAWEKMTRPRKQGGLGFKDFRLFNQALLARQAWRILEFPNSLCSRLFKAKYFPNGRLLDTGFTSNPSPTWQAIAYGLELLKKGVVWRIGNGQSVRIWRDRWIAREPTGGLISQRGRCRLKWVSELLNIHGNWDFDKINQFFLPVDIVEIQKIKPSARLEEDFVAWGPEKSGVFTVRSAYKLASDECSNPNEVSTSSRPDGTREAWKFIWQSSVPPKVQSFAWRLATDSLANWTNKVKRNLEVSGTCLVCGMEEEDSFHVFCTCNHAVFLWKAMGNEWTL

SEQ ID NO: 139897 - protein, 216 aa, Triticum aestivum
  Clone ID: PAT_TA_34315.pep
DTSPSDVRSHHHHSILRVHSPDKLVVDLHLFDNSVLFTAEELCRAPAEIIGRSCDGTSYMATLDNGYELTAKRLKEGFAKSKKECSREIKKLGSVKHPSLVSLRGYYWGPKEHERIIISDYVDATSLSTYLSEIEERDLAPLSVGQRLDIAISIAHCLDYLHNERVIPHGNLKSSNVLLQDSSPSALVTDYSLHRLMTPVGMAEQVLNAGALGYSP

SEQ ID NO: 139898 - protein, 347 aa, Triticum aestivum
  Clone ID: PAT_TA_34316.pep
LRQSADSSTLMSRARAYAPVDDSLTLQGPLCRVCEENNELEGKNSSCEGKAVGFVYSSVGKDSVLVTAWGSGQLQIDALADEIQPQWSIGVPTRLNVDSHGRIKSVAMICDSNPQDSSALRSHRSSSMGSNVKSNTEAVWMGHSPPLLRLSIVDLALPKTSNGSSLSLFLDPLVPERFYCAHGGGLDMGTLHFLPFSYPEMASTPPSVHPVLTTGNSDTSSPFLSGFVAIADAYGHVQLVGITYTGECFVVEMKGWKEPTPLQLDICSKDIKDVESSTTGMISKELLAGPDPPILPSSTSLRSLTPDSIEGKSTLHHYIKVFHEHYVEYGHKVRAIIMVFCAYPLST

SEQ ID NO: 139899 - protein, 460 aa, Triticum aestivum
  unsure (1)..(460): unsure at all Xaa locations
  Clone ID: PAT_TA_34317.pep
TYKAIERGIFVSAAAGNAGPAAGSVSNCAPWILTVAAGTTDRAIRTTVKLGNGQEFDGESLFQPHNNSAGRPLPLVFPGASGDPDARGCSSLPDSVSGKVVLCESRGFKEHVEQGQTVKAYSGAGMILMNKPEEGYTTFANAHVLPASHVSNAAGSKITAYFKSTPNPTASITFKGTVLGISPAPTVAFFSSRGPSKASPGILKPDISGPGMNILAAWAPSEMHPEFVDDVSLAFFMESGTSMSTPHLSGIAAVIKSLHPSWSPAAIKSALMTSSDPADHAGVPVKDEQFRRASFFTMGAGYVNPSARRXHPGLVYDLSPNDYIPYLCGLGYGDDGLKEIVHRRVDCAKLKPITEAELNYPSLVVKLLSQPITVRRTVKNVGKAGSVYTAVVDMPKEVSVTVRPPMLRFSKVNERQSFTVTVRWAGKQPAVAGAEGNLKWVSPEHVVRSPIVVPPAKVVA

SEQ ID NO: 139900 - protein, 196 aa, Triticum aestivum
  unsure (1)..(196): unsure at all Xaa locations
  Clone ID: PAT_TA_34318.pep
MECSGDEVVELSCARAGGDPGEYAAVLKRKLQLYCAAVAKTMEAKPQESSLNCLNSQASGSPPVAAPGSFCSWLSXLSSDGYLSVVHRKGGRGCTSKEQSDDDDGDLEENTDPASAKRVKRMLSNRESARRSRKRKQAHQNDIESQVTQLRAENASLLKRLTDMTQKYKEASLGNRNLTVDIETMRRKVYPFLDNS

SEQ ID NO: 139901 - protein, 133 aa, Triticum aestivum
  Clone ID: PAT_TA_34319.pep
WISFPLAPARFWESRWCCPSPNAEPEWSGLSPSEAPRRIVFNLKSGSPSSALHSSTYRSPDLSSPFFYVCIRLDLYTLRYVLLASDKCYYPAYSFRIVMRSHFLSIYKSHAVNGVCLTQGRCFVDRPSKFRTS

SEQ ID NO: 139902 - protein, 232 aa, Triticum aestivum
  Clone ID: PAT_TA_34320.pep
GPPLEIVPGTLSAALSALTLLVQFNGWLSFFLLLSYKLPLMPETHATYYEYTGLWHINALLALNSWFWCAIYHSCDTAWTEKLYLSSAAAFLGYSLILAILRTSNLRDEASRVMVAAPILAFVTTHILYLNFYELDKGLNMKVCTVISVAQLLLWTVWAAITRHPSRLKVAFVAHRRVLSLYLEAHDVPPRWGYVDGHAICLAMAIPLSYLWWSFAKEDAEMRTAAIMKKKR

SEQ ID NO: 139903 - protein, 190 aa, Triticum aestivum
  unsure (1)..(190): unsure at all Xaa locations
  Clone ID: PAT_TA_34321.pep
MGLCVSYDAAADGPATARVVLPSGELREYSPPATAALALEEAGHQEWFLCDADAMGLEGSVAAVASGEALLPGQIYFVLPSDMLRRRLAPXEVASLAVKASAALVKAATVSSAGSRRRRGSVAPLVFEPSEEDYSAEDAFTMATFAVKPMVAPETEGGVPRRLGPPEPLPRPHRHRRGASRRAAQTRLPK

SEQ ID NO: 139904 - protein, 141 aa, Triticum aestivum
  Clone ID: PAT_TA_34322.pep
KDTIYLICGRRDEQWEMISTRRDKSIAAFIQELNQHIRRQENQMCAGMIDLKVMTRNMELEEELKSTRDGYEEEIVVLLEKNEDLKKKLEVFMGDPAPEEDIRSEDYIIIDDTDSHPDSSDDDYEDEAGADIMESSTDQNF

SEQ ID NO: 139905 - protein, 302 aa, Triticum aestivum
  unsure (1)..(302): unsure at all Xaa locations
  Clone ID: PAT_TA_34323.pep
MQGGSFFRGYTKLCKGLAVILLLVHLLVQLFPSAVNYLALIPARTIPFAWNLITAGYVEQTIPGVIISIIGLLLFGKLLEPLWGTKELSKFVFIVNFSTSMCVFVTAIAVYYVTQQESYLYTPLSGFYGXVLSGLLVGIKQLMPEMELNLFVLKIKGKWIPSLIALISVVVSFFMKDLVSYLPVILFGIYMSWIYLRYFQKRLETGLKGDPSEEFSFSSFFPAILRPVLDPIATIFHRLLCGRSDRADRGQTLETSSLPGSDSTEANRRRERGQRALEQRLAEKLAAVKSTESTSLDASDKV

SEQ ID NO: 139906 - protein, 174 aa, Triticum aestivum
  Clone ID: PAT_TA_34324.pep
RPAASAFSVATKHLRPETALNLVVPKIKGTCTPPLFALSSVGARRFVRARRSAAATMMSSALPSGAVAPFSRWRLQKRLHAAPSGQLPLMASCPPLGRPVPITQEGKGYRLLCGKSGRADRGHTLETSSLPGPVSPEANRRRERAPRALEQRLAEKLAAVKSTESTSLDASDKV

SEQ ID NO: 139907 - protein, 164 aa, Triticum aestivum
  unsure (1)..(164): unsure at all Xaa locations
  Clone ID: PAT_TA_34325.pep
MGNVTSSVAARLAFFPPEPATYEVAAAEGGAGLRMTGVLPDANVDVHALPTRAGTXVVAAFWRYPTARLTLLYSHGNAADLGQMLGLFMELRSHLRVNIMCYDYSGYGASTGKPSEYNTYYDIEXAVYDCLKNEYGIVHXLLIICGQSVGSGPTLHLASRLDKL

SEQ ID NO: 139908 - protein, 123 aa, Triticum aestivum
  Clone ID: PAT_TA_34326.pep
MGELHARRRRPLLLLLPHEEEEEKLPPRRHHLASANDASSKIQILIPQVSPSPCPLRGSAALIVSPALKLAIIWVAERGRQWSFGEHRPRTRAGSEAIGVTSGPWALGICGLAQVGAPRHAPE

SEQ ID NO: 139909 - protein, 58 aa, Triticum aestivum
  Clone ID: PAT_TA_34327.pep
RVVDKFSIKILREEFERAANILQYDPNPSVKLFEPYVPPPPSGTLDEEGILSTAGAII

SEQ ID NO: 139910 - protein, 70 aa, Triticum aestivum
  Clone ID: PAT_TA_34328.pep
TLVCGVLRSSQARAYSVDPLVTCYVCILLCIQHSTLITNAMARPSCCMRLPHIISSEPSWFLFDWWSILD

SEQ ID NO: 139911 - protein, 263 aa, Triticum aestivum
  unsure (1)..(263): unsure at all Xaa locations
  Clone ID: PAT_TA_34329.pep
MAASSDLLDVDPPELQFPFELDKQISCPLKMINKTDRTVAFKVKTTSPKKYCVRPNNGVVRPRSTCEVVVTMQAQIVAPPDLQCKDKFLVQSVVVADRLSAKDITAQMFTKQGGNAVREVRMRVTYVMPTESSLEIAEESDGPQRILVPMQRIVDHGRSASELSSGSVSLRSAELGTEVGSPTGPVVRTEELLRAAGHAADARSXSGPDALPLELLACWTFASMAWDSGLQPHIRPRSQSLLVGRDASNHRGFALFLVPVCGL

SEQ ID NO: 139912 - protein, 201 aa, Triticum aestivum
  Clone ID: PAT_TA_34330.pep
TRPRLSDSCPCDRIKDLKAVELCRIEGLGYSAYGEICCTLALKFIDDTSSGFGKQFIITLLELADFSDFLVERTRFEATIVQNWTIRDKCKVWSMDDGEEERSWWEGHVLAITPDSPDFPESPWLKYAIQFYDGSDFLYSPWELHAAGPLVPWKHPHIDSSIRNKLLSAVTTLQKMSHKNQDYYGVLKLDTVVGESDFINR

SEQ ID NO: 139913 - protein, 367 aa, Triticum aestivum
  unsure (1)..(367): unsure at all Xaa locations
  Clone ID: PAT_TA_34331.pep
FHSLRFQMKEFFQGPNMAHKVVDQGPLEALDGPDWGSNLXISGFAKTERVHRLGLNRPLKRRIMPKSPAVEYLALILLSXLKLNIKXVACSVHFQTMIQXVLARLSSPVSRGLLYNGRCLTXRELHVARHYLRYLPVYEETYKSLRSRGIRFPGRDDESLAPIFTPPRSVPAAEPYSDAAQDGXQEISDESFAPVRAAPSVQVDEAFEVARNSVELLSTVLSSSPQKEALEDDLTTTLVQQCRQCQYTIRRIVETAGDNEAQLFEALSIHDELQKVLSKYEDLKEPIVAEPEPEPAMIPVTVEPEESPRAVGKDTPSRKSAGSGGRSSGGDDLLQDLDDMIFGKKAGTASQQERTPRKEQKDDFIGL

SEQ ID NO: 139914 - protein, 328 aa, Triticum aestivum
  Clone ID: PAT_TA_34332.pep
PRVRILIIQKYLNVKMLKSANELVKQYDLAEEFPDVNYLYKESSLKKLAEKGCWDVAEVRAKKDTKLMEYLVYLAMEAGYMEKVDELCERYSLEGYVKSLVPEEVMCQSDYLELKKLILEEIVWVDEINGLLSATSYIEACKIIGVDCEWKPNYEKGSRPNKVAIIQIASDKKAFIFDLIKLYEDDPKALDCCFRRIMCSSNILKLGYNLQCDLHQLSQSYGELLCFQSYEMLLDIQKLFKETTGGLSGLSKKILGAGLNKTRRNSDWEQRPLSQNQKEYAALDAAVLVHIFHHVRGQPQFGVNEGRQVEWKSHIVSRVNRARSPLRF

SEQ ID NO: 139915 - protein, 368 aa, Triticum aestivum
  Clone ID: PAT_TA_34333.pep
LLLPLSVRRQRACLAAALFLTIFLYGFWRMGIHFPMPSPEKGFFTMPQLVSRIGVIGVTVMAVLSGFGAVNRRYSYLSLFIREIDEMDIKALERQLMQSMEASIAKKKKIILSKMEMERIQGSEEKLKARSFLKRIVGTVVRSVQEDQTEQDIKNLEAQVQGLEELSKQLFLEIYELRQAKIAAAYSRTWRGHFQNLLGYALSVYCVYKMLKALQSVVFKAAGSVDPVTMTITIFLRHFDIGIDVTLLSQYISLLFIGMLVGISIRGFLANVMKFFFAFSRVGTGSTTNVVLFLSEIMGMYFISSILLIRKSLANEYRVIITDVLGGDIQFDFYHRWFDAIFVASAFLSLLLISAQYTSRQADKHPID

SEQ ID NO: 139916 - protein, 237 aa, Triticum aestivum
  unsure (1)..(237): unsure at all Xaa locations
  Clone ID: PAT_TA_34334.pep
ARGCGPRAGCRAARPGCALSAGWLGLPEGSPRACPVRAPLSELSEQVVSRLRRSVVSLASFDGDTKLRECTGMCIETSCSDSEATILTSRRLIPPTHPAASLNIKVRLPNDRIVTGWIEDPKIYVDFFIVNIKNVSGVDAASLDRDMQFEPHTKVAAVXRCFCSGFLTATSGLNLASPTSEKIVSTCRIHKAXPGGPLVDFDGNFVGMNSSRTKMEKTAYVRRGNFPILGASGKGQC

SEQ ID NO: 139917 - protein, 191 aa, Triticum aestivum
  Clone ID: PAT_TA_34335.pep
NSKTIAVAHQVQGSCQWETLELYLDKYKDLHPRLPVIVAETLLYTDPEIELPLWLVQMFKTTKGGNRMISWGMSGKEADPAALFRLYTNYGRHTEAANLLVEYLDSFASSRPMDVLHRKKMSAAWFPYTTVERFWCQLEEMQSAGHSADQCDRLKKLLHGALMNHLQQVVVDSEDVLSSVGGGQGVESQSS

SEQ ID NO: 139918 - protein, 77 aa, Triticum aestivum
  Clone ID: PAT_TA_34336.pep
SSRNELDVAGEYEDYRYNYLQQQLLYIHTWVNETTTCRLLQAIFSFHVYSQKPTPHLVSVHTLESYTCWIWAMNPKP

SEQ ID NO: 139919 - protein, 81 aa, Triticum aestivum
  Clone ID: PAT_TA_34337.pep
MALRMAAAAFVRRLAPARPPALLAEGEAVTCGRGDKKTKRGKRFKGSYGNSRPKREKKIERIKDRVEVPRSTPWPLPFKLI

SEQ ID NO: 139920 - protein, 211 aa, Triticum aestivum
  unsure (1)..(211): unsure at all Xaa locations
  Clone ID: PAT_TA_34338.pep
ANCSCKFCQEHLNHDAPDNAEVDSLHSCSQCEEKYHPACSPETEDLSSVSNQAGNHFCQQSCRLLFEELQNLLAVKKDLEPEFACRIIQCSHEDAPETVLDLDGRVECNSKIAVALSLMDECFLPIVDQRTGINLIRNVVYPCGSNFLRLDXHGSHIFILERXDEIVSAASVRIHGTKLAEMPFIGTRHMYRRQGMCRRLLDGIEMILSSL

SEQ ID NO: 139921 - protein, 413 aa, Triticum aestivum
  unsure (1)..(413): unsure at all Xaa locations
  Clone ID: PAT_TA_34339.pep
GGDHARSKEAAGMMALHEALRNVCLNSDWTYSVFWTIRPRPRCRGGNGCKVGDDNGSLMLMWEDGFCRPRMAECLEDMEGEDPVRKAFSKMSIQLYNYGEGLMGKVASDKCHKWVFKEPSECEPNIANYWQSSFDALPTEWTDQFASGIQTIAVIQAGHGLLQLGSCKIIPEDLHFVLRMRHMFXESLGYQSGFFLSQLFSSSRGASSAPSFPLKQPPPARPPPQLFNWPGQPQLPHAAASPLFPPGPAAFHPSARSSMPHYPGGKDESHMYHLAPSQHGKPPHLDEHQHQHQQQMRPGEAPDGDLKWPNGLSFFTALTGRSDDSKLLYGGPGGGGGGGARRREASAGRADRARRRGERGGVPEPGEPLQGEDGEHQSASRGLHVAGEDSSLRLPVRVGKGPGRNNSGWGTER

SEQ ID NO: 139922 - protein, 255 aa, Triticum aestivum
  Clone ID: PAT_TA_34340.pep
MEYDLPPLRECRYLHSRPQQALCSGLPPASATNQNFNHIFLVRVYGLCMVLAYVCASLSGAASDLTRLAAQMFLAEAVHCIGLHEFNPVGKAAAQLLAKVCGDPKIDCHDVFSALAGPDCCLNKSTTCAFMLHAPQPTSMRNLIHLSQMVRNEGVRRYDYGNAKENMKHYKQPRPPLYNLSSIPTHVPMLLTHGGQDFLGDVPDTRHLLKTLVRNHDSDNIEVQYLPDYAHADFVIAYNAPRLVYEPRVDFFQRH

SEQ ID NO: 139923 - protein, 210 aa, Triticum aestivum
  Clone ID: PAT_TA_34341.pep
KKKKKKKKKKKKKKKKKKKKKKKKKKKKKKKKKKKKKKKKKGGPFKRTQVYDPGLARSKFFYGAPKIKFPGRGLTTRGWENPGGTQIKGLGKKPPFPQWGKNQKGPPRSPFQKVAHPKGEREPPLKGPINRGGGGGSPQGARYLCQALSPRSFGFFPFFFRHVGGFPPEGFKRGAPLRVPIKGLRAPGPKKPGLGGGLTKGPIPLINGFP

SEQ ID NO: 139924 - protein, 75 aa, Triticum aestivum
  Clone ID: PAT_TA_34342.pep
PYNRTDHQNYDKLATKNTINCTTSAFTSHMYYHARNIFFASTLSLLLFVQFAPLCLGCTLLKLRLYLATDVRKNK

SEQ ID NO: 139925 - protein, 176 aa, Triticum aestivum
  Clone ID: PAT_TA_34343.pep
KSKLAVEGDEDLDSLEDDDKLEYDGEVLEDHQLIADISNKDDAVIHLFIRKPAKVRTQQVDKDTVVTVDNPQKKENLQNESVVVTPAKPAGGKPAPIEPIVVNRKAKLSSEVMKMIDSAIAGLENGYTPVMSAEGSGGVYFMQDSSGQKNVAVFKPIDEEPMAENNPRGHPLSTDG

SEQ ID NO: 139926 - protein, 95 aa, Triticum aestivum
  Clone ID: PAT_TA_34344.pep
MSSAGVIALAPMTDDLAFLPIRFDGSRSAHCFSGSQLQDSILIFLAVPGAPPMPMSVLGTDSIASVKLRIQRFKGFVVTKQRLVLRGHELARNNC

SEQ ID NO: 139927 - protein, 286 aa, Triticum aestivum
  unsure (1)..(286): unsure at all Xaa locations
  Clone ID: PAT_TA_34345.pep
LWHNRLCGLWVSRFRIWVPPPRIEGSQRYTCLEIHVEGLNRGTRLGEGALREVAVHILDRAVGDGESGHGVRFSGVPPTPLVRSLHRRKNFKFXSLQMFMENDGGCXDLGPRALPVXQVHLMAVLAIRYANADRQPGNILVSKEERPTCKLLSIDHAYSLPRXFEVWTCEWRDRTQAREGCSVETIAFIESPDAEXDIKLLRFHGWELSSSCARFLRISTMLLKKGPARGLTSKHLXRILCRDTVNPVCVIXDIIQDAEDPVLPGTSENLFLETVSEIIDRYLLVK

SEQ ID NO: 139928 - protein, 77 aa, Triticum aestivum
  Clone ID: PAT_TA_34346.pep
MWTKKVATQVVLVLLLLLIAQEAAVPGAEAKICRQRSAGFKGPCLSDKNCAQVCQQEHWGGGNCDGPFRRCKCIRQC

SEQ ID NO: 139929 - protein, 161 aa, Triticum aestivum
  Clone ID: PAT_TA_34347.pep
LKSGGGRASRSTYKHTHCLMHLRPGRKGPSQLAPAPSLACRQTGAAVHIGHARPFEAPRCAAGGPWPSPPCPRPPPFAGNHGKETQDQSHRAPATCLRHMVSGRPPTPLTCCLLCDEEEKQDQNHLRRHLLGPHCERPGWERPKLCLRYVLALLRSWSRTR

SEQ ID NO: 139930 - protein, 127 aa, Triticum aestivum
  unsure (1)..(127): unsure at all Xaa locations
  Clone ID: PAT_TA_34348.pep
MSLMPWFGGGRGGMDPFSSDLWDPFGASWPLDAGRRGGEGRQXDDATAMARTNVDWHENDKEHIFSAGDXPGVSEGRRVKVEAWRTRNVLKISGEKTREEEHKGPTAWNRVERSFGVLSCDGSALPA

SEQ ID NO: 139931 - protein, 77 aa, Triticum aestivum
  Clone ID: PAT_TA_34349.pep
VAKKKKKKKKKKKKKKKKKKKKKKKKKKKKKKKKKKKKKKKKKKKKKKKKKRGAPLKEPNLTPPAWQGKIFFLGPPN

SEQ ID NO: 139932 - protein, 138 aa, Triticum aestivum
  Clone ID: PAT_TA_34350.pep
KIFSSIFCQICRSLSMDNKTTARCRRGRRHLHGSREVRLGGGGARGRESGGWATPIVQREGEESENQTWSHRRTSSRKPRRPYSAFSSLHLTSSLPPLFFPGDRAAMAMERCRCRPPRRRIRSRPGPPRLDVRHFPTV

SEQ ID NO: 139933 - protein, 178 aa, Triticum aestivum
  Clone ID: PAT_TA_34351.pep
MAELLFAPAVAGLVHLPEVLERLAAADADHRDHAHHHTAHGHGHGHPRAQIGGVGGGAPVDIVETPAEYAFLLDVPGLSKSDIQVTLEEDNVLVMKSASNGGGGANGKRKREEEEADCRYIRLERRASPRSFVRKFRLPEDADAGAVAARCENGVLTVTVKKQPPPEKKTKSVQVAIA

SEQ ID NO: 139934 - protein, 106 aa, Triticum aestivum
  Clone ID: PAT_TA_34352.pep
LSTCNHMYYVLRMDQLIQWLTERTQPANKTIVPKVVKYNTLGHIFQRIFGVIYIPYCQCEIVFRYYNAKVCNIDSWFQAAVTPGIEELTIELSSKSGRYYNFPWSL

SEQ ID NO: 139935 - protein, 520 aa, Triticum aestivum
  Clone ID: PAT_TA_34353.pep
MGQLMLNRVISMQRESRRLQIQPHNGTADSMVDRKDSTCKQDHCSQGGEIQYPGPHLPEDIWCHIYSLLPMRDAARAACVSHAFKRTWRCYPNLAFNMITLGIDIESCGEDGIARNFTNKVDHILKNRPCIATKTLEIVFRYYNAKVCNIDSWFQAAVTPGIEELTIELSSKSGRYYNFPWSLLANESGNSIRYLNLARCAFSPTDELCFKSLSRLELSDVAITGDQLGSILHNSFALQRMQLKFCNKIICLKIPFHLQQLRYLDVFDGGSLLRVIEVEAPNLSNFQFMGHRKVHLSFGVGLQFKKFDLYFPGAISYVCADFLSSLRYVEDLSLGSRCEMIDTPVLHSKFLHLKHLNVDLQAMTFSPTYDYCSLISLFDASPFLETLVMNVLQQKMLHESIVGDTSHLRQMPGHHHDSLKTVKIIGFSSAKSLVELTCHIIENTSSLESLTLNTTTGHPFDSCLTNNTGKCNLLGVDFMVEVGRGLLAIRTYVEPKVPSGVELNVVEPCRRCHDQPPPMP

SEQ ID NO: 139936 - protein, 299 aa, Triticum aestivum
  unsure (1)..(299): unsure at all Xaa locations
  Clone ID: PAT_TA_34354.pep
TRRGDYKYGSTNNYIRFPKEAKTSYYSAKNYRSVPRKSHSYYDEQNWTESRICYVNAKGYNNAPPTRPGKPSRPYQPTWKNTFQTSSVQNNRTYSRSRNEEGCSDTGVGKNSHRTLGLQNEQEFSSKQEPSFVERRKARPDILSKLFSSSVRMAHSSLKPQSRPSFGVKAFAPSGEHGNTAGSLSMVKGMPNLGSHSTVSTSNSQYSESRDQGSGLNIGVPTENKLSAQIFHQNIASASKIQSHPQNTLISSTEDAETSPPPGSNNSLAPSVIIVQNDKVEAVSGSFLVXEGHALDVTV

SEQ ID NO: 139937 - protein, 226 aa, Triticum aestivum
  Clone ID: PAT_TA_34355.pep
LFPAAVPKTDNTSKTDRRKSLGSKPEKVQLIELRRANNTEIMLTKVKMPLPDLVSAALALDQSTLDVDQVENLIKFCPTKEEMELLKNYTGDKQLLGKCELFFLELMKVPRMESKLRVFSFKIQFGSQVADLGKSLKTIDSSCNEIRSSLKLKEIMKKILLLGNTLNQGTARGAAVGFRLDSLLKLTDTRATNNKMTLMHYLCKVLAARSPQLLNFYVDLVSLDAA

SEQ ID NO: 139938 - protein, 388 aa, Triticum aestivum
  Clone ID: PAT_TA_34356.pep
PFSLLTVARVPLLSVSFSSARAPSLSSHPSNGGPRRRRRLVRAPPGLPRPPASLPRGAPRPPLRPPSRGPPAAGGKDDAAKPNGTPVVKLKVDPSQNGALGPVTTDKSRTTSSTNSTPDSSGSRAGLFRTPISGGVQSATFAHGLPPPALAVRNLMEQARFAHLCTVMSGMHHRRAGYPFGSLVDFANDSMGHPIFSLSPLAIHTRNLLSDPRCTLVVQVPGWSGLSNARVTIFGDVYPLSAEQQEWAHKQYVAKHQQWASQQWGNFYYYRMQNISDIYFIGGFGTVAWVDVKQYETIQPDKIAVDGGEQSLKELNAIFSKPLREFMSAEGEVDDAALISVDSKGIDIRVRQGAQFNIQRLAFDVPYKVETLEEAKRALHKIIKTSSK

SEQ ID NO: 139939 - protein, 200 aa, Triticum aestivum
  Clone ID: PAT_TA_34357.pep
MVKGMPKSRPIKAAAEVVFDPVRLWPPEAAPRRGRPRRAAKYHHFMGSSLSNLYHKPAPAKSTDMSDDDPDIDAPKLLIGKELFGAAPGTDNRKIPHRKVVELGGKAFKKQRTPLSVPIPAMKNHQKREQEKIEEERLLGIFRKQNKNKKFEKLRPEDRVLRATEGRFKNGILDEAPHGRTKAVLVVIVQRCARAGDEKG

SEQ ID NO: 139940 - protein, 381 aa, Triticum aestivum
  unsure (1)..(381): unsure at all Xaa locations
  Clone ID: PAT_TA_34358.pep
MATEKARQLLARLAATPDAAVPNLPFLHRALLLPLLSAASAASALLRLPVILSSSPLRSRRTLPVPVISVGNLTWGGNGKTPMVDFLARRFHAMGVSPLILTRGYAGGDESKMLRRRLADTSTKIGVGANRAAVGSSMLQKYGHVDPCDAFCREKLACNRVASGKSAKIGVAILDDGMQXQHRSLLRDVEIVMVNGLTPWGNTHFIPRGPMREPLSALTRADIVVIHHADLACEAQLETIARTVQDSGTTCSVFFSKLAPSHIFEVHQPLQKRSLILSGGVIGPRVADRLDFSDHHFFNDYDLELIQERVRQLVDQHNKETVVLVTEKDYDRDPDVLRMLGVKVWVPSSSLQIMALKEQGEDELLRKLKDIITATRHVVQP

SEQ ID NO: 139941 - protein, 286 aa, Triticum aestivum
  Clone ID: PAT_TA_34359.pep
HASRLRVSRGFPEPPLSSSVGPAGRRRDGPGCRIFSVDSRNSSKFSLSLPSGGLALCLSLASCRRGGGRGCLRAASSGGRLLLPFVVHGGWRRRRWDPVSPFSISSLGSPDLEMWFLPLQLCSCRRGGGRWAAEAASISSRVATAVFFLDLISRCVPGGASARLGRLPVSVATLLFLVEGRPIEAVMALFFPPDAPSSDGRQPSASQAHAVVSSDLVKMAQRSRRPKWFVPGDGGFGVRLVLLQRTGLRFCSLFWGPLCKMQGLVCNFLFFRGPCVRCACTVCSYI

SEQ ID NO: 139942 - protein, 66 aa, Triticum aestivum
  Clone ID: PAT_TA_34360.pep
INYYPKYHGLKISAAGLIGSLGDGGPTAASQAYFSTVTETLPPPTLFFVTLTVGSSTFFPFLGVGP

SEQ ID NO: 139943 - protein, 235 aa, Triticum aestivum
  Clone ID: PAT_TA_34361.pep
MKDPAHRTKVVLRRLPPAIAQQAVVDQVDARFAGRYDWACFRPGNASQKNHRYSRLYLNFKSPEDVVEFAEFFNGHVFVNEKGAQFKALVEYAPSQQVPKSNIKKDARQGTITKDPEYLEFLELISKPTEHLPSAEIQLERKEAERAAAGKVPPVVTPLMVYVRQQRAAKSMAQRSVSSRLSRKVAGVVTSSSSPSKRSSERRRASTSTVLCLVENCHMKRILSFPPYVLSRPTH

SEQ ID NO: 139944 - protein, 459 aa, Triticum aestivum
  Clone ID: PAT_TA_34362.pep
DPAPAGSPARPSPPAPGEAARPPCPRTRGRARGRTRGRSRPRELKRHLNSLEERLLESMAWEKGSSMYNSLIVARPTLSAEINRLGLLAEPMPSLDAIAVHHDISLGGLPPLPFHKQPDKDEVRSPKRACTERRNVLVDNSFRSPVKDAIKSKFLPPLQSAFASPTRPNPAAGGETCAETGIGVFLSKITKLAAIRIKCLCERLQLSQQILERVYSLVQQIISQQTALFFNRHIDQIILCCIYGVAKISQLALTFKEIIFSYRKQSQCKPQVFRSVYVNWPSRSRSGKIGEDHVDIITFYNEVFIPTVKPLLVDLGPGTSPNRNNEPKSGGDAAPFPESPRLSRFPNLPDMSPKKVSATHNVYVSPLRSSKMDTLLSPSSKSYYACVGESTHAFQSPSKDLNAINTRLNSGKKVNGRLNFDVVSDLVVARSLSDQNGSSAAAMAVFGTKTPVKGEQQDP

SEQ ID NO: 139945 - protein, 175 aa, Triticum aestivum
  Clone ID: PAT_TA_34363.pep
ASQANPRASSSRARDQFNLCTWYICGNVSAKKRNHHIFLQHFDPASHEFLIYFCAIVRPRRLWQSHKDEYGLRSSSWFPSEFLLKVGFHDEVWNAMYMEILMEYDDGDVAQVDLMEFGWAGGGRRWTRVHELWGSICRSTTTYSHSVHWFCFHCHACSSSTCSRRHEITPALLVT

SEQ ID NO: 139946 - protein, 236 aa, Triticum aestivum
  unsure (1)..(236): unsure at all Xaa locations
  Clone ID: PAT_TA_34364.pep
RGFPSGRRTRTSVFPAAAPVSPATAPVSPATAPSAPPPVSPATPQPPPPPPLAPPSPPPPKAVDHRRPPPPAPASPPSTATSSPPSTSSASRIDRTRCELFDLHRQIVPLVDSWGWQKSIVERRKPLVGIDTDTDEDHSDTLITLQHPPVYTLGNGNSEKYLNFNIEDSPIEIHRIDRXGDVTYHGPLQLVLYPILNLRYQKKDLNWYQRSLETVIIRALQSAFSIKASTIEGLTG

SEQ ID NO: 139947 - protein, 366 aa, Triticum aestivum
  unsure (1)..(366): unsure at all Xaa locations
  Clone ID: PAT_TA_34365.pep
QIANVYLDTYVITGDEYYSSVARDILDYLRRDVIGEDGEIFSAAPADSAEYEGAPRKKEGSFYVWTSQEIEDTLGENAELFKNHYYVKSSGNCDLSGMSDPHNEFSGKNVLIERRPGSLMASKYGKSVDEYYGILGECRQKLFDVRSKRPRPHLDDKVIVSWNGLAISAFARASQILKSGPPGTKFYFPVAGCDPVEYLQVAEKAANFIKEKLYDASSKRLHHSYRNGPAKAPGFLDDYAFLINALLDLYEYGGKIEWLLWAVELQVIQDELFLDKQGGGYFNTPGEDPSVLLRVKEDYDGAEPSGNSMAAINMVRLSSIFDATKSEGYKRNVEHLLAVFETRLXELGIALPXLMCCAADMLSVPS

SEQ ID NO: 139948 - protein, 333 aa, Triticum aestivum
  Clone ID: PAT_TA_34366.pep
MNFPIAMYHIRALWQTLPCSTPKYTSKGKLSLDFENFHCLPLSPVADINGDIINGCSLVDCLKHFTVLEHLDNYRCDHCWHNAAAKYFSLQSEVDEEKVNKLRTCVDYDSCNCKHLFGPEKTTWSVSSKATKQLAITRCPKILCIHLLRASISFDGELVKRQGHVSFPLLLNLSPFAGGTFTTGQGPGPSAMNVQKYDTPSLKFYRQLNAHMPINMFPTGGNSSSQAPKDQVTNGGVHSLNEGNADVALSSSSPSPSASRMELYRLSAVVEHYGVCGGGHYAAYRRVASTPDANDQVGPRRKHWVYVSDDHVSQVSEDDVLGAEATLLFYERL

SEQ ID NO: 139949 - protein, 171 aa, Triticum aestivum
  Clone ID: PAT_TA_34367.pep
MARHFLLNTGAKIPSVGLGTWQADPGVVGAAVYAAVKAGYRHIDCARVYGNEKEIGLALKKLFQEGVVKREDLFITSKLWNDHHAPEDVPEALNESLDDLQLVLLDLYLIQGRFSGKKGTNNNPENIVTPDIPATWAAMEKLHDAGKARAIGVSNFSSKKLGDLLAVARVP

SEQ ID NO: 139950 - protein, 250 aa, Triticum aestivum
  Clone ID: PAT_TA_34368.pep
FLWRIGQLACVRAPTPFSTPGTCGWEGGVLVAVGFSLAFVIHESANPHIAVLGRLPGTTVYRNTLQYPEAYTYSGIVVVRVDAPIYFANISYIKDRLREYELKLPNSNRGPDVGRVYFVILEMSPVTYIDSSAVQALKDLHQEYKARDIQIAIANPNRQVHLLLSRAGIIDMIGAGWCFVRVHDAVQVCLQHVQSSSSNAIKLSPQASGNLTESPKAQQRYGFLRNLWKAQDGNGSAGDEAQSLLRQNLV

SEQ ID NO: 139951 - protein, 108 aa, Triticum aestivum
  Clone ID: PAT_TA_34369.pep
MACKRKAPAQTVLPRRPPRGDGAGRSPSGPRRGATRTSTPAWRARRRPPDRPAGAVARAEGDGGTLRTADLRCPCSYKNSPWLSLYNIDPKRAMELPAKCGLTTPPDC

SEQ ID NO: 139952 - protein, 217 aa, Triticum aestivum
  unsure (1)..(217): unsure at all Xaa locations
  Clone ID: PAT_TA_34370.pep
MKTTKGGKVMNPTDAFRKEQRRKELKRNKKERKKVREVGILKKDPDAIKDQIEKLEKMKADGALDKARKHKKRQLEDTYNLVVKKRKEYEEKMKEKGEQPVMFSHLGPPKRRPAADEDDRAKNPMPEDSVYYHPTLNPSGAPPPGKPPMYKSSIGPTIPLPSSVGPYASSSITESVDAGPSTMPXPAPXPXLPANSEPSDLSVPSLPFTPTTGPHPG

SEQ ID NO: 139953 - protein, 134 aa, Triticum aestivum
  Clone ID: PAT_TA_34371.pep
MAGDGDEEPPATGGDKLILRGLQFHGFHGVKQEEKKLGQKFVVDVDAWMDLAAAGDSDDIAHTVSYTDIYRIAKGVVEGPSRNLLESVAQSIAGSTLLEFPQISAVRVKVGKPHVAVQGIVDYLGVEILRRRGA

SEQ ID NO: 139954 - protein, 455 aa, Triticum aestivum
  Clone ID: PAT_TA_34372.pep
FLRTENTHTEDIRVTEINTRRVSAPKSKLAIQRELLALKKKALALRREGKVDEAEEELKKGSILEKQLEELESSSNRPVARENMVFSSKSPLIAEPPSLDFADEGYEPEVTDNDMQDPALLSVLKNMGWEDDDNDSVKTTDKPLNRSPVVAQKPKKNKGQIQKELLAIKRKALAFRREGKNTEAEEELEKAKVLEEQLAEIEELANSTASQKGSGPGEHETMENKYDIQHVPNVHATASSIRHALKEDVSLPVNAAEFSSGSKPQSETVTSKPAHKLEVTSDGAYSAFSRSPIADQLQTAEASHSPSDVDHKEPPKAHGDDTLRDDILLHKRKAVAFKREGKLAEAREELKLAKLLEKRLEAPQQDSEDGAHELATAAVQQSNSIQQSASVTTHTNPLTYAPPAQENKSVEPQKAMSSRDRLKNPTWNPPPPRAPELRERKTRNRNQLAKTTGDQ

SEQ ID NO: 139955 - protein, 127 aa, Triticum aestivum
  unsure (1)..(127): unsure at all Xaa locations
  Clone ID: PAT_TA_34373.pep
FNLLGRGLTRWGWEKPGGYQLNWLGRKSPFGKWGYYQKGPNGWPFQPVAQPDGEREPPLNGAFNRGGGXVTPRGTVTLARALRPVLLVFFLSFLARLAGFPGKVLIGGLLLGFRLRVLRTLNPKKLD

SEQ ID NO: 139956 - protein, 77 aa, Triticum aestivum
  Clone ID: PAT_TA_34374.pep
RAEQIPKEDDSKSFYEVYDVVLYLGIIDILQEYNITKKIEHAVKSMQYDSVSISAVDPEFYSERFLKFIQTVFPENS

SEQ ID NO: 139957 - protein, 178 aa, Triticum aestivum
  Clone ID: PAT_TA_34375.pep
AAASPWRAARQRKGRSRSRSKGWSTARIRRSASSDSSALIRPAASAACMLPAIAPSAPPPRFARAGRRTRTVAGGSGAGRARSNKSSRASNGRAKNGRTSTTDRKNGKGVESIPEQKGTRRRSSYRLCYIVPSFGWAGCFRTGCALRAAPLLSRSTSWGWIGLPVPRVPGPEELVPNS

SEQ ID NO: 139958 - protein, 162 aa, Triticum aestivum
  unsure (1)..(162): unsure at all Xaa locations
  Clone ID: PAT_TA_34376.pep
MLSSSCSVAACGVRAFRLLAVAAVRLPMLLFCDAMVWAVTFLTFPVRLLAAADRERKLERLVGEMQGQMERVVWENRDLEQRLRTALKENATMEGILDEMEEENEDAFARIDLLESQLKALKKXNMRLKEXRGKSVWDKAAATATAATVAVAGIGGGKNNLA

SEQ ID NO: 139959 - protein, 240 aa, Triticum aestivum
  Clone ID: PAT_TA_34377.pep
GGREGLVHVSQMASRRVANAKEVVKRDQEVFVKVVSVKGDKLSLSLRDVDQDTGKDLLPMQRGVEDAPRTNPSVGSAAAAGSGRRLGLSGIVITEEDEVAPISRRPLKRMSSPERWEAKQLIASGVLDVRDYPQFDEDGDGMLYQEEGAEEELEIELNEDEPEFLQGQSRFSIDMSPVKIFKNPEGSLSRAAALQTALIKERREVREQEQRAMLDSIPKDLNRPWEDPLPDTGERHLAQE

SEQ ID NO: 139960 - protein, 182 aa, Triticum aestivum
  Clone ID: PAT_TA_34378.pep
MMASRAAAALRAAALQGYFRRSASTAAAHAERPKAKPMGDYVPVYVALGMIGLAGALGLHTARQQLAHAPNVWVDKRKREAVPEVADPDLALDEAERFVGGSVFRKVAHVQDDRSLTAGVADPVTDYPARKAVTLKDVGVDPPGIPEQSREGRPRQDLQEEHRLISGRSRQQHASASVPFLR

SEQ ID NO: 139961 - protein, 320 aa, Triticum aestivum
  Clone ID: PAT_TA_34379.pep
MASAKATMGQEKQDHFVLKSGHAMPAVGLGTWRAGSDTAHSVQTAITEAGYRHVDTAAEYGVEKEVGKGLRAAMEAGIDRKDLFVTSKLWCTNLVPERVRPALESTLKDLQLDYIDLYHIHWPFRLKDGAHKPPEAGEVLEFDMEGVWKEMENLVKDGLVKDIGVCNYTVTKLDRLLRSAKIPPAVCQMEMHHGGKNDKVFEACEKRGIHVTAYSPLGSSEKNLAHDPVVEKVANKLNKTPGQVLIRWALQRGTSVIPKSSKDERIKENIQVFGWEIPEEDFKVLCSIKDEKRVLTGEELFVNKTHGPYKSASEVWDHEN

SEQ ID NO: 139962 - protein, 299 aa, Triticum aestivum
  unsure (1)..(299): unsure at all Xaa locations
  Clone ID: PAT_TA_34380.pep
MDYSNGSFFPSWPDNSASENYSFVDGSVESYAEEGSMPPAGYFRARSNQNLTFDEHEQNPAMLANGCLPYNTQTDLLSGEILSENKPSNSLMELPQLQNNGSLQSNLIPPGTLQCTSTPGTFDLQLDTPGLLELPHALSSSIESNGSEVSAFLADVHAVSSASTLCSTFQNVPSYMEPVSLEAFSFQGIQNAPMFNNTSHSNGKPXSVFDEATMASLHDSKEFLSGXASHLLGMAEQSQLAGSGLKAEXKEQNAMCNIPLPFASGSQMAVSEAQGALNPSKIGSTILHNRSPYPAPRKD

SEQ ID NO: 139963 - protein, 261 aa, Triticum aestivum
  Clone ID: PAT_TA_34381.pep
YIAAMYPPSQVCALLSTTAYDCTPMLVQYIASIAPGRICAMLPTTATDHPASGASPSSLASDSSQSNKLKSYISFWDRLTVAFLLGAMFLIATVKPRVDAAAKAEDRAASKDDKVYEAVLDELCKDHRYAARAQAEVHEATRCTFPASHALRPDVARRMRTRDDAVKAREEACKKVDDLRAVVGVARMGKVERFMVRCFFVLSILFSLSAGICSAAAFFRSAQLEKGGSMSLAAVIGTIAVAGVPMVLAHAHFLYVALYEN

SEQ ID NO: 139964 - protein, 105 aa, Triticum aestivum
  Clone ID: PAT_TA_34382.pep
MAKHQADLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKKY

SEQ ID NO: 139965 - protein, 105 aa, Triticum aestivum
  Clone ID: PAT_TA_34383.pep
NGRPFFFFFFFFFFFFFFFFFFFFFFFFFFIFFFFFFFFMSRRRNLHGAGPWHGPGSFFFFQVKHSLVIHIKCILHRQSRVLNHTTELVITEHIRDEFLYIKIIP

SEQ ID NO: 139966 - protein, 155 aa, Triticum aestivum
  unsure (1)..(155): unsure at all Xaa locations
  Clone ID: PAT_TA_34384.pep
MARGLKKHLKRLNAPSHWMLDKLGGAFAPKPSSGPHKARECLPLILILRNRLKYALTYREVQSILMQRHIMVDGKVRTDKTYPAXGFMDIISIPKTGENYRLLCDTKGRFRLHSVRDEDAKFKLCKVRSVKFGQEGXIPYLETYVSRTIALPDPL

SEQ ID NO: 139967 - protein, 72 aa, Triticum aestivum
  Clone ID: PAT_TA_34385.pep
MSSTEVASGECKKMSWPEVVGLTIKEAKEIILKDKPDADIIVVPVGSAVTEDFRPNRVRIFVGTVAETPHVR

SEQ ID NO: 139968 - protein, 125 aa, Triticum aestivum
  Clone ID: PAT_TA_34386.pep
RGLHYSRLPSCNHVFLRRFASARRPKCVAASGNGRQGLRASQYRFDDDEPLWLAVVREFAVSVRNLVVFLAEQPGQLKHLEWPAFRNTLRTAALTLILVVVFIVALSSVDAALSYIWSWLLRNSA

SEQ ID NO: 139969 - protein, 397 aa, Triticum aestivum
  Clone ID: PAT_TA_34387.pep
MATLGALMGQNNGPLEPCNSTEKGLLIGSHMDTVVDACMYDGALGIICAFSAPKVLRITGKLQRLTIPVEVIAFSDEEGVRFQTTFLGSAAVAGILPESILQVSDKSGTTVQEALRLNSFEATAAALGQVKYSPESVGSYVEVHLEQGPVLEALRYPLGVVKGIAGQTRLKVIVDGSQGHAGTVPMKLRRDPMVAAAELVVTLEGLCKDPSRFLTYDEECGCFTEESLAGLVCTVGELLTWPSASNVIPGQVNFTVDIRAMDDLVRETIVASFSRIVMQRCDHRLVDCAVEHKHSAAATPCDPELTAQLKRATRSAVSAMAAPGGHAAGAGESTPVLMSGAGHDAMAMARLTRVGMLFVRCRGGVSHSPEEHVAEDDVWAAGLALLRFLDQHAVAEL

SEQ ID NO: 139970 - protein, 249 aa, Triticum aestivum
  unsure (1)..(249): unsure at all Xaa locations
  Clone ID: PAT_TA_34388.pep
PSSPPWGARPSAPQWLSSPKSSPPRAPIPTSPPPATLSPPPTHSAQRLASTPLXHRRRGRLAASGPGSSPSPSPDQYPSEPDDGLVELPLFPLPLVLFPDATHALHIFEFRYRIMMHTVLDTDLRFGVVFAGSDGASDVGCVXGEVVKHERLADDRFFLICKGQERFRVARIVRNKPYLVAAVQWLEDRPPAETPSPGEDAXALAVXVEALMRDVIRIANRLNGNPXKEVXDLXRGXFPTPFSFYXANT

SEQ ID NO: 139971 - protein, 272 aa, Triticum aestivum
  Clone ID: PAT_TA_34389.pep
MVSFAVNVISVKVTESDRGYPISVYGTVVARDTIDYRCVYLFRRAREDPQIINSKDDMLKLIGPRRGLVQLDNIYFELNLRVKGDAGDEDFSKGVVVLHVGPYDPEPITRVLSSWLSRVELVLATVESPVAASLEVKVLKGAAPFSGKICAGTSENPKTQMIVYDSRDTKSGSSVVLTRNLVAVPDPDDDEDEIGVYVRFLDDGDDVDDEDTGTLVKLAYPAEEQLCCHRAWELQVKVSWTAILCKPMAKHVLTRGTSMPRDYTCPRYAPRF

SEQ ID NO: 139972 - protein, 127 aa, Triticum aestivum
  unsure (1)..(127): unsure at all Xaa locations
  Clone ID: PAT_TA_34390.pep
CGCGPRGPXXCXXXXGGAIDQASPLTVSIQPPPLLGTPPICDWETEHRSHESARNPARDRITRAYAASRRARGRRPIPSSPAAEGISSPVAAHELPTSRPGRGAAGPNRACGRTNCARRPNPRAMEA

SEQ ID NO: 139973 - protein, 233 aa, Triticum aestivum
  unsure (1)..(233): unsure at all Xaa locations
  Clone ID: PAT_TA_34391.pep
MAEEATRAVREEELSPVAEGAPVTARRPVRADLEKRIPKPYLARALVAPDVYHPGGSKEGGHQHRQRSVLQQHVAFFDMDGDGVIYPWETYQGLRALGFNMIVSILIAIGIHTTLSYTTLHSWVPSLLFPIYIDNIHRAKHGSDTATYDSEGRYMPVNFENIFSKNASPDKLTFREIWMMTDGQRQANDPFGWVASRXEWMLLYMLAKDEEGNLPXREAIRRCFDGSLFESSP

SEQ ID NO: 139974 - protein, 267 aa, Triticum aestivum
  Clone ID: PAT_TA_34392.pep
MAEEATRAVRRRGTHGGAIGPSAIAAAARAVREEELSSVAEGAPVTARRPVRADLEKHIPKPYLARALVAPDVYHPGGSKEGGHQHQQRSVLQQHVAFFDMDGDGVIYPWETYRGLRALGFNMIVSVLFAIGIHTTLSYTTLPSWVPSLLFPIYIDNIHRAKHGSDTATYDSEGRYMPVNFENIFSKNARSSPDKLTFREIWMMTDGQRQANDPFGWVASKGEWMLLYMLAKDEEGNLPREAIRRCFDGSLFEFIADERRQPHGKRQ

SEQ ID NO: 139975 - protein, 96 aa, Triticum aestivum
  Clone ID: PAT_TA_34393.pep
FILLLSDLLYLSPSPLFPSLSDLVQQPLWIKFLVEMQRMLKVIHQGGPPPVEGWLLSKKGHPWVMAGDQEKNKQFYLKIEELAPKSPSPPPRSNSI

SEQ ID NO: 139976 - protein, 232 aa, Triticum aestivum
  Clone ID: PAT_TA_34394.pep
MASPQEPKPLCLKRKLVDNCLSKECKSRRVVVDNGPSDPSAKRCKCCCTRPNLASDCVNYLKSGVPSRIVFYKQDSWHNFPELIMKSLIEGFKGGKSSVVAVMDDEPVLVDFLSMSLVNLQTRKQRSVAWYDDTGKGFFPSLFFDEEGDETANLDSSNVEDGAQGIMLDKAVSSPEEVVKQVVLESGPPGPHKPSTADILRKKITSVERGSEDFLLVPEPFSLWYGSVCNTE

SEQ ID NO: 139977 - protein, 151 aa, Triticum aestivum
  Clone ID: PAT_TA_34395.pep
YGSHDTICPSRHKGGAKEDILVGAFEQLIDLLAQEALPVGEGPVYINNLLRCAWIEWMMQQKNREDDTFGSGVVQAGPCMVHDKQTCLLLVKIIEICGGRTAEASSMINTMDGAWFIQLASSICDNLHHKMLLSQDTKTNETAMSHMNEKI

SEQ ID NO: 139978 - protein, 456 aa, Triticum aestivum
  unsure (1)..(456): unsure at all Xaa locations
  Clone ID: PAT_TA_34396.pep
MALQGKNLINNPDDVVTEFIEGLVETYPGLQYLDGFPEIKVVLRADAVGVAYDKVAVISGGGSGHEPAHAGFVGPGMLTAVVSGDVFASPPADSILAAIRAVTGTMGCLLIIKNYTGDRLNFGLAAEQAKSEGYKIEMVIVGDDCALPPPRGIAGRRGLAGTILVHKVAGAAADAGLSLADVAAEAKHASEAVGTMGVALSVCTLPGQVTSDRLGPEQIELGLGIHGEPGAAVVELQTVDVVVEHVLKQILSQETQYLPITRGSNAVLLINGLGATPVMELMIAARKAVPELQLEYGIAVDRVYTGTFMTSLDMAGLSITIMRSDENILQRLDAPTKAPAWPVGSEGNRPPAKFPVPVPPSPSMKDDEILSERQELSKQGCMLEAAIEAAAKELIDLKDNLNDWDSKXGDGDCGTTMYRGATXILEDMKTRFXSERATGTLNEMGQHPEXDGGTSG

SEQ ID NO: 139979 - protein, 236 aa, Triticum aestivum
  Clone ID: PAT_TA_34397.pep
GTRQKAKLLLSSGLNHRDEVPSETDNYMDALNTLESETETEVDFQTKKRGKPVHSFNAHAPQIESADNIVSLPDSSPAEFPDTSPNSRMLHTFERTADFPSLSSADASDISQHTLSGYTDIHPNEWSSVTTIPENNENDAAGDPTEISEPAPQAYTATPPNERSPHANEIPESKAEVAPRDSPEISKPGLSTYAVFPPNKESVVNQIPENNVEDASEDGTVESISCLVQEPAISFA

SEQ ID NO: 139980 - protein, 256 aa, Triticum aestivum
  Clone ID: PAT_TA_34398.pep
MSNLSDAAAGAGGGDALFSRCLLALYVISPVTVFLLRFVSAPYGKLSRPGWGPAIPAALAWCAMESPTLWLPPLVSPLPLLLAAAAASGSPLAALPTALYALHYVNRTVLHPLRILRLRRAAAPVPVLVAACGFGFNLLNAYVQARSWALHAGRPASAFALARCLAGLALFAWGMRVNVAADKELLRLKEAGGGYKIPRGGWFDAVTCPNYFGEIVEWLGYCLVAWSPASWAFFLYTCANLMPRARDHRQWYLNKF

SEQ ID NO: 139981 - protein, 124 aa, Triticum aestivum
  unsure (1)..(124): unsure at all Xaa locations
  Clone ID: PAT_TA_34399.pep
MECSSDESSELSDTDIDDYAEKAYTDLKSGKLVARFGADRFRCPFCPGKKKQDYRYNELLQHAIGVGASNRAAKVKANHQALASHLKTDHADAAGSLPPRQAEALINPSKPVQDQEXFVWPWMG

SEQ ID NO: 139982 - protein, 283 aa, Triticum aestivum
  unsure (1)..(283): unsure at all Xaa locations
  Clone ID: PAT_TA_34400.pep
PCWCSRIVATARGRGADQPSYPNTGPRAVDKANGGVWSLVDQHKXEKEAALNKVYLLXKQLDEKHQLELDIQQLRGKLEVVKHMEGEGVDVKKRTEELNKDLQDRIDAMEXWQELNQALIIKERMTNDELQDAKKELISGLVDLLGPRSNIGIRRMGQVDEKPFIEACKPKYGAEADTKALEFCSMWQDNLRDANWHPFKIVTRGEKSEQIIDKGDEKLVGLKEELGEEVYKAVTTALVEMNEYNASGSYVVSELWNNKESRKASMGEVVEHILKQWKAKRKR

SEQ ID NO: 139983 - protein, 121 aa, Triticum aestivum
  Clone ID: PAT_TA_34401.pep
PAAPPGSFSPDAPPVEYSVSSALLMSDPAPPISPWSAWGSILGRSPVTGSPCPVRLLRSVVILPRERGCAAVVEMNRAAFGRCRSRYALGAGASFYHGNQMLLAPDLDDQTCSQLLIWKHE

SEQ ID NO: 139984 - protein, 236 aa, Triticum aestivum
  Clone ID: PAT_TA_34402.pep
MAASCHDVDVPGKPTETGTALLEAATGAIQGFAPINQIHQHLCAFHFYGDDMTRQVEAHHFCAHLNEDVRQCLVFDGPDAGARLIGVEYIVTEELFLTLPDEEKPLWHTHEFEVKGGMLFMPGVPGVVERRDLEQVAKTYGKTVHFWQVDRGDALPLGLPQIMMALTREGQLRQDLADCVEKKFSVSFQKERENRAYMSGPAHGIHPLANAAGKGLKTEIREVDLPAANTGARIFT

SEQ ID NO: 139985 - protein, 123 aa, Triticum aestivum
  Clone ID: PAT_TA_34403.pep
MSPLSELVWSPDDGLSIKIAASSLSTRKASLRWNADTLNIVISSPQQSGGKSGDNVDATLRDAGEMPSQPRTRSDSSVRVSAASPNRTRNLDAQQSTSIRPQEQDSKCSGGISEMSEGEELSD

SEQ ID NO: 139986 - protein, 172 aa, Triticum aestivum
  Clone ID: PAT_TA_34404.pep
MQESVEERSECVVLSSARVQAENGVCESNPGSDHDTSADFSAVSKSEDCLDTSQQDNENEGLSEVSHEQDDFQVQEGTVEKTTLGSDLPEFSKSEDCLVTSQQDNEDEGLTKASNEQEQVATGQLDLEAASIMEDADSEEVAYDEENKKPVHPTDINSLCQKINVSGPVEHA

SEQ ID NO: 139987 - protein, 190 aa, Triticum aestivum
  Clone ID: PAT_TA_34405.pep
LCRERRHVGVECLSPEEKLIILERRQKSGQVKGDIQKVVDEVRSIKEILKDAKQCPRCKMAISKIEGCNKMTCWNCGRFFCYQCNAAISGYDHFKGDCVVFDQEEIDRWEMQMNQRQQRQVVAQAQAEIFEGEYGYPCPTCRNPIPKIGNNNHLYCWACQRHFCALCRKVVLKTSQHFGPRGCKQHTADD

SEQ ID NO: 139988 - protein, 153 aa, Triticum aestivum
  Clone ID: PAT_TA_34406.pep
YRLAGHLTARSDVYSFGVVLLELLTGRKSIDKSRASREHSLVDWVRPKLSDKRRLHQIIDPKLEGQYSVRAAHKACSLAYYCLSQNPKARPLMSDVVETLEPLQSGGGSDGAVVQAGGLPDYRVRRGLTGNSVHCRAIPNPKCSPAVPACRVR

SEQ ID NO: 139989 - protein, 59 aa, Triticum aestivum
  Clone ID: PAT_TA_34407.pep
LAPYKSFFLFMLAFFFFVSFLFSFPFFFFFFFFFFFYKLHVKSLKTNFLKLLTKHSTWC

SEQ ID NO: 139990 - protein, 182 aa, Triticum aestivum
  Clone ID: PAT_TA_34408.pep
APRPRPWRAAWRLAPEPARQRARRGRRWRRWSPATRASTPWTGCSATSSGSTWARPPAPSSSSIPPTTSATLSPCAAANAPPPTAVDSVRKTHEENSRRVVSAALDGCRQKQRAAPAGVVEGDAKEAICPAVEEMRADLLVLGSRGLGMIKTALLGSVSDYLAHHASCPVLIVKPPNNAHHK

SEQ ID NO: 139991 - protein, 204 aa, Triticum aestivum
  unsure (1)..(204): unsure at all Xaa locations
  Clone ID: PAT_TA_34409.pep
MAKQLRVYQVWRGNNIIWCGGRLIFGPDAKATLLSFSLIVAPVVVFCIFVGKNLIHIFPAYNAGYAILVVTVVLTIHVLLLLFLTSSQDPGIVPRNSNPPVEEFSHDSSAPHTLQFPRIKEIMVNGVPVRVKYCETCMLYRPPRCSHCSKCDNCVERFDHHCPWVGQCIGQRNYRYFFWFVCSAAILWFYVFTMSAXYISLLMK

SEQ ID NO: 139992 - protein, 261 aa, Triticum aestivum
  unsure (1)..(261): unsure at all Xaa locations
  Clone ID: PAT_TA_34410.pep
DILVKEMVMDQRARPSDRTKTPEELAQEEKERLEKLEKERHKRMLGTAESSDEEDDDSEDGDHHMRADNSKPISGDDLGDSFSFDEPTKRKKGWVDEIYENEGRKIGEGVASGDEGSDDSGEDEDEDEEDAGDEEDSSDDDFRNMPARDWEQSDDDEVAVEEDEKDDVKDKEQVIGEKVMKTNAQNLKRVSNAKQKSHGKDEDLPFVIEAPNNLQDLCSLVDGRSXTEIAEIISRIRTCNSIRLTPENRKKMQVFYGVLLQ

SEQ ID NO: 139993 - protein, 339 aa, Triticum aestivum
  Clone ID: PAT_TA_34411.pep
KVMPQKLFKEPVRIAEKYPAGQEGDLKKKYMVCTNWLLSEEPLDVETELALGFLDHLLLGTPASPLIRILLESGLGEAIVGGGVEDELLQPQFSIGLKGVSEDNIEKVEELVMQILKNLAEEGFAPEAVEASMNTIEFSLRENNTGSFPRGLSLMLRSMGKWIYDMDPFEPLKYEQPLQQLKARIAEKGSKAVFSPLIEKYILNNVHRVTVEMQPDPEKASRDEAAEKEILKQVKSSMTQEDLAELARATKELKDKQETPDPPEALKAVPSLSLQDIPKKPIHVPIEVGEINGVKVLQHDLFTNDVVYSEVVFDMGSMKKEHLQLLPLLCPSPVRIGSA

SEQ ID NO: 139994 - protein, 98 aa, Triticum aestivum
  unsure (1)..(98): unsure at all Xaa locations
  Clone ID: PAT_TA_34412.pep
PTRYPGVVSTIEAKQPSSVILKCACVHHLMKNGXKIADFVPNDGCLNFVEQIDEVLIAEFGLKRHVVGDIPCGRFKVVMVSGVSQRDLFLLLTVTIKV

SEQ ID NO: 139995 - protein, 126 aa, Triticum aestivum
  Clone ID: PAT_TA_34413.pep
SPGRRKAWPEFAAWQREEEEHRPSTMWPEMKAWASMADDPLKRASSSAPSPPSPMRRFSPPPMAVGGLLTVAPRRLLHVHGQGRQAARARPAQRAPGSAHLRSRHRRPPPLREANAVQLSVLAAAA

SEQ ID NO: 139996 - protein, 199 aa, Triticum aestivum
  unsure (1)..(199): unsure at all Xaa locations
  Clone ID: PAT_TA_34414.pep
LLFACNALLLWXAAVAVKAGHLSLVTALKEYIVFSFATFALVEPFGLAPYILKRRKSLTSVFEIIDRVPKIDPDDASGLKPPNVYGSIEFRSIDFCYPTRPEMMVLSNFSLKVNGGQTIAVVGVSGSGKSTIISLIERFYDPTAGQVLLDGRDLKLFNVRWLRSHMGLVPQDPVIFSTTIRENIIYARHNATESEMKEA

SEQ ID NO: 139997 - protein, 95 aa, Triticum aestivum
  Clone ID: PAT_TA_34415.pep
MAKRNTVGLLLVLAIMFSYNVLEGGAHQSQVVFSRKVTNAEHKASFSGMTSSLGGRVSGATNAGGVRNNAEIANVETTTTIESHRDVSVGDFPWY

SEQ ID NO: 139998 - protein, 406 aa, Triticum aestivum
  Clone ID: PAT_TA_34416.pep
EDLSLGRRKGIDDFEAISARRDTEIPLLHEIIFSSNDKPKLLSQLSTLLSDLGLNIREAHVFSTTDGLCLDVFVVDGWETEETDGLLQQLKETAKRNPSLSNLTSSASERISELQEKIGESEFDRDLLQIVEKIASGSSGDLYRGTYLDVDVAIKFLRTEHVNDNSKVEFLQEIMILRSVNHENVVRFYGACTKQRKYLIVTEYMAGGNLYDFLHKHNNTLELSLILRIAIGISKGMDYLHQNNIIHRDLKSANLLIGDGQVVKIADFGVSRQRSQEGDMTAETGTYRWMAPEVINHKPYDHKADVFSFAIVLWELVTSKVPYENLTPLQAALSVRQGLRLVIPSGVHPRISKLIQRCWGENPHTRPVFSEITAELEDILQPIQAASSSKGGHRHTKQKIQMKSQR

SEQ ID NO: 139999 - protein, 155 aa, Triticum aestivum
  unsure (1)..(155): unsure at all Xaa locations
  Clone ID: PAT_TA_34417.pep
GTSPRIRRGYSTMIATVQDRGPFRSLAEALAALREYAPRPKSSLPGLLRFHSAEAYGQVFPLMGESLLFCTPWSGWKYHMALKGGFFHVYPPHIGGPFRGLSEAVAAIERHRASLAPPPAAQASLALLXXCRGFPCSAACCRTFTCRGACCRAFP

SEQ ID NO: 140000 - protein, 499 aa, Triticum aestivum
  Clone ID: PAT_TA_34418.pep
MAAKQPLAAAPAAPRAPRIPDSRFFASSLGVPHIDVEDVIKRLPALRALRSADITEGARLLGGRGCSPTEAKGYAARGSPAIPPVAASPPEGASKGALKERLGDVSDIGKKAAAKNKWIGFEKGNKDLVLRKVEDTRDELQEQLRRLENGEVIADKVIDDLKRRKLVTKEKSIWYSLKKGPEFVAKRKTLATDVTREHLKSGDWKDLEFKDYNYGAQGQPIAIGYSQPLLEVREAIQNIFLEMGFSEMPTNMYVESSFWNFDALFQPQQHPARDSHDTFFLKAPATTTQLPDDYLEKVKQVHQSGGHGSKGYGYDWKRDEAEKNLLRTHTTAVSTRMLYKLAQEKTFAPKRYYSIDRVFRNEAVDRTHLAEFHQIEGLICDYGLTLGDLIGVLEDFFSRLGMSKLRFKPAYNPYTEPSMEIFSYHDGLKKWVEIGNSGMFRPEMLLPMGLPEGVNVIAWGLSLERPTMILYGIDNIRDLFGPKVDFNLIKSSPICRLGL

SEQ ID NO: 140001 - protein, 160 aa, Triticum aestivum
  unsure (1)..(160): unsure at all Xaa locations
  Clone ID: PAT_TA_34419.pep
LVPAAGRRRRAAVPGVASPRAAVAFDHPESVXLANEPVSVKSGQHIVEVKPQSVSARDLSPEKILSMLTEKKRQADFVLCIGDDRSDEDMFEGIADIMRRSIVDPQTSLYACTVGQKPSKAKYYLDDTNDVLNMLEALADVSEEVGSPEESEILSPSEGA

SEQ ID NO: 140002 - protein, 319 aa, Triticum aestivum
  Clone ID: PAT_TA_34420.pep
MVKLATARDCRAYSLGATGGETSRNRRWEYINAGVYVFAAVLLVAGFLAQLWPWAVSTKAGLAVAVVGLLGVLGANAHDLLAHVAGVDYNLGLAGLDTQFVLVELAAPAVQLAGAALTLVALILFEIQMERGHRRGLERHGLNLLIAGPALWCLGSIHNMCQVYERANGHVQILQKSVHIPFLLGSTLFFIGGVVNRNDVHGRSSHSSTLLGRSWAWYCLFGSLLFLAGGLLNLLKVFKTRPAGARGLVMLRGGALERLSRESEGKVPLILEEGRMGKHGGNVGDTWAPGPAPRHEPRAPPVPPPPEGSYKDAVVSGGN

SEQ ID NO: 140003 - protein, 227 aa, Triticum aestivum
  Clone ID: PAT_TA_34421.pep
RGPSAVMMYREQQQQQHDHILSRTPPDANASANAHGITGRIPHGDQHILQFAGGRTLIGEHHIHPSTGARIPHKGQRQQETCLADISQGDQRWQGHASRNLSAGTVLEMLGKMPMKEKHQVTAPSSSSVDMDVRGDRGKKFLAEATGLEVGVGEVGFEHGVHGRVVVDARNFKVSCQNSEVRFAAKKDEDDADSKEEDAIIEQLMDTMVIDGNDEAKGMVMRDSGSR

SEQ ID NO: 140004 - protein, 263 aa, Triticum aestivum
  Clone ID: PAT_TA_34422.pep
ARAKYAVMALRCAAGAGGGAYLTPRRSRCCGVGSARPSATTRGTRGLSLLLRIPSSQYSKAPWALRCSPDSPPLEGDQHSDRTGAPGALKAMVCDMFRPLARNISDIRSLRTVFDLEDYQVGMLFGAFLGCVGCYQLWKAAPSIFVDAALAYAFYKLSVVSSEVRRQGKCNDLLTRLKFGIVVIMATKDFRKNYELLDIVKMPVFFLYLSTFIFDVARMKKYAKHYLILTVNLLRMKGGAQELFRIMFYPSYTSPYDDCFRRK

SEQ ID NO: 140005 - protein, 193 aa, Triticum aestivum
  Clone ID: PAT_TA_34423.pep
LPRTVLHLTEITKNRSPPQGNFQGSRQQQVRGYAPQQNYSQAGQDGRGYGRNDSAVRPGYNAPGGYQGRVTEAGQGFQDPQERRSFSQGQEGDLRPGGPSAPGNYGQPPAPGNYGQPPAPGNYGQPSAPGSYGKPFGPPAYGQPSGSRYAGGNQGGPGYGGDNRQGAAPAYGGDNLQGVSDQYPSPGEGQQGN

SEQ ID NO: 140006 - protein, 87 aa, Triticum aestivum
  Clone ID: PAT_TA_34424.pep
QLVSFTLPTSQTWAIHNTTLLQYHIKQMMCHLLPLSHNVRRFFTLVHYGTEGVNSYRINKCNYTNSLLEREQPNVCLLGLVYQEIPT

SEQ ID NO: 140007 - protein, 307 aa, Triticum aestivum
  Clone ID: PAT_TA_34425.pep
MAKAEAEAEVDSYINYMLMQRREAMRKVDEARERMKRGGPGRKMKKRKTETGKSSKKAAAVPVEMSVSEVGSSPAESEDLARTREIVEAAMAKILARMKGIVIKEPVKTMTEEDVAAAAVYRAKAEEARRNEDRPEESSALRKWIATGDPEAVKCRKRWIAEDMEALRLKDMDPDEDTSDWRAFEAKEFREFWEYLYPKSFGNFKDNTRIPNMLYTDKKSSGGTAHPIRTLQVFSVKVAGLQDGVHWPLQVFGVVAARDCLDHNRNVIFQRERDNCQMIHKENPYLTLTGPSRAIVVVDPVWFWRLL

SEQ ID NO: 140008 - protein, 134 aa, Triticum aestivum
  Clone ID: PAT_TA_34426.pep
MGPLYKLWGQAVGGPQPGARPGRRRQPPPRPRPPQRNRVAPGGGLVIPPTTTARGEDAPMKVTRSIMIKRPAGYPSSPRGAASTPPASPLGTTPPLSPFAGGGGRFRRKSSSDAYERATPPGASTSHPPPPFEV

SEQ ID NO: 140009 - protein, 127 aa, Triticum aestivum
  unsure (1)..(127): unsure at all Xaa locations
  Clone ID: PAT_TA_34427.pep
RCGRALERRRGASAGGGGAGAXGGTSSAAAAAAMPWRSHQGSGPPGATGGGGGGLVSRIWWSARKREKTLSAAAASGLAARGPGWRNSSQTSPSSVLGADLYLRRPEEFIGGGGWFRSLDAGEPYIS

SEQ ID NO: 140010 - protein, 119 aa, Triticum aestivum
  Clone ID: PAT_TA_34428.pep
MDDDGSLSIRNWGFYETMKGNLGLQLMPSVAGGHRDTKPLLPNGTFLQHHNAPHHPPHSHHPRDYGNGEPSGGMPTEPPAIHMDFVRNEAWMHPSQHQHQQQHQHHHPDQHQQQHQHQH

SEQ ID NO: 140011 - protein, 103 aa, Triticum aestivum
  Clone ID: PAT_TA_34429.pep
SRYRWVWRSTTGQRRRPDGEEDESLSLPTSASAPTPLTRALPPLPLLHLLQCLTPIGLVCLPVMQVLLAWPCFQPLSLSLLCASPSIATGCFIWSIVRFAIHD

SEQ ID NO: 140012 - protein, 252 aa, Triticum aestivum
  Clone ID: PAT_TA_34430.pep
MDIKVVGITLPVMEQALLQARDGRKHILNEMLKCSPPPCKALSPRAPLIRLVLGDPNKGSLWSGSGGCTTTRPLEETGVYAIDARDDGTVKITARDMESLEKSKNIITNLTMVPKVGEIFRNCEIKTIAPYGAFVEIAPGREGLCHISELSSSWLAKAEDAYKVGDRIDVKLIEINDKGQLRLSCKALLPDANQEPGSIKQQTSSSVKEKVVYKDDIIKMTTRRSKRKKEVEPSAAENATPKTLENSTADSP

SEQ ID NO: 140013 - protein, 311 aa, Triticum aestivum
  unsure (1)..(311): unsure at all Xaa locations
  Clone ID: PAT_TA_34431.pep
PKQELDNKSLLCMEFLSRSSSSDAPLVAFGASDGVIRVLSMMTWKLXRRYTGGHKGAISCLMTFMSAAGEVHLVSGGSDGLLVLWSADHIHDSRELVPKISLKAHDGGVVAVELSRVMGSAPQLITIGADKTLAIWDTVTFKEIRRIKPVPKLACHSVASWCHPRAPNLDILTCVKDSHIWAIEHPTYSALTRPLCELSSLVPPQALAQHKKLRVYCMVAHPLQPHLVATGTNIGIILSEFDPRALPAVAPLPALTESKEHSAVYIVERELKLLNFQLSNTANPSLGSASEAGRSRSESIDQLIVKQSKKH

SEQ ID NO: 140014 - protein, 133 aa, Triticum aestivum
  Clone ID: PAT_TA_34432.pep
AGRRPGQLIPGINQDAEAKLFVGSQVRRRTQTQVIEANRANLLSACTCTNAHPDGPRWTDRVVRTLPGWFIHEAAPPQGALCTETGQAIQMYTYLLAIIITPVLCFSSNSGQPREAQPASFEDSSSSSPLKRL

SEQ ID NO: 140015 - protein, 328 aa, Triticum aestivum
  unsure (1)..(328): unsure at all Xaa locations
  Clone ID: PAT_TA_34433.pep
HEPAAHVALGPLRSACAGWAPRPRCPRRCGVLPSCSQAPLLVCSPAFDRALSLSSLLLASDGWVILLRLPLPDSASVLEKMRKIKRDGGDLTRSLHGNKRAKSVVTTSKESCLEIREPIQISGDLDGDSNQDVLTELSDEVKSNLSKSVASLAVCSGDTVLFACSGLAIERHGYVTRFVTSAELALVFNNEKYKEKRHNVKIEVRHEGSEVYQGFLATYDVDYNYSVVKVKTFLDVNVGLIEHAVGILPDXKVVALGRGTCGELMARSVMLADDLSVCEDXKDPVSSMLNITKAWQGGPLFSFDGNXVGMNLFLIMERAFFLPGGVLL

SEQ ID NO: 140016 - protein, 359 aa, Triticum aestivum
  Clone ID: PAT_TA_34434.pep
MLGGGVSFSFSDVLTICGLLAVQCIFGLYMMFLNRLLVAGVPSLFIIVVACAASSVVVLPFAIALERKKWPKRWSPVLIIQLVMISLGGVSIYQVLMMLGVERTSPAIASAMPNLGPGFIFVIAACLRFERFEWKCKYTRAKILGTLVCISGAMCVSFLKNPDPGRVPESVPRDQELSGMKIDRDWVLGCVYLLTGVTVFACNTVLQAATLKRFPAPLSICVITAMMGSIFSAIIQVIMDGKLGAGTTGNIPRIIAEIVLVGGVVIGLCTTFQVSSIGRKGPVLVSMFSPFQTAFSAFISFIFFGQWIGTGCLVGIALMFAGLYVVLWAKNREDKMFAELALPSDSDATESDIERPFLQ

SEQ ID NO: 140017 - protein, 396 aa, Triticum aestivum
  unsure (1)..(396): unsure at all Xaa locations
  Clone ID: PAT_TA_34435.pep
NDTIGVIPKNSWSIDPFGYSSTMAYLLRRMGFHNMLIQRTHYELKKELARKQNLEYLWRQNWDIEETTDIFVHMMPFYSYDIPHTCAPPPAPGRPSRPARMRGFSYESCPWRYDPVETDSNNVQERATKLLDQYRKKSTLYRTNTLLIPLGDDFRYVNTEEAEAQFRNYEKLFDYINSNPHLNAEVKFGTLEDYFSTLRDEAEKINYTRPGEVGSVELQGFPTLSGDFFTYADRNQDYWSGYYVSRPFFKAVDRVLEQTLRASEILSSFVLGYCQKFQCAKLPISFSHKLTAARRNLALFQHHDGVTGTAKDHVVVDYGTRMHTSLQDLQLFMSRAVEVLLGDVYDRSDPTILSHFEPLQERSKYDVQPVHRVLNPHEGKTHSVVFFNPLEXTRDE

SEQ ID NO: 140018 - protein, 212 aa, Triticum aestivum
  Clone ID: PAT_TA_34436.pep
SYAPTAATSNHLPPPELDPPPPQSPAKLPANCSSSPPPIPLQSSPPPPIPTPTADLVSPSSAPSPPPADLPPHLVHPPMETSFSTDPHTHPRPPMDGWMDGAHQFRRRRRRIHTHLHNGGRPHRDPSPALGLVRHSRPHWRLLLRWPSTTAHLWRDLDAQGMHPWLVTLHAALAGGWLAGWTGIRDAGVCSLISQGRRLLKCVHAKIPTVPD

SEQ ID NO: 140019 - protein, 74 aa, Triticum aestivum
  Clone ID: PAT_TA_34437.pep
SLKSSFLSILFFKIHFHFTQSCPNAFSINHSKRSICDLLPPSAHIFIYGCCSLSFSLSVCVCVCVSVCVCYSHV

SEQ ID NO: 140020 - protein, 150 aa, Triticum aestivum
  Clone ID: PAT_TA_34438.pep
KEKKLCLNFSFFYFFLLFVKSAQTMVKLLIQEVLVLLNNYSRILVLLNNYSRILVLVNNYFSFLNFGQIWSVMFETTVKLIIQEILVLLNNYFSFFEFRPNQDRPGPDEGQTTYSSNKGVIGGLGFGGRPGPAPAGPELTIDLERPPGQV

SEQ ID NO: 140021 - protein, 238 aa, Triticum aestivum
  Clone ID: PAT_TA_34439.pep
YSTTEAAPVPRSTHARISKKMSRASFLGSYFPNRSRASTPARNTRNRTSPKFGKKRGITHRSGEAGRGAWLLGVSRLQGASGPRRGTGGGGKKCRRVGWRRGTKKRSEGHGRLSFSRLLVCLARGRVAPRFLRRFHAWCAFLGARSVVCRHRPWKVERTLCGPSVGHGLLDAHTVRGEEDGRLSPAQASAGEIPESHRLLVPAADRILLCCRRRSGGGGRETSARRSWALTQVTRRDL

SEQ ID NO: 140022 - protein, 109 aa, Triticum aestivum
  Clone ID: PAT_TA_34440.pep
TRAPAAPSPPRPPPPPPVALPAPPHPPASEAHPPPAPSRRRRPGRRLGRVGGPPDSMMTTRTPFPDAWAKACMSDVQAKLYRCRLHTLEIANSVDDKYYDLGLRKKINT

SEQ ID NO: 140023 - protein, 111 aa, Triticum aestivum
  Clone ID: PAT_TA_34441.pep
SDIDYQATQNNQVTLAVAMCKSANRCSRCSQPWVIGPCLIAGISTTGKRSTEDSCLPFLFWCEIAVKLLTYDSYQGIREFSNWVCFCFSLIYVSTVGVALWQYIFFALLKG

SEQ ID NO: 140024 - protein, 66 aa, Triticum aestivum
  Clone ID: PAT_TA_34442.pep
FTSPLYVSWMDICDGWLSLLKQELLMMTTFRAGLPLVLLMLICMFSFVFPSPFYCIIYGCCRINVN

SEQ ID NO: 140025 - protein, 372 aa, Triticum aestivum
  unsure (1)..(372): unsure at all Xaa locations
  Clone ID: PAT_TA_34443.pep
MSDILAVALGGAAGGLALVGAITLIVVLCLRHRRRNSDSSESNSSGQALSDVQGARCMTLEELRSATNNFSSSNLVGHGMFGEVYNGLLQDGTXXAVKRRHSPPSQEFLHEVNYLSSIRRHPNLVNLLGYCQDNGMQMLVYQYVPNGSISTHLHGNGNSPTVRLEFKQRLAIAHGTAKGLSHLQSMTPPAVHMNFKTANVLVDADFLPKVADXXIRGLLDRLGNAGPPPMIFNDPLVDPRGKESMIFSIQSDVYSFGVFLVELISGRTAASDQGIIEWVQNFQESXSDISTIADRRMTSGFTPQGMKELLRLALRCVNPTSENRPSMSLVEAEIHRIRKQEIRRTTGMPLGDTTVTLCSQLFTSARWKNMGN

SEQ ID NO: 140026 - protein, 211 aa, Triticum aestivum
  Clone ID: PAT_TA_34444.pep
MANRTDPLARSIHGTNPQNLVEKIVRAKIYQSNYWKEQCFGLTAETLVDKAMELDHTGGTHGGNRRPTPFLCLALKMLQIQPDKEIVVEFIKNEDYKYVRVLGAFYLRLTGTVADVYQYLEPLYNDYRKIRQKLSDGKFTLTHVDEFIDELLTKDYSCDTALPRIQKRWILEASGTLEPRRSALEDDFDEEEEDKEDGQPMDVDEPNTREK

SEQ ID NO: 140027 - protein, 122 aa, Triticum aestivum
  Clone ID: PAT_TA_34445.pep
APHPLVPPHPPTPNPRSSRRRRLLRPARRTAAIHFPGVVAIVLTCTGRRSAPTIFSPPPLITSQDKEGHRGQAGQATRPDHQGTARRPWRDRAEQVLSLSWIAASRVLPSVVTNASCNVSLV

SEQ ID NO: 140028 - protein, 132 aa, Triticum aestivum
  Clone ID: PAT_TA_34446.pep
GLLRICFGRKPLTEPPQDSSPGIVISIKNMDDWQLRWDNFARYNKLLVYSFYDKNSPLSKAMDKLLEKLPNQYKGKADFCKLGVDNFEFLAGLCGVEGAYPTFVLFKKCKQVGKVVGLKDDELERSIERALN

SEQ ID NO: 140029 - protein, 172 aa, Triticum aestivum
  Clone ID: PAT_TA_34447.pep
MNSYYYYLEDSRQWFWWSAGWRKTNDGRRYPAVNIVILTEVSFDYVFGREPLTEPPQDSSPGTVISIKDMEEWQSRWDNSARYNKLLVYAFYDKNSTLSKAMDKLLEKLAKQYKGKADFCKLDVDNFEFLAGLCGVEGAYPTFVLFKKCKQVGKVVGLKDDELERSIERALN

SEQ ID NO: 140030 - protein, 224 aa, Triticum aestivum
  unsure (1)..(224): unsure at all Xaa locations
  Clone ID: PAT_TA_34448.pep
MAAAAASKQPPLYIAVADDHRGRSGFRYTRPVLQSALQLMGCKPRHAFKISKRVFDVARSAFVDSSKLNGSTTQEDGMKVAELLDAENMTNIPFELYKTQTTAVVSREEFLDVVCDALTLYKYVGPNQRADLLLACRIKERKESVTVLLCGTSGCGKSTLSSLLGNRLGITTVVSTDSIRHMMRSFVEEKENPLLYASTYHAGDYLDPXAVAQAKAKNKAKKLS

SEQ ID NO: 140031 - protein, 189 aa, Triticum aestivum
  Clone ID: PAT_TA_34449.pep
MPGAEADGAGGPGSSSSSTADSFDAGQYAFFGKEPRDGLELGCLEADGGHGNGGGFSGPEDGGLYRLSSVGEEIDNLSNLSDVDDLASTFAKLNRTVSGTRNPGVIGDRRSISEGSSLTVDWTEDAEFPNYQDILENEEFQEGKRWGASQSHSLVQQGDSKPLSRTSSFFQQLLQHQGNFTDHSLTGKT

SEQ ID NO: 140032 - protein, 383 aa, Triticum aestivum
  unsure (1)..(383): unsure at all Xaa locations
  Clone ID: PAT_TA_34450.pep
TRPLQKRKSGNKEAGKLSASWYFSRKEVEENSPSDRDGIDLKKETYLRKSYCTYLQDLGMRLKVPQVTIATSIVFCHRFYLRQSHAKNDRRTIATVCMFLAGKVEETPRPLKDVILVSYELIHKKDPAAGQKIKQREVYDRQKELILLGERVVLATLGFDLNVHHPYKPLVETIKKFKITHNALPQVAWNFVNDGLRTSLCLQFKPHHIAAGALFLAGKFLKVKFLPDDGEKAWYQEFDVTPRQLEEVXHQMLELYEPRPVVQSQPTNGNEAEGSSAGVPNQRISVKAEANSEEPPVVHHPASKQPDSNPSTSTGVPIHNGAEHSKPHKQIGSQKSLQSDNGGHENDKTSSQSGGRVDTSTKDGVLDGTKSLPRSSRPSDKPG

SEQ ID NO: 140033 - protein, 166 aa, Triticum aestivum
  unsure (1)..(166): unsure at all Xaa locations
  Clone ID: PAT_TA_34451.pep
STSETNTTAYDGMLLATILQQEQQHSYSRYDGIQQHLLDHGNFRPHSTTTLLIRNRHGGTGSTTALPGRVRIVASPWRRSHGSRRSLSEGGRMASLRRRRFPSPATGSACCQPSSWHCYHHLHRLLRPGPGAASSGWSAAHRRTSSRFLSWPGXRYSSSDLVLVPN

SEQ ID NO: 140034 - protein, 82 aa, Triticum aestivum
  Clone ID: PAT_TA_34452.pep
NSHHVYNNYGSGLGCAQRRTTIGKKMLVQLLASSSYSIPENILRPFIFFSKFSLKDLRIASRSSAQGPTSVQLQKQNKSMRL

SEQ ID NO: 140035 - protein, 303 aa, Triticum aestivum
  unsure (1)..(303): unsure at all Xaa locations
  Clone ID: PAT_TA_34453.pep
EAGEQGEGEEAGEEEEEEEAVQEEDDAPEQPDPSQFFASSEGASFSARSFLELNLSRPLIRACEALGYQKPTPIQAACIPLXALTGRDICGSAITGSGXTAAFSLPVLERLLFRPKRVPAIRVLILTPTRELAAQVHSMIEKLAQFTDITCCLIVGGLPTKEQETVALRSNPDIVVATPGRIVDHLRNSLSVGLEDLAVLILDEADRLLELGFSVEIGELIRMCPKRRQTMLFSATMTEQIDELVKLSLNKPVRLEADPSLKRPATLTEEVVRIRRSREATQEAVLLALCLKTFKERVIIFSG

SEQ ID NO: 140036 - protein, 99 aa, Triticum aestivum
  Clone ID: PAT_TA_34454.pep
ETLGNPCVGGNDFLRLTTFLSQSTFVLPLPGLPGTFIFMADRWNPSDLRDSRYVWLPLSIGGLADEALDYSFGFPSWSRVSIYWHRKWRLPEGWRKSYA

SEQ ID NO: 140037 - protein, 185 aa, Triticum aestivum
  unsure (1)..(185): unsure at all Xaa locations
  Clone ID: PAT_TA_34455.pep
PRPRRPASPVPLAVADAPRPRQPRPVRPAARLASPATFTVGITARRPTKVFSRVRDLLAKSILYARAIADSLFLRCDLVHDARGTDAVRADDGQVXTVDETIAMVLHYASGIADAHVGLPXRDAVVAVPPYFGQAERRALTQAAQLAGFNVLALVNEHAGAALQFVLQRQGVREDGVCQRVPEAS

SEQ ID NO: 140038 - protein, 648 aa, Triticum aestivum
  unsure (1)..(648): unsure at all Xaa locations
  Clone ID: PAT_TA_34456.pep
ERRGGGGGGRGSGKGPAAGKMMSLNEFVSSMAPLIDLEKAAEISAESEASSKRKERRGSVMPNLKCTDAQSXTGLMGKTLLEFQPNKGDVLPPHKFGTHDVVALKPNKADAGSPALGQGVVYRLKDSSITVVFDDIPEDGLNSPLRLEKLANEVTYRRMKDALIQLSKGIQAGPSANLVPVLFGENSPMRSKDAVKFSPFNKNLDDSQKDAISKALRSRDAFLLHGPPGTGKTTTIIEIILQEVKRGAKILACAASNIAVDNIVERLSQYRTKLVRLGHPARLLPQVLDSALDAQVLRADNSSLAGDIRKEMKVLNSKLLKAKDRNTKRDIRKELKTLAKEERKRQQLAVADVIKNADVVLSTLTGASSKKIAGITFDLVIIDEAAQALEVACWIALLLGQRCVLAGDHLQLPPTIQSVEAEKKGMGKTLFERLTEGYGEEITCMLTIQYRMHELIMNWSSKELYNNKIKAHSSVAGHMLYDLEGVNKSSSTEPTIILVDTTGCDMEEVKDEEESTMNEGEAAVSIAHAKLLVESGVRAIDIGIITPYSAQVTCLKMLRNKDAKLKDLEISTVDGFQGREKEAIIITMVRSNPKKEVGFLSDHRRMNVAVTRARRQCCIVCDAETVSSDRFLKRLVEYFEENGEYLSA

SEQ ID NO: 140039 - protein, 229 aa, Triticum aestivum
  unsure (1)..(229): unsure at all Xaa locations
  Clone ID: PAT_TA_34457.pep
MAGTISRIRLENFMCHSSLHIELGEHVNFITGQNGSGKSAILTALCIAFGCRAKNTQRAATIKDFIKTGCSYAAIAVDINNQGEDSFKPDVYGNLIKLERRITESSSSTILKDQHGRKVANRKDDLNEIIEHFNIDVENPCVIMSQDKSREFLHSGNDKDKFKFFFKATLLQQVNELLETIRDQLNNADSVVQELEKSIKPVMRELDELREKIKNMEHIEEIAHDXRYL

SEQ ID NO: 140040 - protein, 246 aa, Triticum aestivum
  unsure (1)..(246): unsure at all Xaa locations
  Clone ID: PAT_TA_34458.pep
MAMARRQHITIFTTASLPWMTGTAVNPLFRAAYLAKAGDWEVTLVVPWLSKGDQMLVYPNKMKFSGPAEQEGYVWRWLEERTGPLPRFNIIFYPGKFSTEKRSILPVGDITETISDEKADIAVLEEPEHLTWYHHGRRWKKKFRKVIGVVHTNYLEYVKREKNGYIQAFLLKHINSWVTDIYCHKVIRLSGATQEVPRSVICNVHGVNPKFIEIGKLKHQQISQREQSFFKGAYYXWGKMVWSKGY

SEQ ID NO: 140041 - protein, 106 aa, Triticum aestivum
  unsure (1)..(106): unsure at all Xaa locations
  Clone ID: PAT_TA_34459.pep
LLVVKEXLRLHPALPLLVPRECNETCKIMGYDVPKGFVVFVNAWAIGRDPKFWDDPEEFKPERFENSKVDLKGTDFEFIPFGAGRRLCPRLAFGLASIEIALAARF

SEQ ID NO: 140042 - protein, 214 aa, Triticum aestivum
  unsure (1)..(214): unsure at all Xaa locations
  Clone ID: PAT_TA_34460.pep
TAAVCLIHPFLWPVTQLSCHCGYHYCTCISIVSCILFGDAAGAVLGWKCNADEDGLLGFCVQSDVLRQIRMHWFLSGDSAXIVISFGVPGFNPKKTNFSCIEMNGKEVFRFAVRCVPQSIEKALEEAGLPASSIDWLLLHQANQRIIDAAASRLSIPSEKVISNLANYGNTSAASIPLALDEAVRGGKVKAGDVIAASGFGAGLTWGSAIVKWG

SEQ ID NO: 140043 - protein, 133 aa, Triticum aestivum
  Clone ID: PAT_TA_34461.pep
MAEKKVVLKLDLHDDKQKQRALKVVSTLHGIDQIAVDMKDQKMTVVGTVDPVDLVGRLRSKLFPTAQMLSVGPAKEEKKDGGAKKDDGKKEGDKKDPIPVYTPWYPPPPPLYHPHPYYHNHSAEEDPSSCVIC

SEQ ID NO: 140044 - protein, 134 aa, Triticum aestivum
  Clone ID: PAT_TA_34462.pep
MAAMNVVLKLDVHDDRQKQKAIQVVSALHGIDHIAVDMKDQKMTVVGTVDPVAVVARLRSKPFPTAQIFSVGPAKEEKKEGEKNDAGKQVEYPTYWYPPPPYHPHLCHLARGGPQLVRHLLIDARRRFPPLYTL

SEQ ID NO: 140045 - protein, 123 aa, Triticum aestivum
  Clone ID: PAT_TA_34463.pep
MAAMKVVLKLDLHDDKQKQKAIKVVSTLHGIDQIAVDTKDDKMTVVGTVDPVHVVGKLRSKLFRTAQIVSVGPAKDEKKDGAAKKEPIPVYAPWYPPPPYHYHPHPYYYNHSAEEDPSSCVIC

SEQ ID NO: 140046 - protein, 128 aa, Triticum aestivum
  Clone ID: PAT_TA_34464.pep
MAAMKVVLKLDLHDDKQKHKAIKVVSTLHGIDQIAVDTKDDKMTVVGTVDPVHVVGKLRSKLFRTAHILSVGPAKEEKKDDAKKDDGKKDPTPVYPPWYPPPPPYHYHPHPYYHGHSAEDDPSSCVIC

SEQ ID NO: 140047 - protein, 128 aa, Triticum aestivum
  Clone ID: PAT_TA_34465.pep
MAAMKVVLKLDLHDDKQKQKALKLVSSLHGIDQIAVDTKDDKMTVVGTVDPVHIVGKLRSKLFRTAQILSVGPAKEDKKDDAKKDDGKKEPTPVYPPWYPPPPPYHYHAHPYYHGHSAEEDPSSCVIC

SEQ ID NO: 140048 - protein, 211 aa, Triticum aestivum
  Clone ID: PAT_TA_34466.pep
MAEKTVVLKLDLHDDRQKQKALKVVSTPQGIDHIAVDMTDQTMTVVRTVDPVDPVGRLRSKLFPTAQMLSVGPAKEEKKDGGAKKEADTKKEGGRRTRSRCTCRGTRRRRRSTTRTRTTTTTAPRRTPAPASSADRRAQPIRSLVQFVAGRVLCCLPVAPASYGDRRRAPWCHTSGPVNAAALLVLLQCLCICFGYKEQIWYLQMSGLGRR

SEQ ID NO: 140049 - protein, 147 aa, Triticum aestivum
  Clone ID: PAT_TA_34467.pep
GENEWYFYCQKDRKYPTGIRTNRATKAGYWKTTGKDKEIVNPHCTSMLIGMKKTLVFYKGRAPSGEKTNWVMHEYRLKINKQSTTSLPSAIGNAASINMSSKEYVVCRIFHKNAGSRLSSMVSHEGNGGATPTDKIWSMSMGTDGAC

SEQ ID NO: 140050 - protein, 370 aa, Triticum aestivum
  Clone ID: PAT_TA_34468.pep
MIRDHQDQGKLVQVVAVDVGLVAPPGRYVLSEENRPTTVEQQAKLVIPIVDVSRLARPDDVEEAAKLRSALQSWGLFVVTGHGMPKEFLDEILEASRKFFHLPLEEKLKCGNVIDGIMFQNEGYGIDRIDSDEQILDWCDRLWLQLQPEDERRLQFWPQNLRDPLHEYTLESGRVTMDVLKAMAKLLNQEENFFINMVGERFKSYSRFTYYPPCPRPDLVNGLKPHTDNSVITLLLMDKDVGGLQVLKDGHWVDVPVLGNDLLVVVGEGMEIVSNAIFKAPWHRVVTSAEKERLSLAMFYQPEPERIIGPPVVLVHEKRPAMFKKCLVQTLADGYWDAFAAGDRTVDFLNVRINAEADAELEARAVVANN

SEQ ID NO: 140051 - protein, 227 aa, Triticum aestivum
  unsure (1)..(227): unsure at all Xaa locations
  Clone ID: PAT_TA_34469.pep
LDGLQADEAFPEAWHADAATVPSDGLASIRSKVYLTPKLWYLRVNVIEAQDLVPSDKCRYPEVYVKATLGNQSLRTRISASKSVNPMWNEDLMFVAAEPFEEHLILSVEDRIAPNKDEVLGKACIPLQNVDRRPDHRPVHSRWCNLEKHVAGDGEQKKKDVKFSSRIHLRFXLDGGYHVLDESAHYSSDLRATEKQLWKPXLGVLELGILNAQGLLAMKTKDGEWHH

SEQ ID NO: 140052 - protein, 213 aa, Triticum aestivum
  Clone ID: PAT_TA_34470.pep
HRMVGPDPLSVLPILVDLAPLGLALWVSPPLPAHPGKDRKHDGSIDGRANGNPKVVSNVVQSSPMSPQASNESTYGTPAVNRFRVAVRKVPRKKYEQLNDKSKKDTSKRGASAIFSDTISEDSDELLNTMDEKAGVENSSDDSSTSADSGISSTAWEGSDVPDDEGIASLSQRSDINSVLRGSSSYKKARLKPTELLEDTEVPDSQPPDSLWG

SEQ ID NO: 140053 - protein, 145 aa, Triticum aestivum
  Clone ID: PAT_TA_34471.pep
PKAKKTILRKIISSGKDKVFCRKGIGSSERPQVGSLERPHVTQQAIPYGQALNHYVGQILALYRDRIYAVNAIGLGDRYSEFRPVEEDGECFYRSFIFSYLEQVLDRKGRNEERRLLAAIQELAEEPARFGWASEFSRSHDALRS

SEQ ID NO: 140054 - protein, 77 aa, Triticum aestivum
  Clone ID: PAT_TA_34472.pep
SSTTLQETWGQNMAPSSAMSLDIYLLKGSIFSQQAAVSLGISSRGAGILLLHLLLAGGELGDLLELVPSFGGVVDPE

SEQ ID NO: 140055 - protein, 570 aa, Triticum aestivum
  unsure (1)..(570): unsure at all Xaa locations
  Clone ID: PAT_TA_34473.pep
SAPPPPNTTSTAHEIFCPKTREPRRRREAWDAKSVTPGAVALILANPTPESPDDVPEIVARVLDHKPIGSRFIFMQSDGDAKDKALLPTHCAAEALSGTLQNLRLVRTQNYTCNDIPQKTDEMVIIPKXERVPGARYAEIEREVKGRAGGAHMPPEEAAAALYNPLGGAGAEFTETKMHEEDPKSHRVCEQGKGCSLSEGAPIEASEQFKTVQNHYEMTLNETAVVKEAEGVIFHCXPVQYNFVMNDMLGPYVGDRELVDIIGGAQSVSXLPCSIRRKIDNESIPKRDIVVADDSNKTVTISLXWNDLATTVGEELLDMVDSAPIIAVKSLKVSDFQGVSVSTVGKSTLVINPELPETEKLRAWYESEGKGTTXASVGAGMGASNAGGLRSMYSDRVFLSHITSDPNLGQDKPVFFSLYANISNIKPDQTMWYRACTTCNKKVTESLGSGYWCEGCQKNYEQCSLRYIMVIKVSDPTGEAWLSLFNDQAERIVGCSADELDRIRKEEGDDMFQLKLKEATWIPHLFRVSVVQNEYMGVKRQRITVRSESPVDYAAEARYQLEEISKLTSS

SEQ ID NO: 140056 - protein, 220 aa, Triticum aestivum
  unsure (1)..(220): unsure at all Xaa locations
  Clone ID: PAT_TA_34474.pep
MKGGTVPTWLELLLATQFFAICTNHLSSTRNECNLFCIDCEESKAALCYYCRSHHHSTHRVIQIRRSSYHDVVRVAELKDVLDIXDVQTYVINSATVVFLNXRPQQRGCGCFCWSRHQSSSXHNCDDVAISATSLSPLPRSCSLGCNLKAIKEDMSTSIPNRDIIDYTRTNDDTDCSNTSGNTGNNVESCSDADYCNEKPSTARVIRLRRRGIPQRAPFY

SEQ ID NO: 140057 - protein, 103 aa, Triticum aestivum
  Clone ID: PAT_TA_34475.pep
RVPCRGITSADPLVFVQNAAVLVVGSGREGDELDEDPPLNGLILLGGHGVNDNSDGERDGNENRSLEQRRARARAFDIAATCHPGLSFHRENGGNCRKITPCI

SEQ ID NO: 140058 - protein, 138 aa, Triticum aestivum
  Clone ID: PAT_TA_34476.pep
RINVLQYKIPCLILCEMAVVWMTNQLAKNQTQDLIFKYINQLCDRIPSPMGESSVDCGRLASMPDIAFSIGGKQFVLTPEQYILKIGEGDATQCISGFTAMDIPRPRGPLWILGDIFMGAYHTVFDYGNMKIGFAKAA

SEQ ID NO: 140059 - protein, 527 aa, Triticum aestivum
  unsure (1)..(527): unsure at all Xaa locations
  Clone ID: PAT_TA_34477.pep
LLSRSILLAKQPWQAAGHLMLLSCVLLHALLAGPAEGLVRVPLTKRPVDEDGPVVAGEDAQRLLAWRHGLVYNADVQPTTGSEKGHAVALKNHLNAQYYGEVGVRDAAXHNFTVIFDTGTRRLLGCPPPSASSRLGCYLHASYKASKSAMYXKNGKRGRTYVTGTGSQFLGGILAKDQCANLVVDVVKYQFYIEATSEPSITCMFRKFDGILGLGFKEIARGGVEPVWYNMVNQHLVGSPVFSFWFNRHAGEGHGGEIVFGGIDPKHHKEEHKYVPVTKKGYWQFDMGDVLIGGKSTGLCTSRCAAIADSGTSLLVGPTAIITQINEKIGAPGIFSQECKEVASQYGQRILDLLLNEIDPTKICPSVGLCTHSGTQGVNDVSFGIRTVVDDETGRSNDAVCHVCEMAVMWAKNQLAQDQTRDLILKYINTLCGYIPSPMGESSVDCKRLASMPDVAFSIGGKKFALTPEQYILKIGEGDATKCISGFVAMDIPPPRGPIWILGDIFMGAYHTVFDYGKMKVGFAKAA

SEQ ID NO: 140060 - protein, 111 aa, Triticum aestivum
  Clone ID: PAT_TA_34478.pep
LEVSRTRFHRVGSTLAEDTRLDVYLGYVGGTSQIWGSLVVRVIVGSCRSGLKQSSSQSKQGQSLGCIVRGAAWSMVSLQGQPVGSFGFCLTRGRPEPHVLSGESDFASYIA

SEQ ID NO: 140061 - protein, 216 aa, Triticum aestivum
  Clone ID: PAT_TA_34479.pep
MSKLQTDALKEAITQVVADAKEKNRKFTETVELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 140062 - protein, 443 aa, Triticum aestivum
  unsure (1)..(443): unsure at all Xaa locations
  Clone ID: PAT_TA_34480.pep
MSLRPNERAEVRRSRYKASVDAEDGRRRREDQMVEIRKNQRDANLQKKRRDGFPAGAASAAGGAPQMGHSSALQQKLEGLPAMVQAVLSDDNAVQLEATTQFRKLLSIERSPPIEEVINTGVVPRFIEFLTREDYPQLQFEAAWALTNIASGTSDNTKVVVEXGAVPIFVKLLSSPXRDVREQAVWALGNVAGDSPKCRDLVLGSGGLFPLLQQLNEHAKLSMLRNATWTLSNFCRGKPQPNFEQVKPALSALQRLIHSQDEEVLTDACWALSYLSDGTNDKIQSVIESGVFPRLVELLLHPSASVLIPALRTVGNIVTGDDLQTQCVIDHQALSCILNLSTTNHKKSIKKEACWTISXNITAGNRDQIQAVIQANIIGPLVHLLQGAEFDIKKEAAWAISNATSGGTHDQIKYLVAQGCIKPLCDLLICPDPRIVTVCLALP

SEQ ID NO: 140063 - protein, 377 aa, Triticum aestivum
  unsure (1)..(377): unsure at all Xaa locations
  Clone ID: PAT_TA_34481.pep
RLSWVWAGHEFISDVIGAETTERGNCTGRHGANGAPPHCCEKQPVMADLLPGAPYNRQSANCCRGGVLSSVTQNNRTATSQFEMYIVNFALDEHGDPKMPTTFSIGVPGYTCSNATNVPATRSKVDEQRHVQVLRTWQIICSYSQFRDAPSPSCCVSLTTFYNNTIVXGCPRDSCGGANSPSAHQCLSGGEQSKVLAALPDAEGAPPVPVIRCTEHMCPIRVHWHVKQSYRGYWRVKAAVTNYDVVSNYTDWNLVVQHPNLRSLTQLFSFNYQPLIQYGTINDTGMFWGIKNYNEMLLGDGNVQTEMILEKDPSDFTFSGGWAFPRRVYFNGHECVMPPPDQYPSLPNAAWDVRVSAVQRWLVAGSCLLSLSMLFLV

SEQ ID NO: 140064 - protein, 122 aa, Triticum aestivum
  Clone ID: PAT_TA_34482.pep
SLKKRSSRGSLGKISVVKNLVKGPDVGIEERSQRSLGLEKINGGRRSWRRSAAVVDQGRQGGGARVQTPLPPCLVKRAVRRGRPRGGSAATAASLSGGRRNSLPSPLRSGVVGKHRGEGENE

SEQ ID NO: 140065 - protein, 265 aa, Triticum aestivum
  Clone ID: PAT_TA_34483.pep
PHPTAGYNGRGSCGVCAWLLWATKNSSYLNDLISLGANDDLDVFSWDNKLAGARVLLSRRALLDGDERLEPFTRQAEEFICHILPNSSSPSSTTAYTPGGLMHRPGNVNMQYVASASFLLTTYAKYMAASRRRAFSCQNSRPVTHRNLRALAKRQVDYVLGDNPLGMSYMVGYGARYPQRIHHRASSMPSVAAHPAHIGCQEGYRSYLNAPGPNPNVHTGAVVGGPDENDAFPDDRVDYARSEPVTYTNAPLVGCLAYFAGSYKN

SEQ ID NO: 140066 - protein, 104 aa, Triticum aestivum
  Clone ID: PAT_TA_34484.pep
EMVEAMGGTESQYYTRFKSYCCEAYNILRNNSSLILNLFTLMERSSIPDISAEENATLKVQEKFRLDLDDEEAIHFFQGLINDSVSALFPQMVETIHRWAQYWR

SEQ ID NO: 140067 - protein, 413 aa, Triticum aestivum
  Clone ID: PAT_TA_34485.pep
MGSWVLLAVVLGSLVGAARGSEPWSNGTQVYSTNANSGSGSNGAFVALTLIQSAAAKGAVCLDGSLPGYHLHRGSGSGSNNWLVNLEGGGWCNDVKSCVFRKGSRRGSSNHMERQLQFTGIMSNRPEENPDFYNWNRVKVRYCDGGSFTGDGADAASGLYFRGQRIWQAAMDDLMAQGMHSASQALLSGCSAGGASAILHCDEFRGMFPSNTRVKCLADAGMFLDSVDIAGRREMRDLFNGIVRLQGSGRSLPRSCTSHMDKTSCFFPQNVLPNIQTPTFILNTAYDVWQLQESLAPRTADPRGLWQSCKQNYASCNSNQLQFLNGFRNEMLNAVKGFSGSGQNGVFINSCFAHCQSERQDTWYSSNSPRLGNKRIAEAVGDWFFERGNAKYTDCAYPCDGTCHHLVFKGRHL

SEQ ID NO: 140068 - protein, 89 aa, Triticum aestivum
  Clone ID: PAT_TA_34486.pep
MAVISTVLFSEREQNSVKDFSTNNCSKILSLCVSYITPVYVMKLKDFFPNKELREAPYFDGRVVCYPNMKTIRDYLAWRQLDCRNNTEN

SEQ ID NO: 140069 - protein, 166 aa, Triticum aestivum
  Clone ID: PAT_TA_34487.pep
HSLTHDRSESISSLTTRGLYPALPQWICQTPSSSKAPIRRGWKRQITSFFSSGSPTNENGVHSSAIASVITHIKYSWQGHITQHTVPNQSRFQNTTCHIVSSTNWELSPPGGLSMAPLTPTVTCSPPASFSGRPPRASPTRPGGCVALQQTTPVIGMPLSRWGVDT

SEQ ID NO: 140070 - protein, 133 aa, Triticum aestivum
  Clone ID: PAT_TA_34488.pep
STPGTPLTVLAREAYRVVEDAVWSDLRRNRAERIQRQGYGLCVRKTAEIKRHLQSLSFHFAEETARLVVKPEELFTAVEGRLHGPALCFAMSPGERTVIGALQQVDTRFVYDLKDAKLSFASEPCSQDTAGVD

SEQ ID NO: 140071 - protein, 161 aa, Triticum aestivum
  Clone ID: PAT_TA_34489.pep
NKTQNSPMNKMGIVESCRGRPTEGRSTIKNLHVCISGKPELVFEMMTMALKRKMSLLQAPQCPPELPSIAGVIFRYLDNPEGWAGVKYPLRENGAKSTNIFFFRSTAIIHVFYVAKFGFTRTRGQYHHNHSSSSGQGEMLAGPSMSTLLHSCHPESGQATT

SEQ ID NO: 140072 - protein, 457 aa, Triticum aestivum
  unsure (1)..(457): unsure at all Xaa locations
  Clone ID: PAT_TA_34490.pep
ADLSSAFFPRLAPGGKYLVFISAKSAVDSGAHNATNSMHKIDWPTDGKLEGSLSVSDVVPTVMSPQDGCFPGMYCSGLLRFPWLSDGRTMILSSAWXSKEVILSINVASGEVSRVSPQDSDYSWNVLALDNNNILAVSSSLVPLPQMYYGFEDSHTDKPCQWDWQEIPSPFPKPSDKVSSLLADHKFSVIKIPVSNPSDKLPDGANLPFEAIFVSGKDSASSPTIVVLHGGPHSVYPSSYSRSLAFLYAQGYNLLVVNCRGSLGFGEEALQSLPGNIGSQDVNDVLTALDFVKKRGLIDASRVAVVGGSHGGFLTTHLIGQAPETFVAAAARNPVCNLQLMVGTTDIPDWCFLEVYGKEGKNCFTESPLADSLTKFYQKSPISHISKVKTPTLFLLGAKDLRVPVSNGLQYARALKERGVDTKIIVFPEDIHGLDKPQSDFESFLNIGVWFKKYMSK

SEQ ID NO: 140073 - protein, 309 aa, Triticum aestivum
  Clone ID: PAT_TA_34491.pep
LLINDSTRFCYVYLLNTKDEDLHYFKIYKAEVENQLEKKIKRVWSDRGGEYFSNEFDLFSVEQGIIHERTPPYSPQSNGVAERKNRTLTDLVNAMLDTSGLSKAWWGEAIMTSCHVLNKVPTKDNEITPYEKWTKRRTTLSYLRTWGCLAKVNVPIPKKRKLGPKTVDCVNLGYAMNSVGYRFLVVKSEVPDMKVGTIMESKDATFFEDIFPMRYVQSTSRQESEETPEPAISMEYYDQTHDENPEEDNEETLGRGKRQRTAKTFGDDFFVHLVDDTPTCIVLAYASPEADYWKYASRFQFRTISISGT

SEQ ID NO: 140074 - protein, 173 aa, Triticum aestivum
  Clone ID: PAT_TA_34492.pep
LEIMSVDGDMPTEVVGSSWSLCPGSTRELQKRRNEVAINGWLHQYFESVVSMYEDRFELYVLCRRSCKNTADNRPDKTNWLTNAFRKPSTSTRLDYVCISPFSLPVRRTKELRALTGWRYYYSLFLELSDIAMPFARAVVARVSAAVSYFWVSMIGRSLGLIFSGIRQSLGWK

SEQ ID NO: 140075 - protein, 378 aa, Triticum aestivum
  unsure (1)..(378): unsure at all Xaa locations
  Clone ID: PAT_TA_34493.pep
MDHRLVAALLVLLGLLLSPAPAAAAAGDEEPLIRQVVGGADPLDNDLELDSQFLGFVQRFGKTYRDAEEHAHRLSVFKANLRRARRHQMLDPSAEHGVTKFSDLTPAEFRRTFLGLKTTRRSFLREMAGSAHDAPVLPTDGLPEDFDWRDHGAVGPVKNQGSCGSCWSFSASGALEGANYLATGKMEVLSEQQLVDCDHECDPAEPDSCDAGCNGGLMTSAFSYLLKSGGLEREKDYPYTXGKDGTCKFEKSKIAASVQNFSVVAVDEEQIAANLVKYGPLAIGINAAYMQTYIGGVSCPYICGRHLDHGVLLVGYGASGFAPSRFKEKPYWIIKNSWGENWGDKGYYKICRGSNVRNKCGVDSMVSTVSATHASKDE

SEQ ID NO: 140076 - protein, 116 aa, Triticum aestivum
  Clone ID: PAT_TA_34494.pep
MQTAKVKVKDAVSSAKEKAKEGTAKAQGKTGKATATTHGEKEMAKEETRANKAQAKAEMHQEKAEHRAEAAAGRHGATHVPLTGPHGHHRPVGAAPAAADPAYPGTGAYPTTDKYV

SEQ ID NO: 140077 - protein, 123 aa, Triticum aestivum
  Clone ID: PAT_TA_34495.pep
MQTARVKVKDAVSSAKEKAKEGTAKAQGKTGKATATTHGEKEMTKEETRANKAQPKAEMHQEKAEHRAGGRGRAPRRHARAPHRAARPPPPRGCRCRCSACRRRPCVPGHRRVPDHGQVRLGV

SEQ ID NO: 140078 - protein, 116 aa, Triticum aestivum
  Clone ID: PAT_TA_34496.pep
LTYSLLTLANSTSTETRPWYSWCWICAPSLHIHTPRLACPTPHTTKAYTCTCMVFSVSPASYSVSTFKTYSSSTAGLCRRAVLRRGGRDQWPPALTARNWALGDLGQQEHAHDAAE

SEQ ID NO: 140079 - protein, 88 aa, Triticum aestivum
  Clone ID: PAT_TA_34497.pep
MASAASRKAPSLVVAASVGAVEALKDQAGLCRWGYPLRSLYRRAAAAPRVRALSASLSDAAAAPRPAPLSAEDAKLRKAHHLVCWGPN

SEQ ID NO: 140080 - protein, 180 aa, Triticum aestivum
  unsure (1)..(180): unsure at all Xaa locations
  Clone ID: PAT_TA_34498.pep
XXAQFYTYKRPRQWLSSSGLGAMGFGLPAAAGAAVANPGVTVVDIDGDGSFLMNIQELALIRIENLPVKVMILNNQHLGMVVQWEDRFYKANRAHTYLGNPENESEIYPDFVTIAKGFNVPAVRVTKKSEVTAAIKKMLETPGPYLLDIIVPHQEHVLPMIPSGGAFKDMIMEGDGRTSY

SEQ ID NO: 140081 - protein, 84 aa, Triticum aestivum
  Clone ID: PAT_TA_34499.pep
NHDFLSYNHASTRHYHERALTHVYQSTMFQLAMRQDEPSMSAFKAGHQKHFPSMSCCISICKPKNSVLVTVDVCHGEIILTIAN

SEQ ID NO: 140082 - protein, 330 aa, Triticum aestivum
  Clone ID: PAT_TA_34500.pep
MPSASSGSAWDSRASNKMKHSISTPNFVPGGSPAQASSSTAYGNYKQLPPHSSQPLPVVEDVRPANPSLVERMRVALGMDEDRFSAFKEIASEYRQGVIDTSEYLSYVEQFGISHLVPEMAKLLPDPLKQMELADAYYTNMRFRSLQENDGCGTITVKENKRRNKGKGKTPDAETAPAKDASESLADSFMDTVRKLQLNNKAQEGEAAVLSKDGYRSSKEKIPLSAGGSSCGTNMGLDGDPVAISKASGTSRYVGKGSSSSNNKQSKKTSKFLRARLGDNSLATLDFSHPDVSPERPVRETQVPAKLGLPVPSVWWDGAAPNLFSSNGKK

SEQ ID NO: 140083 - protein, 195 aa, Triticum aestivum
  Clone ID: PAT_TA_34501.pep
MVQGANQAGMVEGPNPSGMVQGANRSRRAFTWDPCLPFSGSGHTNGPPVHAFFPGHVYNGSLRLLQQAAMATMSTFYDAIHLIDEQWDMGLDIDGMTYEELLALQEQIGDVNTGLPERYICQNLRVHWYVVPRAARGSDQSVEKDACIICQEEFEARDLVGALDCGHKYHEVCIRQWLMVKNLCPICKATALPAE

SEQ ID NO: 140084 - protein, 130 aa, Triticum aestivum
  Clone ID: PAT_TA_34502.pep
HASEALEMGAVETLIVWENLDINRYSLKHSVSGEIIVKHLNKEQEADQSNFRDSETNAELEVQEKISLLEWFANEYKKFGCALEFVTNKSQEGSQFCRGFGGIGGLLRYQLDMRSFDEVSDDEGLYEDSD

SEQ ID NO: 140085 - protein, 339 aa, Triticum aestivum
  Clone ID: PAT_TA_34503.pep
EEFGTREGKEEVSSPLADEETLEKATTENVSSATADEETLETAAAEKVSSAPADEETSETAATEKVSNAPAGEETLEKVKEEVSSPHADEAIPEKAAEKVSSPHADEATPEKAADEVSSPPADVETPEKATEKVCCPPADEEIAEKPSDKVSSPHAEAEMSEKAAKSSPAPSEPPVVCDDMKDNYWSDILINVEEPLSSLAKKKDKGKMRSSKKQRRDDEMKQDEMLLAEAENGKANGAEEDVSLTGLVLHFSKPGAVPSRGDLIEIFSQYGPVSEARTETDEHSSSAQVVFRRRADAEAAFGGAGKIVALRPGLDSFRLTDFPCATAAFRVEDGPKQG

SEQ ID NO: 140086 - protein, 334 aa, Triticum aestivum
  Clone ID: PAT_TA_34504.pep
MERFVMFMDNLLLRRGLVPLDSFSLMGWSDDFSLNHPRANLWVCHALRSNVRVLQIFSRKLFNLEYSPFISSHLKILNLRDVSIAALFIEKLFSGCPQLEELSLVDCRVPATKFSSRTLKKLTFIAHTPYGADDVHTDFEDLVIDTPSLVSLHLEDIPLLTPCLVNVSSVVKASFRLDEECFSSPYVSCNIISALSNVTKLKLFFGLDNETASKVLRRDLWRCQAFNNLKTLSVSGWCIDVDLRALVYFLRRSPALEKLTLCLSQARASDRLRRRDNTESEETSTSFNCKHLKKVKIRCPQGDKRVGNILNVILASASLPEIVINPYERWDPLE

SEQ ID NO: 140087 - protein, 247 aa, Triticum aestivum
  Clone ID: PAT_TA_34505.pep
DSFHLQSLGRTVTKNNSLKHAPGIGPVVPQECSDCGKKFNVGGPIWSAPIHDQDWVLSTLTDVRQMKDRYPAYNKITSVLTTVSEELHDIPLFFSLHNISGTVKCTSPSAVMFRSAVINAGYQISSSHCNPLGLKSDAPWDVIWDIMRCWVKNHPIKEQPRDSPGTAILSKSPQLEANFSRAVAALSKAQVKKVNRFLPNPESHWGPKVRAGRRITSKHISLLGAEALNGAISHQDGNGAVTDKPAS

SEQ ID NO: 140088 - protein, 101 aa, Triticum aestivum
  Clone ID: PAT_TA_34506.pep
MASKGLIVVSVLLAAAFLVATAEQTQAKKEETQARVQGGYPGGGGRGGGYHGGGGGGGYPGHGGGGSGGGCSHRCCGHGGCHCCAGPDEIPKPKYRAEVRN

SEQ ID NO: 140089 - protein, 251 aa, Triticum aestivum
  Clone ID: PAT_TA_34507.pep
RSTRRGCQAWRPRVSLWLLSCLLRLSSWPQLNKLRPTRKRPNPVFRAATLDTTEAVAAVILDTEEAVAAGTLDTVGAVAAAAAVTDAAGTVAVTAAPAPTRSRSPSIGRTSATKCRMQQRVLPLLDLAHPPLGRRLASQGLVALPVLLAAALRLATPEPTQGHEVETHAGGARWRPRRQGRFPVGAAPAPAARAGGLLAAPAAAPASTASAADTCRYPVPLYMGGWLFVSCWSLLGDCGVWPVLCLVVPLV

SEQ ID NO: 140090 - protein, 182 aa, Triticum aestivum
  Clone ID: PAT_TA_34508.pep
DAWARGEKTNWVMHEYRLECGKQGTPGLPTDITTATAINASSKEEYVVCRIFHKSTGLKKVVVSSYAIPMSMPMGAEEQHAFLESGTLPPFMGYGASSSLVPPSSLPTSSSYQLHDVGARSSMMGSAVLPMMNDHYFGNHHYQNMATPPRPLVSFYHHDPPPAATTTTTHDSNADADADRCR

SEQ ID NO: 140091 - protein, 145 aa, Triticum aestivum
  Clone ID: PAT_TA_34509.pep
LEGSTEGIYKIIRPAIGEALREMPLSELKGKYRKVSSIDKVSKGWQDEYDVSSKQCMHGSKCKVGSYCTVGRRLQEFNILGGLILPVWGTIEKALAKQVYQNHKRIRVVRLVTTNDNQRIVGLFIPNAAVESVLTGLQWVQDIND

SEQ ID NO: 140092 - protein, 257 aa, Triticum aestivum
  Clone ID: PAT_TA_34510.pep
YNEFIDKLRKVLSEHNDAKTIKDRPVLEKQRPGAQPSRWVLIHLVLGEDLVLILAVRGDNVYFVGFQNKHGKWYELGYSKQPDSYNIGSVQLIPDSTFLEAGTSYANMVCGTKFSDPRPDNEVVKIAMCQLNLSPENMKDDASLLLDYPDVRWLTDHTHDTYLASVLRACAGIALRLCEPTRLFHNHDPMNINWARQQRFNLIGKLVDYIWNWKHISNGMHSWSRDTSFNWSEKRFLVALGITNIELAAAAVALILN

SEQ ID NO: 140093 - protein, 224 aa, Triticum aestivum
  Clone ID: PAT_TA_34511.pep
KGEAKAMFLRHEGFLGALGAFMSYEKHGLDDLSAHHLVERFPMGAPYVGGKIHGPPLGDLNEKISWMEKFVQKGTQITAPVPMGAPATTGMGGFERPTSKGDILRSDASAALNVGVLHLVPSLDVFPLLEDPKTYEPNTIDLDHDEFKYWFTILSDHLPDLVEKAVASEGGTDDAKRRGDAFALAFSALLARLSYGPSVTTFGLKSKIFFTREKNFLVLTTFKK

SEQ ID NO: 140094 - protein, 82 aa, Triticum aestivum
  Clone ID: PAT_TA_34512.pep
HHHHASVAFDRSTLQPNTVSTPQWPPSQHPFLMQRFSAAPAEPSPMFPFFLGGNSASAAAPAAANAPERRLQLWDFKEERKT

SEQ ID NO: 140095 - protein, 297 aa, Triticum aestivum
  Clone ID: PAT_TA_34513.pep
LDAFIVSCHKDLQVLRECANRVYYNNLRIIVYDFTRQRLIIPDGSLPTTEHPTVLSVIQSENHTVLNVLVDQGHAERQVLVRDYEVGKSVAFDHRMRNIKEVYTSDGFRMFSRGSVQTILPPNKRPRPERWCSSPAEKIAELKNEVDGIQRIISEKNAQRRKLVNDRSNLEQKIANLKRKREPEERHLMNKKVQLEDGRRATAENNRHAAVDTTELEEDIKEEKNNIEQKELSLQKTNVKLTAALREVNDRRTAFKTFMDSVNEERLHFSSANDELDLVKRKIDAAQQEKTHYEGVM

SEQ ID NO: 140096 - protein, 127 aa, Triticum aestivum
  unsure (1)..(127): unsure at all Xaa locations
  Clone ID: PAT_TA_34514.pep
VQIYHYIADKPLYSTAATMATFSIPVTIPLEIPKVHCQRKLKQKGDFVCCPPVVPFPVTALYEQRYSQALPSYTHXDRATSNNFTKLDTAQAFATLDCLARQSSRIFTYGITFCTGTHITEQALXCC

SEQ ID NO: 140097 - protein, 344 aa, Triticum aestivum
  unsure (1)..(344): unsure at all Xaa locations
  Clone ID: PAT_TA_34515.pep
MADGSRDISRRRNPADKLTEDLLVEILSRVPYRSLCRFKCVSKRWRGIISHPDHRKALPQHHLHDLAGFLYSSRGPSTGYFSTRNFTHVSAGGRPPIRPSLPFLPDCHQVXLLDSCNGLLLCRRFKTFGAGAFYYVVCNPATEKWVALPGIFSKMQTARLGFDPAVSSHFHVFQFVEDGAADANANDDDDGYEFVRGVDIYSSKTGAWSHKDTGWDFLPRIVSDSRSVFVNGFLHLLAVESAVVAVDVEGTTWRAIPMPDDEDAPIIDVDDGFIDLSRGRLYLANSDQHDLYKLSIWVLEDYGSEVWVLEHSVRYLNLFGVKNVRLGHEYHIGALHPQRNTIFL

SEQ ID NO: 140098 - protein, 248 aa, Triticum aestivum
  Clone ID: PAT_TA_34516.pep
GLGLGARLEAEVHGVEVSEHKTESVVGDVEPVPELTETMGHTGESAPGPGMMDEFVPGDAGREEPQGDSHDMASRLVGRVDSGSTKADSVESGEKMSHARGQESNIQHSLSCNARVYSGIDLSKDEVTQTGKMLTKDEYDPGNDLGATDGENDYETGLPEFDPIKHHNNYCPWVNGYVAIACTMNTGSSTNSAAFCGWQLTVDALETVQSLGQNQYQAMRSDSAASLYKDDHAAPSHKLLKRPKHSKC

SEQ ID NO: 140099 - protein, 167 aa, Triticum aestivum
  Clone ID: PAT_TA_34517.pep
MADRHGEGGVASARRPGRTDLDDPSTTLLQRVQAHLPNATQVVGLLTLLLAGAALLVLAGLTFTGAVVALVFLGPLALLTSPIWVPFSFALLVVVVAALSFVGFAVAALAAVTWAYRSFTGRHPVGAHRRVRARNRLADTATHREDYARREYGGYLGNRTKDAAPGA

SEQ ID NO: 140100 - protein, 96 aa, Triticum aestivum
  Clone ID: PAT_TA_34518.pep
VQLYSWRVKIMSAPFFIANLVCDQSRSRDSGRTCFRRTSPYFPPGLLANSVSVTPCVPGGGITITRAWAPAPPQPGSELSLLCLIWGSVDEQAVCN

SEQ ID NO: 140101 - protein, 178 aa, Triticum aestivum
  unsure (1)..(178): unsure at all Xaa locations
  Clone ID: PAT_TA_34519.pep
MAGVIRSMVAPLLVLNLXMYTVVIGLASWNLTXLHHNGTTNYAGVAGNGATFYFLLFAILAGVVGAASKLAGVHHVRTWRGDSLATSASSALVAWAITALAFGLACKEIHVGGHRGWRLRVLEAFIIILAFTQLLYVMALHAGLFGNQFGDGYGGAEHQYGDHHHHKGMGTAAATARV

SEQ ID NO: 140102 - protein, 137 aa, Triticum aestivum
  Clone ID: PAT_TA_34520.pep
VSDRLTGAPARRQEWCCREAGPRRLRGRVRVRPGGAAACAAGRAPGRAGAAVSIHRRGAGVPPVANSRGAGRILAVRAPSCAAGDAGGRVAWRALVMQRCAGVPPIPMSSAAGRILPARRASWSATGGGAATCGAWL

SEQ ID NO: 140103 - protein, 106 aa, Triticum aestivum
  Clone ID: PAT_TA_34521.pep
GRPFKRLGRRVYSAEHIHGWDVKPVRFQLSTSDGQQAQSKCYLTDPGVWIYHHVGDFVVKDSNGPLNIKFAIVRIDCTHTKGGLCMDSVVIKPKCLARKKGPGSYE

SEQ ID NO: 140104 - protein, 172 aa, Triticum aestivum
  unsure (1)..(172): unsure at all Xaa locations
  Clone ID: PAT_TA_34522.pep
MAPTRFRRSSVAAGAAAFIALAAVGSASASNTAFVKFPVKAHXVVIFSKSYCPHCKSAKAVFKELELKKDAYVVELGQREDGGEFPEAISDKVRQAYSDLIVTCRGKHLXASDDTVDAYEXGELAKLLNISVKGRSLNIILAQISYLLLRLPRPCNATLDCHFRRTCHWYSC

SEQ ID NO: 140105 - protein, 139 aa, Triticum aestivum
  unsure (1)..(139): unsure at all Xaa locations
  Clone ID: PAT_TA_34523.pep
GPTCRGFRAVCGVSGRRAVSGLALLGAAASCANLLAVPMPVQAAMLEPDVIRYRKLDSGVKLEDVVDGEGPEAREGDLVQFNYVCRRANGYFVHSTVNQFSGESKPVTLRLDVQEMIRRLFSVILTFLQMXKRRALIPP

SEQ ID NO: 140106 - protein, 70 aa, Triticum aestivum
  Clone ID: PAT_TA_34524.pep
SEDVVEGEGPEAREGNLVQFNYVCRRANGYFVHSTVNQFSGESKPVTLRLDVQEVPGQDFSWQLTFLQMI

SEQ ID NO: 140107 - protein, 93 aa, Triticum aestivum
  Clone ID: PAT_TA_34525.pep
PWRHNHGDSQSGHDGGRGSAARKGGESESKRVASIFINCPRTSAATTSVVNFFECFQSSLVPYSCLANALLVEVTVAPPLTARLMYQVCSSCQ

SEQ ID NO: 140108 - protein, 137 aa, Triticum aestivum
  unsure (1)..(137): unsure at all Xaa locations
  Clone ID: PAT_TA_34526.pep
MARTKQTARKSTGGKAPRKQLATKAARKSAPATGGVKKPHRFRPGTVALREIRKYQKSTELLIRKLPFQRLVREIAQDFKTDLRFQSSAVSALQEASEAYLVGLFEDTNLCAIHAKRVTIMPKXTSKLARRIRGERA

SEQ ID NO: 140109 - protein, 403 aa, Triticum aestivum
  unsure (1)..(403): unsure at all Xaa locations
  Clone ID: PAT_TA_34527.pep
TRRELTRILSVQKSPVIHLFSESIAGAATIRGFGQEKRFMKRNLYLLDCFARPLFSSLAAIEWLCLRMELLSTFVFAFCMAILVSFPPGTIEPSMAGLAVTYGLNLNARMSRWILSFCKLENRIISVERIYQYCKIPSEAPLIIENCRPPASWPENGNIQLIDLKVRYKDDLPFVLHGVSCIFPGGKKIGIVGRTGSGKSTLIQALFRLIEPTGGKIIIDDIDVSAIGLHDLRSRLSIIPQDPTLFEGTIRMNLDPLEERSDQEIWEALEKCQLGEVIRSKEEKLDSPVLENGDNWSVGQRQLIALGRALLKQARILVLDEATASVDTATDNLIQKIIRSEFRDCTVCTIAHRIPTVIDSDLVMVLSDGKIAEFDTPQRLVEXDKSSMFMQLVSEYSTRASCI

SEQ ID NO: 140110 - protein, 238 aa, Triticum aestivum
  Clone ID: PAT_TA_34528.pep
MSAGSASFLEIQPSELAFPFELMKQSSCSMQLANKTDRYVAFKVKTTNPKQYCVRPNIGVVLPGSTCDVTVTMQAQREAPPDLQCKDKFLVQSVAAENGAATQDISAAMFNKEPGKVVDECKLRVIYVPTSSPSPFSEDSEQGSSARSLENGTPNSTLPQSVFRSSGEASKDKSSEATSMISKLTEEKMSAVQQNQKLRQELDVLRKESSKSNGGFSITFLIVVGILGIIAGFILKKT

SEQ ID NO: 140111 - protein, 222 aa, Triticum aestivum
  Clone ID: PAT_TA_34529.pep
MFGASNPFGQSSASPFGQTSTNPFGTQQGFGQPSTTTNNPFAPKPFGSPTPAFGAPTGTTSPFGATSTFGQPSAPAFGATSTGAFGQQSAPAFGATSTGAFGQQSTPAFGSTSTGAFGQQPAFGATSTGAFGQPSTPAFGTPSSSPFGSSTPAFGSSPAPAPGAAASGSSPSQSSPFGSTFQQTQPTFGNSTFGTTTTPAFGSTTTAAFGSTTTPAFGSTST

SEQ ID NO: 140112 - protein, 253 aa, Triticum aestivum
  unsure (1)..(253): unsure at all Xaa locations
  Clone ID: PAT_TA_34530.pep
HASANLHFXQIEELMFELSMWRCNDELRVRAEELHRASRKAEKHYIEFWKQVPPTEPYRVILGYVRDKLYYTRERSRHLLTSGSSDIPVDSTFTDVEQFLEPLELCYRSLCDCGDKTVADGSLLDFLRQVSTFRPRSWAPPPPSGPPARTSRSSRSPRRCRPRRHPSGAPWSRCAGVPRGAAEEQLRGPQEAAPPGPSTSGGARQRAGIRAHTAAAYRAPHPPPDVAALPARGGGCPHPPRAAAPAARRGPPR

SEQ ID NO: 140113 - protein, 350 aa, Triticum aestivum
  unsure (1)..(350): unsure at all Xaa locations
  Clone ID: PAT_TA_34531.pep
ASILHWFRSYISIIDKTLVLNSYISMVCSKNTVGQYESHTAFTLPGLYRVVHGIDVFGPRGNIVSPGADMSIYFPFTEKDKRLTALHGSIESLIYDPEQNDVHIGHLDDRSKPILFSMARLDRVKNMTGLVEAYSKNAKLRSLVNLVVVAGYNNVKKSKDREEIAEIEKMHELIKTYNLFGQFRWISAQTNXRARNGELYRYIADTHGAFVQPALYEAFGLTVVEAMTCGLPTFATLXHGGPAEIIEHGISGFHIXPYHPDQAATLMADFFEKCKPDPSPGDEPCDRGVRRSQGEETWQRGTERRKTLAGATGSRRHVPKRAGRGARAYLETFYTARAARGFVCARYVHE

SEQ ID NO: 140114 - protein, 92 aa, Triticum aestivum
  Clone ID: PAT_TA_34532.pep
GPAVVRAGCDLGPRPRRLDSATNEPLFTNCTRDFTGTVDYIFYTADSLSVESLLELLDEENLRKDTALPSPEWSSDHIALLAEFRCKPRIRR

SEQ ID NO: 140115 - protein, 237 aa, Triticum aestivum
  Clone ID: PAT_TA_34533.pep
PCPPRPLPFPTAAPAPCPSRAPAGPGSARPRPLPCCRASAALRPLGAPSSRAGGLLPRSGVLPVRTVLRGSLGAVPSARSPRRDDNGEFSTYRRSPAMPCGVVAAVLASMTQILAGVAICCFGAWRVTKGAKRIAAVVFFITSWVLAIIAVLLFLAGAMLGFEGSAKKTVGNARIVGGVAIFVIATFLFLVVAALDVASYRLVRKKDHYQAYVGSNPPFVPSKDAPYGSAPPPPNQV

SEQ ID NO: 140116 - protein, 243 aa, Triticum aestivum
  unsure (1)..(243): unsure at all Xaa locations
  Clone ID: PAT_TA_34534.pep
MARVSNSKKRMLHTNSSSNKKEEATTANANANAAGNDGRPIRVYADGIFDLFHFGHARALEQAKLLFPNTYLLVGCCNDDLTRRYKGKTVMNQEERYESLRHCKWVDEVIPDAPWVLTPEFIEKHQIDYVAHDALPYADTSGAANDVYEFVKKIGKFKETKRTDGVSTSDLIMRIVKDYNQYVMRNLARGYSRKDXLGVSYVKEKXLQVNMKINKLRETVKAQQEXLQTWAKTAGINHEEWLA

SEQ ID NO: 140117 - protein, 96 aa, Triticum aestivum
  Clone ID: PAT_TA_34535.pep
HPLRAFYVQSVDRCSFGYIMYHGRWPDTLEPKPSLAPHKFPCYTELDRRPVADPFLGRRRLCCALQLRYTKMQVVTAKQAGTIHWLATSSWLIKPK

SEQ ID NO: 140118 - protein, 74 aa, Triticum aestivum
  Clone ID: PAT_TA_34536.pep
TNWWICCKVDTTPEDAASNGKEGCGQRRSNAGSCNRVRWSYNRRLGELQEGWLFFAEQFSFFAGTNVLFPAKKK

SEQ ID NO: 140119 - protein, 76 aa, Triticum aestivum
  Clone ID: PAT_TA_34537.pep
IIITFITKRSVERSLLHVSSSTNGSMSTPSHEDSVSIAQCFTDPFVKSASSSTEEGGRQMTTTSVQDRDSGGRRAF

SEQ ID NO: 140120 - protein, 108 aa, Triticum aestivum
  unsure (1)..(108): unsure at all Xaa locations
  Clone ID: PAT_TA_34538.pep
MAKRLAVALVLLLLVLASCDGRELKGKGGAGGAVDEVKDLLPGLPVPVPPLVPNLPLPPVVPGIPXLPTAPPTTTSLHDHIMPIEFTRLCIMFTGCVRRSACRFRLLL

SEQ ID NO: 140121 - protein, 156 aa, Triticum aestivum
  unsure (1)..(156): unsure at all Xaa locations
  Clone ID: PAT_TA_34539.pep
EQRRTPSSARSSGPAGKPQPRAPRSPPPCCPSSQRRRPAASAPXHPPPEGRRAHRKSPPHQIRACHAWPARPPPHDRGEGRSPQAAPHAWDPPDPPPXAPRPPRATPTGPPPDLAAPAPPXPSKGERQAPPPPEPRGPSPAPPAGGGGGKGRRREG

SEQ ID NO: 140122 - protein, 296 aa, Triticum aestivum
  Clone ID: PAT_TA_34540.pep
MLDRTGAAPQTGERPGGEDGEGDGGEVLADVDAAEVDELLACFKRYRLRSKVEIDNVSEEFLCWQRFGNDVAHAGPSTQEPEAQSIGWGQGSDHAAESSAQGNGHGWQWLKDPRLDILGYRGIFPADTIPPLVEADKEADERHYLLWRIENGVAEGSTEIPKGEAIPLEYNLAGLNAISFDKGCYIGQELIARTHHRGVIRKRLIPLKFVDENDKELEQAVAPGSDVVDDASGKKVGTVSTALGSRGMGLLRLDAALKENATLAISDKRDVRVKAIKPDWWPAEWTQVLEQQSAVA

SEQ ID NO: 140123 - protein, 150 aa, Triticum aestivum
  unsure (1)..(150): unsure at all Xaa locations
  Clone ID: PAT_TA_34541.pep
MMRRLHLAAAVLAVFLPLAVSAAGGKAAAAAAKAPVGPPAPPNITAAMAKGGCKAFAALVAASPDAHSTFQSAGDGGVTAFCPSDDAVRSFMPRYKNLXADGKASLLLFHAVPXYYAPRSLKSKQRVMNTSPTTXGQHFNFTVQERGRQX

SEQ ID NO: 140124 - protein, 89 aa, Triticum aestivum
  Clone ID: PAT_TA_34542.pep
QSFVSRLSRLRSTPLLACSRRSDPIGFTRAIAPLVSHPLRSAALPSLSPARPLPRAALASVAPSRGDGRARRSHPCKKLSCRNQLGCLL

SEQ ID NO: 140125 - protein, 160 aa, Triticum aestivum
  Clone ID: PAT_TA_34543.pep
MMDELRPPSVVQKLHGQSMLFREISSSAMRSHVINNAHYARNFSVTKYHQTNGSIGRLPRNTPSPIRAPAPEEKGFSGFMIDFLMGGVSAAVSKTAAAPIERVKLLIQNQDEMIKSGRLSHPYKSIGHCFTRTIKDEGVVALWRGNTANVIRYFPTQALN

SEQ ID NO: 140126 - protein, 171 aa, Triticum aestivum
  unsure (1)..(171): unsure at all Xaa locations
  Clone ID: PAT_TA_34544.pep
MFFSGDPTSRKRVDLGGRSNKERDRQVLLEQTREERRRRLALRLQNSSATKIQKCFRGRKAFELARLEVRKNFCSTFGEHCQRVDRNCFGNNTDFLRQLLFFFNASKDSDIAILSQVCSLLLQYVKHGDVVSLFAGVDYSSVEPVVIHRVKRLALICVHAVHQKXXDWNNQ

SEQ ID NO: 140127 - protein, 128 aa, Triticum aestivum
  Clone ID: PAT_TA_34545.pep
INNLTTTSGIAWTEEGNGESTKSVNLSLVPCSASRSRILGMVISERSMQVMPQVMSSSRSFSQSCEIAAPNINRTPGRTRGNSGTCRSGIHLLYLLPCCFLLLICLTPMSLTHAAYMLIIRGWTLVPS

SEQ ID NO: 140128 - protein, 163 aa, Triticum aestivum
  Clone ID: PAT_TA_34546.pep
KKLSWVDIFEEIPIKVSNSALVSAFMKELEPESPVSQCDFDRLKLSTAPFMERNLEFMIGCMDGLSSEQNKFQYYYRNLGRQQSQQQAWLQKRRQENMSRKAAGEEPLPEEDPSNPIFKPLPEPSRLEGYLVTNQISSYCNHINGVAGQSFNRLYLMKALQED

SEQ ID NO: 140129 - protein, 356 aa, Triticum aestivum
  unsure (1)..(356): unsure at all Xaa locations
  Clone ID: PAT_TA_34547.pep
MANPAPATGGKSFLQAMSTVTEEAAVQLRVVQMEGLAVLKIIKHCEEFAPALVTGQLLGLDVGSVLEVTNCFPFPIREDDEEADADGANYQLEMMRCLREVNVDNNTVGWYQSCLLGSFQTVELIETFMNYQENIRRCVCIVYDPSRSSQGVLALKALKLTDSFMDLYRNNGLTGEKLREKKLSWVDIFEEIPIKVSNSALVSAFMKELEPESPVSQCDFDRLKLSTAPFMERNLEFMIGCMDGLSSEQNKFQYYYRNLGRQQSQQQAWIQKRRQENMSRKAAGEEPLPEEDPSNPLFKPLPSXTQSELEILQPYQWGCWPDYINGVVDESFTRLYLVGALQVGEVQGARCCEILT

SEQ ID NO: 140130 - protein, 67 aa, Triticum aestivum
  Clone ID: PAT_TA_34548.pep
SHTHDTLPLKIVYICECTSIISYRGERCWSFLEDHKGSCLLELILIYCIDQLCQVILWYLAFPNFYI

SEQ ID NO: 140131 - protein, 207 aa, Triticum aestivum
  unsure (1)..(207): unsure at all Xaa locations
  Clone ID: PAT_TA_34549.pep
MESESGMGTEGESGKEQDLLLDLGRKLGKMEIELGKWTEQASGKEQETVRDLKKRHRKLSKNRRYLLQDIVSGKFKELYSDSGRNRVMGIFREAEELDKELMIIKEKEKEKEKQETVVDSGEEEMGRDSAQHQSLMEGINSVERERKDLLGSLTPTFSLWKEIDSQTTWTIATTESATXSRDNXENXLADYFNLILQXMEDLGHRML

SEQ ID NO: 140132 - protein, 122 aa, Triticum aestivum
  Clone ID: PAT_TA_34550.pep
PCNVSTHRLESDIRSISKFNKFVEDNGFKLNTEGGILKVSPDGLLQQSSTVADSSLFTFADGITESIPRSYIEFAERLPLPQFRDLQDEEVKEHHRRDGFEVGNADKIFESTSKDQLTRRSA

SEQ ID NO: 140133 - protein, 176 aa, Triticum aestivum
  Clone ID: PAT_TA_34551.pep
MNPQEKSPVDGPLPQWFREGMAGPILNSGMCSEVFQFDVSAATNSGGIIPASPAVNSSSVNATRKVPTPAPAYYGKLKNRRIMYNEAIPLTGKTANNTGPFNRTSESSKLPDKKPASSVVVSVLADPREAGDGDSDPRMTPKSLSRIFVVVLLDGVRYVTYSCTLPFKGASPHLVN

SEQ ID NO: 140134 - protein, 69 aa, Triticum aestivum
  Clone ID: PAT_TA_34552.pep
NLKNKQPPPLFFFFFFFFFFFFFFFFFFFFFFFFFFFFFFFFFFFFFFTQSSDGSIQNVKIHYNAWCIS

SEQ ID NO: 140135 - protein, 245 aa, Triticum aestivum
  Clone ID: PAT_TA_34553.pep
QAQMENSFEKNNMLKEFYIPTYIFMPESSVEQVSHIPCCPVIVFINTRSGGQLGHNLLITYRKLLNHAQVFDLLDETPDKVLHKLYNNVERLKRDGDTLASEIHRRLRLIVAGGDGTAGWLLGVVSDLKLVHPPPVATVPLGTGNNLPYSFGWGKRNPGTDRESVISFLKLVKEAREINIDSWHTVMRMKCPKRSPCDPIAPSDLPHPLHAFHRVHFTDPEDMEYSYTYRGGFWNYFSMGMDAQV

SEQ ID NO: 140136 - protein, 245 aa, Triticum aestivum
  Clone ID: PAT_TA_34554.pep
DIAPSVPNKRLTPSVSNIDNLKNKVSENGKSFNTRGIKDKKKSEERKKKRTVQEEERERGRVSLNVYLTYMGEAYKGSLIPLIVLAQTLFQVLQIASNWWMAWANPQTEGDAPKTSSVVLLVVYMCLAFGSSLFVFVRSLLVATFGLAAAQKLFIKMLRCVFRAPMSFFDTTPSGRILNRVSVDQSVVDLDIAFRLGGFASTTIQLLGIVAVMSKVTWQVLFLIVPMAMACMWMQRYYIASSREL

SEQ ID NO: 140137 - protein, 221 aa, Triticum aestivum
  unsure (1)..(221): unsure at all Xaa locations
  Clone ID: PAT_TA_34555.pep
MLRVEEALAAVLSAAAACRAAPSAVPLLDALGLVLAEDVRAPDPLPPFRASVKDGYAVVAADGPGEYPVIAEARAGDDALGVVVTPGTVAYVTTGGPIPDGADAVVQVEDTEQVAAAPDGSKRVRISVRVPEGHDIRSVGCDIEKDYIVLKSGENIGPAEIGLLATVGVTTVKAYRRPTIAVFSTGDELVQPATATLNRGQIRDSNRALVLAAAXXRKCXX

SEQ ID NO: 140138 - protein, 244 aa, Triticum aestivum
  Clone ID: PAT_TA_34556.pep
LEVQRGDVYNLEQGSILYIQSYPNATRERLRIYAIFTSNAINSDDPSHPNSEAYSSVSNLLRGFEVKILRQGFGVSAEVVEAIRSAKSPQSIITYNPDQEKEEKSNWTEEIFNALWGDESPLNKKKKKDKHKKKDKKDDKSKSETFNFYSGKPDVKNCFGWSKTMTNKDLQNLKGSNIGMFMVNLTTGAMMGPHWNPKATEIAIVTHGSGIVQVVCPSIPSGTGGGHGHHDEGGRGGGDHGHHD

SEQ ID NO: 140139 - protein, 82 aa, Triticum aestivum
  Clone ID: PAT_TA_34557.pep
SRSASRTSPFLISCRSTNDTATAVRLPRSLPIRASNEIPLLTRHDIGMRRKGVGGMRTSCVINCSLSMRALWLCIFQLGSCC

SEQ ID NO: 140140 - protein, 62 aa, Triticum aestivum
  Clone ID: PAT_TA_34558.pep
EKFRREHPELYKGQDSQANETGGKPTDGNNPGGPPPGRREAATDELLLERFRKREKFRVMRR

SEQ ID NO: 140141 - protein, 337 aa, Triticum aestivum
  unsure (1)..(337): unsure at all Xaa locations
  Clone ID: PAT_TA_34559.pep
SIAYDGTLPDLYLPNIEHGIVNAAKDEPASTTSSAQLTKRPWKLFIPNAYHPLLLQQHQENLRRTKKDVASATAEIRRRRIYGQDITEEDQLASELDFMKIRVSELERNHPIPVDFMIAEETTVLVITGPNTGGKTISLKTVGLASLMAKIGLYILASEPVKIPWFDAVYADIGDEQSLTQSLSTFSGHLKQIGXSLTIRTASEPSFYXAIRAQSTSQSLVLLDEVGAGTNPLEGAALGMSLLESFAEAGSFLTLATTHHGELKTLKYSNDSFENACVEFDEENLKPTFRILWGIPGRSNAINIAERLGLPLDIIESSRQLLGTAGAEINAVSSTGS

SEQ ID NO: 140142 - protein, 250 aa, Triticum aestivum
  Clone ID: PAT_TA_34560.pep
ARFNLVTALSNIEAKKRFEFLEAVSGTMDAHLRYFKQGYELLHQMEPYINQVLAYAQQSRERSNYEQAALVERMQEFKRQIDRESRWSPNGMTDSPNGDGIQAIGRSSHKMIEAVMQSASKGKQNSRPSSGYSNQRSSTPTEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSGHHRTNSES

SEQ ID NO: 140143 - protein, 334 aa, Triticum aestivum
  unsure (1)..(334): unsure at all Xaa locations
  Clone ID: PAT_TA_34561.pep
EWPVPMPDGSMGGPWDYXNAASFIHYTVSKGYDIYGWELGNELSGSGVGTRVGADQYAADVINLNQIVDKAYQGSKPLVIAPGGFFDAGWFTELVAKTKPNQMDVITHHIYNLGPGVDTHLVEKILNPSYLDNMVSTFSNLQGILKSAGTSTTAWVGEAGGAYNSGHHLVTDAFVFSFWYLDQLGMSAKYDTKSYCRQILVGGNYGLLNTTTFEPNPDYYSALLWHRLMGTKVLSTTFNGTNKIRAYTHCAKDSQGITLLLINLSGNNTNHIYVTSEGAQEVTHPHVAKEHTRSIPKLGETXGSQRXEYXLTXKDWNLQSQHMLLNXNXLGQRQ

SEQ ID NO: 140144 - protein, 66 aa, Triticum aestivum
  unsure (1)..(66): unsure at all Xaa locations
  Clone ID: PAT_TA_34562.pep
KNKFGCFKEXVIFFFFFFFFFFFFFFFFFFFFFFFFFFFFLRKRSIHVLIIPSATRNQGVLTSELC

SEQ ID NO: 140145 - protein, 194 aa, Triticum aestivum
  Clone ID: PAT_TA_34563.pep
MPKPGTHAVLNLSISLRFDWFVQPGRRRAAEDEQALDPPHPPPHPRGAGPAVPVPVFHGGSGQGGPGEVGGLRAPLLLHHPLAGPGVTLLYPLYASVHAMESPSKVDDEQWLAYWILYSFITLLEMVLESLIYWIPIWYPLKLLFLAWLALPKFKGAAFIYDRFIVVLRVFTYLVRNDHKVHILKAEADHGHVH

SEQ ID NO: 140146 - protein, 110 aa, Triticum aestivum
  Clone ID: PAT_TA_34564.pep
MAQAQATRGSGDPMKAQQEQPEPIQYGHVFAVTGDLAVQAIAPRDAEAMRTAEESVQGVQVPQASGGGFSAAVAMETAATYNQAVGAVRPGQASDAATKQGITVTQTAVP

SEQ ID NO: 140147 - protein, 128 aa, Triticum aestivum
  unsure (1)..(128): unsure at all Xaa locations
  Clone ID: PAT_TA_34565.pep
MGEGARSATLCAGRPPPGATDAAGIRAAADAAAGSXEVMPGGLADQAWAAASANAWAERDEDKITVGDVLSDATTKLADDKPAAREDAARVVQAETYSDAGARTKAGGVGAAVTTAARLNQEDDDDDA

SEQ ID NO: 140148 - protein, 74 aa, Triticum aestivum
  Clone ID: PAT_TA_34566.pep
LTNVREPSFKNLNTGKDHIVSAPSSRPSFHVRTRPGPSHSSFRHRAHHHTCRRPSPRRRYNPPCHQTRHPRRRR

SEQ ID NO: 140149 - protein, 289 aa, Triticum aestivum
  unsure (1)..(289): unsure at all Xaa locations
  Clone ID: PAT_TA_34567.pep
PRATASPALDDDAGEGEGEVHIPDWAGMRAEALSAGVRGRGVADVPTGPGRAWRAWRRLADRDPGPWRRLDMTRHGDILETEEAEAMARPAVEPPAGTLHSFCADTFVNPTLSSCYHLRQGQPSXLRAVQLSLCDEVSNEALAEAVKGFPQLEELEITFCSLNSNVCELVGRACPQLKSFRLNERWTILQRGFAAFEGMDDDTGALGRENSMPEPRGLQLMGNNVPSLETGPRSSPTDPPSSPLDVRRCCNLQVDDALRCKRPRIGNLRLPRDPSSVPRRFRHRGRHVR

SEQ ID NO: 140150 - protein, 114 aa, Triticum aestivum
  Clone ID: PAT_TA_34568.pep
MAQQEKKAPELQQDPEIQDSENRTQQVKKAPELQDPEIRAELDRRAREEGETVIKSGAGGKTLEAQERLAEGRKKGGLSRATGSGNERAEGEGGVVIEPDEKKLKEVKKDLGRE

SEQ ID NO: 140151 - protein, 710 aa, Triticum aestivum
  unsure (1)..(710): unsure at all Xaa locations
  Clone ID: PAT_TA_34569.pep
TRPTFSRQILDALIVMKGAGIIHCDLKPENILITPKVNSAAGVKVIDFGSACMEGKTIYSYIQSRYYRSPEVLLGYPYTTAIDMWSFGCIVAELYIGLPLFPGASEYDVLSRMIEIVGGQPPDDLLREAKNTRKFFKHVGSIYPGNEAHDGLCSSYRVLTEDEVEARDSKKPKIGKWYFPRGRLDRLIFAYPWKNLNEGNLPETEKEDCLALVDFLRGLVEFDPNKRWSPLQASYHPFITGEAFTGPYEPFRETPVIPVGRAATVDHNPGGGHWLAAGLSPQVGSXSINRSLPFNNVFPPKMPFSYGSSCGSFSSRGSFNDNVGPASSYGSYDVNNVNMYHSPLGPSGFNLQSQAGGTFLGFSPDIRRRPHLSHGVGIRLSPGGPGPMSLGASPSQFTPPNSQTQMPASATAKYVATSPARGSHGSSLGKAAVVGQYNRRRNLGHPPMSMPPHEYTSQLIQGPHGDSVSSAFVRGHSGYSYGALPNSGHYNWRPQIGVSTGLSTNSSSNHGYVQPSGYNDFRPLHSSNVRADTSTSSSVPDPADWDPNYSDESLLQEDNSLSAELGSVHLRDASGRTIQSGRLPNIQSHDIAGSNQRNDFLFHAPSLRESGHSTGHVNYDSYNHANYSQRNFPGRHGQPFQRHNHMNSTSIRPTGNLQNVQSAWSKYGMPDSTSPPRMVEGMPWGGSAGHSLATSGLPPSFGRKDFGRIF

SEQ ID NO: 140152 - protein, 300 aa, Triticum aestivum
  Clone ID: PAT_TA_34570.pep
GQTKLKVLKDIAKEHQIDWDPSEAEQDLLKPAEELIQGPSSFGEASKMPVKTTLSANFVQPSPSNYSSGYADEHDDNNVGGAMQFKDAASAARAAAESAAQAAFAAKAAANLANENNHSSDEDDDDDEDEDWKTTLHESTHSSRRQSMMSNSSRISRKENASTFDEMRLRGSTGGRRLSGSNHMEEKDSDLLQDLGTGRTRRRNSRAASKVHSEIKFDDSEVEDGSDAEIQSSLERRPPQKDRYQGNGHHEEKEAEDDDDDFPEPPKANPGSRVHPNMPLDFETLTARFEALRSSGGKLP

SEQ ID NO: 140153 - protein, 164 aa, Triticum aestivum
  Clone ID: PAT_TA_34571.pep
MERILKSARESGSLNLSNRSLSEVPGEVYNNLDTGSLDDKWWEGVDLQKLILAHNNLEVLREDLRNLSSLVVLNISHNQLSSVPAAIGDLPLLKSLDVSFNQIKLIPEEVGLATALVKVDFSNNCLTELPASLGRCLNLSELKASNNNISRLPDELAGCCKLRI

SEQ ID NO: 140154 - protein, 322 aa, Triticum aestivum
  Clone ID: PAT_TA_34572.pep
DVPSLQEVNRMIARTEEEVELFDQMDEEFDWTGDMMKHNQVPKWLRVGSTDVDCVVASLTKKPARNALGSAPDNGDKLEKRRGRPTGSGKYSIYREYEDEDDEESEEDDEERNTPSHPEEEAGESEEEEENDDSVPDDDNKDQSEEEEPNNDDRYDLQQGTGSGKGHKSEEAGSTGSSSGSRRLPPPAPSSSLKKLRSLSALDSRPGTFSKRTSDDLEDGEIALSGDSHMDLQQSGSWNHDRDDGEDEQVLQPKIKRKRSLRTRPRPSTDKQEDRSGADGTFPQRGARLLFPGDGDYDSQQDAHALADPTSRQQDTVHPIVK

SEQ ID NO: 140155 - protein, 199 aa, Triticum aestivum
  Clone ID: PAT_TA_34573.pep
NLQSAHSRSSSTYCTRHAGREERHGGHQGGGGERGRLRLLRHGEDAGHPAGAGGQGHGAQRRRQGGGRDEGASACSGMEKTRATLQGQVDKATAHSAADREAAETRTRERVHGAEEVKRDAMLANAAAKERATAGAYHPSQGAPGIVPGGAPTGGRVEAGVAESRPIGTATGTGRPSAAHNPRVGGGAAPATGTGGQYQ

SEQ ID NO: 140156 - protein, 228 aa, Triticum aestivum
  unsure (1)..(228): unsure at all Xaa locations
  Clone ID: PAT_TA_34574.pep
TRDDLGVKFWNHSDWKPCKEVAEKMLDIMHKANLMKRHADAKLCTLRSFITFLSVYTGTSSSNEPTLPDGGISATAMESAIRCACKYLQSTVDSLFPEVDTNEVLFPLLSGQVDLLLTLTRFLFHQAKQTKSYVHLYPVIVLLMRTSGASTSFLVDLVPSSPALKKPVKSLLVLILSLFEFIYGKDDMKDGSGDANLFGESSIISTRLXPVLCXLAENREYSDLAVGS

SEQ ID NO: 140157 - protein, 278 aa, Triticum aestivum
  unsure (1)..(278): unsure at all Xaa locations
  Clone ID: PAT_TA_34575.pep
MACSAHLLSQSLYQSHRSCPVPSKHLRFQARPAAAFSAGVSSSFSTRSRRSPSVRVAASAEQGRKKIELTYDAQAKFNQLADQIDKDVGITRLNLFSPCKINVFLRITGKRPDGFHDLASLFHVVSLGDTIKFSLSPSKSKDRLSTNVAGVPVDESNLIIRALDLYRKKTGTDKHFWIHLDKKVPTGAGLGGGSSNAATALWAANQFSGGIASEKDLQEWSGEIGSDIPFFFSRGAAYCTGRGEIVQDIPNLLPENLPMVLIKPXEACSTAEVYKRPG

SEQ ID NO: 140158 - protein, 105 aa, Triticum aestivum
  unsure (1)..(105): unsure at all Xaa locations
  Clone ID: PAT_TA_34576.pep
AAPVSKKFYMGKKPGNAGPSSASRPMNQAVSLREETSGKTQADPPSLLRVQHLQRLGAWASGEVGVGSIGALLGRRLATNAEAAGIPIGASTFLCQRCEXXLLPG

SEQ ID NO: 140159 - protein, 269 aa, Triticum aestivum
  unsure (1)..(269): unsure at all Xaa locations
  Clone ID: PAT_TA_34577.pep
MAGSSTSTFVIRWFNFLTMILAILVVGFGFWMSTHNDECRRSLTIPVMGLGGVIFLMSLAGFVGAWKNISCLLWTYLIMLFVVLVAIMVFTVLAFIITNTGTGIAVPGSLYNGYRLQDYSSCFVKDLQNTLXWMHLRLCLVQSYERKVVSQSFETLKXYQLAELTPSVSGFSLCFSEFXYPALGAWGYDPSFYALRTNVXCKLYKNDPVPQLXYDCNSCKAGVAHDMKTEWRVVAIFNVILFIILSLVYFVGCCARRHAGGXDSKVPGR

SEQ ID NO: 140160 - protein, 227 aa, Triticum aestivum
  Clone ID: PAT_TA_34578.pep
QKLTDVGNSWASLPPSLAKLGKELLKYRESAQVAAVEAMQEASAAESLLRCLSSYAEVSSTAEEQNPQPTVEQFLALHSSLSRATVITDTLTKSAAPPECSAASDAGTVASATDDEAAAAVAAERQRRAKSWVNAALATDLSGFGLYNLKPVPATVSSPLAVVVVDESAKPVAAPPNAVKSLSPAAKSRMPAKGKPRTGPGATAAAVTPAPPEWERGVGAEERGQLA

SEQ ID NO: 140161 - protein, 319 aa, Triticum aestivum
  Clone ID: PAT_TA_34579.pep
RPTRPQQQSLQYMDDKVTYAGAGNIKDGRSKLILRDVFVAHVPVNNGNFQPKCIYTAVMLRRMLDAILNSDTFDDKDYVGNKRLELSGQLVSLLFEDLFKTMNTYAVDRMNKNSDMARSSPLDFSQLIMQQDVITSGLERAISTGNWDIKRFKMHRKGVSQVLSRLSYMASLGYMTRITPQFEKTRKTSGPRALQPSQWGMLCPCDTPEGEACGLTKNLALMTHVTTDQEEGPLRNLCFSLGVEDLSLLSGEEIHAPGSFLVMFNGLILGKHRQPQRFANNMRTFRRSGKIGEFVSVFVNEKQHCIHIASDGGRVCRPL

SEQ ID NO: 140162 - protein, 134 aa, Triticum aestivum
  unsure (1)..(134): unsure at all Xaa locations
  Clone ID: PAT_TA_34580.pep
APARTGPAAPGPAAPHLRLAAAGSAAQLPPPPPXLSRQHGPRLPDLKQPHRVAAQHSTTTALIRRSQLARHQRHRSPAAAYITARVNGCNPCRSNHEMCDAQHRCGWTMVLCNISDDEPLRETIKGPLGFQDKK

SEQ ID NO: 140163 - protein, 146 aa, Triticum aestivum
  Clone ID: PAT_TA_34581.pep
PGTGRGSTTGHRNDLPAGIWRRRKLSSPPRGSCIAQPGATPWRSCPAPSTPSNRRRLPARPCRCVAGRLSCVSSPQGSSTPSLTTLPAGLPDRILLRPATSHIARRSWPYVMAKGIQPCQGPVVIHMLLMDELALCHGKMYSALSW

SEQ ID NO: 140164 - protein, 151 aa, Triticum aestivum
  Clone ID: PAT_TA_34582.pep
KETWRTYNCYRSRRTDVSGTPTDVLLPAGASLLEVYDDDKLISCRCIIMETYCCRQSREQPEGSQGPRAAAAAAVWVVVPEAAASATWAPHPSPRRRRHRRRHSLSAPSRRRTRAPSPPAAAGARHPDASPLLRFANQEPEILLALWYALW

SEQ ID NO: 140165 - protein, 101 aa, Triticum aestivum
  Clone ID: PAT_TA_34583.pep
CMNVEKSCVHPSGPFGTSQLINVGAARQVIVEPAGSRPSREALAYVGCGGITGRSSLYVWILVKLVLTPCRFFASDCSSFWKGSLQRSVARDVHEYRQVRF

SEQ ID NO: 140166 - protein, 109 aa, Triticum aestivum
  Clone ID: PAT_TA_34584.pep
RSTACECCPCFGQPATPVGPEEKFSVTHGQTALVSLYQCRNSFGRSTACECSPCFGQPANPAWAEEKFSVTRSNCSSLPEPMQVETCFLVRRLLDAARCLVSRKPNNYF

SEQ ID NO: 140167 - protein, 112 aa, Triticum aestivum
  Clone ID: PAT_TA_34585.pep
GSSAQNRPQVEGKLLGGDNRARRRRRVEGKLLRGRAVRRGTSVAVASIARATAAGKRHVRATREPSRSLLTARATAACAAEARPHDYGAKLLAEGYVQHNNGCNLSVGLSET

SEQ ID NO: 140168 - protein, 229 aa, Triticum aestivum
  unsure (1)..(229): unsure at all Xaa locations
  Clone ID: PAT_TA_34586.pep
MNRTVAAIPAVRKTEAEAQVAAPAPKRLASAGTAGRRPRKRIREDKLVSDGDLISHGDLISKLPDDILGTIISLLPTKDGARTQAIARRWRPLWRLAPLNLHASYHLCSKQFKSLSVVSRILSDHPGPARRFVFSLVRLHKAKKRHAEESAQIENWFHSRALRNLKELDISFDLLDYVHEKXYPLPSSVFCLAPTLLVATIGFCKFPKEITHSLSXPLLKQLNLRRVSI

SEQ ID NO: 140169 - protein, 140 aa, Triticum aestivum
  unsure (1)..(140): unsure at all Xaa locations
  Clone ID: PAT_TA_34587.pep
MAEVKPEEMVHHPPMDQLQGFEYCIDSNPSWGEAIGLGFQHYILSLGTAVMIPTMLVPLMGGNDHDKAKVVQTLLFETGIKDTAPDAFLELRLPTVIGGXSYAYVXVXALSIIHDRSLAQIAXGHTRFLQTMRATQGALI

SEQ ID NO: 140170 - protein, 344 aa, Triticum aestivum
  unsure (1)..(344): unsure at all Xaa locations
  Clone ID: PAT_TA_34588.pep
QFPSDIATVLLAAGSTVTIQTASKMLCLTLEEFLEQPPCDAKTILLSIFVPDWGSDNVIFETSRAAPRPFGNAVSYVNSAFLARTSGDAATGELIVDEICLAFGAYGVDHAARARKVEEFLKGKSMSASVILEAVRLLKDVISPSEGTTHPEYRVSLAVSFLFSFLSSLATDLDEPAKAITPNGLSTNGTMNGNGASSXEKQSKVGSDDLPIRSRQELVFTEEYKPVGKPTTKAGAELQASXGEAVYVDDIPSPKDCLLRSIIYSTHLKPISKQLQLWIKAHGTPQNPAVGRILVSPGVGDNVSVSVLNPGKYGCDNQSTREQLTVNPAHRKRCTIFTPFATLD

SEQ ID NO: 140171 - protein, 286 aa, Triticum aestivum
  Clone ID: PAT_TA_34589.pep
RSEDDSGRELEHLCRRVKTIATLLAYLKSKARIMAIPHLAHTSCGIRNQDGVGFVDRHGLPLADWSKAAEPASCGGGSDDRASAEGSGVHKNCDAVEGDGDVDDILKSIRVVTDVMESLVKRVIVAESETANEKEKVRIGLEEIRRKTIQVESMSVKVEEMEKFAVGTNGMLNEMRQRVEDMVLETTRQRQRAAENEQELSRVKNDFESLRTYVSTLVSVRETLLSSEKQFETMEKLFDRLVARTNQLETEKAQKEAEVQKVMEENVRLRAMVDKKDAQLQAMSEQ

SEQ ID NO: 140172 - protein, 344 aa, Triticum aestivum
  unsure (1)..(344): unsure at all Xaa locations
  Clone ID: PAT_TA_34590.pep
MEEDGPSRSGLPPVGECEWREELRQQQSQVEALRDRLVEVKVGMRRSEDDSGRELEHLCRRVKTIATLLAYLKSKARIMAIPHLAHTSCGIRNQDGVGFVDRHGVPLADWSKAAEPASCGAGSDDRAAAEGSGVHKHGDAVEGDGDVDDILKSIRVVTDVMESLVKRVIVAESETANEKEKVRIGLEEIRRKXTIQVESMSVKVEEMEKFAVGTNGMLKRTRRQRVEGMVLETTRQRQRAAENEQELSRVKNDFESLRTYVSTLXSVRETLLSSEXQFETMEKLFDRASRKXTTSSETEKAQKEAEVQKVMEENVRLRAMVDKKDAQLQAMSEQCKFMALNRPN

SEQ ID NO: 140173 - protein, 264 aa, Triticum aestivum
  Clone ID: PAT_TA_34591.pep
LGRLLCPFYVASVISAFVVLRCAFLYTRPLPKFPIPRAPQPTPSFAVAERETGMRHVPEWLPAFPDPHTYVRTEVWSEQAAKDRVDMVEQVRQRRKAEKSLLSLQQRLALAGADGFRPAVSEDSAAKGKEIQPAGSKRNPFLEPALPHGDKEVSEVDIPSERKKLSVLDAFAPAIQGANAMELDSGTGWDQNQNQKSIVPKVRAPVHLKIGVNKKPLAVALNSNSMDLREDPSFLKEEQKDDRKRRAGMILRASMDNPQELPQI

SEQ ID NO: 140174 - protein, 73 aa, Triticum aestivum
  Clone ID: PAT_TA_34592.pep
KYISTNRVTAHITLPCHTRHNRPDGDRRQTHAYPRQRFSWVPAGMHVRHMRMIIITSMIISNSMEITNMHPCI

SEQ ID NO: 140175 - protein, 156 aa, Triticum aestivum
  unsure (1)..(156): unsure at all Xaa locations
  Clone ID: PAT_TA_34593.pep
FCRRKEASGRPEVSGNFLKLNSCQVVLPKDLVLSKSDIRESSYRKHSLWMAHWTRDGHSAEPQNSKSCSPFEEIDDVGYSKDCGNLPFELMKARMAERLMVGVSHGGASSGNXQQFSSNMXGVAHDVCQEVQCKNXDQFNRPFRRSMVQKNLNGYA

SEQ ID NO: 140176 - protein, 214 aa, Triticum aestivum
  Clone ID: PAT_TA_34594.pep
MATPTAAADTAAAPLTPVAPEPAAKFSLASSDMAAPTAAADTSAPPPPAPVPPTAAADTSAPPPPAPSPPTAGADTAAPPPPPPPTTTEPAAKVSHSPYHMAAPTATAETVGRPIPPPPAPEIAAKVSHFPPPFPPQPDAPAPKRRKLEEAGFHTSAYYKIRATVADLRLRFVQVHEATDFRKSDAAREILREIKTVMELSKKMRLDLGVSSEP

SEQ ID NO: 140177 - protein, 353 aa, Triticum aestivum
  Clone ID: PAT_TA_34595.pep
MSRTGSRLASSVVRLPGRSRVSASPSPRRRSLSPSPSPRRQRRRDRSPIPSRDRRGERSPVPSRDRRRDRSPSPYRDRRRDRSPSPFRDRRRQWSPYHNERGRDMDRVRDVEPPARRGGGGGGEWSASDDDDEDLKGLTYFEYRRVKRQKLRKSLKKCIWKVTPSPPRRDDEADEYQYSEEEEEKKESPKKESSEKSDEEENKDSSESESDESGSLSDSSESDYCRKKKKGRKGRRSSSKRNKRAHRRHRKSDMESESDSKVDEDSEGSDDSEDSRDKRRSKRSRRHKKSKRRGRSSRRKKSKSLDVPSDVSSEEVEVLVSSPISTDSKKMGKSSRKKSSSQSDSEDSIPSDA

SEQ ID NO: 140178 - protein, 105 aa, Triticum aestivum
  Clone ID: PAT_TA_34596.pep
MAGARLSRTQRYLVAVEYDGTRFSGSQQQPNQRTVVGVLKEAFHKFIGQPVSIFCSSRTDAGVHALSNVCHVDVERISKRKPGEVVCMHTLFSLNWLTLRICINY

SEQ ID NO: 140179 - protein, 238 aa, Triticum aestivum
  Clone ID: PAT_TA_34597.pep
MLPTRFPSRGADNAAGLETLLPAASRAVLSEFIATAVFVFAAEGSVYGLWKMYKDTGTLGGLLVVAVAHALALAAAVALASGASGGHVNPAVTFGVLVGRRISFARAVLYWAAQLLGAVLAAALLRIISGGVRPMGFTLGHGIHERHALLLEVVMTFGLMYTVYATAVDRNRGGNVGTIAPIAIGFVLGANILAGGPFDGAAMNPARAFGPALGGWTWRHHWVYWVGPLIGARAGRRA

SEQ ID NO: 140180 - protein, 214 aa, Triticum aestivum
  unsure (1)..(214): unsure at all Xaa locations
  Clone ID: PAT_TA_34598.pep
MQQPRGGCWAARRLLAAPAPPPDPAHPMDAQPMARLETVFSGTTIVLFVATVSYVVFSAVYACIRATRYDARQQGHGWVDGDGLGAAAPREETKRALETIPVRVVVLQQQQQQPGDVIGGRKNKKDADADAGDCAVCLAEYAAGDEVRXLPACRHGFHRECVDRWLLTRAPTCPVCRATVGAHVEGADAKEDYAAGHGGGIGFAAGSHALPEPV

SEQ ID NO: 140181 - protein, 147 aa, Triticum aestivum
  Clone ID: PAT_TA_34599.pep
KIEVDTMFIANTSNGLLIKTWQDGCGYARKVKFANVVMKNVSDPIIIDQYRSEHPIPCGSTAATRTVAVEKIDYVNIAGTSASKRAVTFSCSDVVPCRQVSLKDVNLKRLSGRGASAYCRSASGKAAGVVVPESCLAGARAAGVEEQ

SEQ ID NO: 140182 - protein, 188 aa, Triticum aestivum
  Clone ID: PAT_TA_34600.pep
GRRWRARPVPVHGAEIAGRARDESVHQAKGHACVHAIAEEDPGRWRGLGGVEELLLAQERGCSLGRSPVHWRSDEGRHQGCLVGVVDGGRWVAWSCLLCGSGARVIMTTMATTAITAAVAWAPMARNTSTVASGRSTDLPSNASNKGRGDSVQVHPCHLTFSLVLFMLCFSCRNCSRRGAVLITCKNS

SEQ ID NO: 140183 - protein, 351 aa, Triticum aestivum
  Clone ID: PAT_TA_34601.pep
PRVRVFPAGGDGLYLVVDENGKFREDSFQKSLNVLAPATGSDKKRENGKRQKGLVSAGKTNEESDIFKMVKMIIQRQYDPVILFSFSKRECEFLAMQMAKMDLNGDDEKVNIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMMLKGGADSLNSAFHLSYNMLLNQLRSEDGDPEKLLRHSFYQFQADRALPDLEKQVRELEIERSSMVIEDEESVKDYYDLLQQYRTLKKDVRDIVLSPKYILPFLQSEGL

SEQ ID NO: 140184 - protein, 282 aa, Triticum aestivum
  Clone ID: PAT_TA_34602.pep
MAGAGAGEDDAAWERAISAAVKSAPLSPFSAPKTLTLDGAVKSSTGRLPSPALFDRFPSLEELSVAGARLSSLAGLPRLPALRRLSLPDNRLAGADSLAAVADSCGGTIRHLDLGNNRFAAVEELAPLAPLGVESLDLYQCPVTKLKGYREKVFALVPSLKYLDGVDAEGNDRLESDEDEEEDEDEDEEEEEEGAEDGEGEGDEEDGEEEDGDEEEDGEEEEGDEEEEEGDEAEDEEDEAEDDEPESGAAEKSEVVNGNKSAGSALPSKRKRDNEDGANGDN

SEQ ID NO: 140185 - protein, 217 aa, Triticum aestivum
  Clone ID: PAT_TA_34603.pep
DILGFENAEFYIKRWPELDGMRFGDVLISFPDAVPCGVKLASRFGSILMNPDDDYVLREGDEILVIAEDDDTYAPAPLPEVHKGFLPNVPTPPKYPEKILFCGWRRDIHDMIMVLEAFLAPGSELWMFNEVPEKARETKLTDGGMDILGLTNIKLVHKEGNAVIRRHLESLPLETFDSILILADESVEEFLLQSHSRSLVTSLLINDVQSTCLLPAG

SEQ ID NO: 140186 - protein, 180 aa, Triticum aestivum
  Clone ID: PAT_TA_34604.pep
MFGRMPRKTSNNTKYYEVLGVSKTATPDELKKAYRKAAIKNHPDKGGDPEKFKELAQAYDVLNDPEKREIYDQYGEDAIKEGMGGSGGADMHSPFDIFEQLFGGGGGGFGGGSSRGRRQKRGEDVVHTMKVSLEDLYNGATKKLSLSRNVLCGKCKGKGSKSGATATCSGCRGAGMRMIT

SEQ ID NO: 140187 - protein, 279 aa, Triticum aestivum
  Clone ID: PAT_TA_34605.pep
MFGRMPRKTSNNTKYYEVLGVSKTATPDELKKAYRKAAIKNHPDKGGDPEKFKELAQAYDVLNDPEKRDRDKVSQEKKVLEVHVEKGMQHGQKIVFQGEADEAPDTVTGDIVFVLQLKEHPKFKRKSDDLFVEHTISLTEALCGFQFVLTHLDGRQLLIKSNPGEIIKPGQHKAINDEGMPQHGRPFMKGRLFVEFSVEFPEPGVLTPSQCKSLEKILPPRPGSQSSDMDVDQCEETTMHDVNIEEEMRRRQHQRRQEAYDEEDDDEGGAPRGVQCAQQ

SEQ ID NO: 140188 - protein, 370 aa, Triticum aestivum
  Clone ID: PAT_TA_34606.pep
ISVGPREDGGEEGRRGPRDGRGGAGGEAAAAGERPHRGAPPRPEPHARGGGGGFGGGSSRGRRQKRGEDVVHTMKVSLEDLYNGATKKLSLSRNVLCGKCKGKGSKSGATATCSGCRGAGMRMITRQIGPGMIQQMNTVCPECRGSGEMINDKDRCPSCRGNKVSQEKKVLEVHVEKGMQHGQKIVFQGEADEAPDTVTGDIVFVLQLKEHPKFKRKSDDLFVEHTISLTEALCGFQFVLTHLDGRQLLIKSNPGEIIKPGQHKAINDEGMPQHGRPFMKGRLFVEFSVEFPEPGVLTPSQCKSLEKILPPRPGSQSSDMDVDQCEETTMHDVNIEEEMRRRQHQRRQEAYDEEDDDEGGAPRGVQCAQQ

SEQ ID NO: 140189 - protein, 206 aa, Triticum aestivum
  unsure (1)..(206): unsure at all Xaa locations
  Clone ID: PAT_TA_34607.pep
EGMGGSGGADMHSPFDGVRSSXFGGGGGGFGGGSSRXRRQKRGEDVVHTMKVSLEDLYNGATKKLSLSRNXLCGKCKGKGSKSGATATCRGCRGGGMSMITRQIGPGMIXQEMNTVCSEYRGTGEIINDKDRCPSXQGRKKPRRRRDMEVHGRKGIQHGLRSVLRGEADEVSSKVAADVDPGKLQKRLPTRPGTEWSDIKLNKRAG

SEQ ID NO: 140190 - protein, 113 aa, Triticum aestivum
  unsure (1)..(113): unsure at all Xaa locations
  Clone ID: PAT_TA_34608.pep
KFHFYLYKQILGESVGEVKVVSDMHGRKAEMARRSEAFIALPGGYGTMEELLEMITWSQFGIHNKPVGLLNVDGYYDTLLALFDKGAXXGFNXPNCXHILSQRXPXTGKWGKT

SEQ ID NO: 140191 - protein, 169 aa, Triticum aestivum
  unsure (1)..(169): unsure at all Xaa locations
  Clone ID: PAT_TA_34609.pep
SLARFHSSRSRHLLPPTQPPPSLTRSSSGDGGSHTRVLPPPTRPARPRTPRRLPPTTATAQRPRRRAADQRRRRWRPWQRWRARLRSVLLRAQQAAARPGRASESMRVVAVNKTKPVGVIHGADDAGHRCFGXNYVQELIDKAPQVVPPAEMNEIFIPFHRVKELLIGT

SEQ ID NO: 140192 - protein, 73 aa, Triticum aestivum
  unsure (1)..(73): unsure at all Xaa locations
  Clone ID: PAT_TA_34610.pep
PAVTVPNXRDDLYLLYIYTLIKYIKYTLIKNRVGDDGVPAILQYRPSDLYLTDRKETMAILQKGTHTPLHICK

SEQ ID NO: 140193 - protein, 108 aa, Triticum aestivum
  unsure (1)..(108): unsure at all Xaa locations
  Clone ID: PAT_TA_34611.pep
HAFSWFMSLPSLFYISTLIKNRVGDDGVPAILPCTPSGFFLPLWIHSIARARTVALAPPPSCSRGLPSFILFSHKINYSYKCILMAPANARGCFLGGSLXRGVVVVAS

SEQ ID NO: 140194 - protein, 165 aa, Triticum aestivum
  Clone ID: PAT_TA_34612.pep
GHNSKRVHLAWVALIRKKIELQVRHIVPRNLLVSRIVPGSTSDDNMMLGLGDMVTNRNLLKHIVVIIHLVPAGSRSAATVHGDGKDAGVAGSSPVGPSGRRWRQIRKERARLGVKRRMREIAMMWCCTTALLLLAEFWYCCCYLNFAHTRRGVLADAVLVVRGGG

SEQ ID NO: 140195 - protein, 265 aa, Triticum aestivum
  Clone ID: PAT_TA_34613.pep
GYQPLENAKHPPEEPPVLIENVAKTAPSKVGNTSEPVEAEKSSVPLVKQEVTIGKLPVLKHVYSGKKRGRTPKTEDMGSEAASKNHNKEASETPSAKQKAETTPCAENENAGSKMQEIVDIRSPSKKSNSGNSCSAAEKLKIGNSSSAAKAQKSGNSSSAAKAPKTGNSSSDGNKQAAGNSSSAAKKPKMGNSSSDGKKQAAGNSFTAAKPKTGKSSPDGKKQAAGNSSAPARTEMSENIHTNLRIEKAILVEVNSRRSQRVRKA

SEQ ID NO: 140196 - protein, 155 aa, Triticum aestivum
  unsure (1)..(155): unsure at all Xaa locations
  Clone ID: PAT_TA_34614.pep
RIPWEGYPERRWRSGCARRRRGRRGAAARGGGKEMAKRLREAAPWEEAPGWPVNGLDDGCLMHIFSILGPIPDRYDTARVCHRWRFLAFYPRLXGRVDSSVQNEKEPGVYPSLVATKTAGRPGYTILSTDDGTNSYXNTPLKRDACVIVGGELAA

SEQ ID NO: 140197 - protein, 121 aa, Triticum aestivum
  unsure (1)..(121): unsure at all Xaa locations
  Clone ID: PAT_TA_34615.pep
MASTGRSMLLSLLLFAVTLSLLEMYRGWFAASELKTIAGGFVSSLLFLLLLAFIGNYQEASGVRTGWXAVVVAELVALIVAGTVHRVCITTCFLFSAGILYEVDKLSGMILARSESKARRY

SEQ ID NO: 140198 - protein, 121 aa, Triticum aestivum
  Clone ID: PAT_TA_34616.pep
MAGTGRSMLLSLLLFAVTLSLLEMYRGWFAASELKTIAGGFVSSLLFLLLLTFIGNYQEASGVRTGWGAVVVAQLVALIVAGTVHRVCITTCFLFSAGILYEVDKLSGMILARSESKARRY

SEQ ID NO: 140199 - protein, 82 aa, Triticum aestivum
  unsure (1)..(82): unsure at all Xaa locations
  Clone ID: PAT_TA_34617.pep
MASGQQERSQLDRKAREGETVVPGGTGGTNLQAQENLAEGRSRGGKPRKEQMGEEXTNDEFGGERAAREGIDVDESKFKTKS

SEQ ID NO: 140200 - protein, 131 aa, Triticum aestivum
  unsure (1)..(131): unsure at all Xaa locations
  Clone ID: PAT_TA_34618.pep
EALVXGAREDIAAADRAAAKAEGEAGXLRAEVKRLQGLLDSSDRDADRPRGAGGDLATAHQEKLALEEEIKALKASAAAAAADKEXAEEEAAAAPSAKEGLAAPHGKVAAAAAAGAAATAAIAVVLLNLKR

SEQ ID NO: 140201 - protein, 216 aa, Triticum aestivum
  Clone ID: PAT_TA_34619.pep
MSIPQRKNTLHCCIKTRGHIDVAGGVAQLPDKDETSVSRKQMLARLDVCMGGRVAEELIFGDSEVTSGASSDFEQATLMARAMVTQYGMSKQVGLVSYNYEEDGKTMSSETRLLIEEEVKNFLEKAYNNAKAILTKHNKELHALANALLEHETMSGTQIKNLLAQVDNKQPQGHAVEAPQKTPASPPSPAAAAAAAAAAAAQQAAAQAKGVVGIGS

SEQ ID NO: 140202 - protein, 193 aa, Triticum aestivum
  unsure (1)..(193): unsure at all Xaa locations
  Clone ID: PAT_TA_34620.pep
LHEISSKYQTCQHQFQLLPVCIPCPLKRARPCHHLVCHGKPRNLLSYITVCHSITRYRPKISPSRYITVCTVVVHTFNCLSHERAARRGDVEPLPVSALTAPRHPSSTARTEGADRQRRRESVDVDAARGRPTRTHNLVLATSALEVEPCSGRSGAALAMVEGVHGEAARVGLLGRHTNXLDMGEADVKTMGK

SEQ ID NO: 140203 - protein, 222 aa, Triticum aestivum
  unsure (1)..(222): unsure at all Xaa locations
  Clone ID: PAT_TA_34621.pep
SCRQTGRGGAPPRRDPSPTGVAVSPEVEAALASGGAVVALESTIISHGLPYPKNLTVCLIRRISRRQWRWRPATIAILNGVPHPHVGLNSEQLKNLAISGSQFQKTARRDIAQVVASGGNGATTVSATMFFAHKVXIPIFVTGGIGGVHRYGAKNHGTSLSDLTCDCGNTPVAVISSQRTVPFGDSARNTRSTLVTQGVTVACFTRTNPIFQLSFQQGTIGM

SEQ ID NO: 140204 - protein, 94 aa, Triticum aestivum
  Clone ID: PAT_TA_34622.pep
MGLPAYIRYVKSDYCPVLLIAKKKKKKKKKKKKKKKKKKKKKNKKKKKKKKKKKKKKKKKKQKKKKKKKKKKRGGGLKKGPKENFGGLQNIFFF

SEQ ID NO: 140205 - protein, 390 aa, Triticum aestivum
  unsure (1)..(390): unsure at all Xaa locations
  Clone ID: PAT_TA_34623.pep
PVVSLHGHLMLNSEKMSSXGNFLTLKEAIIRYSSDATRFALADAGDGMDDANFVTETANAAILRLTKEIAWMEEVIAAESSLRGGPPSTYADHVFANEINIAVKETEKSYNAFMFRDALKSGFYDLQLARDEYRLSCGAAGMNRELLGRFMEIQTKLITPICPHYAEHVWQKILKKEGFAIKAGWPVAGTPDPTLRSANKYLQDSIVLMRKLLQKQESGSKKPKKGAAPPPSAENKLTVGLIYVNEHYDGWKEQCLRVLQSNFDSQARSFAPDEEINEALRNCFIDRETNFKQVQKLCMPFIRFKKDEARNVGPQALNLKLPFGEINVLEENLELIRRQLGLEHVEVLPVFDGAARAKAGKHASVLDKNPPSPGEPVAIFMSKQEFEAQN

SEQ ID NO: 140206 - protein, 133 aa, Triticum aestivum
  Clone ID: PAT_TA_34624.pep
RYISKQKNKFDDKSKITRAMLAPGRHRLLLHQLESSPAAPGALLGGLLLLQLRTANVVLGEGDAVPYLVRCVGVLCRVLDVPHGQRQGGPVLVLIVGDLLLHVVVVVVDEHAGDVPEGVQRLGCLGHPPLLLD

SEQ ID NO: 140207 - protein, 227 aa, Triticum aestivum
  unsure (1)..(227): unsure at all Xaa locations
  Clone ID: PAT_TA_34625.pep
MATSSPSATAIQMPAPTATKEVDDHGEITAAGTAPPTATPTMDRVMSSVTNLAQLLPTGTVLAYQALAPSFTNHGKCEASNQWLTVVLVAILVVMCLFFSFTDSLVGRDGKLYYGVATPRGFNVFNFPGEDENREWDRDELRSLRLRPLDFVHSFFAAVVFLTVVFSDVGLQNCFFPDANRNTQELLKNLPLXMAFLSTFVFTIFPTKRKGIGFSDNTPRRKVDHSI

SEQ ID NO: 140208 - protein, 233 aa, Triticum aestivum
  Clone ID: PAT_TA_34626.pep
MASPPSSTVIEMPPTPHTNAGVPMAPTTPKDAGDVPTMAPAATAGPAATATDKVMSSAANLAQLLPTGTVLAYQALSPSFTNHGKCFSSNRWLTAALVIVLTISCVLFSFTDSVLGRDQKLYYGIATPRGFNVFNFSDEEEKLQWTPAEFRRLRIRPLDFMRAVFTALVFLTVAFSDVGLQNCFFPGAGRNTEELLKNLPLGIAFLSSFVFMIFPTKRKGIGYSDTTPRQKLT

SEQ ID NO: 140209 - protein, 235 aa, Triticum aestivum
  Clone ID: PAT_TA_34627.pep
MASPSPSSTVIQMPPSPHTNGGTAGLAPATPEDAGDVPTTAPAAAAGPAASPTDKVMSSAANLAQLLPTGTVLAYQALSPSFTNHGKCFSSNQWLTAALVIILTISCILFTFTDSVLGRDQKLYYGIATPRGFNVFNFSDEEERQQWTPAEFRRLRIRPLDFVRAIFTALVFLTVAFSDVGLQNCFFPNAGMNTQELLKNLPLGIAFLSSFVFMIFPTKRKGIGYSDTTPRQKLT

SEQ ID NO: 140210 - protein, 80 aa, Triticum aestivum
  unsure (1)..(80): unsure at all Xaa locations
  Clone ID: PAT_TA_34628.pep
HGLVQRQQWRSCRSACSAGRRSHPCRCKVXGPTLGFVALVXVAGVVXWPLGAAVYLFRHRKGRRIMGHPARAVYPRVIPI

SEQ ID NO: 140211 - protein, 226 aa, Triticum aestivum
  Clone ID: PAT_TA_34629.pep
LINLIKGIIPAYVGSAIGNRSWQPSLYPGIYTTNFINESNCSIICSLSRFYFHTLSAPCPNTTIRPDLLDASGDSQHCRLYLARRTAATSLGTDGDISHGSASVCLCTRDDDSIQRDSINHNPSMARIDGHAYFPPSPSSILTVSSSIATTISKTSRRRVVAWPRPPASTRGVRSIGAGAASLSIREETRCIEKESTKFRERSRTLERQGDQKKNIQDPWDTSPTK

SEQ ID NO: 140212 - protein, 223 aa, Triticum aestivum
  unsure (1)..(223): unsure at all Xaa locations
  Clone ID: PAT_TA_34630.pep
GCTKLFXAPEFVYKHLRLKHPEIVLEVTSNLREDIYSQNYMSDPNAPGGTPVMQQSAADKSRRGADNGMDSRLRYDRGNRREYDRADRDGGRHGRGDGSPSRDGPDNQMFDSFRGRGSNAPFSAEFPAPPILMPVPGAGPLGPFVPAPPEIAMHMLREQGPSPFEPNGGPHGNSGVLGSMMGGGPAPIIAMPPSFHHDPRRLRSYNDLDAPDEEVTVLDYRSL

SEQ ID NO: 140213 - protein, 450 aa, Triticum aestivum
  unsure (1)..(450): unsure at all Xaa locations
  Clone ID: PAT_TA_34631.pep
RSLIIWIFGEYSSIGNLIPKIAPVVLKYLAWSFAAEVLETKLQILNASAKVIIHSAEEQLEEFKRIVAYVIQLAACDMNYDVRDRARFLSGLLPCCATENDPSCRSQNVDVIKELADHIFGGKIPPASNSDSNYRIYLPGSLSQVVLHAAPGYAPLPKPQSMILIHKTVEPTRGVADSSEGTNSDAESGSSRGESGSVYDSESEAGSDSNDDGHNLHRQEENQEAPLIHMYDGNVDQAYAGRAVDENLASLISTDLTELMSKSALESWLDEAPAAPLVQDSVQTSCARVSFTTRSFERKPKLHRLLDPSDSDGLSVLYAFSSEVSPKSRLLVCVDLFVENITTDQLADITIKSEEASGSKGGMAQTSEGSASIPTLVPVEEXQSLAPDQTAKILLQVHFHHHLLALEPAGLCNGKSHPAQLHPDIAYLATTTHGLNAFLCRENQLXGMXI

SEQ ID NO: 140214 - protein, 300 aa, Triticum aestivum
  unsure (1)..(300): unsure at all Xaa locations
  Clone ID: PAT_TA_34632.pep
GTRVEVIFPXYDCLNLSNVKDLHCRQSFTWGGTEIKVWFGKVEGISVYFLEPQNGMFWVGCVYGKNDESRFGFFCHSALEFLLQSGSSPDIIHCHDWSSAPVAWLYKQQYVHNGLPNGRVVFTIHNLEFGVHHIDKAMAHCDKATTVSYTYSKEVSGHASIAPHYFKFHGIRNGIDSDIWDPYNDNFIPVHYTSENVVEGKSSAKRALQEKLGLHQTDSPIVGIISRLTAQKGIHLIKHAIYRTLERNGQXVVLLGSAPDHRIQGDFSNLAAKLHGEFDGRVKLCLTYDEPLSHLIYAGA

SEQ ID NO: 140215 - protein, 236 aa, Triticum aestivum
  Clone ID: PAT_TA_34633.pep
SHRHIPHPYRLATTSGPSTKPFLHLCERLARPGSTLQRRKMKRLLVHGRRGISCPSRSAAGDPSALPALGNSVLLPRYHSTEKHDDSDTLGEIGEKARTTAEEFLTMDKEKTDDVDEGAKETVRATEKAVLAESGDEEGEVRAEGRAGEVPSGNKWRLLRCTASILARKQTWPVEVVSSAVCMSSTTSFGIELLCVMSLPPSVLRPSVQQRDLVARQLGTSHITTPARPLNLKNTI

SEQ ID NO: 140216 - protein, 63 aa, Triticum aestivum
  unsure (1)..(63): unsure at all Xaa locations
  Clone ID: PAT_TA_34634.pep
AFWTGDGQRPRLKLGGPADAASDXCWFSVDRVYQCTRATAYFRPKAEQIYNSLCSLPTCYDLS

SEQ ID NO: 140217 - protein, 135 aa, Triticum aestivum
  Clone ID: PAT_TA_34635.pep
SSGLARHPFLLRKSTGPSLRLSRHKDIGWRGSGANDAHLGPVAGAGGVGGGDGRCGASFSRDLVLPIHGHWQEGPLGFIPSSEVATALGGAVHGHGYLGGRDVVPQLVRLRVGATDEACCCDLALVPAATDYPPR

SEQ ID NO: 140218 - protein, 126 aa, Triticum aestivum
  Clone ID: PAT_TA_34636.pep
HRDHHVVDCWSWFHRPVHWIRSPLPTVLVLERKYGSIFTDAHAAAWRRSSSRCSSEGPRLHLHLGGPVAWRRNGSGAPSASRRTSSSELRKGVWRHRCSYRRAKSSQLLLLLPTEGGVYSGCADTP

SEQ ID NO: 140219 - protein, 233 aa, Triticum aestivum
  Clone ID: PAT_TA_34637.pep
APSFRRRLAGPSVTERPRRRHLCAPLRIAPGALRLFSLPQRDTHPRDRAPGAAFPFSLPSSLQSSKLSSVTCGAAAYGLQVAGAARRGRLGLWRRRGSGGRRLLEGAAWICLLGFGELLSSALIFWSEQSLAIQRVLVSVGGHSMTNEKNRGNQFSEAAHPAKRTKEPILSLPEKKKARPNLNRRPSLPAYARRADGGPDLRRHGPPKREAGVGAVQAVHGDGDARAGRAQSG

SEQ ID NO: 140220 - protein, 109 aa, Triticum aestivum
  Clone ID: PAT_TA_34638.pep
RHIISSQALLPQQFVSPVKTSTFFLDQTAAQPTASLRSIRACKGTPPPCRTRIYLPTSRYYKIIIIRKSHIDSSILLAGGTIQHHYVATIFFAFYIPFSSISDLTKQEL

SEQ ID NO: 140221 - protein, 135 aa, Triticum aestivum
  Clone ID: PAT_TA_34639.pep
MSRSLGIPVKLLHEAAGHVVTVELKTGEVYRGSMIECEDNWNCQIENITFTAKDGKVSQLEHVFIRGSRVRFMIIPDMLKNAPMFKRLEARIRGKGSAIGVGRGRAVAMRARAAGGRGGGPPVGGGRGGAPPVRR

SEQ ID NO: 140222 - protein, 236 aa, Triticum aestivum
  Clone ID: PAT_TA_34640.pep
MSSAQDPFYIVREEIQGSIGKLQTTFHRWEQVSSNTGEYIHLTKELLASCESIEWQVDELEKTISVASRDPAYYGLDEVELSRRRNWTGSARNQIGTVKRAVEKGKSNPAMARHQDNGTSRTNYYSSQDNDDYIASESDRQLLLMRQQDDELDELSASVQRIGGVGLTIHEELSGQERILNNLSLEMETTSNRLDFVQKRVAMVMKKAGRDRPGSERARVWRGGGKEGSRKGESGR

SEQ ID NO: 140223 - protein, 463 aa, Triticum aestivum
  Clone ID: PAT_TA_34641.pep
MVPLTPARAAPGAAPARCLASCRHLSRPSFTRVSCLGSFKNLERLDLGHNCLVTLEGLSACTNLKWLSVIENKLVSLKGAEVLSKLQVLNAGKNKLTRIDEVKSMTSLGGARVEGQDPGNCCGWKICRRLNTLVLSKNPVITFGDALVNAKSIKKISMSHCEIESIGSSLAACVELKELRLAHNKITTIPSDLAKNTKILNLDLGNNLIERESDLKVLSELRYLRNLNLQGNPIAEKGTLAKKVMKIVPNLRIFNAKPIEAISQNENSGKGSKLKKDEEMPDRDPIDSNTKKEKRKRSKQQVQSPEEPAAKDTPPAATIAAPVKSALSDSKKKKKEKVVTEQDKSSKTKIKDYKASFDDTELKAKKESKKKKSANKEDKDAGGIDDTEVSFAELMFSGDGAVPEPTAKDKAQATAVDGKFVGGLVIDHSKKRKKAKGTPIDASDLKQLCSAPEVGAGGLSGWD

SEQ ID NO: 140224 - protein, 78 aa, Triticum aestivum
  Clone ID: PAT_TA_34642.pep
HSPPYPPPPPPPPPWPRRRPRRRRRARARGPPPRPPPAPTRGSWPPSPPSSRPAASPARSPPSCPRPTSREMLGGRRR

SEQ ID NO: 140225 - protein, 251 aa, Triticum aestivum
  Clone ID: PAT_TA_34643.pep
MGGAAVALFAATRRRSTPLVTSSLPRAARGLHEAAAAAGEDKARTRRRRSSSSSFLGPDITDTWDPPPRPAARPLPPRAAGVDYESTATTIDGKSIAEDIRLQIAEEVLQMKNAVGHVPGLAVVLVGDRKDSQSYVRFKVKGCEEVGIKSLLAELPRNCTEDEVVDSVSRFNEDPSVHGVLVQLPLPQHMDEEKILNAISLDKDVDGFHPLNVAYLALRSPVPLVVSCAAKACLELLLQSGIDLMGKHVTI

SEQ ID NO: 140226 - protein, 113 aa, Triticum aestivum
  Clone ID: PAT_TA_34644.pep
EASGGESQEEECDSDAAEADDDDDDDDDDDDEDEEEEEEEEVAPPRSERRSKLVHDPVTERGEGVATATQSTKRPRTTSPAPTEKASKQPRAAPSKPTKHLPKMKVSIPTISG

SEQ ID NO: 140227 - protein, 62 aa, Triticum aestivum
  Clone ID: PAT_TA_34645.pep
VGTYGHICPLRHAPDAHLHLQTIAASDIDKWFGSEGGPPSPSSPPREQSSRRIIYKHLYLIC

SEQ ID NO: 140228 - protein, 58 aa, Triticum aestivum
  Clone ID: PAT_TA_34646.pep
AAYVFLPISVLVIYLCSLVGYYLKISSLIVIMNVYPFVAPTGFPAPFAILIAYSIVHI

SEQ ID NO: 140229 - protein, 191 aa, Triticum aestivum
  Clone ID: PAT_TA_34647.pep
MPDANLGDLLLQAAGRTVGKGGQSRQSNQHWQQHGRRAGGSYSGGSGSDGSDDGDSDSALAPSHPATRLPPGSQVPLKKRHQTGKGGSRGGGYDDEDPDDEGRRSGGEDSDSAPSVGSDLYKDEDDKEQLENMTELQREMILAERSTRIDDYKLKKLARASSSKTDKARKDSPPPPPSRLRASARTDRSAT

SEQ ID NO: 140230 - protein, 176 aa, Triticum aestivum
  unsure (1)..(176): unsure at all Xaa locations
  Clone ID: PAT_TA_34648.pep
DSFGLGQLSTRVXNELGAGRPEAARLATRVTMVLGLVTGVSLGLIMISVRNLWGYAYSNEKEVVEYIARMMPLLSVSIIFDDMQCVLSGVVRGCGLQRIGACVNLSAYYLVGIPAALCFAFVFHLGGMGLWFGIICGLIVQMLLLLAITMRTNWDKEALKAKDRVFSSSLPLDVST

SEQ ID NO: 140231 - protein, 413 aa, Triticum aestivum
  unsure (1)..(413): unsure at all Xaa locations
  Clone ID: PAT_TA_34649.pep
LKPTQEPSWKEPLCMLITLWIKLVDDIPRQPTDASSYERTGYLDSNRLTHCMSAFRQLLINNEITVHQGWDAISMFVQVGFNSEIIMDTSHFCRAMILSRCGFKTVVEVYHGGQENLESVNADSRNPLDLLELYGASTDGCLSDLIEGSCESQALLHKLLSSLSQSVGEHADSLEMIRSGVWGKLIAFSENMQLGSQLRVYALQLMQCITGRNLKSLPNEIVSQVEPWESWYEPGTSDSLADEGSTPSCSITASLVALRSNQMVTAVLPDASITPENLSSLDSAVSCFLHLSGRASSVESVAVLEAVLEEWEQLFSSSSXKKNMFSLRIRQXEARDWSDGWDDGWEALXEELENXAQKQDGASTLSVHPLHXCWMEIIKXTCWGLEASRIELRSKHPQGHKVAKRTNRALNSL

SEQ ID NO: 140232 - protein, 392 aa, Triticum aestivum
  Clone ID: PAT_TA_34650.pep
SCSVHGDGHALRFYSFVPSPRCVRGHVLWLWGVYCKNGTYKPNEWMHMMVVVVFLNLNCFAQYALCGLNIGYRRSERPPLGVAVTISFAFGAALFASVYNIVSPLGKDYDAELREGVPEAQAGVTSTEGARPASSGRSLERRYSFLQSDERRFVESRPEWVGGLSDFWDSITIAYLSIFCSCCVFGWNVQRLGFGNMYVHIATFLLFCLAPFFIFNLAAVNINNETLREALGLTGIALCFFGLLYGGFWRIQMRKRFNLPGNPFCCRNPDVTDCFQWLCCCSCSLAQEVRTADYYDIAEERSYRGQVNGESQRVMSPLAREDGLPLFKSTPASPYRSSTGTASQSIFIMESPSAPRRSSGATPPGSSPANGGDRAMKAPAPSVLHREGEDES

SEQ ID NO: 140233 - protein, 211 aa, Triticum aestivum
  Clone ID: PAT_TA_34651.pep
MMDPSSSSTASAPAASTHSSDSGGPAAALSAAVATASRRFQHLLDRSTPHVGRRWLGLAGVVLVYALRAWFVGGYYIVTYALGIYLLNLLIAFLSPQVDPELAEVLGEGPALPTRSSDEFRPFVRRLPEFKFWYSIVKAFCIAFGMTFFSVFDVPVFWPILLFYWVVLFTVTMKRQILHMVKYRYVPFTFGKQRYNGKRAASADDLTLPKD

SEQ ID NO: 140234 - protein, 102 aa, Triticum aestivum
  Clone ID: PAT_TA_34652.pep
VSCIILQLLVFFHAYLHECVTYIVHGVCHLIIVQPLLPINKFWGNGDIDRLSRTIYGLTSCCYIFVCVRIITCIWLLQQVAYLPPNPLYFCLILCTYQCLVT

SEQ ID NO: 140235 - protein, 73 aa, Triticum aestivum
  Clone ID: PAT_TA_34653.pep
SLFGASSMNQSRCFNPYGRKKSSQSNLTGTVAITWFLHKCVRQYKPDQSFLITMLFMLPQPHVISIDNHRSSA

SEQ ID NO: 140236 - protein, 552 aa, Triticum aestivum
  Clone ID: PAT_TA_34654.pep
MMLTSHYPVQVTVPVRAWSALPRRPPRPDGSLQKSFPSTTSLHQELICFELPSLHSSFLDLLHATIKGMRSQLLPHAANIVRLVTDYFKIAKLPTTRTKVYSIVQLLLTSMGVGMSLHLLEVIVSNAVGDLDDNCVKEMTLFSTNPSKGNSESLSKSYSKKRKQEPQMQNSHASGLEKAAISPKKMKTSSMPTSSKGMTPETPGDVRMFTPLCVKIAALETLEILLNVGGSLRTDHWRAKVDLLLINIATSACDSGAGYEPSTTKVGETSISDFRLASYKALLASFLSSPHARPLYLAQGTELFRKGKLEIGTTLAEFCSHALLALDVLTHPRALSLEKAGPLVPGLNRSEPEKAIFGAGTFNFSPSQGQRQVIADEDTYDDWLPSIKDNEPSEKSTLVKEVPQIDSHTIAEAVEDVPACNRSDAIMVVAATEKTSEPMTVDNPSSSNAASNPIYSRPPEAQKAAATPFREEKRADHVDSLLQNKSSAAVNLPFRNLATSGEKPSDPGVAAPSSYKDVSSTRFIQPIKADLSDTESGDSMPEIQDGDPDSDY

SEQ ID NO: 140237 - protein, 173 aa, Triticum aestivum
  Clone ID: PAT_TA_34655.pep
GEGDEETPAAKPPSGKTEEEKLAEANEIGYKVVGPLGADEKPFKPYEPVFAVVQIGSHQFKVSNGDSIFTERLKFCDVNDKLVLNRVLMLGSQAQTIIGRPILTDATVHAVVEEHALDAKVIIFKKKRRKNYRRTRGHRQELTKLRITNIEGIDKSFIQQEGTDKPESAAVAA

SEQ ID NO: 140238 - protein, 179 aa, Triticum aestivum
  Clone ID: PAT_TA_34656.pep
MEEVAGGGSSWPYAKKPQPHQLGRSLTYHHPYQGQGRRLQPAQRHQLPDVRAPRPAVVLYTTSLRGVRRTFTDCSAVRAVLRGFRVAVDERDLSMDAALRRELQGLLAARGRAFSLPQLFVGGRLVGGAEEARQLHEAGELRRLLEGAAGQDPAFVCDACGGVRFVPCPACAGSRKVFV

SEQ ID NO: 140239 - protein, 207 aa, Triticum aestivum
  Clone ID: PAT_TA_34657.pep
MSFRDESGGEDGSGGRSSSASDLRKPFLHTGSWYRMSAAGGGAMDRLGSSAYGLRDSSISALLCTLIVALGPIQFGFTCGYSSPTQDAIMADLGLTLSEFSLFGSLSNVGAMVGAIASGQIAEYIGRKGSLMIAAIPNIIGWLAISFANDSSFVFMGRLLEGFGVGVISYTVPVYIAEIAPQNMRGALGSVNQLSVTIGILLAYTLG

SEQ ID NO: 140240 - protein, 211 aa, Triticum aestivum
  Clone ID: PAT_TA_34658.pep
MAMPPKPGEPPKPSPGRSPSLNPNPCPLPPIPGGPQPGGPPAAAAPPRSHHRRARSEVPFRFPDADGGGFDEIGSEDDLFSTFMDMDKIAGAGRDRAAETSSSPPRPTKHRSSRSFDGFAMGCGGPGRQDGGGGGGGVFADVLVQVRSMSSEQLSELECIDPKPANLSLAFPSSAARSTIQVFISITELERQLLPLPQATTTFSTQMTPLI

SEQ ID NO: 140241 - protein, 244 aa, Triticum aestivum
  Clone ID: PAT_TA_34659.pep
VRLQKLKERIPACQERIDRNTVVIDDLKKELTEKEELVRSLGDKTHEVNSMKKSMEDNIAEVVKLKIELEAEHERGTRTLEKMNGRLKQMQAQLRDFQMQHMQFTQAEASQIEEDMQNIQREIDYLDSNVTRLREEEKEFSEELSGIQKSISDIAKEIAESDKRILQLKSHMDGLQQRQSNTVTAFGGQKVLKLLQLIESNHGRFRSPPIGPIGAHLQLASESWSVAVDCACGGLLDAFIVSCH

SEQ ID NO: 140242 - protein, 258 aa, Triticum aestivum
  Clone ID: PAT_TA_34660.pep
NIRTCYECGTPGHLSFACPNKKVSEVISSENKDNTDSAEALSKKRRTCYECGVPGHISSACPNKKASEVIADETKANIDSATTSSKKRRTCYECGIPGHLSSACPNKSAPEVIADETKANTESATTASKKRRTCYECGIPGHLSSACPNKSAPEVIADENKANTESASTASKKRRTCYECGVSGHLSSACPNKKATEINPEEAVKPVGGSSTEPSAVSGENKPSDDTSSAPPKKKKRRTCYECGIAGHLSSECPNKAK

SEQ ID NO: 140243 - protein, 107 aa, Triticum aestivum
  Clone ID: PAT_TA_34661.pep
NQRSFNKNKIILFVRTYMRVRRGIRAILQSGTCSEIIGALWCCLFCVCLMCVLSGWEEDALGPRTKHCDLHCWTFSCLPVGAGSNGHSAMEEEEEWMMRNFITTHYM

SEQ ID NO: 140244 - protein, 352 aa, Triticum aestivum
  Clone ID: PAT_TA_34662.pep
DDYEFFDRTKKKSSNPQSSGQQSVETADSLLDKKDFINNDIEGKKKLLEEEKIKLAQRDNADLGDDLDAYMSGLSSQLVHDNIATIQKELSDLQAELDKVVYLLKVADPMGEAARKRDLKPREGNPQASNDNPRPESKKQDKIAQDKTSTEENLKDSFSTKTEADKPAEVETDVPPNQENASKPAFTIPKPQWLGDKRIIEPEEKCIKEGNTNAEEPDDFVDYKDRKTILSNSANEKDIEGAAPGLIIRKRKSADQSAGVEAESSSVESEASAADAVALLLKHTRGLQPAEDIENENEPQASKRKGKKSKQKRVLGPARPDFLEAGPDHETWVPPQGQTGDGRTSLNDRLGY

SEQ ID NO: 140245 - protein, 146 aa, Triticum aestivum
  Clone ID: PAT_TA_34663.pep
HRFTKNAHFIPLKHPFSAPVVAKAFLHTLVNLHGPPHTIVSDRDKIFTSHFWRDLFKLRDTKLLMSTAYHPQTDGRSERVNRCLEMFLRCAVHDTPTKWHAWLPLAEFWYNTNYHSSLECSPFKALYGYEPTYGVFPSLLQSDNID

SEQ ID NO: 140246 - protein, 235 aa, Triticum aestivum
  unsure (1)..(235): unsure at all Xaa locations
  Clone ID: PAT_TA_34664.pep
VEDDWFVVSNPDAPRLGMERLAKMGPKSTEEKIMAGTLLLTVGLWIFGGMLSVDAVSAAILGLSVLLXTGVVTWKECLAESVAWDTLTWFAALIAMAGYLNKYGLISWFSETVVKFVGGLGLSWQLSFGVLVLMYFYSHYFFASGAAHIGAMFTAFLSVASALGTPPLFAAMVMSFLSNLMGGLTHYGIGSAPVFYGAGYVPLAEWWGYGFVISVVNIIIWLGAGGFWWKMIGLW

SEQ ID NO: 140247 - protein, 247 aa, Triticum aestivum
  unsure (1)..(247): unsure at all Xaa locations
  Clone ID: PAT_TA_34665.pep
ARGWDKRVIMDLLPQFGGETHFIITTRLPRVMNLEPXKLSYLSGAEAMTLMKGAVKEYPLMEIDALKVIEEKLGRLTLGLGIVGAILSELPITPSRLLDTLNRPSPIRDFSWNDREVISLKNHEILVRLLDVCLSIFEHADGPRSLAIRMVQVSGWFAPSAVPIHMLALAAHKIPKKHRRGPRWRKWWRTLTCGLATSRMQRSEAEAAAMLMRFGICQCSAXSEYIQFHDMIRLYARKRGSTRTAQA

SEQ ID NO: 140248 - protein, 216 aa, Triticum aestivum
  Clone ID: PAT_TA_34666.pep
MSKLQSDAVKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLEAKVNETKATVKFQLKKVLCMGGAGGNLSMDEKQIQQNIQMSVNFRVSLLKKNWQNVRCLYVKSTMGKRVRVF

SEQ ID NO: 140249 - protein, 216 aa, Triticum aestivum
  Clone ID: PAT_TA_34667.pep
MSKLQSDAVKDAITQIVGEAREKKRKFTETVELQIGLKNYDPQKDKRFSGSVKLPHIPRPKMRVCMLGDAQHVDQAEKMGLDYMDVESLKKMNKNKKLVKKLAKKYHAFLASEAIIKQIPRLLGPGLNKAGKFPTLVSHQESLEAKVNETKATVKFQLKKVLCMGVAVGNLSMDEKQIQQNIQMSVNFLVSLLKKNWQNVRCLYVKSTMGKRVRVF

SEQ ID NO: 140250 - protein, 130 aa, Triticum aestivum
  Clone ID: PAT_TA_34668.pep
MRPLSRSAAAPTAQPPPPRSVSCGQIRPGSRRRASTSSEQSSPRWVPISSRRSPAGPRPPHSLSRWCFSPRRRRWFASPSSPCRLQPLLPSTVLLFGIHRRPVSGHDQKSGRPLFLMNRDAVLACGHMRA

SEQ ID NO: 140251 - protein, 196 aa, Triticum aestivum
  Clone ID: PAT_TA_34669.pep
SRTTRARLVLSVLINLLCSVVYYGLSLNVVNLKTNLYVSVAVNSIAEMPAYLLTALLLDHFGRKPLGIGTMLLSGVFCIAGSLIAGVGAMRIVRMVCGVVGIFGMAATYNLLFIYTAELFPTVVRNAALGCTSQASQMGAILAPMVVVLGERVPFAVFGVSGIIGGLLVFYLPETMNKPLYDTMAGLEEGEKTPLK

SEQ ID NO: 140252 - protein, 245 aa, Triticum aestivum
  unsure (1)..(245): unsure at all Xaa locations
  Clone ID: PAT_TA_34670.pep
LDVLLAERRVDEALDALDEAERIAVDAEKQQTLATADIVALKEIISDNRQKLSDQLAEAACQSSTCGIELRAAASALKRLGDGPRAHSLLLSAHNQRLQSKIQTTRPSSTGHSVAYTASLAKQVFSVIANALSDSMEVFGNEPSYTSELVTWATKQAMEFTLLVKRHALGSCAAAGGLRAAAECVQIALGYTSLLEARGLSLSAVLLKQFRPXVEQALDSNLRRIXXTTSALXAXDDWALILQLV

SEQ ID NO: 140253 - protein, 125 aa, Triticum aestivum
  Clone ID: PAT_TA_34671.pep
GSPTRFLQSGRIAIGEKKPPGRRDTTEERGAIAARLFLRPIPQEGGSAGVRETVLFCGKGKNVASTVVAVPRLPRWLLARVLPWNLSYIRTKPSSYRHPCIDGFFSTLDTTTLRKKTIRTRTGDR

SEQ ID NO: 140254 - protein, 349 aa, Triticum aestivum
  Clone ID: PAT_TA_34672.pep
PVRNSRVDPRVRAQAILNHAWISARYARGNASESSSNTTMKIYVPTNPRGAEMLAPGIIASESDFNAHRLWGDPAEDLPFKPKYLVTFTVGIAQKDNINRAVQKFSDDFAILLFHYDGHVTEWEEFEWSKRAIHVSVLKQAKWWYAKRFLHPDIVAPYEYIFIWDEDLGVDHFNGEEYIKLVKKYQLEISQPGLEPDKGLTWQMTKRRGDREVHKDTEERPGWCTDPHLPPCAAFVEIMAPVFSRDAWRCVWHMIQNDLVHGWGLDFALRKCVEPAHEKIGVVDSQWIVHQVVPSLGSQGQVENGKAPWEGVRERCRKEWGIFQTRIAEADKAYYEMMGVTPPNVTSVH

SEQ ID NO: 140255 - protein, 131 aa, Triticum aestivum
  unsure (1)..(131): unsure at all Xaa locations
  Clone ID: PAT_TA_34673.pep
MVDWTSDNDDSDKFEWESDGEAEPSSAPAFRNLDAAGPSTLDSNGWANEEAPPTSLVEGYVLMGFPKEMVLKGIKEIGHSDANALLELLLTYKTLXDDAAVGNCSTSGCFPQSVEDDDDFDFXNWDGDDDA

SEQ ID NO: 140256 - protein, 81 aa, Triticum aestivum
  unsure (1)..(81): unsure at all Xaa locations
  Clone ID: PAT_TA_34674.pep
VARAILKKSGGVPLAIITIASIWVSNNQIEXNNDWLCLLNAMGCGVTKGASLKGKKKILLLTYYDLPSHLKACLLSKHISQ

SEQ ID NO: 140257 - protein, 165 aa, Triticum aestivum
  Clone ID: PAT_TA_34675.pep
PQAGASSVQSLPLSPLADACSRKDLTAIHEILEKTGYKDDEGTANELSFQMWTNQMQDTLTSKKKGDSAFRQKDFTTAIDCYSQFIEVGTMVSPTIYARRCLSYLMNDMAEQALSDAMQALVISPTWPTAFYLQAAALLSLDMENEAQDALKDGCAQETSSSSGR

SEQ ID NO: 140258 - protein, 233 aa, Triticum aestivum
  Clone ID: PAT_TA_34676.pep
MYMTTVHTSKIDGGVLLKPNRPALVVSSTSWTPDEDFSILLEAALMYDRRVAATLGEEDSMDEGQLWIDIKNGKQFDYPRLLFIITGKGPDRNKYEEQIKRLKLRRVAFRTMWLASEDYPLLLGSADLGVSLHTSSSGLDLPMKVVDMFGCGLPVCAASFSCIEELVKVNKNGLLFSTSSELADELMMLFKGFPEECDTLKSLKDGALSTGSSSKWSNEWETNALPLVNQVIG

SEQ ID NO: 140259 - protein, 131 aa, Triticum aestivum
  Clone ID: PAT_TA_34677.pep
SRVHKNQDVLDSMHNALSIYREGWQLCVNEGEAPALRGFAGADTLDQHHDNGNSASLMSATNDDKAKPPHMAIDLTSNGRNRLGFQLFLGFSLLCINYFEMIEKSVSTLFDHSGWMGSAQLAIHKHVRQFF

SEQ ID NO: 140260 - protein, 213 aa, Triticum aestivum
  Clone ID: PAT_TA_34678.pep
APPCSLLSHAATLEPAPPPPRLLPASNSPTLPPSMPRKGRCRHVGDTQRRSSAGAQQKPTPNPIRSIDKSRATDWIEGALAWPGRRCHLDSLADVWSCPGRRLESPPSPPRVSSTIGARNLVPTRKIPRDLIDGGITIWRWIIHFCSTNNVVFVWNGQFSISKSAMLYFLSEHITLLFLQSICSTKIDDKVEFVGDTIGHDDDAKGSACKQGN

SEQ ID NO: 140261 - protein, 418 aa, Triticum aestivum
  unsure (1)..(418): unsure at all Xaa locations
  Clone ID: PAT_TA_34679.pep
LLGVSTKSSGSSAARKCVKRNDSIWGAWFFFTHYFKPVMSADKGGKTKAPAAAGNGNSATLDAFLVQHXDMENMYMWVFKDRPENALGKMQLRSFMNGHSRLGEPQFPFSADKGFVRSHRMQRKHYRGLSNPQCLHGIEIVRAPNLVGVPEADMKRWFELTGRDANFLVPTEADDLESWRNLPTTEFELERPATAAPAKSTSHGHHKKVLNGSGLNLSTHASKHGSGDGMDISRVCRSRRKDSSPSAMEEDCSNSNSDKVQDMDVSHTFEPSWTNDFTGVMRHASGPVTAAKTIYEDSKGYLIIISLPFADIQKVKVTWKNTLTNGVXAARAGTPPNIIEAIIVPHVMXLVDPSPEHCPPGEFIREVPLPTRIPEDATLEAYCDESGTGLEIIVPKHRAGPEEHEVRLSLRPPSSWCQ

SEQ ID NO: 140262 - protein, 164 aa, Triticum aestivum
  unsure (1)..(164): unsure at all Xaa locations
  Clone ID: PAT_TA_34680.pep
QVAGMHSDVAALRKGSIWHMASWVVRQEVFWAYSKGNLVKIVHRFSYSAISFYXYERYKKFSTEFYFTEWTAQIMLVSICLLGGGLAXVTPASVTYPLDVVRNHLTTQVMLFFLLKTTRYYKGIFHTLSTICREESGRGLYKGLWSTLLVRSTRPRYINQRLCI

SEQ ID NO: 140263 - protein, 208 aa, Triticum aestivum
  Clone ID: PAT_TA_34681.pep
NRLLFCILNICKEILSYLPKVVGIDIVELALWAKENTLTLDNQENNNQEGQETSVATQTERKVTAKVTVENDLVSQAKDEEEDMEALLDTYVMGIGEADAFSERLKQELVALEAANVYQLLESEPLIEEVLQGIDAASATIDDMDEWLRIFNLKLRHMREDISSIESRNNGLEMQSVNNKGLVEELEKLLERLRIPQEFAASLTGRFI

SEQ ID NO: 140264 - protein, 98 aa, Triticum aestivum
  Clone ID: PAT_TA_34682.pep
LKHPTSLWRSQRGTAHRTNRGGAGAHRRETGVRDDHVWVEVGSSDGECGPECGPVRRRRGCVAVLDLGLVWVCSQLHRSSADRFARSRRAVVDRLPGT

SEQ ID NO: 140265 - protein, 103 aa, Triticum aestivum
  Clone ID: PAT_TA_34683.pep
MGRAMRWLKRLLTGRKEAHGGGKEIHAATDWHDAAAVKESTKRWSFVKQRKSGVDAGKRPSEPLAAALEVKPCRCAGGEQVGAREEKAAVVIQKAFRGYLVCS

SEQ ID NO: 140266 - protein, 373 aa, Triticum aestivum
  unsure (1)..(373): unsure at all Xaa locations
  Clone ID: PAT_TA_34684.pep
GRVGLYAQQQQQFMQDNMGSGIEKIALIFNIGAGYCDVAVSATAGGVSQIRALAGCTVGGEDILQNVMRYLLPDYDSLCDNAGPTTDRIKSMGLLRMATQDAIHKLASQESTEINADLGNGLKVSKLLSRAEFEQVNQAIFEKCERIIKQCLSDAKLTPKHINDVILVGGCSLQQSPILLGAWICXDSGDPDEPWNXVPTVTAAARSFHGAPLFPQEGTSLDLLTMPTTPRSCGIRADGDGFAAIIPRNTAVPARRDMLLTTTQDNQAAARSPVAGALRRPAGGGRPRGSSAIAGAPPPPRGAAAASASSLFVPGSGLRVCAAVLLPQGEATPPLMGLRMPTLDDGHGWCGQALAKMYGSKLDLAVIPKKLHP

SEQ ID NO: 140267 - protein, 415 aa, Triticum aestivum
  Clone ID: PAT_TA_34685.pep
MGSDRGELARLCSGRNWSKAIRLLDSILACSPSSIHDLCNRAFCYFQLELHKHVVKDCDRALQLDPALLQAYVLKGKALCALGKNEEALVAWEQGHEIAVRDTIDLKQLLELEELVSSVKIYETVECEDVVDASPCDTKVVISEDRFINTSFTAATTDTKTVVCEENTANSKSSSNSDALLPNNSKDHKDSVSPAKDTTVTHQTPKKQPKTDKKNKAKVKKETNGQAEDVEERRSSDETITLDQALFATKVSKSSKSISLDFRLSRGIAQVNEGRYDQAISIFDQILRETPTYPEALIGRGTAYAFQRELDSAISDFTKAIQSNPSAGEAWKRRGQARAALGEFVEAIDDLTKALEFEPNSPDILHERGIVNFKFKDYNSAVEDLSTCVKRDKKNSSAHTYLGLTLSAVGEYKRA

SEQ ID NO: 140268 - protein, 266 aa, Triticum aestivum
  Clone ID: PAT_TA_34686.pep
MSFADLESGALQAPRRGRGADATRALVFQITTAVSSYRRLLNSLGTPKDTPALRDQLQKTSHKVLQLAKDAKEKLTSAAEADKSTGTSADKRVADMKLAKDFAATMEEFRKLQNLAIQREMAYKPVVPQGAQPSYTMNDGRSDFDKMPEQRALLAEPNRLEVLQLDNEIVFNEAIIEERDQAIQDIQQQIGEVHEAFKDLATLVHAQGGVIEEVDSNIENSAAATSEAKKEIGKASKTQKSNSSLLCLLMVIFGVVLLIVIIVLAS

SEQ ID NO: 140269 - protein, 162 aa, Triticum aestivum
  Clone ID: PAT_TA_34687.pep
RPPTRPPTRPNEAAIFVDAPLRGKYCVCFDPLDGSSNIDCGVSIGTIFGIYMIKDKDNATLEDVLQPGTDMIAAGYRMYRSSCTLVLSTGNGVNGFTLDPSLGEFILTHPNIKIPNKGKIYSVNEGNARNWDAPTAKYVERCKLTQDGSSPKSLRYIGSLVA

SEQ ID NO: 140270 - protein, 347 aa, Triticum aestivum
  unsure (1)..(347): unsure at all Xaa locations
  Clone ID: PAT_TA_34688.pep
MDHAADTFRTDLMTITRHVLNEQSRHPESRGDLTILLSHIVLGCKFVASAVNKAGLAKLTGLAGETNVQWGREQKKLXDVLSNEVFVNALVSSGRTCVLVSXEEDEKATFXVDPKLXRGKYCVCFDPLDGSSNIDCGVSIWNXILGCYIDQRKPMTTVDSWEEVXLKRGRMDMIAAGYCTVMRKLPAALVXNTGHGEIILTHYPSLLPXRGDLYRLTKSITITWDTPNSKVXVKKCKYPTDGSSPKSLRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKEGSA

SEQ ID NO: 140271 - protein, 223 aa, Triticum aestivum
  Clone ID: PAT_TA_34689.pep
AGSSGGADSGSNGDSESLCSRSSLQMLPAASRGSAPSATSDLTPSLRSPAEPGNENSSSVPTVNSTIATARAVSWSSTYCSACAVSWPSTHCSACAVSWPSTHCSACAVSWPSTHCSACAVSWSTTLSDSRYAPPRGLRCPRDRDGSELAAHGADEGEPGRLCLRSSNRTVSAAWWWSADKSGSATWQVNIYSSGAVGGSGFREANMDLRVWVALNSERLICG

SEQ ID NO: 140272 - protein, 185 aa, Triticum aestivum
  Clone ID: PAT_TA_34690.pep
MNVPVGFLAKLWSFVSFLPFFVLLLLLGSAKALLIGPVVAAIVFLGDSAVIAGLWPAHFVWTYCCVLATKRIGPVLKILAVVFLPLPLLLLPVLGIVGSLLAGIGYGVFTPLMATFEAVGEGVADKLSHCFLDGTASTIRGACMVVRDVTDFCFHSYFSFMDELSEKMGDDEAPIDIKLSYLPRS

SEQ ID NO: 140273 - protein, 365 aa, Triticum aestivum
  Clone ID: PAT_TA_34691.pep
LVDKAGNLAMKRIIVERKKQSGGGDVNNKQDWWRHPWSEGEMDSLCITMDDFEEAATMVQPSLRREGFSSVPDVTWEDVGGLDSLKKEFDRCIVRCIKHPEVYKDFGVNMPAGFLLFGPPGCGKTLIAKAVAHDAGANFIHIKGPEVLNKYVGESESDIRKIFTRARINSPCILFFDEIDALTTKRGKEGAWVVERLLNQLLIELDGADQREGVYVIGATNRIDVIDDALLRPGRLGQKYFVPLPSANERHSILKALTHYQKKPVSCTVDLDALARREDCNTLTRPDQASLLNEAAQVALEEEAAIPALEALCEFLAKGVSSMSTDLTKKTKLRHFEHALSKVKPSVSEQQRKHFDALSKKYSAN

SEQ ID NO: 140274 - protein, 360 aa, Triticum aestivum
  unsure (1)..(360): unsure at all Xaa locations
  Clone ID: PAT_TA_34692.pep
AGNSARGYLGLPQXDRLATTRXFESQFDAYKRANQMFADVVYQHYQEGDVIWCHDYHLMFLPRCLKEHDINMKVGWFLHTPFPSSEIYRTLPSRSELLRSVLCADLVGFHTYDYARHFVSACTRILGLEGTPEGVEDQGKLTRVAAFPIGIDSDRFKRALDIDAAKRHVNELKQRFAGRKVMLGVDRLDMIKGIPQKILAFEKFLEENPEWIDKVVLLQIAVPTRTDVPEYQKLTSQVHEIVGRINGRFGTLSAVPIHHLDRSLDFHALCALYAVTDVALGTSLRDGMNLVSYEYVACQGSKKGVLILSEFAGAAQSLGAGAILVNPWNITEVADSIKHALTMTSDEREKRHRHNYAHVT

SEQ ID NO: 140275 - protein, 232 aa, Triticum aestivum
  Clone ID: PAT_TA_34693.pep
EKISLTNESKSTRKALAGIYDEVLVVDNINSAENVVRLLTTKYKSFVHACDTEVANIDVKKETPVDHGEVICFSIYSGNLDAHADFGNGKTCIWVDVLDGGRDVLMAFAPFFEDMSIKKVCHNYSFDSHVIENYGIKVAGFHADTMHLARLWDSNRRIDGGYSLEGLTNDLRVMSDVGNDLIKTGKVSMKTIFGTKKIRKDGGEGKIVYIEPVKKLQREDRKMWICYSSLDS

SEQ ID NO: 140276 - protein, 316 aa, Triticum aestivum
  unsure (1)..(316): unsure at all Xaa locations
  Clone ID: PAT_TA_34694.pep
VKKKGLRKAGASGVRAGVGGYSYLYEPLWWAGMXTMIVGEVANFAAYAFAPAILVTPLGALSIIISAVLADIMLKEKLHIFGMLGCVLCVVGSTTIVLHAPQEREIESVAEVWDLATEPAFLFYAAIVLAATFVLIFRYIPQYGQTHIMVYIGVCSLVGSLSVMSVKALGIALKLTFSGINQLIYPQTWLFAIIVVACILTQMNYLNKALDTFNTAVVSPIYYTMFTSLTILASVIMFKDWDRQNPTQIVTEMCGFVTILSGTFLLHKTKDMVDGLPPTLPIRIPKHGDENGYAFEGIPLRSAAEGLPLRSPRAAE

SEQ ID NO: 140277 - protein, 122 aa, Triticum aestivum
  Clone ID: PAT_TA_34695.pep
SSTVTCKALKITKLDIFFCLPFGGEIQCFLFLLTESSVSFRKMDPALSSVLLKEQEGFYHQADYYWFKLLTVADYVKSYTKINKATQISRHPGDGDAQWQLKSSDHPSRASSTHACWKIIIV

SEQ ID NO: 140278 - protein, 145 aa, Triticum aestivum
  Clone ID: PAT_TA_34696.pep
ADANALGFMIPGPGIIPADGWWFIVRSADGGHLMLICTYQIDQTISSNHMRYNASGVRDIDGSGCFVFEKDPSFVWPGVFNWRRVYSLGNHSMFLGLNYPSIQPIIDHITGDDYRVMLLPFARGDCVYTSYHGFHESPYPEIRGP

SEQ ID NO: 140279 - protein, 76 aa, Triticum aestivum
  Clone ID: PAT_TA_34697.pep
RREYFAIEVLLQKIGEEEIFVTWLLLQKVTREEVSQQEHCCKKLQNKNGRLASYNRTAHEAAGLFKRSFGRRIALP

SEQ ID NO: 140280 - protein, 365 aa, Triticum aestivum
  Clone ID: PAT_TA_34698.pep
MNVPIVDPLQGDFPETIEEFLQHGNMKCIAFNRRGTLLAAGCANGSCVIWDFETRGLAREFRDKDCTAPITSVSWSKYGHRLLASATDKSLTLWNVVTGEKIARITLQQTPLHARLHPGSSIPSVCLACPLSSAPILVDLNTGSTIVLPVSASDSGNVPLPNSRKFSDGSPPFTPTAATFDKNGELIYVGNSKGEILIVDSKGIQVLGLIPIPGGTVVKDIVFSRDGQYLLTNSNDRVIRVYENILPINGSGKEIEKIITNNNNDYGSKYEKLKANGARCLVLSCEVSDAIAKVQWKAPCFSGDAEWIVGASASKGEHRLHIWDRAGRLIKILEGPKEALIDLAWHPFDPTIASVSVAGLTYIWA

SEQ ID NO: 140281 - protein, 179 aa, Triticum aestivum
  Clone ID: PAT_TA_34699.pep
MASNQDKASYRAGEAKAHTEEKAGQVTGATKDKACEAKDRACDATGKGQGAVEATKQKAGEAGQKTSETAQAAKDRAAEGKDQTGSYLGRTAEAAKQKASEATGYTQDRASDAAQYTKDSAVAGKDKTGSVLSQAGEQVKNAVVGAKDAVASTLGMGGDSTSSETKDASTTETITKSRH

SEQ ID NO: 140282 - protein, 198 aa, Triticum aestivum
  unsure (1)..(198): unsure at all Xaa locations
  Clone ID: PAT_TA_34700.pep
IWHSFFGMPGTHNNINVLQCSPVFAKLVEGYSPPVNFEINRRHYNKGYYLADGIYPRWSTFVKTISNPVAGGKNAWFAKFXEACRKDVERAFGVLQSRFAVVRYPAQTWSKDQMWEIMTCCVVLHNMIIESEQKDPVFDTEPYYRQGPLAEVDHQLPATWTAYLSMRQEIRDPQVHHQLQQDLVEHLWRLKGDAVRDM

SEQ ID NO: 140283 - protein, 203 aa, Triticum aestivum
  unsure (1)..(203): unsure at all Xaa locations
  Clone ID: PAT_TA_34701.pep
GQKLLLLVAATLVLHHSTTAYGAASSGSISMARPGCPDKCGNISIPYPFGTGKGCFQEPFNVTCNGTGAYLGSNGLRVLNISLALGEVRVQNPHITSRCNFSNGSNSTSGLDVLTLDPFHTVSNMKNKLTSIGCGGLAXLVGQAKGKNQLEYLTADSCISSCMDVSSIGNGTECSGMGCCQAPVSGNINAFLAQSIPVSAIYN

SEQ ID NO: 140284 - protein, 305 aa, Triticum aestivum
  unsure (1)..(305): unsure at all Xaa locations
  Clone ID: PAT_TA_34702.pep
TRPVDPERHRKVVNIDDPSAPFFAAQGGHGVPVVTYSFENKKADVHTLKYQLSLFETEVLVQTPHGILEISSGLLGRDNIYNILATVAVGVAVGAPLEDIVKGIEEVDAIPGRCELIDEEQAFGVIIDHARTPEALSRLLDSVKELGPRRIVTVVGCCGEKERGKRPMMTKIAAEKSDVVMLTSDNPASEDPLDILDDMLSGVGWTMEEYLKHGANDYYPPLPNGHRLFLHDIRRVAVRAAVAMGEQGDVVVVTGKGXDTYQMEGDKKEFFDDREECREALQYVDQLHRSGIDTSEFPWRLPESH

SEQ ID NO: 140285 - protein, 206 aa, Triticum aestivum
  Clone ID: PAT_TA_34703.pep
MAGGVGGGGPRASSDSKAVRSPNPAIDSTIKSIKEVVGGHSEDDIYDALRESNMDPNETAQRLLNQDPFHEVKRKRDKKRESAGQKNPSETTAQGEHGTQQTKPHTQRVEIDQRRAYNHGQTYGPSREFRVVRDNRHGAVENGAEQHKVSAYMQSSDRSGVVVQSDRNRPPPTTSEGQITHQSAKSSYNSDMHQMKRDAQGTAQRH

SEQ ID NO: 140286 - protein, 55 aa, Triticum aestivum
  Clone ID: PAT_TA_34704.pep
NGRFYAPRVGLRSLHSVLRGIQFSTRQPKGRHNKLAKLICMHLCQLNHLIPHRSM

SEQ ID NO: 140287 - protein, 316 aa, Triticum aestivum
  unsure (1)..(316): unsure at all Xaa locations
  Clone ID: PAT_TA_34705.pep
MSAPPSSSPSPAPIPQPAATLAPASMRGAAADDDSSGSSPSRMSEDDDDGDGGAGRGDRWAPDLRGGNGNGGRWAPPDQVLENVLESVLEFLTAARDRNAASLVCRSWYRAEAQTRREIFIGNCYAVSPRRAVERFGGVRAVVLKGKPRFADFSLVPHGWGANVSPWVAALGPAYPRLERICLKRMTVSDDELALIPKSFPLFKELSLVCCDGFTTRGLAVIAEGCRHLRVLDLTEDYFHEEESEVVDWISKFPECSTSLESLVFDCVSVPFNFEALEALVARSPALRRXRVNDHVSIEQLRRLMXRAPHLTHLVT

SEQ ID NO: 140288 - protein, 108 aa, Triticum aestivum
  Clone ID: PAT_TA_34706.pep
APAADAGAGSSSSSSRKPGKPFEPKKWNAVALWAWDIVVDNCAIRRNHIMDLCIECQANQASATSEECTVAWGVCNHAFHFHCISRWLKTRQVCPLDNSEWEFQKYGH

SEQ ID NO: 140289 - protein, 123 aa, Triticum aestivum
  Clone ID: PAT_TA_34707.pep
MSAMETDAPDAPPPAAPAPAADAGASSSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 140290 - protein, 116 aa, Triticum aestivum
  Clone ID: PAT_TA_34708.pep
MDQGDVAVAVPPAAPSSSCAGAGCKKGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 140291 - protein, 168 aa, Triticum aestivum
  unsure (1)..(168): unsure at all Xaa locations
  Clone ID: PAT_TA_34709.pep
MSAMETAAPDAPPPAAPAPAAAAGAGSPSPSSRKTGKRFEIKRWNARRAXWAWDIVAGTTAPSAGNHIMDLLHSRRGGQTRPAPPKRGKCTRRMGLSVTTAFPPSTAFSRMGSKTPPRCAHSDNMRVGVPEIRPLAHPHPPLASASMAYSYSHPFKHLCLIFLFKWFL

SEQ ID NO: 140292 - protein, 120 aa, Triticum aestivum
  Clone ID: PAT_TA_34710.pep
ASFGSFLGAMGSPKNSWMLAFITSTMSLWLINCDTIPVSLAFIYGIYISQPPLVHSWVLRAGSSKNSWMLAFITSTTSCQFTGTSPGPSRQCRGIHHSLVDDGDLSPTVTGDRFRYSLWP

SEQ ID NO: 140293 - protein, 271 aa, Triticum aestivum
  unsure (1)..(271): unsure at all Xaa locations
  Clone ID: PAT_TA_34711.pep
TCRTSISCLEEFFSLVEKVCNIFSPEDDDSQFYRNDTQEYSADGDPLPGIEGFQIVGDPSPGSTLRACGFPTNGTTLCNFQWVRCHEDGTRYSIEGATMYDYVVTADDVGTLLAVDCTPMDDSGRQGDLVREFANNENKITCDQEMQNDINICISRGRADFDVYVXAGYSPEEWEHATLVLRRTGYQINISHKDEVVIDEKYSPNLQTKIPNGRTTQFVLVSSGGVNLPFNTQGITEPNNEDNDVRLRDLIVLVMRTFQNKALDAKRKGKA

SEQ ID NO: 140294 - protein, 197 aa, Triticum aestivum
  unsure (1)..(197): unsure at all Xaa locations
  Clone ID: PAT_TA_34712.pep
MDLHQLFKYRLTGANVFCEIPTENNLANSSWQTSPLKLEFSNSPYTPLSTQLECDNLSALSNTPDNQSSTETISAQPISPLEADSSYIKAGSIRENIQVRPDPLYATSRHNMQQTLRDIENVLMAPDADDATTSTKHEFEDTKPAQLMRQRSRTWSHESRQPLPGVXRPHCASGGYPTASYEFRPEXRQKELRDDRQ

SEQ ID NO: 140295 - protein, 314 aa, Triticum aestivum
  Clone ID: PAT_TA_34713.pep
HSLKSSLDESRLERRVKAAIEAEAISRRSRPGGEAQIAELRGKMESARRDIGSLSELLKSKHEEGEAYLSEIESIGQAYEDIQTHNQQLLQQIIERDDHNTQIFMEGVKVKQAQDTLHLELCNLNRNLRQAKGLMDLYKDKIAQLDDKLKVWSEQTARLSEDGRRHSVSSGNAQRKLADVLGEAQQLRQSMDQVQSNVGRSRLEVAGLLVELEKDRFSKRRTEDDLESLSRKASSLRAKTEGSSVLEKVHQEVNEYRGILKCGVCRDRQKEVVITKCYHLFCNDCIQKLLRNRQRRCPSCALSFGANDVKPIYI

SEQ ID NO: 140296 - protein, 275 aa, Triticum aestivum
  Clone ID: PAT_TA_34714.pep
VPANVVESSRRFPEQSRFSCDDRRLLRPAETQEAKKPSSTRAKELPRLSLDSRKESLSPSSRLKSYSYRRTDDSLLDALKPQDSPGHRRSNTVIAKLMGLEEAPDAMGMLVADSYEPARSPRTAAQATRSERPSRSPRRDCQDACGSLLKNEPSALKTRPPPRILTEPAPWRQQERGVSVTNSKASQCRDAEARPRTASLYADIERRLGGLEFSECNKDFRALRILGALHAKDAKHQNNDGDAASVAFQSQEEDSATTSSRSFQSPIVVMKPART

SEQ ID NO: 140297 - protein, 139 aa, Triticum aestivum
  Clone ID: PAT_TA_34715.pep
WNKEKERVTKKLKRVVTKIVAKKLQAAAKMELLTKRTKKAKPEKLVLQKSDAQPRRVLASTRPKLKERLTKWHGRKKELEIVISARTRGGGGLRKPAVARRRAVERRAEVDLVTEPGAPPGRLKELHSPCKDGLPCGDT

SEQ ID NO: 140298 - protein, 53 aa, Triticum aestivum
  Clone ID: PAT_TA_34716.pep
NVYDFRQSLQFFKIVQVFGKCSRFQICSSVKKMFMIFKNCSRFHENESDSVSR

SEQ ID NO: 140299 - protein, 72 aa, Triticum aestivum
  Clone ID: PAT_TA_34717.pep
PIQPGPYSWDGHLRTPESRTPSVAPELAFNDDIVCGYKSSALQGGFSTILWMDDSPASTSVSSLYDPFCRLR

SEQ ID NO: 140300 - protein, 101 aa, Triticum aestivum
  Clone ID: PAT_TA_34718.pep
RSPLKGSRLIVLLFLGYLAAAGQCYQYHGSPLHEGKINVKMCIPRNCDDPNNEVGSKGCYYCVSRPGKASCWHKLKECQANCPTCTPNCPPGSAIEFEACT

SEQ ID NO: 140301 - protein, 122 aa, Triticum aestivum
  Clone ID: PAT_TA_34719.pep
LPSIILTTKAAYSRVRPLARFLSHLTRRHEQRQPAGEELAPLSHAATPASSPGGRRRWRWRLRSIYDLPRCGSPPVSAYAATATATTSEGDEVEATRGPPRGPGPVLPRRLLCSIWPPKKGG

SEQ ID NO: 140302 - protein, 104 aa, Triticum aestivum
  Clone ID: PAT_TA_34720.pep
KVDNQPINSKSSHLFAFLVYGAIIILVLLKSHYSYGTSTFAYLCVQMEVTWQRSNVSDLMLYTCPRVIRYIIYSRLYSYLVFFMLLVSLGYCKDDISTWSWILF

SEQ ID NO: 140303 - protein, 65 aa, Triticum aestivum
  Clone ID: PAT_TA_34721.pep
MFLVGIVAELLEDYTMLVAEVLEQLLDGAPFPRRMRTLMLRSLPFVAPPLAPPPPPHALRVTTRG

SEQ ID NO: 140304 - protein, 234 aa, Triticum aestivum
  Clone ID: PAT_TA_34722.pep
MEAAASPLLLSADAPLAAGRRLLLVPSRPARAPRRGAAPSRCRRASVRAYAAAAAPAPASGNGLVGNNNGVYTVGDFMTKKEDLHVVKVSTPVDEALEMLVQNRISGFPVIDDDWKLVGVVSDYDLLALDSMAGCGLADTNSSMFPEVDSTWKTFREIQRLLSKTSGKVIGDVMTPSPLVVRETTNLDAAARLLLETKYHRLPVVDSTGNLVGMITRGNVVRAALEIKKKAEGA

SEQ ID NO: 140305 - protein, 208 aa, Triticum aestivum
  Clone ID: PAT_TA_34723.pep
EQEVTPDEVVHEAAVGKGLGGALKFLKERGTLNEGTNWGGRTTDKKKSKLVGIEEEAQDGKKEIRIERMDEFGRVMTPKEAFRDLSHKFHGKGPGKMKLEKRQKKYQDDMKAKQMKSSDTPLMSAEKMRDAQARGQTPYLVLSGNAKSGPTGDASGFASVEKAHPGSLTPMLGDKKVEHFLGIKRSAQFGGMPPLPPKKPKLRLAEWE

SEQ ID NO: 140306 - protein, 122 aa, Triticum aestivum
  Clone ID: PAT_TA_34724.pep
AASAAREQVLAKGGPAVAAARAAAAAGAEARGLDVYPGDTKTESECFVVRIDQLPLESTEDNVRVLMEQFGGVKHVFIARHPRTRASLRYAFVYFFEKEDGEAAVEALSDGLEARVVGMLTC

SEQ ID NO: 140307 - protein, 161 aa, Triticum aestivum
  unsure (1)..(161): unsure at all Xaa locations
  Clone ID: PAT_TA_34725.pep
PRVRGIGVVPFLKGLIFTDDAPLCFVSVRCPCRGGAMIPCILLAVGGNLVDGPGEGSKRLGVRTTVAFGFARLIWGPIAGVAIVLLVVQLGSIPTDDKMFMFVLLLRCXLPRSLLSGARAILRGGRYESAAILFWVHSFCGVLHWHAWIIFYLTLLFLTLY

SEQ ID NO: 140308 - protein, 58 aa, Triticum aestivum
  Clone ID: PAT_TA_34726.pep
MSALPTSASFVKLADMGVDTWGLFLEKFQELLPGAFRAHKLGATGQRGRLRMGTSCQF

SEQ ID NO: 140309 - protein, 94 aa, Triticum aestivum
  Clone ID: PAT_TA_34727.pep
LAGIKMPTNWLGMFILSVRTPFLHDNWWRSRDQNVAEAVITPPAVYYQSSLCTDLTECLPPCHRLRLCWAPDFFDNPPQCHHLSCCCCFCCYMT

SEQ ID NO: 140310 - protein, 101 aa, Triticum aestivum
  Clone ID: PAT_TA_34728.pep
MRAQVLLAALTVVTAVLAAALPLAYGQEEAMPSAWPCCDECGTCTRMIPPRCTCMDVSPSGCHPACKNCVQTTLGGRDVFWCMLRIENFCKRRCTPARMVS

SEQ ID NO: 140311 - protein, 356 aa, Triticum aestivum
  unsure (1)..(356): unsure at all Xaa locations
  Clone ID: PAT_TA_34729.pep
MLYTDRGPSPRSSRSEAAAGGSAPRPALALALAVALALTLSPSPAQAAAGGFSCSPGARPVVFNFGDSNSDTGGMAAAKGWHIAPPEGRAFFHHPTGRFCDGRLVIDFLCESLNISYLSPYLKAIGSNYSNGVNFAISGSTTLPRDALFVLHGQVQEFFFFKARSLELINQGQEAPIDAEAFQNALYIIDIGQNDINALLSNLPYDQVVAKLPPILAEIKYAVQLLYGNGSRNFWIHGTGAXLGSVCDPLNVELKNAAVVYTDLFPIKYDLVANHTKYGFDSPLMTCCGYGGPPYNYDLSRSCQSSNSTVCADGSKFISWDGVHLTEAANAVVAAAILSSAYSRPKIKFDQFCKAR

SEQ ID NO: 140312 - protein, 179 aa, Triticum aestivum
  Clone ID: PAT_TA_34730.pep
MVRISTMDWLGQSQYASETVFWPSLSSAISEVIFSKNATVRLLVAYWTHFIPSTEKYLKSLLYSNILCASSKYNHCGGKVEVKYYLVPGYNETGPALAHGAPTGNRYPDFTRVNHGKYAVSDVRANIGTSNLIWDYFYTTAGVSFGTYDPSIVSQLQDVFDADWDSPYTMPVKPLEASR

SEQ ID NO: 140313 - protein, 78 aa, Triticum aestivum
  Clone ID: PAT_TA_34731.pep
HHLENEIYSGGASWMILSKTNPQVTCFFGFLSFALYSSLFTHHRSPTPTPGKMQCLWLKQQFCKPENKRHVLLSILKE

SEQ ID NO: 140314 - protein, 85 aa, Triticum aestivum
  unsure (1)..(85): unsure at all Xaa locations
  Clone ID: PAT_TA_34732.pep
MLFHLMTLLNRGALINGHNFVVRNFRCGQPLQDKVQLKGRDLLTLXNFTREQIKYMLWLSAHLKFRIKHIRQYLPLLHGKSLCMI

SEQ ID NO: 140315 - protein, 316 aa, Triticum aestivum
  Clone ID: PAT_TA_34733.pep
EGSCPFEDFANHNAFTLLEKYKATHLVFNDDIQGTAAVVLAGLMAGLKFAGGTLADHTFLFFGAGEAGTGIAELVALEISMQSKTSQEEARKNIWLVDSKGLIVSSRKDSIQPFKKLYAHEHEPVKDLLSAIKDIKPTALIGSAGVGQSFTKEVIEAMSSINKRPIILALSNPTSKSECTAEQAYSWSQGRAIFGSGSPFDPVKYNEKLFVPAQANNAYIFPGFGLGVVTSGAIRVKDDMVLAAAEALAEQVTAEHFDKGLIYPPFSSIRKISANIAARVAAKAYDLGLASHLPRPKDLVKYAESCMYSPIYRSYR

SEQ ID NO: 140316 - protein, 217 aa, Triticum aestivum
  Clone ID: PAT_TA_34734.pep
MVDDLFYEGNTDHSISSEDEDTLVRSCSNLSVSFGYHCNSYQSFPLENDEHDTSPQMRFETNAMTKSRNGSFTCLSGAAISANFTLANTNICKGLIGEEILPELDSPNSFRKIVSSPSMSRLDLLSTSQGSPASTESSIFEISKNLWRSSAPTTVSSNFLTGTAAATARGAAGEDRVQAVCSEKNGWLICGIYDGFNGRDAADFLAVTLYDNIVYYL

SEQ ID NO: 140317 - protein, 127 aa, Triticum aestivum
  Clone ID: PAT_TA_34735.pep
TPSQNHSPSRPDLRLHSCVRRPPPSGGARATPPKRRCSTLSRAHPLHASSDSPSSAAPWRWVRLCPPSQWRHRGAAAVMGNKIALPFATRAPRCSVFLDFPSHLHSVISCYDDEMACLILWWIGLSC

SEQ ID NO: 140318 - protein, 177 aa, Triticum aestivum
  Clone ID: PAT_TA_34736.pep
AGPSSSIKKLGGAFVAATAVVPDEVDKIKEILVKWSDIDRVNLILTLGNNVHAGGTGFTPRDVTPEATKSVIEKEAPGLAFVMIQESLKVTPFAMLSRAACGIRGSTLIINMPGNPNAVAECMEALLPALKHAMKQLKGDKREKNPRHIPHAEAAPVDQWERSFRAASSGGGCSCDP

SEQ ID NO: 140319 - protein, 332 aa, Triticum aestivum
  Clone ID: PAT_TA_34737.pep
MAEADITRYWCHECQQAVEEAMVEELKCPLCDGGFVEEMTVEQVEALTEQGATQWDPLDNPFEQAGSPGDSDDEENSDIGREFEGFIRRHRRASALRRVLDSIHDDLRDDRERDNSVLISAFNQALALQGAALDPDEDRGDHGNANNDDGLLDEYVLGAGLSLLLQHLAENDPSRYGTPPTKKEAVEALPTVKIEEVVSCSVCLDDLDIGSQAKQLPCEHKFHSPCILPWLELHSSCPVCRFELPSDETKDLSEPSNVDRIESSHEEARADGPGNNGEDSNTNDREDSNRPWALVPWFNGLFSTPEPQTVRATLTDQQLPPASGTNPNAGHS

SEQ ID NO: 140320 - protein, 156 aa, Triticum aestivum
  Clone ID: PAT_TA_34738.pep
SPPPPPHPNPNPTAPPLPTCAPPPQTTRRSPRATTSRTPASCKLPLSVSTAAGFLLAPLTAVERLSNEPFLLITFLNSLLTAAGDFLMDVCTGACYCFHTSFVQLVNLLLLHPLCRTIPLKMRGVGYSSDHNNWLLLTTRGGLICSVLNYHFKSLD

SEQ ID NO: 140321 - protein, 138 aa, Triticum aestivum
  Clone ID: PAT_TA_34739.pep
MAPKAEKKPVAEKAEKTTAAKKTKAEKRPPASKEGGEKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 140322 - protein, 154 aa, Triticum aestivum
  Clone ID: PAT_TA_34740.pep
RHEANTCPRTHVPHIPPSPPQPSAQIPSLPSLLSQKNRRPGSRFAAAAPLLVSLVVAVAEVLAVDAAAPLLVSLVVAVAVAAGPALSSSGCPSCHPHVVVVAPPLYTGNQLFSSMGPDCFLNFRLLGMRAIIGWLIHLASSCPSRSLTLPFLNC

SEQ ID NO: 140323 - protein, 153 aa, Triticum aestivum
  unsure (1)..(153): unsure at all Xaa locations
  Clone ID: PAT_TA_34741.pep
SESSAAKPDLIVSGPPEKIEQGPLQKPDLVESAPTKKLDLIESSTQPGPAEELHLVESRPSRNSQLIEPEPARKLDFNQPWPTTCFVDHPFERPAVTPISYENEMRFCFHSQWVADTSKGGAICRFHNSELQRELLGRLRCRWRRSSSELLXR

SEQ ID NO: 140324 - protein, 279 aa, Triticum aestivum
  unsure (1)..(279): unsure at all Xaa locations
  Clone ID: PAT_TA_34742.pep
ARGEIATQASEIVKANNLADKIVVIHGRVEDVDVEEKVDVIISEWMGYMLLYESMLPSVLFARDKWLKPGGLILPSXATLFMAPITNSDRYEGSVDFWCDVYGINMSALVPLAKKFASEEPSIEIVGGENVISWPFVVKHIDCYTFTVEEFKSITTTYKVSSMMLAPIHGFGLWFEVEFNGPAESCSNLSSDSSPLDIIQKKRRRASDSTVVLSTAPEDEPTHWHQTILYFPDPIGVTQDQIIEGSVTITPSEENPRCLNIHLECSTGGQNLVKDFAMR

SEQ ID NO: 140325 - protein, 267 aa, Triticum aestivum
  Clone ID: PAT_TA_34743.pep
YVFKSLSKSDPIALSAEMAKEHDRDSSTHEQPLTSLGNTIDKVRGEAREVTVANAPIEGMKEEGLTDSLLVLVGLVSPISKLGPVIQEIISWDRPQVTGGVLVVTLLTIYNEWVGYALAASLILVVGAMVWAKERKLGEICSEVIIDKSSDKTTMESIVEAQHSMKKVHEYVKTANVVILRLWSIVLARSPKHTETVIWMLTGLAVALAVVPFKYVLMGLTVCCFAANTRVAKAVSDPRGGRRWREWWESIPAVPVHTVDKGELRTG

SEQ ID NO: 140326 - protein, 183 aa, Triticum aestivum
  Clone ID: PAT_TA_34744.pep
EALRGSKVKGAFIRVEFARPARAVRNLWVGGISPSISKQEVEEEFQKFGKIEGVAFSHDQTSAYIDFEKLEDAISAHRALNGADLGGKELCVDFQRSRGRAERSEAGNFNSRGSLPPGEMGVGHAKGSAGVRMREAKNPTNVLWVGLPNTHKVNEEALRRAMAAHGVVTNIKVFPERQYAFVE

SEQ ID NO: 140327 - protein, 64 aa, Triticum aestivum
  Clone ID: PAT_TA_34745.pep
FSCRPCLYSSGKQHHTQSSLCFSSCMYQVATISHKSAITVSLMAYMVIVYCCVGASFKCSAVVL

SEQ ID NO: 140328 - protein, 201 aa, Triticum aestivum
  unsure (1)..(201): unsure at all Xaa locations
  Clone ID: PAT_TA_34746.pep
MGLGKTLQAIAVASCLHDAWSVLVISQSEXRVHGASMTLQWLNIPTEDILVVLPQTGGSNKAGFRLVYSNTKGDFHLDGMFNVISYDVVPKIQSTLLDLDFKIVVADESHCLKNGXAKSSIASRPVLQEAQYVVXLLGTPGLSLPIEMWTQIEALCSTVSTNVNEDGNRYYWRISTGITKLRASKYQSNYYFGWVVQCHIL

SEQ ID NO: 140329 - protein, 159 aa, Triticum aestivum
  unsure (1)..(159): unsure at all Xaa locations
  Clone ID: PAT_TA_34747.pep
MDTKRGRSLSPVEIKDDHSRGSENGRKDNSAVQNDSSHARPGRGREFVTHSDRHSYGAPRESRRHDDYRRYHDKRADDHGRSHSRTSRSDRESRADTYYYPSKRDDTSDRSHGDWRNVDSRYGGKSVKGEQRTKNQXXHGPPREYPRHDGTEYXQDADL

SEQ ID NO: 140330 - protein, 267 aa, Triticum aestivum
  unsure (1)..(267): unsure at all Xaa locations
  Clone ID: PAT_TA_34748.pep
SESGSGSDDDSDGSGSDDSEEERRREEERSRRRAERLAAMAARAIAEREEAVARLEGEKTSLEKLLAVREKEQAQEASELQTSMXETMEATEIEKQRHHSTRMEALVRLAELEVTNAELAKSLAREQWNLEVQVDQVAHLREEVDLKTFAQDKYKRKIAKIQKTSAPLVDEIESLRRLKLEDEIIDAEYTQTCDRIXAXKDKGKERLEENIGLXRRDMVQPTEVXNWAPRRGLTXHRSVGFQKQMQVESLSSEESTLGLKERFGPRA

SEQ ID NO: 140331 - protein, 181 aa, Triticum aestivum
  Clone ID: PAT_TA_34749.pep
SCKEDEPCNENLPCYPTTRDEASTRTTSGRHEKSPQHPDTLGGRGNATPVAALYGMRAEPPTVHRAERRRQARPRRGAATWNEVCSQNMKHMEASEGLRTQIGLQKQLHAQLELQRKMQLQVEEHSKYLEMVIARQGESLKQLGALPRFQHSNVQAVDHKEAYREQTADTDSAEMSHREKE

SEQ ID NO: 140332 - protein, 77 aa, Triticum aestivum
  Clone ID: PAT_TA_34750.pep
DLSTLVVNLVYVSTLVVNLVYVSVSSKVFHSCHPDPPPNSEDRAIPTVCPVSRWQLHWQEEHLNKANFKQLSHGIFV

SEQ ID NO: 140333 - protein, 154 aa, Triticum aestivum
  unsure (1)..(154): unsure at all Xaa locations
  Clone ID: PAT_TA_34751.pep
MVARRFVVRQVPADEEHTVEYDTEDGLDVLRFQIFSLTSVPPDLQKIVVEADGSVVDDGTDLESIPEGLCLMSIYEGEDADAASAAAPAQEKSDEELIKVEADGSVVDDGTDLESISEVLRLVPVGEGXVTWTQAAAAAVRAQKKSDEELAMMI

SEQ ID NO: 140334 - protein, 618 aa, Triticum aestivum
  unsure (1)..(618): unsure at all Xaa locations
  Clone ID: PAT_TA_34752.pep
AIHAGNXPIDSHLHNYIRGKVYPTPRMWYVRVNVIEAQDIFTMEHHHIPDVFVKVRLGHQLLKTRQVRSPTKNFMWNEEMMFVAAEPFEDDLIIQIENRVAQNKDEVIGETMIPLARIQKRADHKAVVRPLWFDLRRPGLIDVNQLKEDKFYAKVNLRICLEGGYHVLDESTQYCSDLRPTMKQLWKPPIGLLEVGILSANGLNPTKTRQERGSCDPYCVAKYGHKWVRTRTIVDNLNPRFNEQYTWDVFDHGTVLTIGLFDNCHIGGDNNNNNNNNNNHSHSHSHNQSHMDKPIGKVRIRISTLETRRVYTHTYPLLVLHPSGVKKMGEIHLAIRFSVTSLLNVFLTYSRPLLPKMHYAQPLSXIVQQEMLRHQAVQLVAQRLGRMEPPVRREVVEFMSDARSHLWSMRRSKANFFRLMQVFSGFIAAGKWFGDVCQWKNPVTTVLVHVLFIMLVFYPDLILPTIFLYMFLIGLWNYRFRPRVPPHMNTRISYADVAHPDELDEEFDTFPTSKSADLIRMRYDRLRHVAGRIQTVVGDIATQGERLQSLLSWRDPRATAMFLLFCLFTAIILYITPFQVIALCLGFFWMRHPRFRHKVPAAPVNFFRRLPAKTDSLL

SEQ ID NO: 140335 - protein, 224 aa, Triticum aestivum
  Clone ID: PAT_TA_34753.pep
PDVINAEAARSSSAEVLIHNEGMPASEGIGLTENTISNSFDCIDSQGGASLAVQHQLNSSPAIDNSINQESSSGDHRRTEHVERQSGVGSQPLPGETDRHLGDAEMEVNTGNGDNTQADPPESQTLAPVPSQASLQMSKEVEAEANLVMPSAEPIVAPAPLLRREAEQVDRSGITPAQTLQAEMQPSASRELSTPTDLTIQSAQPNMVPTVLSQRDVEQSSLLS

SEQ ID NO: 140336 - protein, 134 aa, Triticum aestivum
  Clone ID: PAT_TA_34754.pep
GTRRPSRGSGGGSPRGRPPPGSPWTPAGWSRATAAPAPPSPWDGAAARPPRGGRRRARGGAGRRRRRRGRRAPTGAAPAPASCATARWSAAAAAAATPLRARSVHARPSPLTPAPTPPPLPSHTLLVICQRTRG

SEQ ID NO: 140337 - protein, 219 aa, Triticum aestivum
  unsure (1)..(219): unsure at all Xaa locations
  Clone ID: PAT_TA_34755.pep
YRSGIPGRPTRPETDGRRPDGDDVELAILEDDLYHYGSNSEEMLLDELKVSRAMSKHFIKVTSTATIKEATLLMHDKQQGCVLVVDNEDFLEGIVTVGDIRRRGFESSEDANGTGENSSDLDVNSALVTSCLTRGFQYHGNERGLVTCFPDTDLSTAKVLMEVKGIKQLPVVKRGAGRRNDGRRKVLGLLHYESIGRCLREELERWIPIYXREFPAASS

SEQ ID NO: 140338 - protein, 140 aa, Triticum aestivum
  Clone ID: PAT_TA_34756.pep
ENFQEIHEDQGQASTSRANDRTNTELELKLSAASEELQFLRSKLTLMERYANILHISIFRKPMDERTLPRSLQESAVFDIRKEFENILDSSDTDELARLEMFYRSMLSGVKDKLLKRKVQVMVQECIVSLSAGRQTPRGQ

SEQ ID NO: 140339 - protein, 198 aa, Triticum aestivum
  unsure (1)..(198): unsure at all Xaa locations
  Clone ID: PAT_TA_34757.pep
SSICFTTTGSSLCFRNFKIDSYPELDATGSLVLTEVGPFFSLKLLDSQGDLKQDFDLSQNQIGETLELCSAVYYGSSDCSGSYTPHHVELHGRTFTVLLRNDHKLTLAGQYEGFNASLLDLLSKEPALKRKHIIGFFHQQAAXFIKNRFLSILQSVVLEYVNLFASGSCFASDIKLDNVLIRGHQIKIYGVMVSKYAN

SEQ ID NO: 140340 - protein, 521 aa, Triticum aestivum
  Clone ID: PAT_TA_34758.pep
MWAWGLAERAIAGLLGPAGANGGRWNTAVAVGVTAAAGIALVAIVVSSRRGGIKSPWRRRRKRALGPKEWRSLFTPEGKFYDGGVKLLKRVRNGGVEPSIRAEVWPFLLGVYSLNSSEAEREAIKAHNRKGYLLLRKHCLRKNNKESVDDHITSEEENPCVISEQEMQDKTGKAIPENQADESLCSSSSRDEDESEKSDVTDVEASRDDVASVDQSSVEDEEESMPLPKYSNTGGNIETETKLSKVARPVKSARTVEDFETWQRIIRLDAVRANNEWVSYSPSQAAVTREKAIESASSVCLKDYEHLEAHRIHHASRLVAILEAYATYDPEIGYCQGMSDLLAPLLAVLEEDDEAFWCFAGFMRKARHNFRLDEVGIRRQLNMVSKIIKTKDFHLYVRLEMLEAADCFFVYRMVVVMFRRELTFEQTLSLWEAMWADQAARRAGITRSSWRKLQLGAPPTDDLLLYAIAASVLEKRKLIIESYSSMDEIIRDCNSMAGQLDIWKLLDDAHDLVVTVQDRIE

SEQ ID NO: 140341 - protein, 126 aa, Triticum aestivum
  Clone ID: PAT_TA_34759.pep
VSLLKKTQLSDCSDAAALSAFKHSVRDEWLARHLGQNKPRTMAALTNLMTRFCAGEDSWLARCSTSDPSTSEVRDGNGKSRRNSNNKRRNKEDRTKGTAVNAGFKSSQPGQKPPPKGTRDELSSPW

SEQ ID NO: 140342 - protein, 168 aa, Triticum aestivum
  Clone ID: PAT_TA_34760.pep
MAEEQMEEEAASSAAASGTPFQLQFDKPIPFQIKLAEWNPEKDLLAMVTDDSKVLLHRFNWQRLWTISPGKCITSICWSPDGKIVALGTEDGFVLLHVENGKMLRSIKSHDVAIVCLNWAEDEPLSRTDKEDLLSYEDRTTRFFPPAPVMPRIGGLNSGDTGLADENE

SEQ ID NO: 140343 - protein, 120 aa, Triticum aestivum
  Clone ID: PAT_TA_34761.pep
VDAKSIIFQGLVDRNRAHREGNDRDVPISSGVHVSGPECFSRAIRAAVIPPNFRLVTGVSKFNGESKPDTWLEDYRVAIQIDDGNDEVAMKHLPLMLEGSARAWLNQLTPSSIYTWEDLS

SEQ ID NO: 140344 - protein, 179 aa, Triticum aestivum
  Clone ID: PAT_TA_34762.pep
MDGGVAAAVAAAAAASTVRWAVAPPGAAGAGAGAPPPFLMKTYDMVGGPATDAVVSWGPANNSFIVWNTPEFARDLLPKYFKHNNFSSFVRQLNTYGFRQVDFSKWEFANEGFLRGQKHLLKTINRRKPSHANTQVQVQQQQPQQQQQQQQPQLQNAPMPSCFECQSVKVELDEIIRKT

SEQ ID NO: 140345 - protein, 166 aa, Triticum aestivum
  Clone ID: PAT_TA_34763.pep
MIMGALCDFCGEQRPTIYCRSDAASLCLSCDRNVHSANTLSQRHMRTLLCDRCASQPAAVRCLEENTSLCQNCDWNGHAATSLAAGHLRQTINCYSGCPSSEELARIWSFDADAPSAAAEPNCEEGISMMSINDSGVSNHCGAQQDSSLLDMANTSLISDPHTGEK

SEQ ID NO: 140346 - protein, 133 aa, Triticum aestivum
  Clone ID: PAT_TA_34764.pep
PVVHIRVNTILAGQRDGSWVMLAESFKGIISDPIIQLASKSSLKRVPAVSPLQVRKTNRQHNRTNISAHVVDAMASLLRRQVRAPSARCRPQARRVRELNLYSCSGVTTFSVPHRPQIVFIKQHISTPARIML

SEQ ID NO: 140347 - protein, 122 aa, Triticum aestivum
  Clone ID: PAT_TA_34765.pep
MATLQLNHIARETGDVRGLAAFYEEVLGFERVPAPAYSGFQVAWLRLPGSPDVALHIIDRDPAAAAAAAAPGGSTPAQSCPRHHLAFSAWPTSTVLTGLTGRATQSFEKSQSQTAARQVSFF

SEQ ID NO: 140348 - protein, 268 aa, Triticum aestivum
  unsure (1)..(268): unsure at all Xaa locations
  Clone ID: PAT_TA_34766.pep
VDDLDGSSXRKXYYRKIGKAWKRGYLLYGPPGTGKSSLIAAIANHLRFDIYDLELTGVNSNSDLRRLLVGMTNRSILVVEDIDCTIELEQREEDDEEDSKSNSTEKKAQDKVTLSGLLNFVDGLWSTSGEERILIFTTNYKERLDPALLRPGRMDMHIHMGYCTTEAFRILANNYHSIDYHATYPEIEKLIEEVAEVLMRNDDTDVALHDLVELIKLKKKDATEIKTESKKTEKKDATDDIKIEATHVDGKKDGGEIKTGSVQVEEKK

SEQ ID NO: 140349 - protein, 496 aa, Triticum aestivum
  unsure (1)..(496): unsure at all Xaa locations
  Clone ID: PAT_TA_34767.pep
MAPSYDKTIATAASLAASLMLVRSLANELLPSELRDALSSALASLRSRMTWQHTIVIKEIEGWCRNCVYDAVNAYLATRTSASLSMQRLRVSSADEAEKMVVSMEAGEEMADLYQGAEFKWCLVTREVRGDPDSVGGGAREVRSYEVSFHRRHKEKALKEYLPFIVATAKAINDQERSLSIYMNEHSDEWSPIGLQHPSTFDTLAMDNKQKQSEDKVLNMLTKKKETHGRIGKAFKRWHLLYDVGGTGKSGLIAALDNHLRFDIYDIELTGVDSNYDLRRPLVEMTNLSIRVVEDDIDCTIELKQREEDDKEHAKSNSTEKKKAEDKVTLSGLLNFXDGLWSTSGEERGIIFTXTNYKERLDPALLRPGRMDMHIHMGYCTTEAFRILANNYHSIDYHVTYPEIEALIEEVTVTPAEVAEVLMRNDNTDVALHDLVELLKLKKKDAIEIEKVSRQRRRKTPMRSRPRVCRWTRRKLLMRSRLKVCRWRRKMTKRWW

SEQ ID NO: 140350 - protein, 203 aa, Triticum aestivum
  Clone ID: PAT_TA_34768.pep
TIMTISLLLSDSSKGRVTPQHSTQISGEASGLGETPIQSLDSVKNLASPFSFSKLRKPKAPLIGGGNLVICPMTLLSQWKAEIEAHTKPDSLNIYVHYGQSRPKEASFIGQNDIVLTTYGVVASEFSTESSTENGGLYSVHWFRIVLDEAHMIKSSKSLISQAAAALTADRRWCLTGTPIQNNLEDLYSLFRFLKVEPWRNWV

SEQ ID NO: 140351 - protein, 103 aa, Triticum aestivum
  unsure (1)..(103): unsure at all Xaa locations
  Clone ID: PAT_TA_34769.pep
LFPSIPLVAEEDSAFIRSSNAADSKSNTLVESISSFFTKHVNNNGPPLTHDDVLRAIDRGGKDAXRFDSNPATYWLLDPREGTKGFLKGEDSLYVVCFFVCIL

SEQ ID NO: 140352 - protein, 123 aa, Triticum aestivum
  Clone ID: PAT_TA_34770.pep
DYSRATGGSPAGCSPAGAPAPAAAAPGHASPAPSASTTPGSKSPGPPVIFHSSVHSTPGWTTAGRPRARPSATNAARNIDGLKSFGQLGWFARHGSEVFSLLLTTGSRIALCLAIFIWFLLSF

SEQ ID NO: 140353 - protein, 110 aa, Triticum aestivum
  Clone ID: PAT_TA_34771.pep
MFYAGYGYLASWFEQTYRCYPASFFDKPHLEGGDKVIMPPSALDRLASLHIEYPMLFELHNGVTDRISHGGVLEFVAEEGMIIMPYWMMQNMLLQEGDIVPAPPATRNKT

SEQ ID NO: 140354 - protein, 190 aa, Triticum aestivum
  Clone ID: PAT_TA_34772.pep
RPRWWRRPWRSPPPSSPPPSPSPSPTPPPRRRTCSSRRSSTSPAPATSTSRSSPPPAPRSSPPPRGAPPTPSRRPGRGGAGLAVTTRAGGPAGGGAAAAQERWRQAAGVAAEPGDAGGPLRVPGRDRRRQEAPARGSHAGGPRDADAEEVQGRGQGQDAQGRGRGEEEAVRGGGQRKRRAPSSSSGREHV

SEQ ID NO: 140355 - protein, 259 aa, Triticum aestivum
  unsure (1)..(259): unsure at all Xaa locations
  Clone ID: PAT_TA_34773.pep
MAPEMWYIELAVGGSKVHAGCNGKLVWRHTPWLGAHSAKGPVRPLRRSLQGLDPLTTASMFAGARCIGERKVNGDDCFILKLCADPETLRARSEGLAEIIRHVLFGYFSQKTGLLVHLEDSHLTRIQSTTGGDAVYWETTINSFIEDYRPVEGIMIAHAGRSAVTLFRFGEVAMSHTKTRMEEAWSIEEVAFNVPGLSMDCFIPPTDIKSGSIXETVELPQSGKSKAGGLLPCHGAKVAALEKADDNVAWRGPLQRDCN

SEQ ID NO: 140356 - protein, 406 aa, Triticum aestivum
  unsure (1)..(406): unsure at all Xaa locations
  Clone ID: PAT_TA_34774.pep
MEALRVWRASSNLLGFAASRAAAASAGRAHRFHIRCCSPAAAATTKPPQDRRRRSASSSSTSDRDSIRAIRLKKVEELRGKGYEPYAYKWDRTHTTKELQERYTHLENGEVCTEASVSIAGRIVARRAFGKLVFMTIRDDSGTIQLYCEKDSLTEEQFEQLKAFIDVGDILGASGSIKKTEKGELSVYVSFFEILTKSLLPLPDKYHGLTDVDKRYRQXYIDMIANPELLMCFEQDKVVSEIRKXMESFGFIEVETPVLQGEAGGAEARPFITHHNSLQRDLYLRIATELHLKRMLVGGLEKVYEIGRIFRNEGISTRHNPEFTTIEXMYEAYSEYESMMNLAEVIVTRCALATTGKLKIDHQRTGFSLSSPETSAIIHLLIVERTAIEKSRSQEAIWQRAGLAQW

SEQ ID NO: 140357 - protein, 92 aa, Triticum aestivum
  unsure (1)..(92): unsure at all Xaa locations
  Clone ID: PAT_TA_34775.pep
RRPSQSMPLRQKVLFHALNPFREERKRSVDHTRRISHVSLHCSSSSSRRSVKLGIDDGVGHGQKQVTEEGLNNEEIYEDEGVXYDYYDDPEE

SEQ ID NO: 140358 - protein, 264 aa, Triticum aestivum
  unsure (1)..(264): unsure at all Xaa locations
  Clone ID: PAT_TA_34776.pep
MGSASDDSREHLLDVGALAADGAAGPKIRVRGLRRRSEASGEEILRGVDLDVPRGVVMGVIGPSGSGKSTLLRALNRLWEXPPPGAVTLDGADICGWDVLALRRKVGMLFQLPAMFDGXVADNVRYGPQLRGKKLSEAEVKSLLSLSDLDPALSSRPASELSVGQAQRVALARTLANDPEVLLLDEPTSALDPISTQNIEEAIVRLKTARGLTTVIVSHSVKQIQRIADLVCLVVDGEVVEVLAPSDLSEAKHPMARRFLELSS

SEQ ID NO: 140359 - protein, 628 aa, Triticum aestivum
  Clone ID: PAT_TA_34777.pep
MLLRTPPQRKRRAVPDADPDANLDLDLAAAVAVATGRTPVSDRRLVPYDRPTALVSASGAEEPSDDMVCTYHCRQMVKSEFVVALDTAEKAVQEYRVKLDTLEKQLSKSEDERTTYHDKLNYVEQELAATKGRETALQERLLKELGEYQERYRQQVRKIGELEVKLNKEIDSRISAESSSASAQESVKELERAMQRSSENSEREKKALQKELSYMQDDSKLSISKLNAELERMSLRAQNSEKEAKMLNEQLEDLKKQLNECLREKNETELRLLDSAPLSVQRNPTDDQKLIKLLQEELRNYEKEVHEARRLKSSHTNVELLSEKLLEEQSRRKRAETELSKLQEIEAKAQKLELELASCTSLLGNIPDVSSYSNIADLQRQALTDLNKLGEVTSRLKELEVTLEFAEISKQRAEGEATLAKERAESASREVKRLELLLTAVSEERDRLRKDHNMLSNQKTRDGDDMSSKKMESDLSQMEKVVRELETTLHEQRELISQQHAELNLMNEKLSIEARKAKSLEREGDQLRSQVALLESKLGHGDYSASSTKVLRMVNTLAMDSEAKQTIEALQAELKKTKERLQAIEELKGQADAGTVVDANVAEKLAQLKNQVATLEKREERYQAVFLE

SEQ ID NO: 140360 - protein, 197 aa, Triticum aestivum
  Clone ID: PAT_TA_34778.pep
MLVCFKILDEFPLNGTTIIYWIKKGIPYPSLPKKEKPRRVELYFSSWRIRPVQSPKKDGQQPMACEVTLFHYEDMGIPKDVAKVGVRHGMWGAVKKLQSGFRAYQLMRKSENILSRSAIMARVTTKTCIAGSDGSLDQGPFSTEQASTEDDNSRAVQHGFDWKWVVVGGAVAAACVLNTGIVGKALLLGVARRQAKK

SEQ ID NO: 140361 - protein, 69 aa, Triticum aestivum
  Clone ID: PAT_TA_34779.pep
TTRLREVNFMVPFILLIWRNFKSQSGGERSGCYWWEMGASPVNRATTNPTGKGSVVIFMLSVTVHDFPG

SEQ ID NO: 140362 - protein, 406 aa, Triticum aestivum
  Clone ID: PAT_TA_34780.pep
MSEIRRDVPEGTGAGAEGKGADSHVGSRAARRRRMEIRRHRLVAEHGAEEVSRKRRKLDGESSTDEEEIEPAKYGVTSVCGRRRDMEDAVSVRPEFLPGHHFFGVFDGHGCSHVATSCEERMHELVSEATPGARSLGSADADRWMDDVERSFARMDAEAVSSRSRASGAPTCRCELQLPKCDHVGSTAVVAVVGPRHLVVANCGDSRAVIGRGAAAIPLSADHKPDRPDELERIHAAGGRVIFWDGARVFGVLAMSRAIGDSYLKPFVISDPEVRVLDRKDGEDEFLILASDGLWDVVSNEVACHVVRSCLRSRAPPHPHGGDGERSSPTSNLSPRQSSGSGSSSGDEEGAGPSDGAGSESDGDGESSEDRACSEAAILLTKLALARQTADNVSVVVVNLRRRRRS

SEQ ID NO: 140363 - protein, 456 aa, Triticum aestivum
  Clone ID: PAT_TA_34781.pep
ILRTETSMVDLRKLQEQISTKATARSTYFTLQQQQYAALSEENEDTDEELKEWQTKFEEKIALLETKIAKLEREMNDEYAKSSLLSETINDSTREIGKLQAEADAHMSVKHERDSAIRTIFNKHNLGPVPDAPFTNDIAMNLTNRTKARLSNLEDDLQEKKKTNETQLEFLWGRYLKVNARYSEVDGQIQSKKESKIGVLRRIKDKENERDAAETELSRHNLARIDERERHLQIEVERKTIALGERDYDLIISQKRSEIYTLDHKIKALHREKDNIATDADDRVKLELKKDELEKCKKKLKKIYDEHKDKFRSVLKGRLPHEKDVKKEITQAFGSVDSEYNDLNSKSQEAEQQLKLAQMKIDAAKSHLAKLQKVLDAKRKHLNSKLQSIAKVSVDINAYPKILKDAMDERDKQTNNFSYAKGMRQMYEPFEKVARQHHKCPCCDRAFTPGRRGREF

SEQ ID NO: 140364 - protein, 90 aa, Triticum aestivum
  unsure (1)..(90): unsure at all Xaa locations
  Clone ID: PAT_TA_34782.pep
MASAEQKVVEHVRSXGNAPILKXDKFKISGXDXFLRVIEFPGRKLHQDTLFVYVNSSFSPSPDELIIDLYNNFAIDGKLVVNYALSAAWG

SEQ ID NO: 140365 - protein, 162 aa, Triticum aestivum
  Clone ID: PAT_TA_34783.pep
ASSGSDPQVMMELGLPPLHKLGDSLCSWLARATSLLERADASVGLQGSLPTMQAALVANHRDQGTEDIGNTMQPLTLGLVAPVVATKISLASSISDEVQAVAKGCAFAIDEGDTLHDLTELIKCLIAMSAITQGLIRLVKAEQIKDANQVVCAAVSVNSATC

SEQ ID NO: 140366 - protein, 126 aa, Triticum aestivum
  unsure (1)..(126): unsure at all Xaa locations
  Clone ID: PAT_TA_34784.pep
MAVDAATAPSELDGSIRGEGEVAAKPPPSAAAPAARESPEELDRRYAPYARRDAYGPMGRGPLGAAEAARXAVAAAVLLPLRVVWAVLVLVAYYLVCRVCTLWXXEEEXXGEGEGYARLQGWRRAW

SEQ ID NO: 140367 - protein, 427 aa, Triticum aestivum
  Clone ID: PAT_TA_34785.pep
DDDWRKLWDDYNGEEVKITKEEAKIISRLMKGKTPHANVDPYPDYVDWFEYADKGHPLSNAPEPKRRFVPSKWEQKKVVKLVRAIRKGWIKFDKPKDEPNYYLLWGDDTDTADNKRQGLSYIPAPKPNLPGHEESYNPSVEYIPTQEEIDNYQLMYEEDRPKFIPRRFESLRSVPAYEKALREGFDRCLDLYLCPRTRKKRINIDPESLKPKLPSKKDLRPYPRTCYLEFKGHGGPVTSLSVEATGQWIASGSSDGTIRVWEVETGRCLKVFNVGADVHHISWNPSPERPILAAIVGRDLLLLNTEVGDEETQVRTKELLHVEEPTPEDDGDKKPAVRWVNNDKFDGITLIHHRAASTVEWHSKGDYFTTVVPTGESRAVLLHQLSKKHSHHPFRKLPGLPVAAVFHPTQKMFFVATKKFVQVYDLQ

SEQ ID NO: 140368 - protein, 285 aa, Triticum aestivum
  unsure (1)..(285): unsure at all Xaa locations
  Clone ID: PAT_TA_34786.pep
LCRSLSSKGEEGIEWGAELSSLQRELSPWPWRPPPSPPTRSRSSPSSAPSPTASTSSPSRASAPTAASPPPGRPPSRRHPSRRRRIPPPPHPTGPPLPLPLPLPRSPPPLLRSPRPRPRRWRRPSSRDSRWVNXGTWDLSRFGNTGGXSQRPTVIDAEARRRKWLEDSPEASSSEDAVVFDTSIIPWWAWIKRFHLPEAEKLNGRAAMVGFFMAYFVDSLTGVGLVDQMGNFFCKTLLFVAVAGVLLVRKNEDIDNLKKLIDESTFYDKQWQSTWQDDSPSGPKK

SEQ ID NO: 140369 - protein, 110 aa, Triticum aestivum
  Clone ID: PAT_TA_34787.pep
HRILSTSSPGLEDHLCPLIPHSSAPTNSAPRKCCLGLLGLSAPHRLHHQWWTRRLCTPEFGWVQRRAWTRRRQDPAGGTCQQDPTETRSHRPPPPPSPWLPLAVVQGILF

SEQ ID NO: 140370 - protein, 458 aa, Triticum aestivum
  unsure (1)..(458): unsure at all Xaa locations
  Clone ID: PAT_TA_34788.pep
MQIFVKTLTGKTITLEVESSDTIDNVKAKIQDKEGIPPDQQRLIFAGKQLEDGRTLADYNIQKESTLHLVLRLRGGMQIFVXKTLTGKTITLEVESSDTIYNVKAKIQDKEGIPPGPTRLTFAGKQPDDGSSLPSETQKISERNETKAFSSSEMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNXKAKIQDKEGIPPXDSSGLIFAGKQLEDGRTLADYNIQKGATLHLGLPPXXG

SEQ ID NO: 140371 - protein, 149 aa, Triticum aestivum
  unsure (1)..(149): unsure at all Xaa locations
  Clone ID: PAT_TA_34789.pep
MLLASSGQMAALRPPRLLLLPPRPAALPLRRRPSMGASSARRRGGAGRVCVPRCAGATPPPQTSAVQVPARRKCSPLLDSALLPGGSELAVHEWKAXPDIWRTAAEKYPTVYSQRSYLISSELNYNNLNNKHWILSSAGFGGAQDKLLL

SEQ ID NO: 140372 - protein, 144 aa, Triticum aestivum
  Clone ID: PAT_TA_34790.pep
GTLPWKTCLAATIHQGTNPQHTSHVRADGVRHAARRRKVRFHGRSPLRCVGHPPGAPNWRGSSLACRGGGQRYHAIIHPASFCCCRGGSVCPARLRGQVSEDEDGQQGGGGGRRRRRRRRRRLLRYVLRRGLRRRLRQRRFGGR

SEQ ID NO: 140373 - protein, 368 aa, Triticum aestivum
  unsure (1)..(368): unsure at all Xaa locations
  Clone ID: PAT_TA_34791.pep
AVLRSCPQLEELSVKRLRGLSDSXPITVSSPRLQSLALKELYNGQCFSCLITCSPNLKTLKIIRCSGDWDPVLQAIPQGSLLAELHLEKLQVSDLGVAALCGLEVLYLAKAPEVTDVGLAALATKSPRLRKLHVDGWKANRIGDRGLATVAQKCAALQELVLIGVNLTSASLELIAANCPTLERLALCGSDTFGDAEIPGPASARASLRKLCIKACPVSDAGMDKLAAGCPRLVKVKVKKCRRVTFECAERLRASRHGALAVNFDTPGGAGELQDASVDESGVLENAGSDVVQDDFDDQIGVPDLPVWHQVADHQGWKSPDCSFDIQACRFPCFPRRPRGSPHTLVPPQVFAAGRPSPSFKVGTNEPF

SEQ ID NO: 140374 - protein, 192 aa, Triticum aestivum
  unsure (1)..(192): unsure at all Xaa locations
  Clone ID: PAT_TA_34792.pep
MAEAAPASPWWAGRMTAAFGAPFLWLVCLIYFIQGFRSFVWTAVSYQMKDIMKLSPSTSQFLVSAAFFPWSIKPIYGIVSDCIPIKQRKRVPYLIISSGLSLFPWLIIGLSEHLRSSSNLFTLMLIVQNLGSAMADVVIDAMIAEAVRXQGTEFAGDLQSLSWSSMAVGGIFGSLLGGYALSNLPINAIYIM

SEQ ID NO: 140375 - protein, 70 aa, Triticum aestivum
  Clone ID: PAT_TA_34793.pep
MAGGGIFSRALSYVVNEFLVEGLANNRAFQRFAVRTNRTLEDLSSKAKQAREEISEQFKDARGPNDRFKQ

SEQ ID NO: 140376 - protein, 77 aa, Triticum aestivum
  Clone ID: PAT_TA_34794.pep
FPRSTFRLAGGGIFSRALSYVVNEFLVEGLANNRAFQRFAVRTNRTLEDLSSKAKQAREEISEQFKDARGPNDRFKQ

SEQ ID NO: 140377 - protein, 94 aa, Triticum aestivum
  Clone ID: PAT_TA_34795.pep
MHRPPWRVACLRPLREVSALHHFAMAGGGIFSRALSYVVNEFLVEGLANNRAFQRFAVRTNRTLEELSSKAKQAREEISEQFKDARGPDDRFKQ

SEQ ID NO: 140378 - protein, 89 aa, Triticum aestivum
  Clone ID: PAT_TA_34796.pep
MAGGSLETAWELAQLFVLRPVLAVTFVLSFILLSWYVAWRTVLVHVPLVQEIAGLRRKKPVKPKPPNRGRIARFYESQAQRNSKSEGTS

SEQ ID NO: 140379 - protein, 73 aa, Triticum aestivum
  unsure (1)..(73): unsure at all Xaa locations
  Clone ID: PAT_TA_34797.pep
VGYTPSPILIQLHQFCFNNVGIHFPKSSTRSSASQIAYDVQAIMLSWLSSFGLLVDANAISCIVXKSCRANLI

SEQ ID NO: 140380 - protein, 122 aa, Triticum aestivum
  Clone ID: PAT_TA_34798.pep
GSLLNLLSDHLRDELVHKLLQVTACSLVDHDLNQAASCDLKELVNKFIPEVIGKEIEKATSSIFPLQNVYVRKVKILKAPKFDLGKLMEVHGDYKEDVGVKLDRPADGDEVIPGAEEVAAAE

SEQ ID NO: 140381 - protein, 90 aa, Triticum aestivum
  unsure (1)..(90): unsure at all Xaa locations
  Clone ID: PAT_TA_34799.pep
FTLGSAGDSCQPPMAVMAFAGDQAQNFHYXERTRVALYSVYYNTRSDDHSSLCGPVIDDVRVWGLNGAAGLKASIGLLIAMASVIVLVLF

SEQ ID NO: 140382 - protein, 140 aa, Triticum aestivum
  Clone ID: PAT_TA_34800.pep
VLGKKSFFLGEMGNGAKMKLVVNMIMGSMMNAFSEGLCLADKSGLSPQTLLDVLDLGAIANPMFKMKGPSMLQGSYNPAFPLKHQQKDMRLALSLGDENAVSMPVAAASNEAFKKARSLGLGDLDFSVVHEVLKGTGGSG

SEQ ID NO: 140383 - protein, 291 aa, Triticum aestivum
  Clone ID: PAT_TA_34801.pep
MEVGFLGLGIMGKAMAANLLRHGFRVTVWNRTLSKCDELVAMGAAVGDTPASVVAKCKYTIAMLSDPSAALSVVFDKDGVLEQIGEGKGYVDMSTVDAATSCKISEAVKQKGGAFVEAPVSGSKKPAEDGQLVILAAGDKALYDDMVPAFDVLGKKSFFLGEMGNGAKMKLVVNMIMGSMMNAFSEGLCLADKSGLSPQTLLDVLDLGAIANPMFKMKGPSMLQGSYNPAFPLKHQQKDMRLALSLGDENAVSMPVAAASNEAFKKARSLGLGDLDFSAVHEVLKGTGGSG

SEQ ID NO: 140384 - protein, 291 aa, Triticum aestivum
  Clone ID: PAT_TA_34802.pep
MEVGFLGLGIMGKAMAANLLRHGFRVTVWNRTLSKCDELVAMGAAVGDTPASVVAKCKYTIAMLSDPSAALSVVFDKDGVLEQIGEGKGYVDMSTVDAATSCKISEAVKQKGGAFVEAPVSGSKKPAEDGQLVILAAGDKALYDDMVPAFDVLGKKSFFLGEMGNGAKMKLVVNMIMGSMMNAFSEGLCLADKSGLSPQTLLDVLDLGAIANPMFKMKGPSMLQGSYNPAFPLKHQQKDMRLALSLGDENAVSMPVAAAANEAFKKARSLGLGDLDFSAVHEVLKGTGGSG

SEQ ID NO: 140385 - protein, 162 aa, Triticum aestivum
  Clone ID: PAT_TA_34803.pep
GMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEIEKATSSIFPLQNVYVRKVKILKAPKFDLGKLMEVHGDYKEDVGVKLDRPADGDEVIPGAEEVAAAE

SEQ ID NO: 140386 - protein, 395 aa, Triticum aestivum
  Clone ID: PAT_TA_34804.pep
MERGLVALLGLGLALLLLAPSRRLASAAPVEDGLLMNGDFETAPPGGFVKSASVSEGAAIPSWMINGTVELISAGQHQGGMILIVPQGDHAVRLGNDAGIGQVVEVEKGSEYAITFSAARTCAQLESLNISAGSVSQTVDLQTLYSIEGWDAYALAFQAVDEQASIEFRNPGMEDDPTCGPILDNVAIKKLFSPDKAKENMVINGDFEEGPWMFANTSFGVLLPTNLDEQTSALPGWMIESNRAVRFVDSDQYTVPQGKRAIELLSGKEGIISQMVETTPQKAYTLTFTLGSAGDSCQPPMAVMAFAGDQAQNFHYAPMGNATSQAVNVNFTARAERTRVALYSVYYNTRSDDHSSLCGPVIDDVRVWGLNGAAGLKASIRMLIAMASVIVLVLF

SEQ ID NO: 140387 - protein, 291 aa, Triticum aestivum
  Clone ID: PAT_TA_34805.pep
MEVGFLGLGIMGKAMAANLLRHGFRVTVWNRTLSKCDELVAMGAAVGDTPASVVAKCKYTIAMLSDPSAALSVVFDKDGVLEQIGEGKGYVDMSTVDAATSCKISEAVKQKGGAFVEAPVSGSKKPAEDGQLVILAAGDKALYDDMVPAFDVLGKKSFFLGEMGNGAKMKLVVNMIMGSMMNAFSEGLCLADKSGLSPQTLLDVLDLGAIANPMFKMKGPSMLQGSYNPAFPLKHQQKDMRLALSLGDENAVSMPVAAASNEAFKKARSLGLGDLDFSVVHEVLKGTGGSG

SEQ ID NO: 140388 - protein, 394 aa, Triticum aestivum
  Clone ID: PAT_TA_34806.pep
MERGLALLGLGLALLLLAPSRRLASAAPVEDGLLMNGDFETAPPGGFVKSASVSEGAAIPSWTINGTVELISAGQHQGGMILIVPQGDHAVRLGNDAGIGQVVEVEKGSEYAITFSAARTCAQLESLNISAGSVSQTVDLQTLYSIEGWDAYALAFQAVDEQASIEFRNPGMEDDPTCGPILDNVAIKKLFSPDKAKENMVINGDFEEGPWMFPNTSFGVLLPTNLDEQTSALPGWMIESNRAVRFVDSDQYTVPQGKRAIELLSGKEGIISQMVETTPQKAYTLTFTLGSAGDSCQLPMAVMAFAGDQAQNFHYSPMGNATSQAVNVNFTARAERTRVALYSVYYNTRSDDHSSLCGPVIDDVRVWGLNGAAGLKASIALLIAMASVIVLVLF

SEQ ID NO: 140389 - protein, 251 aa, Triticum aestivum
  Clone ID: PAT_TA_34807.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEIEKATSGIFPLQNVYVRKVKILKAPKFDLGKLMEVHGGLPGRMLVLNLDRPGDGK

SEQ ID NO: 140390 - protein, 191 aa, Triticum aestivum
  Clone ID: PAT_TA_34808.pep
LQNDEDQAYRKIRLRAEDVQGMNVLTNFWGMDFTTDKLRSLVRKWQTLIEAHVDVKTTDNYMLRMFTIGFTKRRPNQVKRTCYAQASQIRQIRRKMVEIMVNQAASCDLKELVNKFIPEVIGKEIEKATSSIFPLQNVYVRKVKILKAPKFDLGKLMEVHGDYKEDVGVKLDRPADGDEVIPGAEEVAAAE

SEQ ID NO: 140391 - protein, 289 aa, Triticum aestivum
  Clone ID: PAT_TA_34809.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFTIGFTKRRPNQVKRTCYAQASQIRQIRRKMVEIMVNQAASCDLKELVNKFIPEVIGKEIEKATSSIFPLQNVYVRKVKILKAPKFDLGKLMEVHGDYKEDVGVKLDRPADGDEVIPGAEELLLLSRNRILFCCSYLEDDILHWVRNLYHLM

SEQ ID NO: 140392 - protein, 215 aa, Triticum aestivum
  Clone ID: PAT_TA_34810.pep
SRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEIEKATSGIFPLQNVYVRKVKILKAPKFDLGKLMEVHGDYKEDVGVKLDRPADGDEVIPGAEEVAAAE

SEQ ID NO: 140393 - protein, 263 aa, Triticum aestivum
  Clone ID: PAT_TA_34811.pep
MAVGKNKRISKGRKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRKMVEIMVNQAASCDLKELVNKFIPEVIGKEIEKATSSIFPLQNVYVRKVKILKAPKFDLGKLMEVHGDYKEDVGVKLDRPADGDEVIPGAEEVAAAE

SEQ ID NO: 140394 - protein, 323 aa, Triticum aestivum
  unsure (1)..(323): unsure at all Xaa locations
  Clone ID: PAT_TA_34812.pep
RLINGTDVAIKKLLNNMGQAXKEFRVEVEAIGHVRHKNLVRLLGYCVEGIHRMLVYEYVNNGNLEQWIHGAMRQHGVLTWEARMKIILGIAKALAYLHEAIEPKVVHRDIKSSNILIDEDFNGKLSDFGLAKMLGAGKSHITTRVMGTFGYVAPEYANTGLLNEKSDVYSFGVLLLEAVTGRDPVDYGRPANEVHLVEWLKMMVGTKRADEVVDRDMEVKPTIRALKRALLVALGCVDPDSEKRPTMGQVVRMLEAEDVPSREDRRSRRGGHAGGGNAXDAESKASSSEFEVSGDSGALGEVPAMKIGVDERGRPRELGSGRG

SEQ ID NO: 140395 - protein, 687 aa, Triticum aestivum
  unsure (1)..(687): unsure at all Xaa locations
  Clone ID: PAT_TA_34813.pep
MDASAGSSPPRHSQGDAPRRGGPRRGKGPAVEIRQGEDDFMFAQDTFPALPDFPCLSSPSSSTFSSSSSSNSSSAFAAPAGAGGRGDEGARGEPSEPAAAGDGMDDLSDIDHLLDFASIHRAXSDVKSGKYLIRGVKVRAQQDLAKHKNGSPEKGGASDAKAGAEDGGCKEKSPHGVPAISPGGRLHEPDGREHLKXSKLARSDPPLKTRLRRSTIEAAAARLGGGRQGTMQLLKLILTWVQNHHLQKKRPRVGAMDQEAPPAGGQLPSPGANPGYEFPAETGAAAATSWMPYQAFSPTGSYGGGAIYPFQQGCSTSSVAVSSQPFSPPAAPDMHAGAWPLQYAAFVPAGATSAGTQTYPMPPPGAVPQPFAAPGFAGQFPQRMEPAATREARKKRMARQRRLSCLQQQRSQQLNLSQIQTGGFPQEQSPRAAHSAPVTPPSSGWGGLWAQQAVQGQLMVQVPNPLSTKSNSSRQKQQKPSPDAAARPPSGGAATPHRPGQASASNKQRQQGARTPAAAPAAGDKNLRFLLQKVLKQSDVGTLGRIVLPKEAETHLPELKTGDGISIPIEDIGTSQVWSMRYRFWPNNKSRMYLLENTGDFVRSNELQEGDFIVLYSDVKSGKYLIRGVKVRAQQDLAKHKNASPEKGGASDVKAGGEDGGCKEKSPHGVRRSRQEASSMNQMAVSI

SEQ ID NO: 140396 - protein, 339 aa, Triticum aestivum
  unsure (1)..(339): unsure at all Xaa locations
  Clone ID: PAT_TA_34814.pep
MVTDAAALAGVKAATPAPLPRLGALADDASATASRPSPRATDAHSVTMVTDAAAMAVVKAARPVFRGAHDGVAFAANAAFLAAGYSLCAVGPAALTDPLPAVDEEVGIDGWNTMDNCYAFLHSKEXEGKKKRILVKCLVIDDFLAIDALDLEAQHKEPCNVQINVKDFFSEEQPKNYKDMYKNFAGFINTLNSSLLVELDGKNAAAAAAQNVMSSSSINSSENVLRDTRTTEPAGLIYPPVALFGHDDTFPAPGAGFYPHSGGPGGSMHVGPNDPRFFPSNPSPAPFGGPGSVPPGGRYDPIGPPDVPGFEPSRFVRRSRHPGGSTHPDLEFFQQGPDF

SEQ ID NO: 140397 - protein, 135 aa, Triticum aestivum
  Clone ID: PAT_TA_34815.pep
CLKYNEQPLCILHRTSNTHNLRPGHFHLQVHMTYLQSIPPPPETCTQAPSNGAATGRYLASTCPDDRQLVVVRHLADGLSEPTMQKGLSQCHPDRGKRRAQGPGACGPMARSPVRRVDARVNRRARAEPVAPPHR

SEQ ID NO: 140398 - protein, 113 aa, Triticum aestivum
  unsure (1)..(113): unsure at all Xaa locations
  Clone ID: PAT_TA_34816.pep
ESEGEAVPLVTIAAAAKXKRVRKLSDEFDRIAAAQLEGGGKKKPSAVVPAKAPLRKKVSGAAAVPAPAAEAPAKKSLKRKAVAPAAVTAARTSPKRKAAEAPAARRTSPRSKH

SEQ ID NO: 140399 - protein, 253 aa, Triticum aestivum
  Clone ID: PAT_TA_34817.pep
TCTPSAESLKSSYNDSQLQAVSIAIGSASSKTKCDLSLIQGPPGTGKTKTIVAIVSALLSLHADNSYNLPRNESLASAEFTKPRTKISQTAAVARAWQDAALAKQQIKDSQRENPRTERLSKGILSRGRALICAQSNAAVDELVSRLSNGLYDTEGKLYRPYIVRVGNAKTVHPNSIPFFIDTLVEQRLSDELKINDESKISSDGESSGSLKARLEKVVDRIRYYESRRILVEGDKTETGSSVPDEDEMGEVF

SEQ ID NO: 140400 - protein, 420 aa, Triticum aestivum
  unsure (1)..(420): unsure at all Xaa locations
  Clone ID: PAT_TA_34818.pep
AGPAAPLAPSVVLLQELLWPAIFSGLWSQWRHQSPAPIRCKAAVSRAKGAPLVIEDIVVDPPKAYEIRMKVICTSLCHTDITFWRGKEDFPLPPVFPRILGHEAYGVVESVGEXVEGIRGWGKAVVPVVPGANATPAAGCAFAGTNIVLRRSPFVSRPPGLRRDGSTRFEDKKRETHHVVLAVSSFTFDTVVDVNQVVXVDPAVPPKLACLLGCGAGTGVGVRRRLTTVPCFPTIVLFGVLVHGVSVAQGGXMCGATKSFGVDLNPDKEELGKKFGVTDFVNPSKLGESPLSQVIIEMTGGGADYCFECIGAASVMTEAFRSAKQGNGKTVILGLEKDGKPISLPSIEFLFGKCVMGSLFGGIKPKTDIPILAEKCLNKELELEKLITHEVGLQEINTAFDLLLQGKSLRCIIWIDKLEA

SEQ ID NO: 140401 - protein, 336 aa, Triticum aestivum
  unsure (1)..(336): unsure at all Xaa locations
  Clone ID: PAT_TA_34819.pep
MFKFLKDVVAGSGSGLKDFPYTIGEPHASAWGSWTHHRGASKDDGSPVSIFSLSGSNPQDRHMVAGRNGVKRLRTVRHPNILSFLHSTEAEVPDGPAIKHTIYIVTEPVTPLSEKIKELNLGGTQRDEYFAWGLHQISKAVSFLNNDCKLVHGNVCLASVVVTQTLDWKLHAFDVLSEFDANNEIASSPMLQFEWLVGAQYKPLELTKSDWASIRKSPPWAIDSWGLGCLIHELFSGGKLSRTEDLRNIASIPKSLLPDYQKLLSSTPSRRMNPSKLIDNSEFFQNKLVETIQFMEXVLNLKDSVEKDSFFRKXPNIAEXLPXEIXXKKLLPVWDL

SEQ ID NO: 140402 - protein, 214 aa, Triticum aestivum
  Clone ID: PAT_TA_34820.pep
ITASRGYSADPWPHAVPHLGRKATRHGGARIRFLGGRAMNTAERSPGTSKKRSGRFGDGLVPTKATGFLGAPGHSVGGRSLLSSEVGVLGSSSSSSSSSSSATAAGVRDSATTSSSAATGAGRGSASGTVVVEADAWSGVGSATAALFLIGGSAGRTSPAGVEVIPWRGKLRVWVEMVGCGRGEEAGGWKLGLGKGRRRDQGRRGRANRIATRP

SEQ ID NO: 140403 - protein, 572 aa, Triticum aestivum
  unsure (1)..(572): unsure at all Xaa locations
  Clone ID: PAT_TA_34821.pep
PIVLYIRXVEKFLHKSXQMYLLFEKLLTKLEGPVLLLGSRIVDMDFDDDELDDRLSALFPYSIDIKPPENENCLVSWNSQLEEDMKIIQFQDNRNHITEVLAENDLECLDLGSICLSDTMGLSKYIEEIVVSAVSYHLMNHKDPEYRNGKLILSAKSLSHALEIFQENKMSDKDTMKLERHTDARKGIVPTAAKLETKPATLLPPAAPAAATPAPPPESKTEPKKPENPPPPAKLPEVPPDNEFEKRIRPEVIPANEIGVSFDDIGALEDIKESLQELVMLPLRRPDLFKGGLLKPCRGILLFGPPGTGKTMLAKAIANEAQASFINVSMSTITSKWFGEDEKNVRALFTLAAKVSPTIIFVDEVDSMLGQRNRAGEHEAMRKIKNEFMTHWDGLLSRPDQKILVLAATNRPFDLDEAIIRRFERRIMVGLPSVQNREMIMKRLLSKEKVDEGLDYKELATMTEGYTGSDLKNLCTTAAYRPVRELIQKERXTQLGKMKLEKGGSPLDPSKIKQKDKEIILRPLNMADLKEAKNRRAAGAAARGSPGGEVTRWNDLYGEGGSRKKEQLTYFL

SEQ ID NO: 140404 - protein, 135 aa, Triticum aestivum
  Clone ID: PAT_TA_34822.pep
SALFLIFRTKLYFVAKSDVQPPRFSPCVTEREGQGKRQRGHREAGEHMSVEGTLASPGIHPWWRGGASGGARGRRRRTTARAAVRCATALTLSHSTSPPSPISSLFLHPLLSSSPSHILSPTDRTEVAAVALWSA

SEQ ID NO: 140405 - protein, 71 aa, Triticum aestivum
  Clone ID: PAT_TA_34823.pep
DLVPHHRVHGCNNNKKIMVVRIIKHTMEIIHLTDANSILITVDAIIHRGLKFLEMALVLLQGYDDISKEIY

SEQ ID NO: 140406 - protein, 320 aa, Triticum aestivum
  Clone ID: PAT_TA_34824.pep
PHASATRPETVVKDTVKYTQYQRAIAKALVDKVSQDEVSTTRTVLMVVGAGRGPLVRASLQAAEETGRKLKVYAVEKNPNAVITLHSLIKLEGWESMVTIISSDMRCWDAPEKADILVSELLGSFGDNELSPECLDGAQRFLKPDGISIPSSYTSFIQPVTASKLHNDIKAHKDIAHFETAYVVKLHRVARLAPPQEVFSFAHPNFSPKATNQRYTKLQFELPQDTGSCLVHGFAGYFDAVLYKDVHLGIEPNTCTPNMFSWFPIFFPLRKPIYVPSESPIEVHFWRCCGATKVWYEWALVAPSPSPIHNSNGRSYWVGL

SEQ ID NO: 140407 - protein, 605 aa, Triticum aestivum
  Clone ID: PAT_TA_34825.pep
LHVTQISDWLPENRTRGQITERLLSPIFQPSEVDCGQSSQDLDSEFHVTLELTELGISIIDHMPEEVLYLSVQQLLLAYSSGMGSGINRFKVRMHWIQVDNQLPFVSMPVLFCPQKTDNQSDHVLKFSMTMQTNNSLDFCVYPYIGVQVPENCVFFVNIHEPIIWRLHEMVQHLKIDRISTSQPSAVSIDPILKIGLLNISEVRFRVSMAMSPTQRPRGVLGFWSSLMTALGNMEHMPVRIAHGYREELCMRQSALMNSAISNIQKDLLSQPLQLLSGVDILGNASSALSNMSKGIAALSMDKKFIQARMRQDSKGVEDFGDVIRDGGGALAKGIFRGVTGILTKPIEGAKSSGVEGFVQGVGKGLIGAAAQPVSGVLDLLSKTTEGANAVKLKISSAIMAEEQLLRRRLPRAIGGDSLIYPYDEYKAAGQAVLQLAESGTFLGQVDLFKVRGKFASTDAYEDHFILPKGKILLVTHRRVSLPEVPMMTQRKFNPAKDPCSVIWDVLWDDLVTLETTHGKKDAPGSLPSKLILYLKAKPANSREAVHLIKCNRGSDQATIIYSSIDKVYRTYGPNAIKELLRWKVPKPYAPRNTNRHTVQDLSFA

SEQ ID NO: 140408 - protein, 50 aa, Triticum aestivum
  Clone ID: PAT_TA_34826.pep
RTWHVRNEITRQKNPPPTKASCRFLHGYINSLLYNRQQPIADIVKGKTVV

SEQ ID NO: 140409 - protein, 119 aa, Triticum aestivum
  Clone ID: PAT_TA_34827.pep
TSNGGELKPCHSLHMLPQRLIPPVMIPAALIPAASTGAWPSSSETLCCITIFIVLHWIVMVPVPSSCTTTKTLLAMVIHFWPVVLIPVPFSSTTTETLLAMVIPFGPVVLVPVPLFFHH

SEQ ID NO: 140410 - protein, 212 aa, Triticum aestivum
  Clone ID: PAT_TA_34828.pep
MFLRRLSTSASALLRRRRRGAKDDGVLSALRAEIAHELSSPPSSSPPSLHSQEALDFDTVSDAPRAQDVLLRRRGDAEEVHVSALLAPLRFEGEEPLPRDALMKVFISKPGVEPLLRFDCRAVAAGRGAAAGYDITALSYHAFPGDGGDSKYEGPDFGDLDPKLQAALKEYLLARGVTPELATSLREHLLQKEQAQYVSWLKTLEGMFTKDH

SEQ ID NO: 140411 - protein, 140 aa, Triticum aestivum
  Clone ID: PAT_TA_34829.pep
PWDPQVSVAPSCFCSSPPPPPPPRRSTNPCSASPPRRAPSPRRPPAPPAPTSSAPSTSTLATPSPAAPAASASAAAMLSRPEPSSRGRSASPSLVAGDDGHVRVSKSPGTNAGVLPACHQPRRRPRLLPLPFLHPRQAPW

SEQ ID NO: 140412 - protein, 168 aa, Triticum aestivum
  unsure (1)..(168): unsure at all Xaa locations
  Clone ID: PAT_TA_34830.pep
MEQQPVAAAAAEPEVPAGLGLTAAEYAQLLPTVEAYHRYAVGPGQCSSLVAQRIEAPPAAVWAIVRRFDCPQVYKHFIRSCALRPDPEAGDELRPGRLREVSVISGLPASTSTEXRLDLLDDARRAFGFTITGGEHRLRNYRSVTTVSELSPAAPAEICTVVLESYVV

SEQ ID NO: 140413 - protein, 159 aa, Triticum aestivum
  unsure (1)..(159): unsure at all Xaa locations
  Clone ID: PAT_TA_34831.pep
RLFWLMLFEPLSIAFESLQSIMVHGFQLLDIWQRHLMDSGVDYLDFQKTYKQAAGSFSEWRGQLIRNFGLXIDLISLLMSLGHYSMIFWLRGMAFHLVDAVLLLNLRALVVSFLKRIKTYIKLRKALRSLDGALPDAKYDEICAYDDECAIWRGPMARA

SEQ ID NO: 140414 - protein, 226 aa, Triticum aestivum
  unsure (1)..(226): unsure at all Xaa locations
  Clone ID: PAT_TA_34832.pep
MSDQSQPVRTGDVYPPSAAAHDARRQRDEVLATHDDQQQKQDGRRGDLRVTETDEPHAGRRVVTATAGGQVMAQFTVPVPGAGVEEATDAVTIGEALQAAAQTSAGERPVDLAGRXAAVQAAETRATGAGGGVPRRVAAAAQQAAETNMRPRLADGEKVRLRDVLGSAAAVLPANKVATREDAVAVATAAERNAAAGAGGGGKGVADAVAVAAEMNDKRMTRTRQA

SEQ ID NO: 140415 - protein, 81 aa, Triticum aestivum
  Clone ID: PAT_TA_34833.pep
MSTTAHKVATQAASAAGARMKGRRPPSVVREIVYGMSLGLFAGYLWKLHHWSNQRRTREFYALLDEGRITVVVDEPAGAKD

SEQ ID NO: 140416 - protein, 51 aa, Triticum aestivum
  Clone ID: PAT_TA_34834.pep
SVCFLTGKSKIGLKVLWKEVYYKRSTTKLIAQLAREGTQFKNYQQLRPHRD

SEQ ID NO: 140417 - protein, 318 aa, Triticum aestivum
  unsure (1)..(318): unsure at all Xaa locations
  Clone ID: PAT_TA_34835.pep
RCDEDNFISVAYNYNDMARLDGNKYKVHRLSLSSVAGRGASYAPTIDVCLSQVRSFTLFWAPLPSLLLFKYLRVLRIEEYSHDWEATLDLTAIGQLFLLRYLHVTVSCFVQLPAKFEGLVYLETLDMPRANLKSISSDIAQLPQLSYLDIRMEKFMCECIGNMKSLRTLVIDGDELSMKEVNSVKVIMGLGELTNLRKLQIGVNGWEKPEHDAFASSLAKLRNLKCLKFTSXLYYEDNELASLSNPFPHLEEFISAPRWIFCRVPVWMGGLNCLRILELRVMEASTQDVNLLGELPSLVVLWLMALNIPKERVRLGTG

SEQ ID NO: 140418 - protein, 391 aa, Triticum aestivum
  unsure (1)..(391): unsure at all Xaa locations
  Clone ID: PAT_TA_34836.pep
MALLSPRVPRLPLAAHSAGAGAGSLRCCVRVAASAARCQVTASGSVAAGSSSSSELEAIRWGSAKLQGAREEMEDEVVLRPDSLLHGFSFAAVLDGHAGFSTVQFLRDELFKECAAALDGGAVLNTKNLEAITDSIRRAFATMDANLSTWLQQMDKEDDSGATATALFLRNDVLVVSHIGDSCLVISRGGRPQSLTNFHRPYGNNTTSLEEVKRIRAAGGRMPLGRVRALFSGSRALGDSRFKPRKNEMLVKGVNEGRWTEKFVSRIKFKGGLIISSPDVSLVELGPDVEFVLVATDGLWDYIKSTEAVAFVRDQLCQHGDSSRPVRRLGRXALDRRSQDNISIVIADLGRTNWQELPVPRPNVLLELSQAVATVGAVSVGIWISSLLTLQ

SEQ ID NO: 140419 - protein, 259 aa, Triticum aestivum
  unsure (1)..(259): unsure at all Xaa locations
  Clone ID: PAT_TA_34837.pep
TFPSPSSFLCRRRRHLAREGYTRGEKEGNVFVKKPKISEVDKAILALKTQRRKLAQFQQQLEKVIEAEKEAARQLVQQKKRDRALIALKKKKSQEELLKQVDTWQMNVEQQLADIELASKQKAVLESLKTGNAALKSIQSEINIDDVQKLMDDTAEAKAYQDEINAALGEQLSAEDEEAVMAEFDNLEAELALETLPEAPGTEGQSEKKTKAPANTEAPAEDNEEGKKPPEGPXKAPERSEAPEKTKVLEEPLPAKRRS

SEQ ID NO: 140420 - protein, 151 aa, Triticum aestivum
  Clone ID: PAT_TA_34838.pep
PRVREGKEQEAKKLSNLNAFDIISLSTGLDLSGMFEDNDKKRESKFTSTNSASTIVSKIEDIAKCMRLKLVKKDGGMMRMESFKPGRKGVMSIDAEIFEVTPDFHLVELKKTNGDTIEYQKVLNQEMRPALKDIVWAWQGEQQPPPPPQSC

SEQ ID NO: 140421 - protein, 255 aa, Triticum aestivum
  Clone ID: PAT_TA_34839.pep
MGEQKGNILMGKYEMGKMLGQGTFAKVYHARNIETSQSVAIKVTDKEKVLKGGLTDQIKREISVMKLVKHPNIVQMYEVMATKTKIYFVLEHVKGGELFNKVQRGRLKEDAARKYFQQLICAVDFCHSRGVYHRDLKPENLLLDENSNLKVSDFGLSTISECRRLDGLLHTSCGTPAYVAPEVINRKGYDGAKADIWSCGVILFVLLAGYLPFQDKNLMNMYKKIGKARIQMPQLDLLGEPSNGRYMNALIHTRT

SEQ ID NO: 140422 - protein, 172 aa, Triticum aestivum
  Clone ID: PAT_TA_34840.pep
KMNMRPMEKSTCMPDTSFAISCYILVQVDEFGSATIPPPPKDVRGRARSEPDCPSTVGASRTRSSAVACYAAGRRDGLAWLDIAGFCSSTYRSSAAFHGSIAMHTGSLYGPAAINLCMTSNGFGLDDCLSAIWDWIGRESWGKRKKTGFDLGENERIGSSLVVVTSRRRSGG

SEQ ID NO: 140423 - protein, 116 aa, Triticum aestivum
  Clone ID: PAT_TA_34841.pep
HTWYNGINLSCNHDNQGPDCVVRVRTGLATGIGELHMVVRKENGFATSTHHARVPRCGWQPSKYTNRRRLGGLSMAVHAELLMVGESRRATAGLGGLTGCPGRAAAPCLSSRANLG

SEQ ID NO: 140424 - protein, 145 aa, Triticum aestivum
  Clone ID: PAT_TA_34842.pep
TRGSTGREKVFFALLVGAELDGLTNLQPRGGCDDPSYPYYFKCKLCSRDGSVVMIPGQGTPLTAEQSQKGEMTCLMVFECRGYEPIEFAFGNGWKAESVHGTPFDIDLSEGEFDEYDEKGECPVALSKLQSTFRVGEEAGFSWGE

SEQ ID NO: 140425 - protein, 196 aa, Triticum aestivum
  Clone ID: PAT_TA_34843.pep
RGLKEEEAAATPSTGGEMVFFALLVGAELDGLTNLQPRGGCDDPSYPYYFKLRCESCGETSAKTTCTTFGSLDEGVHLLTCEGTANLLQKCKLCSREGSVVMIPGQGTPLTAEQSQKGEMTCLMVFECRGYEPIEFAFGNGWKAESVHGTPFDIDLSEGEFDEYDEKGECPVALSKLQSTFKVVKKQGFHGKTRYV

SEQ ID NO: 140426 - protein, 372 aa, Triticum aestivum
  Clone ID: PAT_TA_34844.pep
TRATRPSASPVPPPACSIRLSRPKGGSAPPRAEVVARVRTAYHCDGMADFQHVVPVHAAQVRKRKRLDCPSVKDDLGTDKAGGLDMDDGDVMMLVPPLFAIKDNPTNIALLPSTNALSKSMQRGVVRHRWEMDIEPTLALPFNIQAVPKKVNWEDHIPRNSSEWDSQMAVCKLFDERPVWPRQSLYERLLDDGVHVSTSQFKSLLFKAGYYFSTGPFGKFWIKKEYDPRKDPESRIYQRIDFRMPPELRNLQTKRHNGSEKWSEMCKLERMPSKSFIFLQLFELKDDFIQAEIRKPSHQSTCSHSTGWFSKPMIKSLRVQLCIRVLSLCPNEDAKTLLRRSHQLLERAKKQEAICRSEQLKERKDGDERSSC

SEQ ID NO: 140427 - protein, 118 aa, Triticum aestivum
  Clone ID: PAT_TA_34845.pep
IVTGAQLGVWDFGLKNVLYMKLLYSRVPGCTTRRSLWDHSPAAASSHPTVGPSNITYLDPGGSGAGSSDAGKFVKIVDRSELCKGPDDMPGHWLVTGGKLGVEKGRIVLRVKYSLLNY

SEQ ID NO: 140428 - protein, 137 aa, Triticum aestivum
  Clone ID: PAT_TA_34846.pep
PEAQGEPETEHTHMERSMSEAAAEAELPRLPARLRKSASDKSAFAHFVAEEDTEVVEARRPATTRDGDRRRRPLAAEPEEPVSEEEIEEAGGEVDARADDFINNFRHQLKLQRIDSFMRYRDTLRRGQATAVASAEQ

SEQ ID NO: 140429 - protein, 128 aa, Triticum aestivum
  Clone ID: PAT_TA_34847.pep
VNTPISIYKENPLPSQGLERARSKDRVWNTLGTQADRNKENNMMPARWTSHKIPPKVAARPAVLPARVNSIEVFVDEECAEEPAPSQVPKSPKPSVLKLRQATSKNLKKETELLKENPLRNFPLSSLR

SEQ ID NO: 140430 - protein, 73 aa, Triticum aestivum
  Clone ID: PAT_TA_34848.pep
FLTVGSPTVAVLLCSSHVVVTSCCNSRIMLSRGKEVVAFSIDQTEPHIVLFLIYIVISDTVWTIRNLMCVCVS

SEQ ID NO: 140431 - protein, 208 aa, Triticum aestivum
  Clone ID: PAT_TA_34849.pep
PTRPQAAAPPPPYGPIKRLSSSPEGPYLASSQPSPLISAIPIPISSPRDPDEEPSMMAYGKHAWRALPRRRRRGRKLPLPTTARIIKGRGAAIPVVGVLFCALATEEDCHNCCGSSSFVLCKDGGRPRCARAAHRELQQLGCRTPCRRPSEPVERRGQRLRGKSCDMLLHLQWLFAPVKTLLPCSILPVSGYGGVRLAQHGIDIYRAP

SEQ ID NO: 140432 - protein, 104 aa, Triticum aestivum
  Clone ID: PAT_TA_34850.pep
LTCTNNASKEKILGVRCPTCTPCGEDEEGFTFWTGNRSIASLQSCWLCSALRRMQRGLHQVEVVTLCTALWIAEDSSLLTPLSLSLFVCLIPPSNSFLYVHGSN

SEQ ID NO: 140433 - protein, 174 aa, Triticum aestivum
  Clone ID: PAT_TA_34851.pep
GLYRFAKPRGAVGRPHALLGYALVLASLGIGSVGEPQVAMHVEPEASFLVQIKNPEQRGGGRGGGGGGGFGGLQGKRKAAFPEHLQGRFGSNRYAPADPPDLLNYEGCELLLISASDDVEEELGLELQTETEEETGEGAGDGGEGGRAWAGCSDLVKMFGEVADVKPLLSGSWD

SEQ ID NO: 140434 - protein, 76 aa, Triticum aestivum
  Clone ID: PAT_TA_34852.pep
EHFRRFLSSFYHFGDPRIWFLTVFSLFFPFFLFSLYYVNFFPIYKIFKFSKVIWNCETLLMISKMFTSFKNCFLEF

SEQ ID NO: 140435 - protein, 106 aa, Triticum aestivum
  Clone ID: PAT_TA_34853.pep
FNESHHAFLASPAMPTWHGRTQWPSSAPSWTSSAPTSASSSTATTPLPSASSGTLECKLNVFMEWGVIVICAMGLEWKGLSFLFSRGCKFYLYKPDLQRQQQIQMW

SEQ ID NO: 140436 - protein, 209 aa, Triticum aestivum
  Clone ID: PAT_TA_34854.pep
EVQPRSQTHYPPDRVIRGTTRPTIRSRPGGGEPKPTKALQPARDPQTPIHQSRRRRGARCSIWTRNGSARSSPPPPSPRRSLPATPRPLRRPGSCSSRSGTSPTTRTPPPRRPPPARATPSGSRSAPPTRWASPTSASTAQASPTPTSPTGLPSSAPRRTSSSSRSSSSSAPTPRSGLKVLLSTCGLGPGLACPSTCSQAPSLRVLPNA

SEQ ID NO: 140437 - protein, 225 aa, Triticum aestivum
  Clone ID: PAT_TA_34855.pep
HMENTSLSTAACRSLSSAIHSCGQHFQILLPKILECLSMNFLLYQRHDCFLRTAANMIEEFGHKEEYSVVCVRTIETFSSAASLSNLNSSYTCDQEPDLIEAYANFTSAFIRCCPKEAIVASRSLLELSFQKAAICSTAMHQGAALVAISYMSCFFDASLTDVLESPECPSDESRGAVLAQILARCGESHNLQQCCIGGLCTSVREQCGRGYLLGSLWVLQRNSL

SEQ ID NO: 140438 - protein, 80 aa, Triticum aestivum
  unsure (1)..(80): unsure at all Xaa locations
  Clone ID: PAT_TA_34856.pep
RRRAHIITAVIGSXGVLSLAWAIAQLGWVIGPAXVLVAFSVLTWFCSSLLGRLLPLTGTPCIGKRIYTYRQRPPGANLGS

SEQ ID NO: 140439 - protein, 74 aa, Triticum aestivum
  Clone ID: PAT_TA_34857.pep
MAFVPGCVQCGTRSNPCRCKVVGPTLGFVAFVVTGVVEWPLGAAVYLFRHRKGRRIMGHPARVVYPRVTRAIPI

SEQ ID NO: 140440 - protein, 53 aa, Triticum aestivum
  Clone ID: PAT_TA_34858.pep
STIEFKPNTADDPHMRKPDITKAKQLLGWEPKVSLKEGLPLMVTDFRKRILDE

SEQ ID NO: 140441 - protein, 426 aa, Triticum aestivum
  unsure (1)..(426): unsure at all Xaa locations
  Clone ID: PAT_TA_34859.pep
RVPPHQPPPPPRRSPAPKQLHKSPTHAPSPAHAPASKISKPARPGPRTWVGYLLREQRLLFVLLGALIATSFFLLRPYLFSLSASNPTERSPIFSFVGHSSDPRGVPTGFRPPPRRVVVTGGAGFVGSHLVDRLLEQGDSVIVVDNFFTGRKENVAHHLRNPRFELLRHDVVEPILLEVDRIYHLACPASPVHYKYNPIKTIKTNVMGTLNMLGSGXRIAARALLTSTSEVYGDPLEHPXTKETYWGHVNPIGVRSCYDEGKRTAETLTMDYHRGGGVAVRIARICNTYGPRMCLDDGPVVSNFVAQALRKHPMTVYGDGKQTRSFQYVSDLVAGLMALMESEHIGPFNLGNPGEFTMLELAEVVKETIDPMATIEFKPNTADDPHMRKPDITXAKQLLRWEXPKLSLKEGLPLMVTAFRKRILDE

SEQ ID NO: 140442 - protein, 110 aa, Triticum aestivum
  Clone ID: PAT_TA_34860.pep
MQAAKVKAKDMVSSAKEKAKEGSAEVQGKAGKAAATTHGEKEMAKEDERARKGQADAQMHQEKAEHRADAAARRHGTAGTRGHHGPVGTPVAPDPVYPASGWHPAAEKYI

SEQ ID NO: 140443 - protein, 112 aa, Triticum aestivum
  Clone ID: PAT_TA_34861.pep
FFFFTEKGFPPALYYKAITTTIHPSKQQKKGKGKTAKIHNATERLTGFKCTKQRLEHRSPQQAPHPAPGKPQPRRLVTVGGRPHCHLPCTITAEPPSASASKEGPLPSRHGP

SEQ ID NO: 140444 - protein, 91 aa, Triticum aestivum
  Clone ID: PAT_TA_34862.pep
ASGISLFDTCYDLAGRQSVQVPAVALRFEGGGELLLPPGAFLLPAVGAAPRGPAAAAPSGAVSIIGNVQQQGVRVSFDTAKNTVGFTADKC

SEQ ID NO: 140445 - protein, 131 aa, Triticum aestivum
  Clone ID: PAT_TA_34863.pep
TNRAMSVGVLTGRPAEEMPGSMGDLLPELSQLLDQVWQVMQGIAQALWPSVSMPEGLGELAMNLKGARRRFRLWKISACRQGAREAWAMVKTRYTKADPNHMAEVGPVGPDGKEILVRLVYGQVELAAKYS

SEQ ID NO: 140446 - protein, 617 aa, Triticum aestivum
  unsure (1)..(617): unsure at all Xaa locations
  Clone ID: PAT_TA_34864.pep
MNPPAPDQTTQQQKPNGRRAVGSSQTWTRYGVLLPSQQTRKLKEWILTDEQQQVVNASGLGHLALTTGFTIDRSLLTAFCERWNNETNTAHFMGFEMAPSLRDVSYILGIPVTGHVVTAEPIGDEAVNRMCLHYLGESPGSGEQLCGLFRLTWXLYRKFHQLPENPTINDIAFSTRAYLLYLVGSTLFPDTMRGFVSPRYLPLLGDFRKIHEYAWGAAALAHLYRGLSVAVTPNATTQFLGSATLLMAWIYEYIPLTQPQQKNQNTLLPRACRWNFGGTTRGQRKKVMEWRKDFEQLQLSDVNWNPYKDINPAIVPGYCIAADNICHSRTWLISFNIKEVYVPDRFNRQFGREQGRLYQVPMWARRTWSKGKDWRVEYAREIEDFHQLVGCRFIPCTEANINSLPSESIAGQTTTRCSRNASQNFSMMVEDLKNDLPVIDRYLEGQVLPEEVASFLERVSTMIKTYSPPQSNERKDEAAQSKNVRAKNPRKRARKPSLSEDPSSPQDCGVDRYAGALVPYQAGKCDRVLDGTVPLLNRGEALKENEVMDPWQMSHLTAESSSSGDSSLPESRRRRCEESGAPRSNQGVRRSGRMCVQLKMLKHRDGVGAEETNPIFL

SEQ ID NO: 140447 - protein, 229 aa, Triticum aestivum
  unsure (1)..(229): unsure at all Xaa locations
  Clone ID: PAT_TA_34865.pep
SPAGPSFPRSTPARSPTPPRQSAAPVPLASQPAGGNGAPPRPPPPRCPAARARPVAPLAPPRAPLPPAPVLRARAPPFRPVPRGIRERGPHFDGCERSWYESSRPDLPGPGHTCIAGSKLRAECKSRSTWAPSSSFESHTDHTGTYNIPVGXTTHEHEPLRKSVLVSSPDTASXAKTVAGRERAPVFLNNNNGVASNVRLANALGFEKDTPLAACAQILKMYEEVDDRV

SEQ ID NO: 140448 - protein, 195 aa, Triticum aestivum
  unsure (1)..(195): unsure at all Xaa locations
  Clone ID: PAT_TA_34866.pep
PXLGVRLLSLRPSFYPHPMLLTLRPAVVASTLPSQRDLPRWELASAVSVVPRLPACINLVTTCSLHKAAMTGGLLLICALPEVRRPQLHHRRCPWRAHVRVLPGAPRRAWLLRRGSPHLCSTTATPAALAGSSSSPCSLRSGWPAWPQRARLVLAGEDGAPEQVPGDSGVGACEEPDGRRPGGAQRVRGSGGSIL

SEQ ID NO: 140449 - protein, 85 aa, Triticum aestivum
  Clone ID: PAT_TA_34867.pep
PAGARHAKVEDDRILVLILRRSHSHVDMIMKTLILKRGAVAAMRWKGQPMDGTAFVSRHTANTDGQVPAVKRSGMTLEPGPKTLL

SEQ ID NO: 140450 - protein, 89 aa, Triticum aestivum
  Clone ID: PAT_TA_34868.pep
DSNCTTCKKVTIMMTHRFCNFLASNAVVASCLVPPHAITQTLGAGGQTRPRPSIPGCGRRGGPKRRLVKDLQTAADSMEAAGTLAGAIL

SEQ ID NO: 140451 - protein, 239 aa, Triticum aestivum
  unsure (1)..(239): unsure at all Xaa locations
  Clone ID: PAT_TA_34869.pep
RTRGRQLVLDKEMSNPKAINKLNEDDTSSNITAVSKANGSARGPRSNSGSLLKSSPNRHRLQANPDDWEHPSATNKLNSASGSGNSKRTKSAHSLSPPTQWGGQRPQKISRSARKSNLVPIITSTDGTLVSGSLESPSISEQSAGLPRRASINASQQAKRGDHGHSTGPEGGEFGFAEKKLRDKSKRAGELDDGHCGXQKTAMLGHPXKKNKFSADEDIGDASRRQGRIGRGFTPTRPS

SEQ ID NO: 140452 - protein, 102 aa, Triticum aestivum
  Clone ID: PAT_TA_34870.pep
WGFRRDWAGDFSHGEGNKLNLRDIHSSLIAVRPSLLINRRKSSWNHFCSSLFVGVHSCVHSASTNPATVVVASRKRSSISQFWMTSGSARYVQSQRTTVGMA

SEQ ID NO: 140453 - protein, 82 aa, Triticum aestivum
  Clone ID: PAT_TA_34871.pep
PRAGISLAYLEPSISPERHLLQTLLVVFPEARVNMCIHIGQETTMTLLLSGKLWAPHNSYTTLVEANIRSIHCHRSLTKEEK

SEQ ID NO: 140454 - protein, 173 aa, Triticum aestivum
  Clone ID: PAT_TA_34872.pep
PRSTLPPSTAAAVASPPPTVQRSAIQSRSRPPTSLRPPPLSTRSTSRVMHGACREPGGWSSPAVGALLPYDRHIHPLAHLLALMAGSPPASSTNSRTAAAPHRSLLSPSGLPSPFSRPPFSLPLISHFSRRHPTHGVPRPIPGLGRSIRPPRRISCLGFCGVSAGGKRRGIPG

SEQ ID NO: 140455 - protein, 328 aa, Triticum aestivum
  Clone ID: PAT_TA_34873.pep
GTSADFLAAAAFSCALLLLLCLSLPRLPFPLPFHLPLRRPRRSPILWSIGSSPSASASAPTTGHFVQVYSNGDVYEGQFNRGRCTGSGVYYYYMSGRYEGDWIDGKYDGYGVETWARGSRYRGQYRQGLRHGHGVYRFYTGDVYSGEWSNGQSHGYGVHTCEDGSRYIGEFKRGVKHGLGHYHFRNGDTYAGEYFADRMHGFGVYSFANGHRYEGAWHEGRRQGLGMYTFRNGETQAGHWQNGVLDTLSTQNIVPGSAIAVNHSKVLNAVQEARRATEKAYDVPRVDDKVNRAVAAANKAANAARVAAVKAAQKRIPNNNDDLPLSIV

SEQ ID NO: 140456 - protein, 197 aa, Triticum aestivum
  Clone ID: PAT_TA_34874.pep
MDDKSNVKKEIDGSLAPRPRKGGLKFAPKKPPKKPAKVVPKAEPVEESKDEIIDKELLMKLKTSQITDPFGRRPKIEKKEINTQVAFGQGNSSYARSFPTRKYSAAPKAPKEYVDPWDYTHSDYPITLPLRRPYSGDPEILDEEEFGEKSASRAQDGELTAAEELGLMDWSDTPQLLFFQLPASLPLPSKRSLKNQI

SEQ ID NO: 140457 - protein, 67 aa, Triticum aestivum
  Clone ID: PAT_TA_34875.pep
SEMMVASSVQLNAGKVGLCDLTPHRSFTTIAALRPGCLQVQPLLRTIIWCITRGTRWWMSHMLAKGV

SEQ ID NO: 140458 - protein, 494 aa, Triticum aestivum
  unsure (1)..(494): unsure at all Xaa locations
  Clone ID: PAT_TA_34876.pep
VRDAAARRRLALLPTPVETVEPAPEFVKRVVKFARETGDLQTLSDVDMKIIALAYMLEAEVHGTSHLREHPPPLHVVSVRTLQEAPLPGWGSNVPNLEEWEALDKMSEAGGNLNSRILPLKDLENQEIPTSDTNSISETQGGEEFQPSKKDACIPWEDDENNEGWLPAVGRTTHRKYLRRKARRDALKASGESFDTSSVAPSVDEDNDLSENGLDSVDGPSAVPEKTRSNTDNLESLEGNEPKIAGDQLSNGENGVGDADTVEGIIDTDSCTEQLDNLDIKSEAGEGVSVSFVDDESEXSRDWALRSLXSNPLVACVTXSYAMQNVIPQIGLRLLAPGGMQIRQLHRWVLXCHACYGGTXKMGQKLWAKCGNGGLLANRVXTAGDKRFPIASPRRRISRQGASYSTPMPQGGGDAASKKASVREDEVWGVGRRGKPNGERKVEGEAAGAKEVGTRSGEREAEPERQLRRAQEEVSWWRPCYACHLCRSRVSLCI

SEQ ID NO: 140459 - protein, 241 aa, Triticum aestivum
  Clone ID: PAT_TA_34877.pep
HASVPLPHQDDSPCRGPGRPLPSPRMFDGDCNGSAEFLGAAGTGADAWATFPRFMPHQTVQKVHEHNDLRSAGTHGATCGQRRKTYKEKFQDGPTETLNFRLNIPAKSAPSSGFSSPVQSPRRLSNVDFSSAAISIQGSNILSAPSPWSSDQSGSSPPSTSPEKFVGGQERSPHSSPLRSPARRSRYPSAPPSPMHTNLFPENHTSRPEGNPSANLHPLPLPPVSMSPKQTNFGHPSVPKV

SEQ ID NO: 140460 - protein, 109 aa, Triticum aestivum
  Clone ID: PAT_TA_34878.pep
GHKCLAMFLNAFRACSCTFDSSCSWSPWNPDTSPSGCLISTPTEVNLSNFQTGDHVTVRLKSILNMLPLSFLFSLKASDSWALKSFSSSACLIFASGSLFFSLMVCVDT

SEQ ID NO: 140461 - protein, 187 aa, Triticum aestivum
  unsure (1)..(187): unsure at all Xaa locations
  Clone ID: PAT_TA_34879.pep
MAPNYEMAASILLCAEDSSSIFGFGDGEEAAAGARAEGSPYCGGDDEFAAGFPLPSEECVARWVATEAEHMPREDYAERLRAGGVDLRVRMDAVDWIWKVHTYYGFGPVTACLALNYMDRFLSLYQIPEGKAWMTQLLSVACLSLAAKMDETSVPQSIDLQVAGDARYVFEAKTIXKMELLVLSTLK

SEQ ID NO: 140462 - protein, 154 aa, Triticum aestivum
  Clone ID: PAT_TA_34880.pep
HLLQSVVVACTRGVQLNSQSSNSAIQNLIVSNHILRVVPAAHVRGTHSSVPPSIIPSWWVREVSEPSLLQAWMPSTEAGDSNIGNLLYCHLDSHSNTLKGMQLVGGVVLPIIDINLSVIHLLVELAVDLVHSVLRVPAISQQGQEVDPGISDAC

SEQ ID NO: 140463 - protein, 127 aa, Triticum aestivum
  Clone ID: PAT_TA_34881.pep
TFRWTDAEVGMALSKFPPVLTSDKESLQLMSEFLISEVGLEPVHIAQRPAMLTHSLEGRIRPRYYVIKFLKENGLLKRDPSYFTVFKESGKAFNKMFIHPHKEAAQDLEKDYDAACKGEVPTNFRFT

SEQ ID NO: 140464 - protein, 129 aa, Triticum aestivum
  unsure (1)..(129): unsure at all Xaa locations
  Clone ID: PAT_TA_34882.pep
FPGTYPRRHXYPNTVHYVTRFLEGLKSPVCLAVSIQQPTNVDTAYQLAILHEELGFGSGSSSSLSPSRRTIALPLPSPPILHLPTGCLMGAMLLNLSDNRTLSTSGEHCVRTVMYEICPRGNNKLVIII

SEQ ID NO: 140465 - protein, 166 aa, Triticum aestivum
  Clone ID: PAT_TA_34883.pep
MGSLPEQQQVVFRSTLPDIAIPDHLPLHDYVFERLAERRDRACLIDGATGETLTVGDVHRLSRRVAAGLYSLGVRHGSTVMLLLPNCVEFALAFLAASRLGAATTTANPLHTPPEIAKQAAASRATLVVTEPAFVAKVRGLAGVTVVATGDGARGLRLVRRPWRPL

SEQ ID NO: 140466 - protein, 110 aa, Triticum aestivum
  Clone ID: PAT_TA_34884.pep
LVVGEVTPRKSPRISRPAEVVEDEGLGLGGTPRCSPRVLATAESTPSLLGAGASGKGKKCGVKRKVPPAKKWSRVNPEEKDDADFNADDEDDVDDAAAANQVLMSHVYCF

SEQ ID NO: 140467 - protein, 224 aa, Triticum aestivum
  Clone ID: PAT_TA_34885.pep
MSAMDRLPMELHAEILRRLPPRGIATCRAVRKGWRAAVDSNGLMLAMEHRVPHHVGGIIINFSYEDRPYFFPCGAGPTGIGHEATALDFMIPPEVETGRGIVLDHRNGLLLYEGEYAVYVCNPATRRWAELPPLPSDLPGAYYLLFDPTESLHYSVFFFPEPNKHDQSMEWPPSSYTTKVYCSRSGQWDDMTFVREGDATTVAMWADRINQRKRHAVYWRGAFY

SEQ ID NO: 140468 - protein, 153 aa, Triticum aestivum
  Clone ID: PAT_TA_34886.pep
GLGGPLIDLAGNFVGINICFHGDTQRPLFLPRILLRQRLPTRLLMGKTSNSRQGSYEPPPGASRIIPSGFMDTWEWLESMGYPKPPPLMLELNGRLVRTFEEVFGWLHAWKVIKTHMLHGMERCCRADKKNSHTNGTHCTSRDLHYRTFPLFF

SEQ ID NO: 140469 - protein, 87 aa, Triticum aestivum
  unsure (1)..(87): unsure at all Xaa locations
  Clone ID: PAT_TA_34887.pep
QSISDIEKKGXSELVKDDDLSKIFQEYPFLFARAGDLTVADVDNLLNSYKQLVLKYVALSKGMGVTPETVRCQSGQAGEINWVKYKQ

SEQ ID NO: 140470 - protein, 131 aa, Triticum aestivum
  Clone ID: PAT_TA_34888.pep
IRQREDDRADLDKPSEKEVDTVVKPSEDSMAVEEPVTDKPSVEDEASAEPSNDRIDAEKPSEEKEDDTVKSSEDSTALEKPATDKPSEEEEEGAASEKPSHDDAVIEAPSHDDMDSATDKPSPATETNTSA

SEQ ID NO: 140471 - protein, 67 aa, Triticum aestivum
  Clone ID: PAT_TA_34889.pep
ATALSSVARTSMVKAQDILSLGSSARMNTPATQKGNWKWRIPSCVSFDSLSLEEAKLKELLMLYDRL

SEQ ID NO: 140472 - protein, 214 aa, Triticum aestivum
  Clone ID: PAT_TA_34890.pep
LVGQYFDLVDHEKVRSFRIQKQLPFSTFKEEVAKEYGIPVQFQRFWLWAKRQNHTYRPNRPLNPHEETQSVGQLREISNKAQNAELKLFLEVEFGLDLQPLPPPEKSKEDILLFFKLYNPEKEVLCFVGRLFVKALGKPSDILRKLTEMAGFTPDEEIELYEEIKFEPNVMCEHIDKKLTFRASQLEDGDIVCFQKSPKADSGTQVRYPDVPSF

SEQ ID NO: 140473 - protein, 228 aa, Triticum aestivum
  unsure (1)..(228): unsure at all Xaa locations
  Clone ID: PAT_TA_34891.pep
PNHPLVNKPSLSKYLRSHQGISPDEKEFLRILYNCNLTTGRMMHVMAEFYGSEMMVPFGPKAITNLCTSFRRDDTKEGDLIETIAHFKDIQKTDPDFFYKVKYDEEDXVVNIFWVDGLARKAYVEAYHDCISFDTTYMTNLYNMPFAPFIXINRHGXSFMLGCAFVRRELASSFDWVFGAFLEAMDGKPLDNFITDQDGAMRQSIQSIFPTTVYPCCRWHIMKKAQEK

SEQ ID NO: 140474 - protein, 112 aa, Triticum aestivum
  Clone ID: PAT_TA_34892.pep
DEESEDDGEEKKHKGTEGVIQIENPNLVKAKNIKAKEADLGKTTELSRREREEIEKQKSHERYMKLQEQGKTEQAKKDLERLALIRQQRADAAKKREEEKAAKEQRKTEARK

SEQ ID NO: 140475 - protein, 190 aa, Triticum aestivum
  Clone ID: PAT_TA_34893.pep
ATPASRPLSPPHASLPLPSSAAAAAATMGRGKFKGKPTGRRNFSTPEEIASGTSGRPRSFKKNVAEAEEEEEEVEESEEEESEDDGEEKKHKGTEGVIQIENPNLVKAKNIKAKEADLGKTTELSRREREEIEKQKSHERYMKLQEQGKTEQAKKDLERLALIRQQRADAAKKREEEKAAKEQRKTEARK

SEQ ID NO: 140476 - protein, 240 aa, Triticum aestivum
  Clone ID: PAT_TA_34894.pep
GTRLRSPVAEALAAAAAGVNTRLTAVAEAGAAAAAAASTHPVAMTVLGRGTCSAPEAAARARDPAPWLLDGPRAPLNFPYPPPARLVKEVIAAPRHRSHGHEAPLFQVVTLPPDPTSPPPPPPKLVVYFPFPFEVPASNPPPVPAYPFLHMPRPARARLSPQPAHAPGPKPQPPIQRMNVMVQAESCLSSSRKTLGASSSRCLVLKKPKLVVLPVTPSAPTEGTGDNFTKPWYFPDFPVV

SEQ ID NO: 140477 - protein, 189 aa, Triticum aestivum
  Clone ID: PAT_TA_34895.pep
LILLVVEHRLGNLPFTEKQVVTPTGSVYSGVDFCKKLCGVSIVRSGESMENALRACCKGIKIGKILIHRVGDDGQQLIYNKLPSDIAERHVLLMDPVLGTGNSANQAIQLLRSTGVPEDHIMFLNLISAPEGIHCVCKRFPGVKIVTSEIDAGLNEDYRVVPGLGEYGDRYVRHRLISYQCRFHLAAKR

SEQ ID NO: 140478 - protein, 112 aa, Triticum aestivum
  Clone ID: PAT_TA_34896.pep
LDVNVPGSDGLTIRRFFWAQDRVDSLFAYEGAAFQAIIYLQRLYGFVIVDYNYTPMTTYRDLARSAVILATSSVRSTIPVASGDGSVAVGDVDVVAQRRMLHAGLVSTACSF

SEQ ID NO: 140479 - protein, 397 aa, Triticum aestivum
  Clone ID: PAT_TA_34897.pep
MATTLATDVCLSVAHQTRFALRLASAISSDPESATGNVAFSPVSLHVALSLITAGAGGTTRDQLVAILGNENAGGPEGLHSLAEQVVQLVLADASITGDPRVAFANGVFVDASLSLKPSFQELAVCNYKSEVQSVDFQNKAPEIASQVNSWVENVTTGLIREILPEGSIDYTTRLVLGNALYFKGLWTEKFDESKTKYDKFHLLNGNTVQTPFMSSTNKQYISSSDGLKVLKLPYQKGGDNRQFSMYILLPERRDDLWTLAKRLSTESEFIEKHIPTEKVVVDQFMLPKFKISFGFEATNLLKSLGLQLPFSREANLSEMVNSQVDLFLSSVFHKSFVEVNEQGTEAAAATSVAIEQQQMPIVMDFVADHPFLFLIREDVTGVVLFIGHVANPLVSS

SEQ ID NO: 140480 - protein, 542 aa, Triticum aestivum
  unsure (1)..(542): unsure at all Xaa locations
  Clone ID: PAT_TA_34898.pep
MGSCRCRSATVRGQQGEMSEVKPEEISHPAMEQLQGFDYCIDSNPPRGEPLIRGFQHYILALGTAVMIPAVLVPMMGGNDGDRVRVGRSLLFVTGINTLLQSLFGTRLPTVIGGSYAFVIPVMAIVQDSSLAAISDDHERFLQSMRAIQGALIVSSSIQIILGYSQLWGIFSRFFSPLGMAPVVALLGFGLFERGFPVVXGRCVEVGLPMLILFVVLSQYLKNVQIREIPILERFSLFICIALVWAYAQILTPGGAYNHSTEVTQINCRTDRANLISSAPWIKIPYPLQWGAPTFSAGQSFGMVSAVLVSLIESTASYSAAARLASATPPPAHILSRGIGWQGIGILLCGLFGTGTGSTVSVENVGLLGSTRIGSRRVIQICAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLMVAVFLDNTLEVKDAGRDRGMPWWVPFRSFKGDSRNEEFYSLPFNLNRFFPPS

SEQ ID NO: 140481 - protein, 79 aa, Triticum aestivum
  Clone ID: PAT_TA_34899.pep
TRASNESKVLLLLNSYVTDVFPLLYLDTQTRSFHAPNPPMGNLHVRLHLTQQLKIKKNARVQCDKKHEFEKFLTLVLLA

SEQ ID NO: 140482 - protein, 140 aa, Triticum aestivum
  Clone ID: PAT_TA_34900.pep
MAAPVMLSSVTLKPAGFTVEKTAARGLPSLTRARPSFKIVASGVKKIKTDKPFGINGSMDLRDGVDASGRKGNGYGVYKYVDKYGANVDGYSPIYNENEWSASGDVYKGGVTGLAIWAVTLAGILAGGALLVYNTSALAQ

SEQ ID NO: 140483 - protein, 121 aa, Triticum aestivum
  unsure (1)..(121): unsure at all Xaa locations
  Clone ID: PAT_TA_34901.pep
LNGIMNEIAELDQRNIIEMHNYLTSVYEERDAXRSALITMLAALNHAKNGVDVVSGTXEVRTHFARPNFKRVLSKVASKHPYAKIGVFYCGAPVLAQELSNLCHEFNGKCTTKFEFHKEHF

SEQ ID NO: 140484 - protein, 146 aa, Triticum aestivum
  Clone ID: PAT_TA_34902.pep
LPGRRVLGVGGFGKVYQGEIDGGTTKVAIKRGNPLSEQGIHEFQTEIEMLSKLRHRHLVSLIGYCEDKNEMILVYDHMAHGTLREHLYKTQNAPLSWRQRLEICIGAARGLHYLHTGAKHTIIHRDVKTTNILLDEKWVAKVSDFG

SEQ ID NO: 140485 - protein, 357 aa, Triticum aestivum
  unsure (1)..(357): unsure at all Xaa locations
  Clone ID: PAT_TA_34903.pep
MGCCVFCKRRRKAWAASGTSDGEPGWQGQLLYPRSLNTSSGRSXATGRNCISLPSNLWRHFSFAEIKAATKKFDESRFLDVGWFGKVYHVEDHGGTTKLEVKRGNPLSEQGIHEFQTEIEILSKLRPLHCVSLIGXLEEKWVTKVSDLGLWNIGPSIEHLLGSTVVXGLEGCLPPDQFRRSRTTENSDVSSIGGVQSDAICARPALNPTLAKEEVSLAEWALHCQKKGILDQIVDPYLKGKIVPKCFKKFAETAEKWVADNGIERPSMGDVLWQPGFALQMQESAEESGSIGCGMSDEGTPLVMVGKKDPNDPSIDSSTTTTTTTSLSMGDQSVASIDSDGLTPSAVFSQIMNPKGR

SEQ ID NO: 140486 - protein, 295 aa, Triticum aestivum
  Clone ID: PAT_TA_34904.pep
RPQPDHFPSPPLPPSPGGGPLARSSAGRLRRRGGRASLLAAPPPALPLSPAVCARLLRDGRCVKLPPALPGCPVVGRRPCPPVGARAARAPAEVIGSREPDAPGGALLRGKRGELKRIYDVVEFVLHVQEPYFTQLSAGSKNVEGRLAAGNYNRITQGSLLLFNKCLLLEVEAVRKYSSFSEMLQTETISNVLPGISSIEEGVKVYRKFYTEEKENSYGVLAISVSKPQIQPYITMTELLAGLGYDGLGRLLGLANTSGTVPDGLPPPKSMLISSCMKLHKPTVCSALATTSQFY

SEQ ID NO: 140487 - protein, 188 aa, Triticum aestivum
  Clone ID: PAT_TA_34905.pep
IRTRLFEQLQKEQQSLELGELKQRVHELTEVKAQLEARNQKLLEESTYAKGLASAAGVELKALSEEVTKLMNQNEKLASELASQRSPTPRRVSNGPRGTARRESMSRRNEPASRRDGNAREERERALETILAEKEQKEAELQRKVEESKQKEAFLESELANMWVLVAKLKKSRGDDDHEDLEAKYNGS

SEQ ID NO: 140488 - protein, 157 aa, Triticum aestivum
  Clone ID: PAT_TA_34906.pep
VRDTKHAPNGGVVNDLNGSTKEVALNEELVENETKPMPNVFIPRDSSGNNQRMLLAPSTCHPSSPVTKGYCQSGALETQPDRIIEFGSLGPFSLTSPSPKSNKASPKACADASALALQSYRAKCNPKQVVRILQKMRPRAVGPNPCYFLLRIKLPYR

SEQ ID NO: 140489 - protein, 183 aa, Triticum aestivum
  Clone ID: PAT_TA_34907.pep
MKTFLVLALLVVVATIEPANSDILRSDQPQQSFPQQPQQKTVQSFFEQQLISCRDVLLMQCNILVPSFKSQILQENVCAVMRKECCEQFRQVPEQSRCLAINSVAHAIILHEQQQHQQQQQYSWGVGTFKLPQQQYPSGQGSIQPPFEAIRTFVLQTLPTACGAYVSQYCSTTTGSFGGFFGN

SEQ ID NO: 140490 - protein, 173 aa, Triticum aestivum
  unsure (1)..(173): unsure at all Xaa locations
  Clone ID: PAT_TA_34908.pep
RLLRRLLAFDPKDRPSAEEALADPYFNGLAKVEREPSCQPIPKIEFEFEGRRVTKEDIKELIFEEILEYHPQLLKEHIXGTDRRNFVHFKCCRPILRNASLNSKENGGENGSAVSSQRKHSSLPGNPSTPIRRVMTCDSENSQDMKIQEAYHLYSLGNQNMKHRTLRTKYLVG

SEQ ID NO: 140491 - protein, 72 aa, Triticum aestivum
  Clone ID: PAT_TA_34909.pep
PQRLPQFVRQVERDVETVINVLQPGPIGIVEHKFTDAEIREAQVTVRSAVEKWRRNSALERNLGTGSFHKSK

SEQ ID NO: 140492 - protein, 300 aa, Triticum aestivum
  Clone ID: PAT_TA_34910.pep
RAGCEQERRGKKPRGSGPSGGGDAGRTSKSRAIGKMFFKTKLCCKFRAGTCPYVTNCNFAHGMEELRKPPPNWQEIVAAHEEATEQREEHQIPIMTSSNVVPGDSVSGRAYKGRHCKKFYTEEGCPYGDACTFLHDEQSKARESVAISLSPSVGGGSYNSAAAAAASPNGPTILKPSNWKTRICNKWEMTGYCPFGSKCHFAHGAAELHKYGGGLVDIDGRDIASTPDSKQAAASSKLPVETAAASTAVPPHADVYHLGSQSQRSALASQRSGQLQRPIQKWKGPDKISRIYGDWIDETD

SEQ ID NO: 140493 - protein, 88 aa, Triticum aestivum
  Clone ID: PAT_TA_34911.pep
RGLFFFFFSTNHDFHCCSLLLTYLAELCSVCQYYLQISTICLIASTVHIHMLQPKKNISQLHCAELILLTSSSYCFLSPRYEAPIAST

SEQ ID NO: 140494 - protein, 604 aa, Triticum aestivum
  Clone ID: PAT_TA_34912.pep
MRSAAGTLVVCPASVLKQWANELNDKVSQSARLSVLVYHGGARTKDPSELAKYDVVVTTYTIVANEVPKQNADDDQDQKNGEESSVGNKRKPPSKSKKRKKKLKDSDIDLDSGPVARVRWFRVVLDEAQTIKNFRTQVAKGCCGLRAKRRWCLSGTPIQNSIDELYSYFRFLKYDPYSTYSSLCTMIKHPIARNAVHGYKKLQTVLRIVLLRRTKETTINGEPIINLPPKTIKLQKVDFTKEERAFYLTLEERSRQQFKEYAAAGTVKQNYANILLLLLRLRQACDHPLLVKGHQSVFKGDGSIEMAKQLSKERVIDLLARLEVSALCAVCRDTPEDAVVAMCGHIFCYQCIYERITTDENMCPVPNCRNTLSTESVFSSGTLKICISGKTSTHAIASSSADDELSSISQSSYISSKIQATVDILNSIINMHALTDSDTIESNPNRVSPVKAIVFSQWTGMLDLLEFSLNSNLIQYRRLDGTMSLNSRDKAVKDFNIDPEVRVMIMSLKAGNLGLNMVAACHVILLDLWWNPYAEDQAIDRAHRIGQTRPVTVSRLTITDTVEDRILSLQEEKRAMVNSAFGEDKSSAHATRLTVDDLRYLFRI

SEQ ID NO: 140495 - protein, 139 aa, Triticum aestivum
  Clone ID: PAT_TA_34913.pep
MILHRVAVMHLHCEVPRTEIWHSLNATIVGLASSCDTPATAHAIPWCVGLGIVRGIDVQRGLLYVITPVAVEHLQSVDLLLQGLIEIPRSVLQVKGCESPYMSTNVRDKITGKDLYASNLNSPLPTQDDGDSDSDADTM

SEQ ID NO: 140496 - protein, 213 aa, Triticum aestivum
  Clone ID: PAT_TA_34914.pep
KDLMEEPCQSMNYTIGSKVSRLPRCKPEPCVKEKREFLRRIGFVEGSEDMEKALKAIRGKGTKLQDRYNKLVEKGLDPKHVAHMVKVAPRILNQKTDALAYKISFLVHVAGYPLSALPAFPRYLEFTVHKSKLKMLMYSWLLERGLAAPQLTLSTVLASSETEFIKAHHVYKVPMGREVWSKLKREGGSFRQEKIRWLRHRCNLDDSRIECMS

SEQ ID NO: 140497 - protein, 165 aa, Triticum aestivum
  unsure (1)..(165): unsure at all Xaa locations
  Clone ID: PAT_TA_34915.pep
MPSTRPLLGTTNEGRTWTTFVEPILGVQXRTPAVEDASVVKSKSRTPTTGLASAGESNNVIPNGAVTVKQANRDESIPKEQAQSSRGLLANGVSEDAQNGFHDADRTVRRGEGPSNMSLHQTEQNQRRTNMELTSGTNSSRGNFSGSEAVVEAMGGNETIPSIGV

SEQ ID NO: 140498 - protein, 278 aa, Triticum aestivum
  unsure (1)..(278): unsure at all Xaa locations
  Clone ID: PAT_TA_34916.pep
EQGQQPGQWQQGYYPTSPQQLGQGQQPGQWQQSGQGQQGHYPTSLQQPGQGQQGHYLASQQQPAQGQQGHYPASQQQPGQGQQGHYPASQQQPGQGQQGHYPASQQEPGQGQQGQIPASQQQPGQGQQGHYPASLQQPGQQGHYPTSLQQLGQGQQIGQPGQKQQPGQGQQTGQGQQPEQEQQPGQGQQGYYPTSLQQPGQGQQQGQGQQGYYPTSFQQPGQGQQGHYPXLSLQQPGQGQPGQRQQPGQGHIPEQGQHQGQAAQXVYPTXSQQPGQGQ

SEQ ID NO: 140499 - protein, 233 aa, Triticum aestivum
  Clone ID: PAT_TA_34917.pep
SAFVAASAAGVPEEAQLRLYGLYKIASARPCTAPQPSALKLKARAKWNAWNKLGAMPTEEAMEEYITIVDEIFPNWSDGSKKKDGETTMSASGSKGPMGPVFSSLMYEEDQGNESELGDIHVSAREGAIDDVKKHLAAGVQINIRDSEERTPLHWAVDRGHLDAVEVLVNSNADVNAQDNEGQTALHYAVLCEREDIAELLVKHHADLQIKDGDGNTARDLCSSAWPFMKPAN

SEQ ID NO: 140500 - protein, 209 aa, Triticum aestivum
  Clone ID: PAT_TA_34918.pep
RRTRPWTRPLSRYSRGDFSGTPEQIHPSVVVSPGPLPSVGRCGGGRVGELCLACVYRVGSVGTLAGGVLEWAARPVFVLQVVLVPSGGGVLLSATAERLLVRARGPRWPMRAFIPLWISTRRIQLSTRKPLMLDQDGVTSGAEWRLPGVRGPATTPPPGDISRSKVRVEMQRRPATGTFFFASATLFCRKDLCVISSFLAFFSVILVSI

SEQ ID NO: 140501 - protein, 247 aa, Triticum aestivum
  Clone ID: PAT_TA_34919.pep
SKELRESDEPKKRRNPRVRYDEEEDAEALQAEDLNSRSCDDDEHVMKQRKCMENAAENQRRSVVEGKEALGSGNLNQYSKNHKQVKKQRSIEAEEDENASVRNPNAGCSRMPVISECIGGQPLDIPYWTGIMKINNNYIPLAAHLSTKAGKKVQELSRSLPPIMKVAKLSTSKSCPHFEASIPTADSIGLYFFSGDIRPNKELDELVKHLADSGSVLEAVVGLRKLFLFPSGVLPVEHQTFQGKPYL

SEQ ID NO: 140502 - protein, 241 aa, Triticum aestivum
  Clone ID: PAT_TA_34920.pep
EFGTRGGGVPSQRLVGAGLPGPMDPRRDGGGGGGGASGDGDGNNQILWDWQEKEHGEPSDGNHDVAKFVWDCLNRDDDDDELLGLLGNQTPLRDCRAFFDIGDITCKETLDLEESRESKRRRVLEYPSEVKQPEVGDHGMCSNFVTSEVAETSLLCTDEPQSLNWNMQLNSDDLDKFSSLSNEASYEPSDNQLDNYSEGATMYYTPDQMPSSQESVTYIGCQTDVPGTSEIAPVTESLHNA

SEQ ID NO: 140503 - protein, 211 aa, Triticum aestivum
  unsure (1)..(211): unsure at all Xaa locations
  Clone ID: PAT_TA_34921.pep
KRKPSGGIEXLRAIPWIFAWTQXTRFHLPVWLGFGAAFKHVLQKDIRNLQALKEMYNEWPFFRVTIDLVEMVFAKGDPGIAALYDKLLVSDDLWPFGERLRANYEETKQLLLQVAGHKDLLEGDPYLRQSLRLRDSYITTLNVCQAYTLKRIRDPSFHSQPGPHLSKEIMESGKLAAELLKLNPTSEYAPGLEDTLILTMKGIAAGMQNTG

SEQ ID NO: 140504 - protein, 324 aa, Triticum aestivum
  Clone ID: PAT_TA_34922.pep
MEASKGGDGSSGASPSNDDSTVEEEGASRQEQEDACRGNSLSSSSVRPYVRSKNPRLRWTPELHHCFVRAIHRLGGQDRATPKLVLQLMNVRGLSIGHVKSHLQMYRSKKIDDSGQVIGHLPLPHAFHHRQSGAGTMLSRFGAAAWPPWRSFHEPYWAHGRPFLGSKTYNSLEAEAEAAFLRSRAQHVARAASSNPGLMMQSGCPSRNDHHTMNHQPKRLLQLTVRNDDDTHVLLDLDLGLSLGLPVPMREAKRRRSGCGWVKEGPDEKGADEEQVDETSTATMLSLSLFSPRDAPRKMSSTSASDHAVDEHATRRASTLDLTI

SEQ ID NO: 140505 - protein, 107 aa, Triticum aestivum
  unsure (1)..(107): unsure at all Xaa locations
  Clone ID: PAT_TA_34923.pep
RKHFFQPNSRAFKRGTWTRRKIQSECGMHAMWHKTGNTLPVMVNGRQTGXKKVLVLHTNKNFDXQRTNWVMHQYHLGDLEQEKERELVLCKIFYQTNTRARSKKIIS

SEQ ID NO: 140506 - protein, 69 aa, Triticum aestivum
  Clone ID: PAT_TA_34924.pep
VVSVFVVPFEFVSSGTLVEFERLFFMILLSDGPHVCNPVLVYINSGVGVISPYVLLHCSPTCYLVACQH

SEQ ID NO: 140507 - protein, 241 aa, Triticum aestivum
  Clone ID: PAT_TA_34925.pep
MLEKGNSQLRTVSSQQFNQNVSRTPSVSQEASSSVFVPIDPSSVQNPHGRFPSASAHHGNLTFNQQPNNGWFQRKPESQSTVEVRARGHPSVAAQHAHPSVAPQHAHPSVSPQHAHPSVAPQHAHPSAVAQHAHPPAIAHPALEMHNRNGGPQRGPRIANVVHRFKCSVEPLEIGTVLSGRMWSSGQAIFPKGFRSRVKYWSIVDPNQMAYYFSEILNRLVAKDLYLLVTGRELAPSEVFN

SEQ ID NO: 140508 - protein, 137 aa, Triticum aestivum
  Clone ID: PAT_TA_34926.pep
MGAPTGPRPALPAPQQRAVDGFWRERQEEMEATADFNDRILPMARLKRLIRAEEDGMMIAADTPAYLAKLCELFVQELAVRAWACAQSHHRRIILESDIAEAIAFTQSYDFLATVLLEHQREARLAGRAAIPDNGFR

SEQ ID NO: 140509 - protein, 155 aa, Triticum aestivum
  Clone ID: PAT_TA_34927.pep
TDVLVSISIAGDYFEGPTGCPTIRELCGPDDTHTFHARNLGHPIIRSDSLGKGSFVPNNINMGGPRNATFIVLTGPNMGGKSTLLRQVCLTIILAQIGANVPAENLELSLVDRIFVRMGARDHIMAGKSTFLVELMETASVLSSATKYSLVALDE

SEQ ID NO: 140510 - protein, 106 aa, Triticum aestivum
  Clone ID: PAT_TA_34928.pep
MMLRGGRRVIRLASRHLGSHGFSTEIFVSRLSFYTTEEEFKKVFSPFGTIEEVRLVRDNQTGRPKGFGFVRYSSQEEAQKAIKAMDGRVLRGRLIFAEMAKEHGTG

SEQ ID NO: 140511 - protein, 100 aa, Triticum aestivum
  Clone ID: PAT_TA_34929.pep
MLGYCWECSKPTEHAIGAEKWDLGLEDGADSPDSLWSPPYTATITSVASRSTTAPETVPDVCKSRAPDEDEEGTQGRLGLLGSFSALLFFTASLESPARE

SEQ ID NO: 140512 - protein, 309 aa, Triticum aestivum
  Clone ID: PAT_TA_34930.pep
EILDLKSKLQSKEVETEKLKYQHLEVIEENRDLISQNHKLSEEAAYAKELASSAAVELKNLAEEVTKLSIQNARQAKELLIAQEMAHSRVPVRKGRPAGRGRDEVGTWSLDLEDMKMELLARKKREAALEAALAEKELLEEEYKKKFDEAKKKELSLENDLAGMWVLVAKLKRGAFSISDLNVDDRSINLADITNDAKENKGDTNVALVEKQVSDDTVKSLTAEEYRSPEFEPLLVRLKAKIQEMKEKETDPLSDKDGNSHVCKVCFESATAAVLLPCRHFCLCKPCALACSECPLCRTRILDRIITFT

SEQ ID NO: 140513 - protein, 138 aa, Triticum aestivum
  Clone ID: PAT_TA_34931.pep
MSAMVASSLNPEAPLFIPAALQQVEDFSPQWWDLVKSSAWFRDHWYHQHQQLDDMADSLIAFEAEDAIAVEASQPQPQPPAALKIDGVLKALSLSSPSPKGGDALRGFSEKPRYTEKPTKYAGSPRSGGAPRFIHQPR

SEQ ID NO: 140514 - protein, 175 aa, Triticum aestivum
  Clone ID: PAT_TA_34932.pep
PGGPALHPGSVPSRWRTSHRSGGTSSSPPPGFCDHWHHHAPSSATGWPTPSGASRPGTRSPSRLRSRQPPSGDSSIDSLMPGAAAYAFPSPKGDASADSLGTPEKPPKVRAAARSGAGATRRIHRASLVWDVKASRIVANPAPAVMHWSSAAAASLIFQIFFYHVAKLGLSLLYI

SEQ ID NO: 140515 - protein, 268 aa, Triticum aestivum
  Clone ID: PAT_TA_34933.pep
MAEMAADGGHGGGNHPLRWTSPMSWFMLRRFVQLTASGVKTEKGFKEVHLNQVAKNCSEHFGLSITGTQVYNHLRKWRARWVKISKLRDISGSLWDDNNYVILLEEEHYMGHIKDHPKDVEYLNVPLENYVQMLAIFGSGIARGRYAMTSNEALGVPSMVGISSSFVNLEACGSEFVVDGNEPGLSATAAAHGETAAAPHGKEPCKDASSSTGKRKRASLMSEEEVLVMSNMSEAVREVAIAIKSTGEAHPELYGAVMELPGLPRMIC

SEQ ID NO: 140516 - protein, 456 aa, Triticum aestivum
  unsure (1)..(456): unsure at all Xaa locations
  Clone ID: PAT_TA_34934.pep
RPCRATRYHLTEFGERVPQNEKEIFNLRHSSSRITFERAFAAFKNRWRIVDNKPHHPYPSQVKIILACCILHNWILXWGEDEFVPLEHTWTGNPASDGVMAEMAADGGHSGGNHPLRWTSPMSGFMLRRFVELMASGVKTEKGFKEGRPIPQAGTPKERFALAKAGIPPGEHWHIWRATSTKLTIVYSAXTAPLSGTDETXGLPDVRCLPRMHEYPNGDQDLNMPLENYVQMLAIFGSGIATGRYAMTSNEALGVPSMVGTSSSFVNLEACGSEFVVDGNEPGLSATAAAHGETAAAPHGKEPCKDASSSTGKRKRASLMSEEEVLVMSNMSEAVREVAIAIKSTGEAHPELYDAVMELPGFTEDDLLIVLDYLSENANRARSHSFVQMSETRRTRWVMHHLSKVNGGVPVPKARTAQGWNARHRRGSAQGWSVSKYVPIQRSWPYFIVPAFFVPA

SEQ ID NO: 140517 - protein, 133 aa, Triticum aestivum
  Clone ID: PAT_TA_34935.pep
TLLILDEGRPTKRGNPWVLNLEWDIGKLGAVAFFCRCRVGFGVFSFWRARLLRPRRRVFDPCGGSSSVLPVAASHELARLALLPSRSGAAVVLPLFSFWSVTICPRNIVTMYSILLKTQYMIRWIFICYAEQP

SEQ ID NO: 140518 - protein, 357 aa, Triticum aestivum
  Clone ID: PAT_TA_34936.pep
SGGHPLVSSPSRHLSRRRRLPAWVRAVVEAIHSSRPQAVIYLAGGASQALGWLLSVPGASGSVLEVVVPYSRASMAQLLGKLPLQFTSKQAAEDMALAAFNRALKLSGPGLQVMGVGFTGSLASSRPKHGDHRFYVSTRTQNCLRTSHVTLSKGLRSREEEDKVSSCFVLKAIADACRVSATIQSDVQEPEIPKESVEQFDEDQELQQVIDGQVCMKVYHFADPTEKNFDRKLILPGSFNPLHDGHLRLLEVASSMCDDGFPCFEISAINADKPPLSIAEIKHRVEQFRKAGMHMTNCCSAKYYSHTWIFFRTIYHAACYFAIFLVLLFDYYESNECALVLSLQRYIIHSLICSHLC

SEQ ID NO: 140519 - protein, 150 aa, Triticum aestivum
  Clone ID: PAT_TA_34937.pep
LQELLMGTCRRMPPLTRSRCAGSWPEEPQVRFAKPQRRAVCTTAGLVAARHWSMSLSCPSLTSSAALAPFPIALGTGRIPRGRAGRSPPSPARRPRRRPDREPLAGDGEGRGGESAKETLAPTRNGGRAAGATRPLGGCCIAPDAWADAK

SEQ ID NO: 140520 - protein, 480 aa, Triticum aestivum
  Clone ID: PAT_TA_34938.pep
MPSHAGLSLLARRKAPSASSDQATGRLVNESSVRSPSGRAPVDLVTVIDISGSMAGTKLALLKRARGFVIQHLGPSDRLSVIAFSSSARRLFHLQRMSHYGRQQALQAINSLGAGGGTNIADALKKATKVIEDRSHKNSVCSIILLSDGQDTYNLSSNVRGGPKDYSTLVPQSILDDTRRMLPIHAFGFGADHDSDSLHSVAEASGGTFSFIEDEGVFRAAFAQCIGGLLSVVVQEMRLNMECVHPGVQLCSIKSGSYPSMMARDGRSCSVDIGHLYADEERDILLSANIPQCREQTSLLKVACSYRDLTNETIKLQVDEVKINRPTSAISEHVSIEVDRERNRIQAADSIESARAAAERGALAEAVTILEDCRRRLSESFASRSGDRLSLALDAELREMQERMASRQLYEASGRAYMLSGLSSHSWQRATTRGDSTESSTIVHSYQTPSMVQMLQHSQSHIPSPPGQQPQARPPRPSAR

SEQ ID NO: 140521 - protein, 123 aa, Triticum aestivum
  Clone ID: PAT_TA_34939.pep
GRGPRRPGRVVPGVLAPLADRAAMHREIAALRAERAQLVMAREMARRLCWEVVSERKSIKAVVPAKRFSALGICKWLLSVIFWRRSSTTRYTFGLSTTFLGLLLLLDRSTTLSPWRRLHRPQQ

SEQ ID NO: 140522 - protein, 427 aa, Triticum aestivum
  unsure (1)..(427): unsure at all Xaa locations
  Clone ID: PAT_TA_34940.pep
TTGVPPFRWRPPSALPSSSASGTSPACCCHPPSAPPPAFRPRPVPCWLSPRLSSQPYVPAAAASAAAWLFCSGMPLLVGGPRGGLAFPPRAAAHLAPACGYPVAVMPSAKGLVPEHHSRFIGTSWGAXPFESTAVARAHGYXYIDGLSSGTCACILLQSLRARKEKAIIVQPDRVVIGNGPAFGCVLMKDFLHALATRLKKNTAAYDNYSRIFVPQGEPLSSEPGEPLRVNILFKHIQKMLSGSSAVIAETGDSWFNCQKLKLPEGXCGYEFQMQYGSIGWSVGATLGYAQAAKDKRVISFIGDGSFQVTAQEVSTMLRWEQNNIIFLINNGGYTIEVEIHDGPYNIIKNWNYTGVVEAFHNGEGKCYTAKVRTEEELKKAIEASLGPNKDSLCFIEVIVHKDDTSKELLEWGSRVSAANSRPPNPQ

SEQ ID NO: 140523 - protein, 229 aa, Triticum aestivum
  Clone ID: PAT_TA_34941.pep
RVVLATAVDRVRRVRACEHIPVGEADRPTVDAVIAECGELPEGADDGVVNFFKDGDMYPDWPNDLDEKPTEVSWWMEAVESAKAFGNDNFKKQDYKTALRKYRKALRYLDVCWEKEEIDEEKSSALRKTKSIILTNSSACKMKLGDLKGALLDADFALRETEGNAKAFFRQGQAHIALNDIDAAVESFQHALDLEPNDGAIKRELAAAKKKISNRRDKERKAYARMFQP

SEQ ID NO: 140524 - protein, 432 aa, Triticum aestivum
  unsure (1)..(432): unsure at all Xaa locations
  Clone ID: PAT_TA_34942.pep
LCQRAPGLYTPRVANMLNFKDNIINNEGMLRTVLDVGCGVASFGGYLLSSNVIAMSLAPNDVHQNQIQFALERGIPAYLGVLGTKRLPYPSRSFELAHCSRCRIDWLQRDGILMLELDRLLRPGGYFAYSSPEAYAQDEEDRRIWKEMSSLAEXMCWKIAEKKNQTXVWVKPLNNDCYRSRLXGTNPPCCXTDNDIDSVWGXVTMEACITPYPEQVLRVGAXGLAPWPARLTTPPPRLADLYVTADTFEKDTEMWQQRVDNYWNLLRPKVKPESIRNIMDMKANFGSFAAALKEKDVWVMNAVSHDGPNTLKIIYDRGLIGSTHDWCEAFSTYPRTYDLLHAWTVFTDLEKRGCSAEDLLLEMDRILRPTGFIIVRDKAPIIVFIKKYLNALHWEAVTVVDGESSPESEENEMILIIRKKLWLPEAGSQDST

SEQ ID NO: 140525 - protein, 60 aa, Triticum aestivum
  Clone ID: PAT_TA_34943.pep
KNLSTLNFLMWITLEICSCMELNSSSSDIVVKIYSTSIVPKKQSRVYHIILLLFSIQQCV

SEQ ID NO: 140526 - protein, 120 aa, Triticum aestivum
  Clone ID: PAT_TA_34944.pep
TSTNGRLSDGTLAENGEVFDTTHEDNSIFSFEVGQGAVIKAWDIALRTMKVGEIAKITCRPEYAYGSPGSPPEIPANATLIFEVELLACKPRKGSSLGSVSDEKARLEELKKQRELSAAT

SEQ ID NO: 140527 - protein, 94 aa, Triticum aestivum
  Clone ID: PAT_TA_34945.pep
KGEVFDTTHEDNSIFSFEVGQGAVIKAWDIALRTMKVGEIAKITCRPEYAYGSPGSPPEIPANATLIFEVELVACKPRKGSSLGSVSDEKARLE

SEQ ID NO: 140528 - protein, 186 aa, Triticum aestivum
  Clone ID: PAT_TA_34946.pep
MAETIDLTGDGGVLKTVVRKAKDDAISPSDSLPLVDVHYEGTLAENGEVFDTTHEDNSIFSFEVGQGAVIKAWDIALRTMKVGEIAKITCRPEYAYGSPGSPPEIPANATLIFEVELLACKPRKGSSLGSVSDEKARLEELKKQRELSAATKEEEKKKREEAKAAAAARVQAKLDAKKGKGKGKGK

SEQ ID NO: 140529 - protein, 267 aa, Triticum aestivum
  unsure (1)..(267): unsure at all Xaa locations
  Clone ID: PAT_TA_34947.pep
LRCLQRRHRLLWTSCEAMAAAVPAIVASLDYRLAPEHRLPAAYDDAVAAVMWLRDVAPQDPWIAAHGDIARCFVMGSSSGGNMAFNAGVRTKGIDLSPAAVRGLLLHQPYLGGVERTPSEERSEDDFMVPLEANDKLWSLALPLGADRDHEFSNPEKAVAQEAVVGLPRCLVSGSDGDPLIDRQRGFATWLRDSGVEVVAKTDXPGFHAAELFVPREGRGDVRAGSPISYPRPALPRCVSPIGGRLRLARAVWVGFSPVVRLRLVIK

SEQ ID NO: 140530 - protein, 142 aa, Triticum aestivum
  unsure (1)..(142): unsure at all Xaa locations
  Clone ID: PAT_TA_34948.pep
DNKLLTPRISANISFHPSQSRYIQVASIVGSPNXQAIIESFSPTTEAPEGITGIRLNVSEKMMDKLPIVSEVLITRGESSIKLSELVEGGRACWSGLQLSAEGPMLSWRRGQAQVLQLVDAGCCCQHQRRRRRQTKAGNEKG

SEQ ID NO: 140531 - protein, 118 aa, Triticum aestivum
  Clone ID: PAT_TA_34949.pep
HRLKDQLQQRGSDLLHYIKKSFRCSSLSKNINMLLNKIIHINIDSDQIDRIHTRLRSVSSSKSSSMSASISRFSHNSMDLCLIDSLSASPSTASTDSIATLMTVKASMHPSATPTVDP

SEQ ID NO: 140532 - protein, 77 aa, Triticum aestivum
  Clone ID: PAT_TA_34950.pep
ETEEQSDLENMKMTLESVDVVLHDAERESIKHKSMLLWLKQLKDAANDISHMLEDFEDETDLNLVCKILIWSLSILI

SEQ ID NO: 140533 - protein, 75 aa, Triticum aestivum
  Clone ID: PAT_TA_34951.pep
RGSSLLPKSNAFFGLLSASFFLLGDDPYSPKSLSPISMYPHAYMSSSDMSCQNNAASLMDYFGPLHKKNFRLQYQ

SEQ ID NO: 140534 - protein, 448 aa, Triticum aestivum
  unsure (1)..(448): unsure at all Xaa locations
  Clone ID: PAT_TA_34952.pep
CLCVAASPLPSPPPTSRRYSGRRRGGSGGGIASSTTNALAATSRNFKQAAKLLGLDSKLEKSLVIQVGGRMVEGTSPIADRRGGSYVGFRVQHTTAWGXNNAVIRYPAEVGPGQXEAGHNGLHVILAVDDIADGGAKGANGCSQGDGNVGLLERCTRVCTQLNWDSNGQPTDVPAPDMGSKGHTMEWRLDEYSKFHRYAPDVVTGEPVDIGGKLGRDXVLVMGTTDGHXTLLAEPGKGIVCQCFVILRXFSNVASWAAQLITEAGGKVIAISGVTRCRXNSNGIDIAKLMKHSAEKRGIKGFDGGDAVDPTSLLTEECDVLXPAALGGVINKGQCCWTQSKVQKQSVEPLLGHAERESIGHKSVVLWLQRLLDDAGLVTVSYFEWVQNIQGLMWDDEKVNRELTTHMSRAFRDTKEMCRSHHCDLRMGAFTVGANRVARATVLRGWEA

SEQ ID NO: 140535 - protein, 296 aa, Triticum aestivum
  Clone ID: PAT_TA_34953.pep
CPDSPRRRLAHQQVKASILEHDPKTKRKVYTRYSFNDFSVFDINAESPIPPMRYTKRCVNGLELQDTANILTVKIVSSDKGFPIDVYGTIIARDSIDHKCMYLFNRTRDNCQPIKSRDENLILTGPGRGLVLLDFIYLEIDLKIKVGEEPLGEQISKGLLMIDGRVLPRDEKVAVAHQTLESWFSIVDVRYATLLNAVEGTFEIKLLEGRFCGKIMAGIEGIQPRIVIYNSKEDGVVSCEGRTDITLRRRVMTLRLNGMLTVGFAVCGGGGAATRKQKVEFTPQHRGEEKKEICFK

SEQ ID NO: 140536 - protein, 148 aa, Triticum aestivum
  Clone ID: PAT_TA_34954.pep
VDSATGRPLEPRKNATKFVNQCGAIVRDNVSIAVQEWNEPKKARIAGFTFVDKRTKKDCFKKLMEHFVLPPEYNKFDEEGNKIEENKERRRLVKQFALHKMADAFRKFKQNLAHDFVKQNKTPDFKGQYEKLKHDWPQFVKQKKSEQF

SEQ ID NO: 140537 - protein, 161 aa, Triticum aestivum
  Clone ID: PAT_TA_34955.pep
TSPITTRPEENESHQRHGKMQIFVKTLTGKTITLEVESSDTIDNVKAKIQDKEGIPPDQQRLIFAGKQLEDGRTLADYNIQKESTLHLVLRLRGGSRGGYPKNLEPNLRILAQKYNENKLVCRRCYARLPARATNCRKKKCGHNNQLREKKRFMSKFANAS

SEQ ID NO: 140538 - protein, 169 aa, Triticum aestivum
  Clone ID: PAT_TA_34956.pep
VRRCRPGRDHTKHTRREESESHRRDGKMQIFVKTLTGKTITLEVESSDTIDNVKAKIQDKEGIPPDQQRLIFAGKQLEDGRTLADYNIQKESTLHLVLRLRGGSRGQYPKNLEPNLRILAQKYNENKLVCRRCYARLPLRATNCRKKKCGHNNQIREKKRFMSKFGSDS

SEQ ID NO: 140539 - protein, 280 aa, Triticum aestivum
  unsure (1)..(280): unsure at all Xaa locations
  Clone ID: PAT_TA_34957.pep
TDVVVICLPPSLEWKPVMGMLAFDLISAVMTALVKKALEQGLNRLVLVTLRXVANIFLAPIAFFKERSTRPKLTLEVLAYLFFSAVFGATLSQYTFFYGLQYTTSTFAITFINLSPVLTFLIAVVMRMEPLKLKSMVGAAKITGTLTSLAGLLLLSLYKGVPLTHQAATAPSPAAHHAAPSDSSGNRSWMLGTMALLFNCLRFSFWLLLQTKLTKKYPAIYSSTAIMFFSKWHRHSTEQMSTRMRVYVSNMAGFVPRAGVHQCNGAEAVQISYFHCYKFE

SEQ ID NO: 140540 - protein, 70 aa, Triticum aestivum
  unsure (1)..(70): unsure at all Xaa locations
  Clone ID: PAT_TA_34958.pep
NSSSTDNIFXYIITLSLLVCQGICILITLSFLVCKGMCIFLLRSNALKPDQNYRKNVNINNTESISSNTS

SEQ ID NO: 140541 - protein, 134 aa, Triticum aestivum
  unsure (1)..(134): unsure at all Xaa locations
  Clone ID: PAT_TA_34959.pep
SRETVPRDVLPQIHKTSLPTPNQYXDHXRAPTGAELLRAYCASRGXVGHGGLPDETRAARPILKDYMDGQMPXHYELPTDVGTDDEADARSSTGIAAAEGPTASASDGSCSEDAAEQDARTGGPDMRLLLSDLG

SEQ ID NO: 140542 - protein, 322 aa, Triticum aestivum
  unsure (1)..(322): unsure at all Xaa locations
  Clone ID: PAT_TA_34960.pep
PKAAHLVPPAPPSSARMSLPSCYAALPAAVAMRLLSFGLGVAILLSVYKTRCRTIRWGGXEVGPHPLPGVPNLVMVAGHSIYTSASCGKTDREDSWFLEPYQKHPGQAATFLAHIKEGXVEIAGRDQGALLLFSGGETRKDAGPRSEAQSYWAIAESEGWFGNDDSVRNRALTEEHARDSFENLLFSVCRFRELTGTYPQNITVVSYDFKEERFAQLHRSALXGFPEERFFFSGTPXATATAKEAALKGEASVRSQXSDPFHPAVPDPFGCRGSREPCSSGPLLPHLGALPWDSVPEKGMMFGSNIYSRCKIPAFLFRPLSV

SEQ ID NO: 140543 - protein, 555 aa, Triticum aestivum
  Clone ID: PAT_TA_34961.pep
AVAVPGHPQCCSCYYSASTTKTTTTTIEPGLLPTASATISITPGLDGRSIKVFHEKAEPIFKLAGFHMEVVKTTHAGHAKSLASTFDFGAFPDGIVCVGGDGIVNEVFNGLLTRSDRTEAVSIPVGIIPAGSDNSLIWTVLGVKDPISASLLIVKGGFTTLDILAVEWLQSGLIHFGTTVSYYGFVSDVLELSEKYQKRFGPLRYFVAGVLKFLCLPSYFYELEYLPLSKDMSGHGKGTGQDKVELSDVYTDVMRSRSKREGFPRASSFSSIDSIMTPSRMSLGDFDTSGGTAASSEPSEYVRGFDPKAKRQSMGRSNIVSEPEEVLRPQQHHASYWPRTRSKTRTDRNSVGVTASNDTRLSWAAPSMHDKEDISSTISDPGPIWDNEPKWDTGPRWDTEPTWEPDHPIELPEPPEDIETGTSRELVPNLDEKWVVRKGHFLGVLVCNHSCKTVQSSQIVAPNASHDANSLDLLLVGGRGKWKLLRFFILMQFGRRLSFPYVEYVKVKSVKVKPGANTHNGCGIDGELCRVKGQVVCSMLPEQCRLIGRQCKQSI

SEQ ID NO: 140544 - protein, 170 aa, Triticum aestivum
  Clone ID: PAT_TA_34962.pep
EDDRRGSTSAYLQVPTSSTSRQVQTSRAHEKTARQALPRGRYGYYHHHFGIFAKCYQGIFAFGCTASSPTSHEFAYIDIFNNKATTYERGRPFILRKPLKEDGQAWEIPFGHADELRGATSYGPPTTRQRQEGRARAIPFDHGDEHEPLQQHEDDAHIGLILRVKLRDRT

SEQ ID NO: 140545 - protein, 268 aa, Triticum aestivum
  Clone ID: PAT_TA_34963.pep
MQATAASFLARPLPWPRRIGRSAYGAVAVHGGVSPLPPRLRGVRCSMSLSIGAGSSDIGDSGFSYQYAPVFRRYRERDPYKLLGVDRDASEEEIRSAKDFLVQQYAGHEASEEAIEGAYEKIIMKSYQHRKKTKINLKTKLLKRVEESPSWVKAFLGYFEVPSMDIISKRLFFFAFIAGWSIATSAENGPAFQLAISLFSCIYFLNDKMKNLLRASTTGFGVLVGGWIVGSMLVPLIPTFIIPPTWSLELLTSLVAYVFLFLGSTYLK

SEQ ID NO: 140546 - protein, 64 aa, Triticum aestivum
  Clone ID: PAT_TA_34964.pep
SLALKKLFEDGVVKHEDLFITFKLWFCAPKDVPEAIVATLKELLQHLLCDLVRPPPPVLSPQSW

SEQ ID NO: 140547 - protein, 185 aa, Triticum aestivum
  Clone ID: PAT_TA_34965.pep
GDLGEENERLRRENSRLTRELGQMKKLCNNIFVLMSKYTDGQQTDAANATSAAADVGNCSGESAETTALPPPPVLELLPSCQNAPTAADLGAEDEEEKMSARLFGVCIGRKRMRHDGEDRTRRGAAAEVKPEPMDAQQPSGMDGHTPDVQAWPIYRPRPVYQPLRASDGSNCYSGSDDHIGSNSR

SEQ ID NO: 140548 - protein, 82 aa, Triticum aestivum
  Clone ID: PAT_TA_34966.pep
SMVVNFLTLETDQKAFLLLLVLRMHQTMHKMKRINETTFALKKKKDMLPINSIILKNRHSFCEVKRIVLFLPCMITTSMDWC

SEQ ID NO: 140549 - protein, 308 aa, Triticum aestivum
  unsure (1)..(308): unsure at all Xaa locations
  Clone ID: PAT_TA_34967.pep
RIVPPPPAHAGAPARFRLAPCPIEVTKMLRGIANVRCAWLPWSKDALEEMMMRGVLDVTKPTLGPMYGIGTHRSIREVKDKQPRLCGSVTTNRRRQAAGFRVIMGNVEGVLTCXASDEEPPNEEFDSGGNDLQXPSHNTIWDAHVHRHLXAEYAVVIKAPSMTNEYLAREDTASNISEIRNSGSAESVIKDDSSETMASPADXNKHPGFGRAPTRRPPTSPWMPLPMLFAAISTKVPRSDMDVIHGHYEEFKRRKISRPEFVRRLRQIFGDKLLVSTVMRLQPKVVAPMAGAEVLPRGAPGTGGSSTS

SEQ ID NO: 140550 - protein, 193 aa, Triticum aestivum
  unsure (1)..(193): unsure at all Xaa locations
  Clone ID: PAT_TA_34968.pep
XLVLDFRTDRHDYQADFPSVVNVSILEPDPIRRTVVLVEQSLLSGLPHRHAENRFRIASEACFEGEGSHWASSVHMNDTARHKSGSKSTGKHKAASESGRPPKSKIQRMAEPQDMPALKFDFLRSPRQLLTSAAEFPITQSLSDFGIDDSELTYMEDLTLEETDTEFAPYQYDQVSLAGIEELDPLVDLTDIG

SEQ ID NO: 140551 - protein, 109 aa, Triticum aestivum
  Clone ID: PAT_TA_34969.pep
SRPRLKKYSGMGSLEAKTKGSDARYLGDPLMLKVARGSLSQVADKGSVLRFIPYTMQAVKQGFQDLGASSLQSAHDLLRAETLRLEVRTGAAQVEGGIHGLVSYEKKSF

SEQ ID NO: 140552 - protein, 151 aa, Triticum aestivum
  unsure (1)..(151): unsure at all Xaa locations
  Clone ID: PAT_TA_34970.pep
MIVSALATAVGVNLGLTVLLVSAYSLLRRRPPFVSVYAPRRPYAPLESWLAAAWRRSEDDIHAAAGLDGVVFVRIFVFSIRLFAVVAVVGVGVLMPINFMGDQLRLIDFTDLPSKSVDVLSISNVRTGSNXAQLHFNATYPTTAHTCQYIQ

SEQ ID NO: 140553 - protein, 386 aa, Triticum aestivum
  unsure (1)..(386): unsure at all Xaa locations
  Clone ID: PAT_TA_34971.pep
HEELPGPAALAQMKMEVESLGMGRDYGDNRLRRSPAKNNSFHRPMSPMSPVPDYAFDNLQHMQKENEFLTARLLTMEEETKMLKEALTKRNSELQTSRSMYAKIAGKLRTLEVQMVTGNQRKSPSNPNIGTRFDGAHSQNGSNPPSMTSMSEDGVDDEGSCTESWANALVSELSHIKKEKVAKSSVTDGSSRLELMDDFLEMERLACLPSEANGHDNAVDKIKIVDAEAAVSGLTESDGVKDLQSVPLPGTPSSKQQLSEGSPLLKLQSRLSSLLDSESPQNNAGKVLNSIRNILKDIEEEADLMNVSKMVEVSESESLMNQDKRLSIGSKHSMDQEVINAVLKIQDFVKSLDQEMSKHQRPSSDYDGLSEKXQQFSALVEKVLSN

SEQ ID NO: 140554 - protein, 302 aa, Triticum aestivum
  Clone ID: PAT_TA_34972.pep
LRSELGTGKASLDSHASGEVMASIAVSSLEAELNRTQKEIESVRSKEEDAQEKMVELPKMLQQAAQEAEDAKDAAQAAEEELRKAKEDTEQTKAAATTTSSRLCAVLKEIEASKTSERLALAAVRALNESKEASDVEDSPRGVTLPISEYYALSKKAQDAEELANEKVTEALAQVESVKGSELESLDRLTEATKEMDEKKRTLELALERAERANEGKLAAEQQLRKWRSDHEQRRKIQEAAKRAVNPVSSPFVDPYLKEQDSRLHMSGSSYEDHVPNRKLRKKKSFLPRMGSFLSRNTPAQT

SEQ ID NO: 140555 - protein, 91 aa, Triticum aestivum
  unsure (1)..(91): unsure at all Xaa locations
  Clone ID: PAT_TA_34973.pep
VHLISGICPFAIVVPAMFSFKYRFSCKFKHLSSAEQYPSPTNTLICHRVLHSGMSRLSWNCITSYGFFMNCYFSPIPIFLXSGLSSTENTK

SEQ ID NO: 140556 - protein, 279 aa, Triticum aestivum
  Clone ID: PAT_TA_34974.pep
DDEPRRRRQDTPEDDEPRRRRRDTPEDDEPRRRRRDTPEDDEPRRRRRDMPEDDEPMRRRRDMPEDDEPRRRRPEMSKHDEHPRRDRPDADDRRRHNSGSDRHHAYPKHDSSDSKQRSIGNGRNNGNSTSEHRSHAEVASGDQRRQESRQGRELGSEGRGRQESQQGRNNGPTTNRRRGGVHHMSEEDREARLRQMQADAEVHEEQRWKRIKKAADDDAKEASTVAANQFRGKNFLDDEKKSIFGADKGGSATIEESIRRRAYYSQGGGDAHEANAFRR

SEQ ID NO: 140557 - protein, 271 aa, Triticum aestivum
  Clone ID: PAT_TA_34975.pep
ENQLALFPDASLLAEEFLPRAATKLSSINQSCMDDLRKRGPVKQNRVPELREWKRKLQRMVDRLRDSFCRQHALELIFTDEGDTHLSAEMYISMDNTVEEPEWVPSPIFQELYAKLNRMAGVAADMFVGRERFATLLMMRLTETVILWLSEDQAFWEEIEQGPKPLGPLGLQQFYLDMQFVIIFGQGRFLSRHVHQVILDIIDRAMGAFSATGMNPDSVLPGDDWFMDVAQEVVGMISGRGRAANGDREINSPTASVSAHSMSSFRSHGSS

SEQ ID NO: 140558 - protein, 272 aa, Triticum aestivum
  Clone ID: PAT_TA_34976.pep
MEHIARFFFGVSGNVIALFLFLSPVVTFWRIIKRKSTEDFSGVPYNMTLLNCLLSAWYGLPFVSPNNILVTTINGAGSVIEAIYVVIFLIFAERKAKIRMLGLLSVVTTIFATVVLVSLLALHGKARTVFCGLAATVFSICMYASPLSIMRLVIKTKSVEYMPFLLSLSVFLCGTSWFIYGLLGLDPFIYIPNGCGSFLGLMQLILYAIYRKNKGPAAGAGKGEDADEADEVEDAKKAAAAVEMGEAKIKVDDDTSSTVVDKVACRPPLQGE

SEQ ID NO: 140559 - protein, 226 aa, Triticum aestivum
  unsure (1)..(226): unsure at all Xaa locations
  Clone ID: PAT_TA_34977.pep
ITHGKLAYRPCTGVSEHGTYADVVVTCSASESGLHTEEQAEAIPNISLANGXVTLFAPVSVSSTRRRSKTKCAHSTAYPISXLDKPLREPKMEDRVGQTQXAHSITTEWLKLFEAXTDPLXTVPTIKKLRSYADRIRASELEKCLQKIGEGNLNMKRRRSIEELSTGIVNKLLHGPLQHLRCDGSDSRTLDETLENMHALNRMFNLDTEKAVLEQKIKAKVEKTQS

SEQ ID NO: 140560 - protein, 385 aa, Triticum aestivum
  Clone ID: PAT_TA_34978.pep
PKLPDAVRKVPPHASGPNSSLVRPNKVNTENKDSSPVEQAASKIDKGGVAQKEGSGTVRTSPGPVKRKATSIGPKIKRFRIDNEESMELKITWEEAQELLRPPLKAPSVVIVDGHEFEEYEEPPVLGRKTYFVTDQSGENHQWAQCEDCSKWRKLPVDALLPSKWTCSDNKWDPERTTCVSPQEASMEELAELIPIKAGAAKKAKLRMDTDSIDVSDGLDTLANLAILGEGESLPSQPTTKHPRHRPGCSCIVCIQPPSGKGPKHKQTCTCNVCMTVRRRFRTLMLRREKRASEKESDELPRKKEQGQSSESIPQDPLPASTSPSSTPQEVSGNGDDAEEAMEHTMASSPMKNQIDLNIQPEREDEQSPKSDAVGAMRLARENAA

SEQ ID NO: 140561 - protein, 241 aa, Triticum aestivum
  unsure (1)..(241): unsure at all Xaa locations
  Clone ID: PAT_TA_34979.pep
MEKKTGMAKLWALFLVVLVLAGSAQAAADRNVSRGGMRRLAGAPGVPVPITVLTSAVAIGAVCMDGTPPAYHMDWGFGAGRNRWIVHLEGGSWCESVGSCLYRKASRLGSSNLMNRQMYFGGILSSSPAENPDFFSWNRVMIRYCDGASFAGEGYDARSGLFFRGQRIWNAVIQHLLSXGMSSADHVLLTGSSAGXLAVVLHCDQXGGFFAGRGTTVKCLADAGFFLDAVNVAGWRTLRSY

SEQ ID NO: 140562 - protein, 547 aa, Triticum aestivum
  unsure (1)..(547): unsure at all Xaa locations
  Clone ID: PAT_TA_34980.pep
GWKQEHEHSGSLDDTDRNRLTNNDNEYASSANDGAEDSWKSQKKKRDKEEDDSELESGDPSNNSKKPRVVWSVELHQQFVNAVNHLGIDKAVPKKILELMNVPGLTRENVASHLQKFRLYLKRIAQHHAGMANPYGVPASSAQVASLGGLDFQALAASGQIPPQALAALQDELLGRPTNSLVLPGRDQSSLRLAAVKGNKPHGEQIAFGQPIYKVQNNSYAALPQNSSAVGRMPSFSAWPNNKLGMSDSMSALGNVNNSQNSNMVLHELQQQPDTMLSGTLHTLDVKPSGIVMPSQSLNTFPASEGLSTHHPSLIIPSQSSGFLTGIPPSMKPELVLPTSQSSNSLLGGIDLINQASTSQPFISSHGGNLPGLMNRNSNVMPSQGISSFQTGNTPYLVNXNSMGMGSKPPGVLKTESTDSLNQSYAYANHIDSGLLSSQSKNAQFGFLQSPNDVTGGWSSFQNMDGYRNTVGPSQPVSSSSSFQSSNAALGKLPDQGRGKNLGFVGKGTCIPNRFAVDEIESPTNSLSHSIGSSGDIPDMFGFSGQM

SEQ ID NO: 140563 - protein, 171 aa, Triticum aestivum
  Clone ID: PAT_TA_34981.pep
YPARTTAGLRHPRRHHLLPRLCAHQHHQGRGYQSPLGGLQPRLGSSQLVKQDILDGFWVKLPSMKARRGCHAVAVLGEVLYAIGGYDGDSMVSSVEIFDPRLNAWRMGDPMSNPRGYASAVTFDDSLFVLGGLRSNEQILDTVEVYNVNSGWSVPGFNSIGKRSFASAIVM

SEQ ID NO: 140564 - protein, 332 aa, Triticum aestivum
  unsure (1)..(332): unsure at all Xaa locations
  Clone ID: PAT_TA_34982.pep
MRPVKSPFEPAPGRAIRRLRAFPGCIFLKYHTFLLVLWIWYLSVERNNKQTCVKLFAELSNSAKNTAPAPIASFVTKLLISFPPDQKIIEHPGILDKPLKHEGLVWTIDSSFTGRFVIEIEFLDLKVADSSGGEPASIWASRQIKQSSDNTALSSLARXMLQEGILCDITINADDGSIRAHRAILAARSPVFRSMFSHDLREKELSTVDISDMSLDACRGFLNYIYGDLRSEEFLAHRLALLGAADKYDIADLKEACVESLLEDIDARNVIERLQTGHLYRLQRLKDSCLRFLVDFRKVYEMQEEFSAFLQTADRDLVAEVFQGVLAAWSGR

SEQ ID NO: 140565 - protein, 395 aa, Triticum aestivum
  unsure (1)..(395): unsure at all Xaa locations
  Clone ID: PAT_TA_34983.pep
RTRGERGLTGMVSYAEILAGGILRLQVSEAEVNNINIRFLDRRTGEPTTGKTKPETILQQLTTKKGQAYNRAQVKRDVETILTMGIMEDVTIIPQPVGDSNKVDLVMNLVERKSGGFSAGGGISSGITNGPLSGLIGSFAYSQRNVFGRNKKLNLSLERGQIDSIFRLNYTDPWIDGGNFGTSRTVMVQNSRTPGTLIHGGEHPDHSPITIGRVTAGIEYSRPFRPKWSGTLGLIFQHAGARDDKGNPMIRDFYNSQLTASGNPYDDTLLAKLESVYTDSGDHSSTMFVFNVEQGLPILPEWLSFNRVTARLRQSYEIGPARLLLSASGGHVEGNFSPHEAFAIGGTNSVRGYEEGAVGSGRSYAVGSGEVSCRLFGPLEGVVFXDYGSDLGSGP

SEQ ID NO: 140566 - protein, 323 aa, Triticum aestivum
  Clone ID: PAT_TA_34984.pep
MPLLICHRLLLLLLFWVAASHGDSSDDGAYDPSMCLNQTYTCGEVRISYPFYLAGETKDLKGNANSYCGYPGLGILCDDDKPILQLDGIVNYTVKSVDGATATVSLADPNVDDDRNTCPRPRIDHNITLQKRSLLYFPDSAVDYLIFFIDCIFNSTFHQPNSIYPISCQGFDAGPRPGLSFVLPDDAVPAGNWVQACNQVIQLPVHKYGEINFTDHGWTNGSGYANLLRQEFQLGWNESGRPTACTQCEGANSKGRCGHSRTGDFIGCLCPDGLVHSDNTCSKSRRQYSKKTTRIYIIAVSSSIPMLCLLFFAFWLGYKKYGC

SEQ ID NO: 140567 - protein, 153 aa, Triticum aestivum
  unsure (1)..(153): unsure at all Xaa locations
  Clone ID: PAT_TA_34985.pep
ASPAERCFLWLGGFRPTEVIKVMLKQVGSLSEGQLLGIYNLQRWVQETEESLNHTMGTLQHSLSDTIASPEAAAGNFMGHMSLALNKISSMEAIVRQADGLRQETLHKLHGMLTVRQAAHCFVAIADYFHRLRAVSTLWXARPRHDEQGPPAP

SEQ ID NO: 140568 - protein, 85 aa, Triticum aestivum
  Clone ID: PAT_TA_34986.pep
TISSRQLGLRHIFVVPRPSRVVGLITRKDLLLEEDGNTATTELQSTSVRSILSTSCKLSFSFCAAMRRTEVSNSLNIALETVSRF

SEQ ID NO: 140569 - protein, 282 aa, Triticum aestivum
  unsure (1)..(282): unsure at all Xaa locations
  Clone ID: PAT_TA_34987.pep
AKLVMEQCVARLDVALFNAILRESENEIPSDPISDPILDSTVLPIPAGNLSFGSGAQLKNAVGSWSRLLTDMFGMDGDDSRKDGQGAEGDGDVRRDGAESNSFKLLNELSDLLMLPKDMLLEKSIRKEVCPSIGLPLVTRILCNFTPDEFCPDPVPGLVLEELNSESLLERFTEKNLISTFPCTAAAVAYRAPSSEDVAEKVANTSGTXRGASKGLDGXRRRGYTSDDDLDDLGSPLMSLYDRSSPPSPCEXGSHIFSTRQEGAVANVRYELLREVWSERRD

SEQ ID NO: 140570 - protein, 430 aa, Triticum aestivum
  Clone ID: PAT_TA_34988.pep
MDPIVNQGWTSSEVEEACSLIARLNTNKIMYDDNDDKNKKHNYIVNSLHALFPSKTMKQVIDLYVDLAMEMHMIQRREGTHVTSGSPQNIFTFCDPVNGNYELPREENGASNTHGLYTMGDHANENFGVREEEATIMDNNGLSFGCPMENTGITVTGEAPLMADNNKMEVLENNISIDQPVVAAHQWGFWTDEEHSMGGLVNENFEAQEDEDTTMDDNGFSFRCGLEDTRIRKTEEAPMMVDKNKMVVLENNTSVDRPVVAAHQRKFWTKEERKSFLYGLEVYGRGDWKNISKHFVTTKTPVQVSSHAQKFFKRIQKKASSGTKRYSINDVRLHDNELLAANNSSVPRQALSFTGLNNDPSFRLQAPTSSLTVMNNQAQCSPSIYNQQVGQQPMWREQQMMGSAAAVMGGVGNYVPDGQHGPAYFYLGNV

SEQ ID NO: 140571 - protein, 90 aa, Triticum aestivum
  Clone ID: PAT_TA_34989.pep
SSAMQKGTGICIVMEIKYFQRTFRKPRRVPLMPEGDDEMGDHLMTKWCAKAGVCCFQNGLVGVATVIPTLHARPLYPYMGKGIIEYLDRY

SEQ ID NO: 140572 - protein, 231 aa, Triticum aestivum
  Clone ID: PAT_TA_34990.pep
QPECYDPRQRGPPSGPAASEPCGPAANVKAKIQDKEGIPPDQQRFIFAGKQLQNGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 140573 - protein, 144 aa, Triticum aestivum
  Clone ID: PAT_TA_34991.pep
WKETMNGRTYSACTADSCKCPDGFKGDGIHECEDIDECKERTACQCKECNCKNTWGSYECGCSGGLLYMKEHDTCISKSTAAQVGWNFLWVVFFGLAATGIAGYAVYKYRIRRYMDSEIRAIMAQYMPLESQGEIPSNAHHIEM

SEQ ID NO: 140574 - protein, 228 aa, Triticum aestivum
  unsure (1)..(228): unsure at all Xaa locations
  Clone ID: PAT_TA_34992.pep
MSRLAAAALRGALTASGARSCSISVAFSPASSRLFSTDASGAVAGSQVDSSSGEGHTYGNFYXIFLVPAVLDMNMLETDINHDLYQRELDLXDVKIEWNKRSYPQGGXLHLSTLXETGDRRTVKDRMYSLETLEGEXGDSKHICMXRMEMLYGGPETLQVHEIKRFXAGSTYLPPTFENFNTXMRAASPEDVGMVKVKFGSRTXPTDFFIAKTRVFFLNNPVTMRVIQ

SEQ ID NO: 140575 - protein, 122 aa, Triticum aestivum
  unsure (1)..(122): unsure at all Xaa locations
  Clone ID: PAT_TA_34993.pep
VWEVRYAHFRQTDELLADSGWHCSXFCFRHISDFAFKMKAYSHVDRIRFKYFLNPERIQDVICRGADLFDMLPEEYTFQEIIAKLGNIPSTFSXAVHLPSYLXQNVDRYRYLLPGNCRRESG

SEQ ID NO: 140576 - protein, 167 aa, Triticum aestivum
  unsure (1)..(167): unsure at all Xaa locations
  Clone ID: PAT_TA_34994.pep
VICHGEKGFLTDGRKSFPSGHTSWSFAGLGFLSLYLSGKIKAFDRKGHVAKLCIVILPLLLASLVGVSRIDNYRHHWEDVLVGGLIGYIMAVLCYLHFFPPPYHHQGWGXMRTSTCWKSLRCTIQIMHKTSSLQVSIISDXPANTITGDQEMIWNLEVCNSPLCGTD

SEQ ID NO: 140577 - protein, 197 aa, Triticum aestivum
  Clone ID: PAT_TA_34995.pep
MGKNQAYKAMQRARLGSSSGAPGEGEEDGMTDGSFHSPEWHAARLASLNKTHTLTWEEFKKKQKDEELKRGEVEADKDKMMREYRAQLDAERAQKLGRGRDVVKSKSSSSKKEKKEKDAKKRIKKRRKHRSSSESSSSSESSSSDDEDRGSRKSRSRSRSKRSKKDKKHRSRSKHAGSDSEEEGPVRLSKFFGNAKN

SEQ ID NO: 140578 - protein, 118 aa, Triticum aestivum
  unsure (1)..(118): unsure at all Xaa locations
  Clone ID: PAT_TA_34996.pep
INRRNNQSDTTPCKTLNKXCXKINXGLIXPSNXXXXMNIATGHKGKGXLVNKEHASXLAQHPSNADRTQHAKTNASIAQFPNTFITKELNLSRDKFLSLLTDXDQXXFLTFPXKFQXQ

SEQ ID NO: 140579 - protein, 155 aa, Triticum aestivum
  Clone ID: PAT_TA_34997.pep
GGAVPRSNPSSCGVLGPLAPGSRSRRAVSVPRCLPASARPGRGSPFPLASTTGCALPACERDVADAAAVLVCCILHPGGPGPAPSPRLGSAPPPPLPSSLRPCPPPPSLAGPVPLCPLSSLSSRRALQGLAFIGEFFFQSGPQSRYANWNSKMSI

SEQ ID NO: 140580 - protein, 80 aa, Triticum aestivum
  Clone ID: PAT_TA_34998.pep
MATIKAKVQDAASSAKAGIDKAKATAGEKVKKATTTDPEKKREAEEKKEDRMHKVNSDERDEKGDHAAERSGRRTIVTGT

SEQ ID NO: 140581 - protein, 166 aa, Triticum aestivum
  Clone ID: PAT_TA_34999.pep
MGRTVKKAGKSKSKKGKGAKKADASSSATAAVASGPAKVWQPGVDALEEGEELQFDPEAYNYLRGFSIGWPCLSFDVVQDQLGLVRSEFPHTLYGVAGTQAEKAPWNYIGVFKLSNINGKKREPIPSSKVDADSDMDSDSSSDEEEKEETNEDTKPILHLKKVAHA

SEQ ID NO: 140582 - protein, 424 aa, Triticum aestivum
  unsure (1)..(424): unsure at all Xaa locations
  Clone ID: PAT_TA_35000.pep
SYAYLRGFSIGWPCLSFDGVQDQLGLVRSEFPHTLYGVAGTQPEKAPWNYIGVFKLCHINGKXREPIPSSKVDADSDMESDSSSDEGGPCGACEDKKPILHPTTVAHAGCVNRIRSMTQQPHICATWGDTGHVQVWDFKSFLNSVADSGPVAHKEDDIIHNHVPLKIFNGHKDEGYAIDWSPLVTGRLVSGDCNSCIHLWEPSSSTWDVDTKPFVGHSASVEDLQWSPTEGDVFASCSVDGKICIWDVRTEKKPCMSIKAHNADVNVISWNRLASCMIASGCDDGSFSIRDLRFIKDDGAVVAHFEYHKHPITSVEWSPHEASTLAVSSADHQLTIWDLSLEKDAEEEAEFRAKMKEQANAPEDLPPQLLFVHQGQKDLKELHWHPQIPGMIVSTAADGFNVLMPSNIDTTIAGADKPTLAPLG

SEQ ID NO: 140583 - protein, 316 aa, Triticum aestivum
  unsure (1)..(316): unsure at all Xaa locations
  Clone ID: PAT_TA_35001.pep
MAGAGVGGRKARNFATFRLFPRDGAADPNDRVFVRVDNNAYTIPGFGDDEDPSLSPTAAADQFPSSTSGPLPDHVRXQILELGLPDDGYNYLLHLRELRPSAVASSFVPSHTARPEQLPLGXVRPNDAKQRWRVASGKVEEELDEGRTMCKVAAKTAPVRRVEKAVDPDVARLLDESEDEGLEEDFVIMANQAEGDDMEDEGEEEGXVGVFSDVENDEEFEDEEGSNNHFHHNNHIHSRNHFHHNYHICSCNHFRSRNYHIHSHNHFDHNNHIHNRNHSIRNHNNQFHSCSSSSSSSNNNDNNNNKSFNNSCNQLV

SEQ ID NO: 140584 - protein, 98 aa, Triticum aestivum
  Clone ID: PAT_TA_35002.pep
MLPQGYPHDAQLQEFQYFVVIDFEATCDKENNPHPQEIIEFPSVLVNSATGQLEASFQTYVRPAYHQNLTDFCKELTGIQQIQEDRGVPLSAFSTNTG

SEQ ID NO: 140585 - protein, 203 aa, Triticum aestivum
  Clone ID: PAT_TA_35003.pep
MSGGNPAGVDNTFRRKFDKEEYLERARQRERDEKDEARRGKDRGPPVQRQPLKHRDYEVDLESRLGKTQVVTPIAPLSQQAGYYCSVCECVVKDSANYLDHINGKKHQRALGMSMRVERASLEQVQKRFEALKKRKDPASFSEQDLDERIWKQQQEEEEKKRQRREKKKEKKKEQAGQNEPEDIDPDVAAMMGFGGFGTSSKK

SEQ ID NO: 140586 - protein, 184 aa, Triticum aestivum
  Clone ID: PAT_TA_35004.pep
FAGRLGKLFLGIPPPLEYLALQLRGGQMWIEPVAIRSQLNHLKKLFIANVAMNWGTFWILTLLAAAPALESLHVHFDSEKASASVLLDVQAEHHQHHYHLKELMVVGFNGVAWQTGFVKRIMQASPILEHVHLLDGHVVEDEERELVGLEIVRRRREWHECERLEVLDELTDGISSLHPKIVLE

SEQ ID NO: 140587 - protein, 283 aa, Triticum aestivum
  unsure (1)..(283): unsure at all Xaa locations
  Clone ID: PAT_TA_35005.pep
EPHGHVSWSEFQYVVDDYGDIFFQVPDDGNILEDDDANNPVTVLIGTDGAIIGETSAVTSDFSDHVVVEDSMDMHDNDSKVDTEITDILIEWGMPVTMRSIHPIYFAKCLTKAVHDNHGEKIDNPSNGVSIVGYLRPAFIEEESYLRSLFGAECSADGYSSNXRGASQXLIIGHQHTESSIDSTIYXLEMMSIELFSVYGKQFMIDPQDFQDAEPDLLSNHASDIIKRVKENSDQCTMALRSLCSRKKGLTVEVCFCSVMLYSGSILLSGLLCMMNRKILTIN

SEQ ID NO: 140588 - protein, 329 aa, Triticum aestivum
  Clone ID: PAT_TA_35006.pep
MAASSLWDELVVAASTGGSSGTVVSICVFTAVLCLCLVAGHLLEENKWVNESITALIIGCIVGALIFLLSKGRNSHILRFDEQLFFIYVLPPIICNAGFQVKKKQFFHNFLTIMSFGVFGVFISVAIVSAGFYWLLPKVGFGKLDAVDYLALGVIFSSTDTVCTLQVISQDETPRLYSLVFGEGVVNDATSVVLFNAIKNMDITKIKSGAVLKVIGDFLYLFATRTILGATIGLFTAYVLKALYFGRHSTDREVALMALMAYLSYMLAELLSLSGILTVFFCGIVMSHYAWHNVTESSRITTRHIFATLSFIAETFIFLYVGMDALDMD

SEQ ID NO: 140589 - protein, 288 aa, Triticum aestivum
  unsure (1)..(288): unsure at all Xaa locations
  Clone ID: PAT_TA_35007.pep
YKSTSARYITCQRYSEGLDILQSGATIQLKHGQITCGAELAVLFVDTLVKGQCPYNEETXFDRVRKIYXAFPRINMPHFLGDDYDDDGQKLSEAISAAKVRSXXCSSFLRAALRWSXXSLGHQETDLLIXHVMLGEYIYSESPETDMTKVSSHFVRGNDPKKFASMLVNFMGKCYPGEDDTAIARSVLMYLSLGNLRDANLLMDGMKEQLKSADMELPKTALIEFIKYLLQTLERDAYPLFRTLRQKYSASTDRDSVFEELLDEIAAKFYGVRQQNPLEGLFGEMFKV

SEQ ID NO: 140590 - protein, 176 aa, Triticum aestivum
  Clone ID: PAT_TA_35008.pep
RGKKGPVKSSRHDSKDEKPRRSKYKDDSYSDSESDVSHSDSESDYDRKKKKSSHHGSKDDKQAPKSKEKEASLVKNVDKRKRHDSDSDGSAHDRKIHLDAANELEERKKGQDGRRKEERMEQEKQKQREEERKELEKHQNIERRKGRLVVKMLISARGMILILILIMDGDTLTQGK

SEQ ID NO: 140591 - protein, 90 aa, Triticum aestivum
  unsure (1)..(90): unsure at all Xaa locations
  Clone ID: PAT_TA_35009.pep
XKTRTNVRDLYTRIWVSLRAAESRSDRLQKLQDGELSVKNKTQVSLVFFHVLRPQLSNDQFSAVLLTALFTFFFELNACQCFSCLRWLKN

SEQ ID NO: 140592 - protein, 430 aa, Triticum aestivum
  unsure (1)..(430): unsure at all Xaa locations
  Clone ID: PAT_TA_35010.pep
MLPTGSSRPQHSPAPRSSSFSLRDLFVPTRTHSHVRQIIMAAPLTAMCFVLLTQPPSHRKTPGVCSIPVLGVAHMLVMGGXAGYIETHAALRLLKDSFRVTIVDNLSRXELGAVKVLQNLFPDPGRLQFIHADLGDPIAVNRIFAENAFDAVMHFAAVAYVGXESTLEPLRYYHNIHDVKTLIYSSTCATYGEPEKMPITEETPQFPINPYGKAKKMAEDIILDFSKLRKSDMSVMILRYFNVIGSDPEGRLGEAPPPELREHGRISGACFDAALGIIPGLKVKGTDYETADGTCVRDYIDVTDLVDAHVXKALNKARGGNLAETAQPPGERQSWRRQWWLRRRQLGEGVCVGLQDGGPGDYAEVYSFPRRPGDXLKVSSNHTELQESLRVAWTWQKKHRSGYVASGWHIFCRAGYADSGRYFIWRVSQR

SEQ ID NO: 140593 - protein, 157 aa, Triticum aestivum
  Clone ID: PAT_TA_35011.pep
VSNRVNKLQELQGEDQERLAWILSYITHLLSLLARNSSMSKQKRKEKDQTIRGPMIPQAVHRKLLLMFTEPGSSSLSTEKHELLVNYILVLTLFADDFRSEPTDICVDLKMNRQMLKPYYDQLGCKSVSTGAFKPFFMTLPAPLKFPQQVTRRRRRK

SEQ ID NO: 140594 - protein, 184 aa, Triticum aestivum
  unsure (1)..(184): unsure at all Xaa locations
  Clone ID: PAT_TA_35012.pep
XGPIPSHVFVRTLIMCILSLCVDWMSLXTVLLFGCAALTHDAQGWRQRRPIXTAVEHEAFPFSRLPSSPIDAVPRLTSRPDISFFVPPGASNIVPMQAQPCHAAEQFMSASLILFYIHSVPLGFRGKSSCSVTVRFRWVVVPLLLRCLLVQFWFSEAASTLRCKNLVARLSFFFLCPTKLSTRE

SEQ ID NO: 140595 - protein, 61 aa, Triticum aestivum
  Clone ID: PAT_TA_35013.pep
SICTIFNHVTMQTKTTSQSYKSDHDHHRKINRSSSDHGRCTSHSPSSSSSPFRSMSTSWSS

SEQ ID NO: 140596 - protein, 111 aa, Triticum aestivum
  Clone ID: PAT_TA_35014.pep
LTDRSSRQARRCGRAALGRRLVGRRTGTSEVLPAGLPCCPAPANRPTGKVVEQERRGGRCAGCSLKDQQGKMGLGERRHPVTVSLDLPLHPATGVSRAPPPGKCQPPSPEK

SEQ ID NO: 140597 - protein, 121 aa, Triticum aestivum
  Clone ID: PAT_TA_35015.pep
CRTELERRCCLCLLKTLAKSRGRTQSQQVAALRQAGMAMTATSSAATVRGCGLRRGLYCDGDLMMKQMRSCSSRMMKASIGTMGLAERADEAAAASLVAEIQRHRVEHLVDTSSLDCLFIC

SEQ ID NO: 140598 - protein, 97 aa, Triticum aestivum
  Clone ID: PAT_TA_35016.pep
LIKEVKRWVPNLYINNSDYICCFYVDRSGVPTVTAEKRGDGHPEARAKVFVIAKGPQKFLKAHGLQQWWMDDSELHLAVNESKLMYKHLKSLYVKET

SEQ ID NO: 140599 - protein, 370 aa, Triticum aestivum
  unsure (1)..(370): unsure at all Xaa locations
  Clone ID: PAT_TA_35017.pep
MALQYVEAQRQARPDLADWYADLADLYQRKLWHQLTLKLDQFLQIPAAQTGDTLIQLYNNFISDFETKINLLKLAQFAVIGSRQYPDKDAAITFLEGXITKLRETRELRINEPILHVKMQIAAIHLDKGEXKECKNLLEEGKTTLDGMTDVDPTVHASFYWISSQYHQSYQAFAAFYKSSKLYLAYAPFVAALLGVQGDNFGELLAYPIINSIIGTNVEWVYHTLQCYQXGNRALYHLPCGVHDADLSPQPALXQNEQKLLEKINILCLMEIIFSRPXSEDRTIPLSVIAKQTKLSTSEVECLLMKSLSVHLIEGIIDEVDSTVHVSWVQPRVLGIPQVKALRERLDSWVGKVHTTLLSIEAETPDLVAA

SEQ ID NO: 140600 - protein, 160 aa, Triticum aestivum
  Clone ID: PAT_TA_35018.pep
AAPVPSSVAACSTVGGALWRGGVRVARTGGRGVRAEAAYFWDASVPVEMGEIDSMDKLDAALASSAEQNQPIIIDWMASWCRKCIYLKPKLEKIAGEFPGVRFYFVDVNKVPQAVVKRGNISKMPTIQLWKDGEWKEEVIGGHKAWLVMDEVREMIHKYK

SEQ ID NO: 140601 - protein, 165 aa, Triticum aestivum
  Clone ID: PAT_TA_35019.pep
MAAGKRTIGLAMDYSPSSKAAMRWVVENLVKAGDRIILIHVLPKGADASHKGLWKSTGSPLIPLLEFMEMNVQARYGVNPDKEVLEILQAESKSKQVEILAKIYWGDAREKLCEAVDDLKVDSVVLGCRGLGPLKRALLGSVSNYVVNNATCPVTVVRGPNGSLA

SEQ ID NO: 140602 - protein, 176 aa, Triticum aestivum
  unsure (1)..(176): unsure at all Xaa locations
  Clone ID: PAT_TA_35020.pep
KRGQATNSHSLAERLRRKKISERMKLLQDLVPGCNKITGKAVMLDEIINYVQSLQRQVEFLSMKLATVNPELGFDIEQILSKQVMLSQDRRLGFYGADPGSSALIAHFNQGMMHPDMMCNASNPAGALHGTIHDISMMNQMPEMWETLQNIPHINXNPAVAADSSTNNAGPMKIEQ

SEQ ID NO: 140603 - protein, 92 aa, Triticum aestivum
  Clone ID: PAT_TA_35021.pep
LQGPNMSSSQKSLLNFIGIAVEGCGDHLGSSTEAGLTTTLPATILQGVGGVMVHLFCIRDLQFVLAQPLLMANGVLIFTSRKVAKSSRLFFP

SEQ ID NO: 140604 - protein, 170 aa, Triticum aestivum
  unsure (1)..(170): unsure at all Xaa locations
  Clone ID: PAT_TA_35022.pep
QLYICTIIQVLAVECKPNTCPAPGTWGAMGVGLGYCVAAAVAEPERLVVAVEGDSGFGFSAMEVETLVRYQLPVVVIVFNNNGVYGGDRRGPDELTGPYKDDPAPTSFVPGAGYHKMMEAFGGKGYLVETPDELRSALSXESFRARKPAVINVTIDPYAGAESGRMQHKN

SEQ ID NO: 140605 - protein, 137 aa, Triticum aestivum
  unsure (1)..(137): unsure at all Xaa locations
  Clone ID: PAT_TA_35023.pep
TTWSTIRYITLSTRLHPICLIYNFVFVHTPSFDFIACCNACCLGRSSSYAWNILVSLWESRSNPTRVYGGPLTPVSSVTVIKIRRHGESGARARPSKPQPRARTWRHEATTHGLRRHKAGQPAPTRRGXHTXXSXER

SEQ ID NO: 140606 - protein, 328 aa, Triticum aestivum
  Clone ID: PAT_TA_35024.pep
MADHLQVQQQHQHQLELPSGFRFHPTDEEIITSYLVPKVLNPTFTAIAIAEVDLNKNDPYELPKKAKMGEKEWYFYCQKDRKYPTGIQTNRATKAGYWKATGKDKEIFHPLPTLIGMKKTLVFYKGRAPRGEKTNWVMHEYRLEISKQPAYGPSTAIAKAAAINASSKKERVVCKIFHKNIGVKKVVTPSYAMHMPMFIGGEQQQGSLNSCTFPPPMDYGASLSLAPPLFLFEDFLYQLHAAKVGLAMTGSLVLPMVNNPHHEMMGGNPMVSYQQQQMMQMQMQMGADQCFMVGVEPGSESSSMVSREGVDRLGNNVQGNGATTTIDS

SEQ ID NO: 140607 - protein, 73 aa, Triticum aestivum
  Clone ID: PAT_TA_35025.pep
GRESAARSRQRKQAYIMELEAEVAKLKERNEALQEKQVEMLQKQKDEIRESIEKQLGPKAKCFCLQRTLTAKW

SEQ ID NO: 140608 - protein, 156 aa, Triticum aestivum
  Clone ID: PAT_TA_35026.pep
EEFRGELVQEFLLQQCNPEEKLSLLQSVIPFLRPKTSQQNSCQLKRLQCCRQLAHISEPSRCPAIHNIVHAIVMQQQHVDRGFGQPQPQQLGQEMPMQPQHQLGQHSILPQQLAQYQLVRLLVIQTLPMLCNVHVPSDCYTITAPFGSMTAYNGGQ

SEQ ID NO: 140609 - protein, 591 aa, Triticum aestivum
  unsure (1)..(591): unsure at all Xaa locations
  Clone ID: PAT_TA_35027.pep
SPLLRPPGRGVRLPERLPLSQPVVDVRLRAAPASRRINGSAGSSFEDFQILHGDMQGLTDTMAFLTSLSXLLETSPRIPEKQSRERTAASVLFDLQEDIYVARAPGRLDVMGGFADSSPRRVLQRPLREACHVAIHXPGPPTLVLSRPSLAGLLADRPGPSFHIVAFASEWSNRAPTLATVRSDLAGGDKPISYEKAKEYFSQDPSQKWAAYVAGTVLVLMTELGVQFTDSMSILVSSSVPEGKGVSSSASVEVATMSAIAAVYGLNIAPRDLAILCQKVENHIVGAPCGVMDQMTSACGEANKLLAMVCQPAEVKELVSIPTHIRFWGLDSGIRHSVGGTDYGSVRVGTYMGRKMIKCAASDLISQSFPSTPTQSCDASEEYEKYGVDLLKSEASLQYLCNLPPHRYEAAYARDIPEFITGDEFMEKYGDHNDAVTVIDPKRSYSVKAPTRHPIYENFRVEAFKALLTAAKTDEQLSALGELMYQCHYSYNACGLGSDGTDRLVNLVQEIQHRKTTSQHEGPSLFGAKITGGGSGGSVCVIGKNSLKSSEEIFEIQKRYKAATGYLPIVFEGSSPGAGKFGYLKIRWRSA

SEQ ID NO: 140610 - protein, 256 aa, Triticum aestivum
  Clone ID: PAT_TA_35028.pep
QIKRLGHADVIFHQLDITDASSIARLADFIKTRFAKLDILVNNAATDGIEHVIDPVYGLTPGDETFNGMDAGQRIDWMWTSCRQTYETAKQGLQTNYYGTKRVTEALLPLLRSSSDGRIVNVSSNFGLLSFFRNEELKQELNDVDNLTEEGLDELLAMFLKDFEGGGAEARGWPAEFSAYKVAKAAMNAYSRILAKRHPELRVNCAHPGYVKTDITRNSGILTPEEGARNITSVALLPEGGPTGKYFSEGEEASFV

SEQ ID NO: 140611 - protein, 164 aa, Triticum aestivum
  Clone ID: PAT_TA_35029.pep
EELAPWIEVKADWVLSRTPLLAIRPPDGISPSEVVAKMNEGLSSGKVKNGQYLKMYLKEDLPSRLHYSESYRIPPIIGLVAEGYKVEMKVSKKNECGGAHGYDNAFFSMRTIFIAHGPRFEEGKIVPSFVNVEIYNAIASILSLKPAPNNGSSSFPETVLLPSE

SEQ ID NO: 140612 - protein, 340 aa, Triticum aestivum
  Clone ID: PAT_TA_35030.pep
AFLQPFTIKMWCITGLFFLVIGTVIWLLEHRINDEFRGPPAKQVVSGSWFSFSTLFFAHREDTRSTLGRFVIIIWLFVVLIIQSSYTASLTSILTVQQLISPITGIDSLVASDEPIGFQVGSFAESYLVNELGVSRHRLKSLGSPDEYKQALELGPANGGVAAIVDERPYVEIFLLLHPKFAVVGSEFTKSGWGFAFPRDSPLAVDLSTSILELSENGDLQRIHDKWLANDVAGSMSQNNELESDRLQVYSFSGLFLICGVACLIALAIHAGILFHKYCEQRRQVSADGSSRSSRSSFRAFLSFADRREMDAHIASKDKAAGDHSISAASSSSVSTATSC

SEQ ID NO: 140613 - protein, 148 aa, Triticum aestivum
  Clone ID: PAT_TA_35031.pep
SRVDGAVGRHGHCGVAAAVCRDSTGLYLGSSLVVYAGIIDPTLLEAFACREALALAEDLRIQMMHVASDCEEVVKDIKQGSGGYHGAIIQEIIARKNDMISCTFTHERRVFNFEAHNLVKFGCNLGVSRHVWLGSPHDQNIVPLIIEQ

SEQ ID NO: 140614 - protein, 265 aa, Triticum aestivum
  Clone ID: PAT_TA_35032.pep
MFVYARGSFLRPRAAAATPPARHPIGLEQIGGRSSFSRSSRMRIFVKTPTGRTICLEVHSSDTLYTVKAKIQQQYHLVFDGVQLEDNRTLADYGIQHDSMIDLQEKMQIYVTETWGGRTITLEVDSLDTIGNVKSKIQYMDGFPKSQQCLIFANKQLEDDNRTLADHNIWKESTLLLVLRSCRPGESRMMRIFVKTLTGKTITLEVESLYTIDNVKVKIYEKDGTPPIQQRIIFAGRQLEDGRTLADYKIHNEDTLHLVLRQCGC

SEQ ID NO: 140615 - protein, 81 aa, Triticum aestivum
  Clone ID: PAT_TA_35033.pep
RGIRVYQLASVPPLFHQNACSANRACIKVVFANKFFLLSFFLSKLISHYGMFFALHSHEAFIRQDRFRHPIRLIHHLGIQE

SEQ ID NO: 140616 - protein, 77 aa, Triticum aestivum
  Clone ID: PAT_TA_35034.pep
GIIPYSWKAIVCSNSNFAPLCELSWMSSSRPLCSVHHMLNHCGKQACLIPLPMSPATLQNGGHGQAQASLCNSAEST

SEQ ID NO: 140617 - protein, 180 aa, Triticum aestivum
  Clone ID: PAT_TA_35035.pep
TWEGKTAEPVQNKKRKNRAMYTKFTRILHIYLQVGQTICPDRSFARELWALGQFIAPGTLQIHNQPHPEKRREPHHIFTCHTRRMMAPLGGQKGTINRQTALLPYLPNQCLYREVLLHCILESERLDPARVPPEYEPPGPVGYHQDPSAPAHLLACVNGVPEPLGALPHGDPVARELCRG

SEQ ID NO: 140618 - protein, 167 aa, Triticum aestivum
  Clone ID: PAT_TA_35036.pep
LTALLGANCCRGCIDWTLMSVNRNAYIMIAITGKGFFKASVLATGLIMNNILRIGKVNVIGDVILFLGKLCVSLFCALFAFLMLDTHKYKSAHNKISSPLVPVLVTWGLGYTVAKLFFAVVEMSIDTIILSFCQDAEEHQGTAQYAPPLLMETLDEQGELQRLTQGP

SEQ ID NO: 140619 - protein, 395 aa, Triticum aestivum
  unsure (1)..(395): unsure at all Xaa locations
  Clone ID: PAT_TA_35037.pep
SNFEYLMILNTLAGRSYNDLTQYPIFPWVLADYASENLDFNKSSTFRDLSKPVGALDEKRFKDFEDRYLNFCDPDIPSFYYGSHYSSMGIVLHYLLRLEPFTTLHRSLQGGKFDHADRLFQSIDSAYRNSLSNSSDVKELIPEFFYMPEFLQNSNSYHLGIKQDGEPLGDVERKLYLYFIPEEFIHINREALESEYVSSNLHHWIDLIFGYKQRGQPAVEAANIFYYVTYEGAVDLENMDDMLQKYAIEDQIANFGQTPIQIFRVKHPRRGPPIPIAHPLYFAPQSITLTSSVSSTISHMSAVLFIGLLDNTIILMNEGLILSENFFGVGSDVISPRKIGTFLAENVKFGRQLLATMQINSDKYLILCGNWENSFQIISLSDGXRIVQSIRQHKD

SEQ ID NO: 140620 - protein, 463 aa, Triticum aestivum
  unsure (1)..(463): unsure at all Xaa locations
  Clone ID: PAT_TA_35038.pep
MAAIMASITSELLFFLPFILLALLTFYTSAVAKCHGLHRWSGRTKKRRPNLPPGAVGWPFIGETFGYLRAHPATSMGQFMDQHIARYGKIYRSSLFGDRTVVSADAGLNRYILQNEGRLFECSYPRSIGGILGKWSMLVLVGDPHREMRFISLNFLSSVRLRAVLLPEVERHTLLVLRDWLPSSSSAVFSAQHEAKKFTFNLMAKNIMSMDPGEEETERLRLEYITFMKGVVSAPLNFPGTAYWKALKSRATILGVIERKMEERLEKMNKEASSMEEDDLLGWAMKQSNLSKEQILDLLLSLLFAGHETSSMALALAIFFLEGCPKAVEELREEHLEIARRQKLRGECKLSWEDYKEMVFTQCVINEDLAGXATWXRFLHRXKVIPDVHYNGYXIXSGWKILPXLTXVHLHSSLXXDPNNXXPWXXXGNPFGGXXKKLTXIPXXXGTKXXXGPELAXLQGGPV

SEQ ID NO: 140621 - protein, 150 aa, Triticum aestivum
  Clone ID: PAT_TA_35039.pep
RVVMGNVEIVHHGSKQHQPSNEYFDSGVDDLKNPQHYIVWDMNLDSHIYSEFVVTIKLPSKAKDSLFTQEDCHDSSDASLVLSPSSADSVSQVRFFTLGVEWDGTVILESTSVLIQTSSTVGAAGAFSYSDCVSDSTIDLCFHYEIITSS

SEQ ID NO: 140622 - protein, 162 aa, Triticum aestivum
  Clone ID: PAT_TA_35040.pep
SGKRYSPAAYHADACHTSQSREHATGNSDIRWYVGEDRKANIACHFNKQILQSYQNYMTSASPKRILLRQSGNWKEFPEKIVKLAQVDFRTKKTITEVGYQNQLFLLDFVHMTFIDSKSGLQRPIAWIDDNGRRYFPEVLNEDQIVYRRIDFGIGHHVYVIA

SEQ ID NO: 140623 - protein, 407 aa, Triticum aestivum
  Clone ID: PAT_TA_35041.pep
PKWACDIIDQYGASECSAESSNFESSTEEVSSDKRVRAEKGIIRKINCDHRETVGENEPHTSLPAVFSCQPQQDKLGGQSRAQGTTSVVQKMLLQGMGTAIGSKDIIGIHRTPFLNNYREDRYNLFQKQAEITKSQHGNANVRYAWLPCSKAAVDEMMLNGTLQIKKPTRCPPYGTGVLLAPANCSINCVNYSDVDENGIIYMMLCRVVMGNVEIVHHGSKQHQPSNEYFDSGVDELKNPQHYIVWDMNLNSHIYSEFVVTIKLPSKAKDSLFTQEDCQDSSDASLVLSPSSADSVSQDMNLEASPALGGQYEAPMLGGSMAKAPSTPWMPFSMLFAAISTKLPREKMDMINNCYEEFKAKKISRIDLVKRLRLIVGDRMLVSTIIRLQDKLPPMVKREAADAPAKA

SEQ ID NO: 140624 - protein, 123 aa, Triticum aestivum
  Clone ID: PAT_TA_35042.pep
MSMADEQYDAGPRGAPHGLLLAVVVGLLVGWPLFLSDGAEAVTDAIAELLGPVGLLLLPVGLLLLIHLLSSDRAPDVFEFGGSPDAVHHVGGSPVGVALMLVLILALLYYRSALFGGGGGDDE

SEQ ID NO: 140625 - protein, 56 aa, Triticum aestivum
  Clone ID: PAT_TA_35043.pep
RTQGPVQVALARDCKSQSYKFKGMCVRDDNCASVCLTEGFPRGKCKGFACSCYKDC

SEQ ID NO: 140626 - protein, 111 aa, Triticum aestivum
  Clone ID: PAT_TA_35044.pep
NAEFWGLYARWHKSKGSLMACSEALLKQVRSLQGSGLWHDQEKFTQYAQASLQLCKVYIEISSTTGSRRELLSAEMHLKGSLKQATDCSGTEEYKSLNDCLDQLRGLIGDA

SEQ ID NO: 140627 - protein, 278 aa, Triticum aestivum
  unsure (1)..(278): unsure at all Xaa locations
  Clone ID: PAT_TA_35045.pep
GIRAETVIYRIFYSINRSGNGHLTLRELKRGNLVAAMQQLDEEEDINKILRYFSYEHFYVIYCKFWELDTDHDFLIDKENLIRYGNHSLTYRIVDRVFSQVPRKFTSMTEGKMGYEDFVYFILSEEDKSSEPSLEYWFKCIDLDGNGILTTNEMQFFYEEQLHRMECMAQEPVLFEDILCQMIDMIGPENETYFTLRDLKKCKLSGNIFNILFNLNKFMAFETRDPFLIRQXERENPTLTEWDRFAHREYIRLSMEEDGEDASNGSGDVWDESLEAPF

SEQ ID NO: 140628 - protein, 358 aa, Triticum aestivum
  unsure (1)..(358): unsure at all Xaa locations
  Clone ID: PAT_TA_35046.pep
HRAGQAARASRCLLLLAIFLSAQPTGQSGEEGPAVPALMVFGDSLVDVGNNNYIFTIAKANFPPYGRDFKDHVATGRFCNGKLLVDFIAEKVGFNGSPPAYLSPQASGQNLLLGANFASAASGYNDHGTLIKAISVSQQLKYFKDYQAKLVVVAGSSHARSIISGSLYIICAGSCDFIYNYYINPFLDMNQTAEQFSDRLVGMFNNSVTQLYDMGARRIGVFSLPPFGCFPLAITLYGHGRSGCVSRLNNDAPXYNMKLKAAVDSLSKKYHDLKIVVLDMYAPLYNLATSPVSQGFTEAKRACCGTGTVEASILCNPLLPGTCPSAQTYVFWDVWHLSEAANKVIVDSLVDEINNLVA

SEQ ID NO: 140629 - protein, 175 aa, Triticum aestivum
  Clone ID: PAT_TA_35047.pep
ELVESNGLAWPAARAPVDAGLVRRGLPAGYAGAGHFPLAVQLPALITAECRIAPGNVGVHPRHGLAADAPGRQERRPHPQLGKCVPLQKVGAPASGPDVHGVSAHKKQRPRACLLVVVAPLPHPPRPLRNERHAELPAHHNSPLPLLEHLVGPAPCIARSLGLSRPTLVQRRCGS

SEQ ID NO: 140630 - protein, 230 aa, Triticum aestivum
  Clone ID: PAT_TA_35048.pep
MAARLLLLSFDCPAVAGGRRSRLSAMPRMSSGAPLVRPPASSVGAFAVTAARGNLPHHTSVVVEGGGVYTVGDFMTKREQLHVVKPSTSVDEALERLVEHRITGFPVTDDHWNLVGVVSDYDLLALDSISGNGQAEADIFPEVDSTWKTFHQIQKLLSKTNGKVVSDVMTSAPLVVRETTNLEDAARLLLVTKYRRLPVVDSSGKLVGIITRGNVVRAALEFKKNVEGSL

SEQ ID NO: 140631 - protein, 172 aa, Triticum aestivum
  unsure (1)..(172): unsure at all Xaa locations
  Clone ID: PAT_TA_35049.pep
MHEEDECDHADLIWRSRCPNKLKIFAWLLFRGRLNTRDNLFDKHIATATACPRCNATSEGTQHLFIACPRAASIWLRLGTVLPAXSKIFGLPRRRLTFETCIWPEILLPIQWKIWDSXTVFRNKNHSKSTAVRSICSDFELWTHRFKEPSDKMAAQSQLSHLTDIRGLVTSL

SEQ ID NO: 140632 - protein, 124 aa, Triticum aestivum
  Clone ID: PAT_TA_35050.pep
KLENTLLAVKLVSTFLFATPPPTNTKYYSLYANWQASLASTTSLSSEPTVCVGNTKHFLLTAKECTLAHTFLGEVSMGTWMLIMMSYQSVQQTGPSVSWPSLSWASTTGLHSQRTGAASSIRQT

SEQ ID NO: 140633 - protein, 166 aa, Triticum aestivum
  Clone ID: PAT_TA_35051.pep
YDRHNFSKRESFTHKMLDGWGLATDGKIIFGSDGTSKLYQLDPESLEVTKTVTVKYQDNAVSFINELEYINGEVWANVWQTDCIARVSHEDGQVASWIFLHELRQQLWNSGNTAIDVLNGIAWDEEKNRLFVTGKLWPKLYEIKLRPVDGPPDGSVERLCPRASFY

SEQ ID NO: 140634 - protein, 250 aa, Triticum aestivum
  Clone ID: PAT_TA_35052.pep
MNSTLFIIGVIGNIISVLVFVSPIPTFWRIVRSRSTEDFEAAPYVLTLLNTLLWLYYGLTKPDGLLIATVNGFGAVMETIYIVLFLVYAADHAKRVKTAKLVAVLDIGFFGVVFAATTFAIGGLDMKIMVIGLICACLSVFMYGSPLTAVRTVIASRSVEYMPFFLSFFLFLNGGVWATYAILDKDVFLGVPNGIGCFLGGIQLVIYAIYRNSKVGSQSQDTHEASYDASTSLLSSYAGRHGQNDVSTHV

SEQ ID NO: 140635 - protein, 487 aa, Triticum aestivum
  Clone ID: PAT_TA_35053.pep
GRVGGRVGDVAGCDEAKQEIMEFVHFLKNPDKYEALGAKIPKGALLCGPPGTGKTLLAKATAGESGVPFLSISGSDFLEMFVGVGPSRVRGLFQEARECAPSIVFIDEIDAIGRARGRGGYSGGNSERENTLNQLLVEMDGFGTTAGVVVLAGTNRPDILDQALLRPGRFDRQISIDRPDINGREQIFRIYLAKLKLDKEPSFYSQRLAALTPGFAGADIANICNEAALITARRDEKLITMQHFESAIDRVIGGLEKKNTVISKLERRTVAYHESGHAVAGWFLEHAEPLLKVTIVPRGTAALGFAQYVPSENLLMTKEQFFDRTCMTLGGRAAEEVLIGKISTGAQNDLEKVTKMTYEQVAVYGFSEKVGLLSFPQRYDGFGMDKPYSGQTASMIDTEVRELVAKAYNTTTELIRKHKDKVAQVAELLLEKEVLHQDDLVRVLGERPFKPDEPTNYDRFKQGFMDSEDSKSAEVDPSSSVGEAVPT

SEQ ID NO: 140636 - protein, 282 aa, Triticum aestivum
  Clone ID: PAT_TA_35054.pep
ILSNNFIIRQLFESCMKMGLYDSARPLLETYVGAAAKVDMILYTSILAHLVRCQDEDSERAIMNILRVSRHKAHDFMCGLFTGPEQRKKPVLSFVREFFQGIDYENEESAARYFVNVLLNYLVLMGQMNRARCIWKVAYENKLFPKAIVFDQHIAWSLDIRNLSVGAALVSTVHTLHRFRKRMLYYGVVPRRIKLVTGPTLKMVVAQVLASLESPFEVSKVVLRAPGDSVLEWFKKPIVQQFLLNEIPSKSDVLMHKLNVMFPSSAPEARSLALPRSLGMSR

SEQ ID NO: 140637 - protein, 417 aa, Triticum aestivum
  unsure (1)..(417): unsure at all Xaa locations
  Clone ID: PAT_TA_35055.pep
MKIFSLSLTGHATTMALGTTEPLLLQPPEQRRRPPDWLAWGLPAAVLILLLLSASGPLRPPLFRVPPPETVPLTLLAGAQEKGAVCLDGTPPGYHLQRGSGDGSNRWLIHLEGGGWCSTIKDCSNRRMYALGSSNFMKPIRFAGAGILGGDQLQNPDFHTWNFVRPAYCDGPSFSADASACSAQIGSTLHLRGLRFYRAGIDELLEKGLVNATQALLPGCSAGGLXTILHCDDFSARFSRNVSVKXLSNAGFFLDVKDLSGXKSFWSVYDDVVHLQSHFKSIRTPMFILNSAYDSWQIRNVLVPVXSATDKSWSSCKDNIRNCSSTQIKVLDGFRNTMVGAFKVVEYKEDWGLFIDSCFTHCQSLYGISWNSEISPRLGNKSIAEAAGDWYHGRSQGEKEIDCEYPCNPTCSGQLPP

SEQ ID NO: 140638 - protein, 345 aa, Triticum aestivum
  Clone ID: PAT_TA_35056.pep
MVDTSDIPVEGPLGILNSKTNEHHTLEFRNNELFVSELQNTIDKKSKQLDEAESKLSSVMGEVNSLKEELENARVLLDESQINCAHLENCLHEAREEARTNKCSADRRAVEYDALRSSALRIHGLFERLNNCVTAPGMSGFADSLRTLALSLASSVKKDEADSTTQFQQCIKILADKVSFLSRQSEELIERYSRVEAAHGILIKELEEKKTLVNNLYSKFQLEKQASKEKISVGHFDVHELAVFVRNPAGHYEAINRSRSNYYLSEESVALFTEPHLPRQPAYIIGQIVHIERRAVKHTDQNEASPRPGGHRRSALNSNPYGLPAGREYFVVTVAMLPDTAATAR

SEQ ID NO: 140639 - protein, 444 aa, Triticum aestivum
  unsure (1)..(444): unsure at all Xaa locations
  Clone ID: PAT_TA_35057.pep
AILWKGGPEWYLEFPDRSQWSIFKQMHDECYSHNIRAASVKNIPIPGVRLVEGHDDNEVVSFVRPQDYLCHIGPDVEMALDESRLIYDMDSDDEEWISGWRKSQRDKNNTMSELTEDLFEKIMDKFEKFAHTHNCSALTIDQIXELDVDNVPLDITEVIHDHWHDKRQKKGMPLVRHFQPVMWKIYAQQLQEWESAVNRMQGSSNGYQGKRPPSKPALFAFCLKPRGLRLQVSKGPKQRSHKKLMYSGCHSFSREQDGFYRQASGRRNGEYVGDGRTYESYDGGSLNSPTGYSPRFSMRTDSPRTSDASDRGSTPRFRTNSMKRNASFAFSEDHQPSPSFRSQKIRRGGVPDHWNTAIHEYQNSKQAPQSHRVDVEELKLRDATSAAQHAATMARLKREKAHCLMHKADLALHKASVAVMIADAIKASSRDSSRAADSRRDDGR

SEQ ID NO: 140640 - protein, 229 aa, Triticum aestivum
  Clone ID: PAT_TA_35058.pep
VGQDITGQKVVMDKFVNIQGDYKAIVHNPNPLIPPIFASDENICCSEWNTAMEKLTGWSRGEVVGKLLVGEVFGNCCRLKGPDALTKFMIVLHNAIGGQDSERSPFSFFDKNGKYVQALLTANTRSKMDGETIGAFCFLQIASPELQQAFEIQRQQEKKCYARMKELAYICQEIKNPLSGIRFTNSLLEMTDLKDDQRQFLETSAACEKQMSKIVKDASLQSIEDGSVF

SEQ ID NO: 140641 - protein, 418 aa, Triticum aestivum
  Clone ID: PAT_TA_35059.pep
MRPPTRPEDGEEGLEVVTPMVVFVNSKSGGRHGPELKVRLHELISKEQVFHLSSVKPSDFVRYGLGCLERLADQGDNCAKDIRANLRIMVAGGDGTVGWVLGCLQELNKSKREPVPPTGIIPLGTGNDLARSFGWGGSFPFGWRSAVKRYLNKAVSASVVHLDSWQAVIRMPEGEITELPHALKKAEPADQLEFSKASGSELTERASCYKGVFYNYLSIGMDAQVAYGFHHLRDEKPYLAQGPVANKLIYAGYSCTQGWFCTPCTASPQLRGLRNILRLYIKRANCSEWEQIQMPSSVRSLVVLNLYNYGSGRHPWGDLKPDYLEKKGFVEAHSDDGLIEIFGLKEGWHASFVMAELIKAKHIAQAAAIKFEMRGGEWDRAYVQMDGEPWKQPLIQDQSTILEINKVPYHSRMINGDS

SEQ ID NO: 140642 - protein, 275 aa, Triticum aestivum
  Clone ID: PAT_TA_35060.pep
CVGFGGFGATYRAEVAPGVLVAVKRLSIGRQHGNKQFQAEVETLGRRHHPNLVTLMGYHISDQETFLIYNYLPGGNLERFIQERAKRQIGWRVLHKIALDIAHALAFMHDECSPRILHRDVKPSNILLDNDFNAYLSDFGLAKLLRNSQTHTTTSVAGTFGYVAPEYATTCRVSDKADVYSYGVLLLELISDKKVLDPSFSPYGNGFNIISWANKLIQSGRVCEFFVEGLWNKAPHDDLVEIMKLGVLCTVESLSSRPKMKHVVRRLRELRPPSY

SEQ ID NO: 140643 - protein, 394 aa, Triticum aestivum
  unsure (1)..(394): unsure at all Xaa locations
  Clone ID: PAT_TA_35061.pep
PPCELIGSLSVNGAKTAKVNYGANGWVSHQVTDLWAKTSPDAGDPSWALRPLGGPWLATHLWEHYSFTMDREFLERTAYPLLEGSASFLLSWLIEGQEGYLETNPSTSPEHYFIAADGKKASVSYSTTMDMSIIREVFSAVLLSADILGKSSSVVARRLXAAPPARPPKKIGRDGTIMVCALXVRTPSLSTGMYLISLVFILDIPXHLSKHLTSAKLLPILFIKEVTKALGGLLHGRWPCGLIFTTSKHAYKMILQLITLIDPKHEHEKEGGLYSNLFTAHPPFQIDANFGFPAALCEMLVQSTGSDLYLLPALPRDKWPHGSVKGLRARGGLTVNICWKEGSLHEALVWSGSSGNSPALARIHYGDHAAVISASPGQVYRFNSELKCLETWQL

SEQ ID NO: 140644 - protein, 147 aa, Triticum aestivum
  Clone ID: PAT_TA_35062.pep
IPGSTPPLYVEQLKVDPLESSVVALPPLPPLEPSQMLDSEKGDSDVAMSCSSVSIGQVVPVGDMVVAPRALARVPGALIAKEICHFLATLDAANPGSGKTIGCLLKEKAIRDKKSGGASSRPVVLKEKSNKCRTKKSGAIEKASVIA

SEQ ID NO: 140645 - protein, 120 aa, Triticum aestivum
  unsure (1)..(120): unsure at all Xaa locations
  Clone ID: PAT_TA_35063.pep
MAGHAAVRSCVQTALKAANSLVGLAGMAVILYALWVLRAWSQQEFTSDXRGRGRGTLLSLGIIMCLLTCSGRIAAEAANSPXLSCHVIFVFLLVILEAAIAVDVFLNSYWEEDKSHQTWL

SEQ ID NO: 140646 - protein, 475 aa, Triticum aestivum
  Clone ID: PAT_TA_35064.pep
SARGLDTILALIGEQFEYDNEICGAILSVRAKQETIAIWIKDATNEAAQLSIGKQWKEILEYKDSIEFIVHDSDATAVQCWSSTFPDDPLDVIYNKVPSHCSRVRFAAVCRSWCTAASRHPALPELPWLLLSPRDRDTTKRLYCPEDSKNLRISLPSDFISNWFVGCHGGGWVASFEPPPFRILNIFSSVEVALSEKQKGIVCPGRLGQIIIWKIIFSKPPTSSDCIIAAITDNHGIALCRVGSPNGGWTTKGDVSYTMELADIAFCNGELYGLTRDRWELVKFVIGVDEDGAPLVTAVDRLVVTPEHQQPPSVWANRVDASYIFELHGKLATAVRSPWSPNLRPFFKVFELVDIEASEGMAHGAHKWAEVMSLGDFALFLGPNSSKAVHVSADRRGGVKRNHIYYSYHRRLAQKEVLLSTDLVFLTSSNADGDSVYYREDESLSAAVGGVHRIGAVGYYVRGSPNPPLWLLPQA

SEQ ID NO: 140647 - protein, 159 aa, Triticum aestivum
  unsure (1)..(159): unsure at all Xaa locations
  Clone ID: PAT_TA_35065.pep
MWRAAVLLCFILQGATVAADNETWGYVEIRHKAHLFWWYYKSPXRMSSPVKPWPTTVWLAGGPGGSGVARGNFCRIGPLDVNLKPHNSTWLQKADLIFVDLPVGVGYSYVEDPSVLATTDVQVASDATELLKALTKEIPTLHSSPLFLVGESYGGKLAA

SEQ ID NO: 140648 - protein, 58 aa, Triticum aestivum
  Clone ID: PAT_TA_35066.pep
TPSGFDLKSGLLNLHKNRPEQVIRATTPLQIFQRSSKRKTFYFQIKVKMAPAGSDWVF

SEQ ID NO: 140649 - protein, 119 aa, Triticum aestivum
  unsure (1)..(119): unsure at all Xaa locations
  Clone ID: PAT_TA_35067.pep
MASAAVIPSPAGXAVPVHGAAEPAGWLMDERDGFISWLRGEFAAANAIIDLLVVHLRAVGDPGEYDHVFAAVQQRRHHWAPVIHMQQFFPVADVAYALQQSGWRRRQPPPHQHGPVVSP

SEQ ID NO: 140650 - protein, 486 aa, Triticum aestivum
  unsure (1)..(486): unsure at all Xaa locations
  Clone ID: PAT_TA_35068.pep
GTRDVLSEMLNAIDPGNREGLSRELIGHLVPQCRSFVLWAALPVHTPADLQLLSLGPSLDDGLPRVLPFRHAVAAGXSGPGCFAKSPSGPGXASPPAWPAGPRQPAQRSSEAAGKVSPFQQLALPAPPSSSTSKPPGEASVGPSIDLLSGDDYFKPEPVNSQALVPVGNSPAASASGHNTLDLVDMFSQSDASNNNHNPVISSPILNSNPNLSAPQAYPAPQHPVPPQQSSFSNGLTSNTIPTYGQGSDLNSASSWNGQLAQGMNQPQQAPNYGQDDQSSDLPPPPWETQPAESDQFQAGQPDRLAMPPGQFGGIPPQPVQVGQPGQVSLSQPLLTGQPGGMQFPPGYVEQPGAQHPQSMPNTQYGGMYPSMQGNQAGGMYPQQMAGDIYQQQMYGGQMAAGYGYGQQPGGYYVPNAAYGYPSANDLSQRMNGLAMQNNGLYGTPASSSLQQANRPARPEDSLFGDLVSIAKTKPSKTAANKAGGL

SEQ ID NO: 140651 - protein, 112 aa, Triticum aestivum
  Clone ID: PAT_TA_35069.pep
RDGRRADRGDRQPGPKLGKAKGSRLGWRATGHRAIRCQLQVCHLGSRKGHRCLSAFRPGGRSRGRSMGGREPEPGKIHGRRWYMALPIHVVGCAHLSAGQPERRRSAPWDLG

SEQ ID NO: 140652 - protein, 153 aa, Triticum aestivum
  unsure (1)..(153): unsure at all Xaa locations
  Clone ID: PAT_TA_35070.pep
IXKGYTXDLXRRLSRAXXAHEIXPRXTKTRVTVTRRARGGGVPGARLRRRMAGDAGPPSPSSSGYASERGNSVTSSTSATCGIEDPDPAPPLAPGAEDWRAARSTLTRSCSSALLLVLPPEPRARVPSQYEEWQQPVEVVGWLQTVRGRQVLQ

SEQ ID NO: 140653 - protein, 206 aa, Triticum aestivum
  unsure (1)..(206): unsure at all Xaa locations
  Clone ID: PAT_TA_35071.pep
MGPVGGRGIMGNGGMVAPPPPMMHPGGMMGQGFDPTGYGAAMGRMGGGFGGFPGGPGGAPFPGLMQPFPPVVAPHVNPAFFGRGGGMGAGGVGMWPDPSMGGGWGGEEQSSYGDDAASDQQYGEGGSHGKERPPEREWSGAPERRREREKDLPPPPELPERRHRDERDMGRERERERDREEXRERERDRGDRERERDRGDRDRHRD

SEQ ID NO: 140654 - protein, 232 aa, Triticum aestivum
  Clone ID: PAT_TA_35072.pep
EFGTRPPLLAAPAAAFIQHRRPAPAATSPEDHGPPPRPLSFRWDSSPPFPALPSLHPPPAAPPPCRPTLSPAVAPGLGDELPPPHLPPALSYSRHPSSHPPHPVSTRRTRSAPLLRAVPPPPPPSEPGLGVRWSRKEDVERGVLGGRAHGAGVHGGFARAAQGQVPATEQQNAGVPRWRPRHQAPAPSQATLPSSGRMPWRPRPQAPAPASPSYAAPPLIRINFKGFYAKQP

SEQ ID NO: 140655 - protein, 101 aa, Triticum aestivum
  Clone ID: PAT_TA_35073.pep
CYMLASGRTMLVYFPLIFSIGACFLYLFYLTYRNVPLLWLDGCSSCKHWMHTENSSNFATLKTPVRSHRIFCRITNDFRLKRTMRCKNDYFGRAPMEDSCN

SEQ ID NO: 140656 - protein, 72 aa, Triticum aestivum
  Clone ID: PAT_TA_35074.pep
NTVIGSQIQMSKHDQKYLNSVQFLSTKLLKLQQYYSFCLNKFFLNGIHSFLMPPLSSPNFSWPCVVAIAANF

SEQ ID NO: 140657 - protein, 154 aa, Triticum aestivum
  Clone ID: PAT_TA_35075.pep
MVKAVSVLRGDSKVSGTVVFEQESESAPTTITWDITGNDPNAKRGFHIHTFGDNTNGCTSAGPHFNPHNKTHGAPSDETRHVGDLGNVETDGQGNAKGSVTDSLIKLIGPHSVIGRTVVIHAGTDDLGKGDGEESLKTGNAGPRPACGVIGISN

SEQ ID NO: 140658 - protein, 337 aa, Triticum aestivum
  unsure (1)..(337): unsure at all Xaa locations
  Clone ID: PAT_TA_35076.pep
RTHCRPQAPRTNPRIPLFYAHASRNSSLLKEDFTCVSKVAXDSLGSDNAKVKPAXSSNPGVPPSSLMSFMTKNTSTSGVVLEDFDSQFSNRFYHSHLDSPANINSSSIAAAAALAARSLYILATGDMTVDLMTLNTIKVNVTLVEELIGCLLTCDPGLSCGIAKSFISPSNACPSHYVGVFQDSPSSTQFPSYADDTSRFIWNFLADRTSTLASNVSSCTGKCNNESEVCVGGEVEGGGRCVVSTTRYAPAYSTRLKFEDNAWHVLPANSSDPMGAADPIWTESYWNTISLRVYAVQSTTSDRLILLAGLAVTAASYLGGGRRQSVHLEDHEARLKT

SEQ ID NO: 140659 - protein, 165 aa, Triticum aestivum
  Clone ID: PAT_TA_35077.pep
RAIQIYRDPPLASIFLMNNGKYVIHKVNDSELGVLLGDDWMKQMLSRVRRWSMEYQRGAWAKVMSVLQTGGSGFSGLPPKAMLQKLQMFNGYLEEIRAAQSEWVITDDQLRADVKAAIADSVLPAYKGLIARLRSSPDAPQDLFIKHTPEDVEACIQHLFEGIGK

SEQ ID NO: 140660 - protein, 151 aa, Triticum aestivum
  Clone ID: PAT_TA_35078.pep
MSGDEVAKAKAAAAGGGGVGEYGTFHGPPSYPPPRPPVGHPQPAPPPGLHGQREPNSRHRGGYQAGNAQDYEAGARGHKHDRLPCFGIGMGWFLFVLGFFLGAIPWYVGAFLLWCSRVDYREKPGYVACTIAAVLATIAVIIGATAGAHVY

SEQ ID NO: 140661 - protein, 167 aa, Triticum aestivum
  unsure (1)..(167): unsure at all Xaa locations
  Clone ID: PAT_TA_35079.pep
GVGQSEILGRXHVAAIKIGKAFYPCSFTVLDAPNMEFLFGLDMLRKHQCIIDLKDNVLRVGGGEVSVPFLHEKDIPSHIRDGEKSSNLASSSQGAAGESSKARGKTPDVPPPSSPAGAPAVIPPQGGDFEAKVIKLVELGFDRASVIQALQLCNGNEDQAAGYLFGG

SEQ ID NO: 140662 - protein, 82 aa, Triticum aestivum
  Clone ID: PAT_TA_35080.pep
TMIRHTIAPSNYCDIIVLFSLTNYVLWCCTFFSLLSKTYSAWGSCLLAMSFRRIISRYTFRNYECNACNLPILCRTLFVTYL

SEQ ID NO: 140663 - protein, 69 aa, Triticum aestivum
  Clone ID: PAT_TA_35081.pep
ALFAMLWHKKADINYYVCTINKIFAKPGQRMYFQVHYMEENLLEYIDLHDDTLIARLIDGIYSPNVALC

SEQ ID NO: 140664 - protein, 402 aa, Triticum aestivum
  unsure (1)..(402): unsure at all Xaa locations
  Clone ID: PAT_TA_35082.pep
GLVDTMDLDVKPSVLNSESSSGVHLGGHDNGHKASPLYPVQVQHAADIDNDEKSTRCVLPSTSGSKGGYLSYKGDCRTRRLLSTRMRKAARNKMCGELPNKGSKFCGKKISATRRRAQMQRMLKTKKVVECYSAQPSDEGVLTETSGTSCSRGGQDPTCASESSQRKPCASEGCNVKFIIKSFNIPELSIEVPENSTVGSLKRIVMDAVTSKIEGSLSVSVLLQGKIIQDDNKTLHQAGICHGAKPDSIGFTLECEAKQDSRPSGLAPEEMDSAGPSVVNPLSKIKFEQPFISCTLGDYPYEGAAQVRSEICQAIVPYGTSNPDALAIVPVVPRSRQRDFGQRRKRRPFSVAEVXVLVEAVEXLGFGRWKNVKTNAFRDMRRGPYVXQDSWKNLLHTRASAA

SEQ ID NO: 140665 - protein, 902 aa, Triticum aestivum
  unsure (1)..(902): unsure at all Xaa locations
  Clone ID: PAT_TA_35083.pep
MTMTTTMTIPRYPSRGRQPARPPPSKAWTSPHPRPPGSGQPNSALARRQKEWAVDGGILSRPRLKGDKSDDSDDDKPLALRKKPDTKLKKVVTGGENAYGSEDDHKPLGMNINSAKVASNNSTNKTVLLKTAPLKTLQPDDDSDDDHKPLVQRFNPAKGASNNSTSKPVLFKAAPKIVQSDDDSEDEKPLASRLPTNAAPKSRASTSDSEDEKPLSARFSRGTAGTSASISNSKDKLPSNNKGPSINSSAPRNSVKRPSDNNNQTSSALKKAKSSDASASGSVKRESKDDDNNSVPVERKLTPGESSKSKPPVKNIVKKSPLSVKKDNKTFKTKTKKTMKSSQFSKSLXVPPGSGGGKKWSTLEHNGVIFPPPYNPHGVKMLYNGQPVELTPEEEEVATMFAVMKDTEYAAKKTFIVRSRVRWKKILGKNHIIKKFELCDFTPIYEWHLREKEKKKQMTSEEKKALREEKLKQEEKYMWAVVDGVREKVGNFRVEPPGLFRGRGEHPKMGKLKRRIRPSDITINIGKGTAVPECPIEGESWKEVKHDNTVTWLAFWNDPISQKDFKYVFLAASSSLKGQSDKEKYEKSRKLKDHIHNIRVNYTKDFKSNDVSKKQIAVATYLIDKLALRAGNEKDDDEADTVGCCTLKVDNVTCVPPNKLQFDFLGKDSIRYFNTVEVELPVYNAIEEFRXGKKTGDPVFDKLDTTKLIHHLKDLMPGLTAKVFRTYNASITLDAILHEETEDGTLLEKIAVYQRANKEVAIICNHQRAVSKSHDTQMTKLNEKIDELKAQIDELNKDLGKVKRGKPLGNGADGKPKRTLAPEAIEKKISQIETKIEKMEMDKKTKEDLKTVALGTSKINYLDPRITVAWCKTHEVPIEKIFSKTILAKFGWAMDVEPDFRF

SEQ ID NO: 140666 - protein, 128 aa, Triticum aestivum
  Clone ID: PAT_TA_35084.pep
KFKRDSIAFHLSALLNLVFPRSWHGPIFKHTISRAEWFDWYLCPRSLFLHEIRIIETLGLVETPYPSFLLFQAFVADRQSHITKQRTYTLRASFGASICSRIVGVLHITTIAMTVVSRFNHAETAARQ

SEQ ID NO: 140667 - protein, 387 aa, Triticum aestivum
  Clone ID: PAT_TA_35085.pep
FGDKYFDPEEWLRGLSAMAAVFRDTKNVVGMSLRNELRGPYQKLGACFRYMQQGAEAVHAANPNVLVILSGLDFDNSLSFLSPKQVKLSFTGKLVFEQHWYGFSDGTDWENWNQNDACGVAVESIRTKGLFLLQQGWPLFFSEIGFDMSGTHIADNRYLTCFLSVAAEMDLDWAVWALEGSYYIREGILAYDETYGLLTWDWYTARNPSFIERINSLQSPFQGPGLPSSHKPYKVIFHPLTGLCVLVESANVLKLGPCDESNAWNYTSAYELVLKHTGQCLEAKSVGDTAKLGAGCSKSCSKWQLISDSGMHVSAELTKNGTRVCLEAGPDGVITTDECKCLTEDPTCDPESQWFKVISSSRGIPGEASVLRLPSLGPWPPTSSSSR

SEQ ID NO: 140668 - protein, 238 aa, Triticum aestivum
  unsure (1)..(238): unsure at all Xaa locations
  Clone ID: PAT_TA_35086.pep
PRPTPGEDRRAHFEAYGDILEAVVITDRATGRSKGYGFVTFRDPDSARMACMDPYPVIDGRRANCNLAILGRPGPAVPFGPIRPVIPYNGGAAVPGGMYVPSPTYQQPPYNYSQALVYPPYGPSTYGPEYLYPQLARXAYGPYVGQQYVPVYGGPRTVGPAVYPYGQFGQPVPSDHSYSPGYVPGHLLPLSNQNAANARASAVQQQYPPGAPRPQQQLLLPARVQQFPPNNVSEQMSG

SEQ ID NO: 140669 - protein, 212 aa, Triticum aestivum
  Clone ID: PAT_TA_35087.pep
GAPPAATSFIGNLPSLVISTSHEADGGVICPVCKDPMPIRTRAKQLPCMHLYHSSCILPWLSSRNTCPVCRYELPTDDPESERSERAATNERDVLGVEEHTHLQEIGEEGSDEPEVEETQDMFNDAVEVTNTSEHGVHVAEQSNRARNHRRWLFIAVAPAVSFVGLALVLCFANPTSSGRRRLCRGSQSASAALVDQKEVGGPCSRYPVHVY

SEQ ID NO: 140670 - protein, 117 aa, Triticum aestivum
  Clone ID: PAT_TA_35088.pep
WALSPSGRAAPSHPPSAGPSAPPHGPPGGPSPLAPTPPRASPPAQPKAAQSLATTRTDQYSSRVFRLMGGSGPPAAPLGPRGLLRRYQGIRSSEVKLGIGRALFYSAARTCPQGLSS

SEQ ID NO: 140671 - protein, 150 aa, Triticum aestivum
  unsure (1)..(150): unsure at all Xaa locations
  Clone ID: PAT_TA_35089.pep
EPGNYWYHVCEGEAERVLPPPRHAIRLAPSLMSIVDDIISSMQQDFDSVHXVGGSVGDLIQRIEDGVDVRRQVYIAGEGINTVSMEVLKAKYNNLRYLDEFQRLWRKDSKWFLEMKRLNGGVPVKFDGYMRELVDREVFLKGKKKVEVLH

SEQ ID NO: 140672 - protein, 360 aa, Triticum aestivum
  Clone ID: PAT_TA_35090.pep
RNSARGEGDPELWNTIAGDGSEDDEEGVRTLDDDNFIDDTGVDPADRYDNDNDGHSPRRFAQAEEAEEDDEIERLFKGGKKKKKNDRPRADIGLIVEQFIAEFEVASEEDANLNRQHKPAINKLMKLPLLIEVLSKKNLQQEFLDHGILTLLKNWLEPLPDGSMPNMNIRSAVLKLLSDFPIDLEQFDRREQLKKSGLGKVIMFLSKSDEETTSNRKLAKELVDKWSRPIFQKSTRFEDMRAYDGERAPYRRPQMKKPSSSSSGMESRDDDLDADFSQRKSGQSGSRQHASRPEASPLDFVIRPQSKIDPEQIRARAKQQVQDQRRLKMNKKLQQLKAPKKKNLQASKLSVEGRGMVKYL

SEQ ID NO: 140673 - protein, 310 aa, Triticum aestivum
  Clone ID: PAT_TA_35091.pep
RSPNPSSDPPSHPSSLIPISSPPPPPPPRPLHHSSSPTSPPPPLPRPLHHSLIPPPAPSPAIPGHPSQSLLSLGSVRWDPLPQPPLHPHRQRPMPPPHTTAPSPHLGPKSGSARRRFQTAMAATLPTPIWIHGALLPPSGSMAAASPMDPAPAGDEGCQIRDLGRSSCRIREQHTAPCSRRSGTSAAARGSRRQTPALLCSIDLDGCYSAKDAAYRRCSTLAHVWWRLRRSGTSCGGSRDGGGVRRWPPALRAGLGGVSAGSPARFTGRARSAAWVWAVNHKLFRWSLRDMGARSLSPWAKEARLRGGVL

SEQ ID NO: 140674 - protein, 311 aa, Triticum aestivum
  unsure (1)..(311): unsure at all Xaa locations
  Clone ID: PAT_TA_35092.pep
PTPHAGGRRIENANILVFYTAMDTXKVKIYGGRVRVGSMAAFKDIEALEKQKMRETTEKIIGGVINCFVNRQLIYNFPEELFADAGILXAVEHADLQAFQPLALVSGRACAAAFDNPESVKLGHCKLIEEIMIGEDRLIHFSGVAMGQACTIVLRGASEHVLDEAERSLHDALCVLSQTVTDTRVIYGGGWPEMVMSKEVDELARKTPGKKSHAIDAFSRALQAIPTIIADNAGLDSAELISQLRAEHHKENSTAGIDVISGGLGDMQKRGICEAFKVKQAIVLSATEAAEMILRVDEIITCAPRRREDRM

SEQ ID NO: 140675 - protein, 144 aa, Triticum aestivum
  Clone ID: PAT_TA_35093.pep
GSWARVLSKGRISMGFWFYLSACFIISGESWLLLGGSAGSCGDVKVEGDLPKPLLEGDTKADGDMSKLLLGGGDTRAEGGMEGLVEEWLVGEGTEQRQNFHGLLVLFKCMLYNIRGKVSYPRIFCWKLSFVWVLVVSPERDVWL

SEQ ID NO: 140676 - protein, 179 aa, Triticum aestivum
  Clone ID: PAT_TA_35094.pep
LTSFRFTVHLSNNPYCRDTACVDSVTRLFVDRQRITDELGHALCLPLRLLQAGPVPRNTSSCVRRRAPARAPGRGPGTRARARGPRTRPRRAARTAAPRPPPRPRRAAARPRAPPAAAPPPAPARRSGAAAAAPPSPPRPPPAPPRPSCRPSSPRPGPRRRWRWTAPWTEIEERGARER

SEQ ID NO: 140677 - protein, 125 aa, Triticum aestivum
  Clone ID: PAT_TA_35095.pep
PVKQRLGRSRRGGGPDEPGEQISRQAGPAAPPSPPCSFYEQEQGSPSRRSPDGKGPPRSSSRLRAWPPRSSSHLPAPPAAPSTPRPPPPLAYSWRRAPRLSTRTGGPLLLPPPSDARRGREGLFP

SEQ ID NO: 140678 - protein, 258 aa, Triticum aestivum
  Clone ID: PAT_TA_35096.pep
MGEVEGALTSCGVGPTAEAAEQVLKSETCYSRPKSAVRFFRWAKASVQLTPLAWNLLVDILGKAAMFDPMWDAVLSMSQEGGLLSVATFASMFASYCARGNFKEAAMAFDVMERHGVTPDAVALNSLLAAMCRRDGGGQAAWELFERYKTTVAPDADTFAILLEAWEKEGNVQRAKSTFGEMVVRVGWDASNMPAYDAFLSTLVRGDQFNEALKFLQVMRTKGCLPLKFFANAIDLVVRKGDHANAIAIWQIMVSDAG

SEQ ID NO: 140679 - protein, 115 aa, Triticum aestivum
  Clone ID: PAT_TA_35097.pep
GLTVWTAQWYLLRFEYARTGSFTGFKLEGCSSVYAVTLTQNTFSTACFLTQLIAFNFCEPILPAFGDWNAGEDGGSWKQAIKAPFWILISLVFWNFLQITSKIPIPCRCVPRRQW

SEQ ID NO: 140680 - protein, 359 aa, Triticum aestivum
  unsure (1)..(359): unsure at all Xaa locations
  Clone ID: PAT_TA_35098.pep
AGQAAHPSASCSPSLLLFPFAPGRRRRRARSEPSPSSGCSKQGRMSRRWSRTIYVGNLPGDIREREVEDLFYKYGRIVEIDLKVPPRPPGFAFVEFEDPRDAEDAIHGRDGYNFDGNRLRVELAHGGRANSSSLPNSYGGGGRRGGVSRHTEYRVLVTGLPSSASWQDLKDHMRKAGDVCFSEVYREGGGTIGIVDYTNYDDMKYAIRKLDDTEFKNAFSRAPIRVKEYAGKSSRSYSRSRSRSRSGSYSRSPSPKKKPSRRSASRSRSRSVSSHSRSPSKERSPSRSPAKSRSPVAASPVVNGEAVXPRGIQARAHHVPGLLMPNQSKTDARLGAVRGGAMVFKFFIFCLRRLLHPLL

SEQ ID NO: 140681 - protein, 179 aa, Triticum aestivum
  unsure (1)..(179): unsure at all Xaa locations
  Clone ID: PAT_TA_35099.pep
MASFPSVSVARARPRPFLLLAAAVVAVAVLARGAHAQLSAGFYSASCPTVHGAVRQVMSQAVINDTRTGAAILRLFFHDCFVNGCDASLLLDDTATTPGEKSSGPNAGGSTFGFDVIDNIKTQVEAACPGTVSCADILALAARDSVNLLGGPSWAVPLGRRDAXXPDPXXXRTLPGPDL

SEQ ID NO: 140682 - protein, 214 aa, Triticum aestivum
  Clone ID: PAT_TA_35100.pep
RRRRARPAPPPARRRTRATSSTRRRAGSWMLLTGCCCWSGSPRTTSSTAASWSSSPTGPRKGRSSAGASAASAGSSATRRTSPPMTTTTTTCWMTTSMKTSNSNQLTRRRARPAGGLRRPRPRREVPQRRPGGGPEQLRDRRGGVRGAGRRRQGAAAGVVRRELPAIRLQAGVRHQQVPGRIAVLPGLRRHRRDPPLPGGRRRLQRRRRRRHAG

SEQ ID NO: 140683 - protein, 174 aa, Triticum aestivum
  Clone ID: PAT_TA_35101.pep
MASNQDQASFRAGEAKGHTQEKAGQVMGAAKDKAYEAKDRAAGLAGHASGQGQGATEATKHKAGEATDRASQTAQAAKDRAAGTAQAAKDKTNETAQAAKDKAAGTTQAAKDRTVEGKDQTGSFLGEKTEMAKQKADETAQYTQDRTYDAAQYAKESAVVGMDKTGSVLQQAGE

SEQ ID NO: 140684 - protein, 197 aa, Triticum aestivum
  Clone ID: PAT_TA_35102.pep
DVRGLRAVALSSVGCGQLGCAALLLEGSGGMSGRRPRKAVPVDCAGRDGAVDVGAAAPEKSLWQPDFCGNDDGGSDVGDAAMVAVVGSSPACPRYCLGLFVAVESKLRWRGPVVYDDWLQVARSVIFRGASRAWFCSSEFSVRVGAALSGCRLTCCPIGWALPNVFQSRGVGLALVVPVFAQFSVINWAILFCLINR

SEQ ID NO: 140685 - protein, 76 aa, Triticum aestivum
  Clone ID: PAT_TA_35103.pep
KYYHQHWSVSRFRHVYRSIGTARLMTTLINCKSQCQITPGISAFACTLIEVCPSLQHTVATRTRRAIVITFRYQNP

SEQ ID NO: 140686 - protein, 312 aa, Triticum aestivum
  unsure (1)..(312): unsure at all Xaa locations
  Clone ID: PAT_TA_35104.pep
TIILPSRCKALRGQSIPSCSVCSCCRLRSLPPCCPWRRAAPGSAPRGGRCFRFAAAWLPLLPSHSTDLQQRAYEVQALLGLDKQAVESVMPIDASCEDIEVDKNLTFLNSYVQQALENGATPYIPESERSGVVSVGNYRAQDQHETSAHALRFEAYELPKPSLPTATSQSSVSLPTTDRFARVDGQTCLRVNFPVAXFVPVPEPSHYREDHHQARSQQSGNAVSGEFGAKLRLDGVQKKWGRESYASSSTPSSSTSSQQAANGGSNSDGGRGXVTSQARXESSYGSKSQQQXTEVSAEKQRLAAYFFWVLSC

SEQ ID NO: 140687 - protein, 428 aa, Triticum aestivum
  unsure (1)..(428): unsure at all Xaa locations
  Clone ID: PAT_TA_35105.pep
QQVVNSQSDPQQCVQGATQTVGFHNSNTIQYATQQKAQSHQPIEDSPRGTIPVAKSDIVTSMGASSLNGTGRMQSVRTDNVPSSSTSPSTTTNHVLLQSIPSSSKNQSLPTAAKTSQSSVVLGPTIEQEMKSYQSVKPTIMVPKMIEQGPATERDYINNPHMDYLDTSSSATSVCLSQADGSLQQNFPSSCFDTHQLLRDTAPDSEFEISDPTNNVLFGVNIDGQLGLPLNADALIANSIENDKFMDEMAGNGISNYISSKDSQQELSSSMISHSLGVADMGFNSIDSAINDPSFLNRNSRAPAPAHQRMRTYTKVHKXRGAVGRSIDMNRYSGYDELXKHDIARMFGIEGQLXGDQSRVGWKLVYEDHEKDVLLVGDDPWEDFLNCVRCIRILSPQEEMQMRLVGDFGDAFXTPTRPAASSDGGQPW

SEQ ID NO: 140688 - protein, 135 aa, Triticum aestivum
  Clone ID: PAT_TA_35106.pep
TGIPAAYLISSRAAPRWFASFHDNARRNWPVSIGGRVKPSSSLALSSPSFSVLTTQVTLEKRRQGIEGEKEGRSMANRASPPSPFAGDARRRRCQRCPPPGPPPPLPKMPATRPARLRFGRIPYSSTPARRPGGG

SEQ ID NO: 140689 - protein, 292 aa, Triticum aestivum
  unsure (1)..(292): unsure at all Xaa locations
  Clone ID: PAT_TA_35107.pep
TLFTCFLILVASLYTVQRNFSGRLELALAVVVFGLVFTFGDFLPSGSVSPSNESTVVNKQLSEEERTNYKRALEGYEETLTKSPNDPTALEGAAVSLVELGEYQKASDLLEKLVKVIPDKAEAYRLLGEVKFELKXYDGSSSSYRNSLSSSDSIDFDVLRGLTNSLVAAKKPDQAVEVILSCRRKLSEKRQTRQPDLEAANENGAQESRDIDPIQVDLLLGKAYSDWGHISDAVTVYDNLITEHPEDFRGYLAKGAILKQNGKAGDAERMFIQAKFFAPEAAKALVDIYAQR

SEQ ID NO: 140690 - protein, 52 aa, Triticum aestivum
  Clone ID: PAT_TA_35108.pep
PAAMVAPAAAAKAKQGHVREWYHSDSDSDVFAVPEITSPPAKRARPSSFWCL

SEQ ID NO: 140691 - protein, 535 aa, Triticum aestivum
  unsure (1)..(535): unsure at all Xaa locations
  Clone ID: PAT_TA_35109.pep
RRGEKPSARLRRTRHDGGDSPELRRQAPLLYVPGPPAPPPPPPLPRKRPKAEPPASPTSSAPGKGRGRIRKAAAATRSAGLADDALTPAIKDQGGDKRAAAAAAESSRRRKETPPQQHAAPWAKLLSQCSQSPHLPISVPQFSVGQSKRCNLLLKDQSVSEILCKLRHVEQGGPCELEVIGDKGVVLLNGRAVNPGMKVPLTGGDEVVFSSCGKHAYIFQHPLNDKVAKAVTSSAVGLLEPPVAGVKHIHMENRTEVTSTVAGTEMLASVSSQSKDLPAVPPASAEEENQRVVQPIISSASDKSKGHCISPDKECENGENTNEANSNIEDSPMDVAATPISPDAVANDTSRQNGFGSDAHLDEIGKIATYKIRPVLRMIAGSTVSEFDLTGDLXKLLKDQRDLIRDLNTSAKLTSXRCQAFKDAMKQGVISPSDIEVTFENFPYYLSENTKNVLLSCAFLHLEXRNSLKQFSRNFINKXQRILLSGPSGSEIYQXNIXKRXFAKHFGGXDYLLLVHSLXPGXALSXXPRNPXKML

SEQ ID NO: 140692 - protein, 402 aa, Triticum aestivum
  unsure (1)..(402): unsure at all Xaa locations
  Clone ID: PAT_TA_35110.pep
EKPGALGSYAPPGMGRQRPSGPDTMLTQHMLHPPVPCTQAQKNQMRPPSHSFPENVRPTVQQQLYGVYQSEMAPRVFAPNLPRPAPTIPDDGMIRPPMAGPLPGLHDTTMPPFAPENVGRPHPVGMRNGVGGEQLGNSRAFHEEGFNTSREHFRSLGPPYPGRYNVNPKDIEENMKQFPGPTHLDDDSFQRGPRPFDGFDSLPGRPPFPNKPGPYPIGFPEDLSRKPHSIVGHPDFVSPGAEFGHHRVDGMPRNPGSFVQGMTAGPGGLRKDQLGPGNLPGSRQHDFDNLGFPHTHFHPADIFLPRNLHGSEPLGHGQLHGIEPSGHRFQGHVHPDDPNFDDYSRHGFPQESGRFSSGGFFSSGXVGWCRDIMFNCAECXRLGHMSYXENITAXMDNVXKXT

SEQ ID NO: 140693 - protein, 133 aa, Triticum aestivum
  Clone ID: PAT_TA_35111.pep
ETRARVRVLDATDGVSSRIVLISATEETQAELAPAMDAAVRIFKHVNDIEGINPDVTLSASAPEICCARLMVPKAQAVHLIGKQGTMIKLIQETTGATMRIIDQGTRLYIFMLTIMRCISSLIHRITGHFYYL

SEQ ID NO: 140694 - protein, 147 aa, Triticum aestivum
  Clone ID: PAT_TA_35112.pep
QATAPFLASLGPSLPPMGSQHPTDQLVGGGGSRGGGIWNQQPIKPSVCRKMMMLTSIQYLFVKLRHWSVVPVVIPGVQNQNFRRSPPGHRSTFKDSAPPPLGSSHRWVRPYPLRFPSAQRTNCSEEAAPVEVESGTSDRTNPRSVPR

SEQ ID NO: 140695 - protein, 188 aa, Triticum aestivum
  unsure (1)..(188): unsure at all Xaa locations
  Clone ID: PAT_TA_35113.pep
MCRQPSTLELSPDEQLAAEETFKLYCKPVELCNVIQKRALDNPAFLQRCLHYMIQASRKKRIQLTVSLSRGTNTDHNIFPLYVLLATPTSDSIPLEGHSPIYRFSRACLLTSFTEFASKDHNKATFTIPDVKNIATSRACNLSIILXXCVSDSEGQVGENNCSXDHVEASALRKLEGKCFWGKIPINL

SEQ ID NO: 140696 - protein, 166 aa, Triticum aestivum
  Clone ID: PAT_TA_35114.pep
LRNRLPRILRASPCATHLRLLSHLLPAAAEQRTLAIDDSCGRQRVPVSDREAATSPGLLPEVPDLERRGQPPLHTQRGDGVDRVAVMSELEAEMAELGLERSRDDGFKGWSAHGMEVLRLEAGEDALRSWRWRRGWEEAWSCSASVLSTCKVVCSTTHRRFCQYAR

SEQ ID NO: 140697 - protein, 76 aa, Triticum aestivum
  unsure (1)..(76): unsure at all Xaa locations
  Clone ID: PAT_TA_35115.pep
ELVXSFFFFFFFFFFFFLXFAYTSVLRKREGVGIXRTKFVKQTNPRFGKVRRTNNSFRRVSSIDAGFRYFNCRFEY

SEQ ID NO: 140698 - protein, 328 aa, Triticum aestivum
  unsure (1)..(328): unsure at all Xaa locations
  Clone ID: PAT_TA_35116.pep
KVFPEAAAVAHGPMQNDVADLPSDDSEDDDFDPNIPEEHVAGHAEGSSEEDGDEGSDSDDSNFMTSSDNSEHVKEKVKVDDLGLPSEDSEDDDYDPAGPDSDKDIEEKQDESDFTSDSDEFCAEITKSCSKDEVSSGPKVGGRTNDLEGAPVRPNTSMSHSKDLEIDPDVILPSTKRQVQRLDYKKLYDDTYGEAPSESSDGDEWSGKSTLKEDNEERNEVDSFARKSSRGTRAVHPDGFHGLVNDQHAGGLTSAGSNSKAXKGHFGPVINERLNQYFTTDQYPSRAVKESLAQELGLTFHQVNKWFESTRHARAAAMKNGTQARKQS

SEQ ID NO: 140699 - protein, 140 aa, Triticum aestivum
  Clone ID: PAT_TA_35117.pep
RHEAGLVYAVEFSHRSGRDLVNVAKKRTNVIPIIEDARHPAKYRMLVGMVDVIFSDVAQPDQARILALNASYFLKNGGHFVISIKANCIDSTQAAEAVFASEVEKLKADQFKPSEQVTLEPFERDHACVVGGYRMPKKQK

SEQ ID NO: 140700 - protein, 182 aa, Triticum aestivum
  unsure (1)..(182): unsure at all Xaa locations
  Clone ID: PAT_TA_35118.pep
GILRAVPSSYSHARLPRDQEEHARCTGAPRPRGLRLHPGGEMGLTFTKLFSRLFAKKEMRILMVGLDAAGKTTILYKLKLXGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEIT

SEQ ID NO: 140701 - protein, 189 aa, Triticum aestivum
  Clone ID: PAT_TA_35119.pep
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITGCPTTLPTRLEASRQGLLWIWISWIFGLILPLRIINYIVLTDNVGVLER

SEQ ID NO: 140702 - protein, 259 aa, Triticum aestivum
  unsure (1)..(259): unsure at all Xaa locations
  Clone ID: PAT_TA_35120.pep
QGRGGRGGGGRGGAGMKGGSKVVVVPHKHDGVFIAQAXEDALCTKNMVAGESVYGEKRVSVQNEDGTKVEYRVWNPFRSKLAAAVLGGVDNIWIAPGARVLYLGAASGTTVSHVSDIVGPTGLVXAVEFSHRSGRILVNMAKKRTNVIPIIEDARHPAKYRMLVGMVDVIFSDVAQPDQARILALNASYFLKNGGHFVISIKANCIDSTQAPEAVFAAEVEKLKLEQFKPSEQVTLEPFERDHACVVGGYRMPKKPKAT

SEQ ID NO: 140703 - protein, 308 aa, Triticum aestivum
  Clone ID: PAT_TA_35121.pep
MRAPMRGGGGRGGGRGFGDSGGRGGRGRGFGGRSDGGGRSGGRGFGGRSAGRGRGGGRGGGRGGPGMKGGAKVVVVPHKHDGVFIAKAKEDALCTKNMVAGESVYGEKRVSVQNEDASKVEYRVWNPFRSKLAAAVLGGVDNIWIAPGTRVLYLGAASGTTVSHVSDIVGPNGLVYAVEFSHRSGRDLVNMAKKRTNVIPIIEDARHPAKYRMLVGMVDVIFSDVAQPDQARILALNASYFLKNGGHFVISIKANCIDSTQAAEAVFASEVEKLKADQFKPSEQVTLEPFERDHACVVGGYRMPKKQK

SEQ ID NO: 140704 - protein, 180 aa, Triticum aestivum
  Clone ID: PAT_TA_35122.pep
DSDEAKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 140705 - protein, 231 aa, Triticum aestivum
  Clone ID: PAT_TA_35123.pep
MLRLSRFLPSTSRGVTDLKDVLWSGSLTFKHALSTSAANVDENASVKKYASYTVFKGKAALSISPILPLFTKVESGGSRVDRNGSVMLTFFPAVGQRKYDYTKKQLFALSPTEVGSLISLGPAESCEFFHDPSMKSSHEGQVKKSLSITPLGSDNGYFVNITVLNNVQKTNERLSVPVTKAEFAVMRTALSFALPHIMGWDQALSTHPQSTSTSASKPRFERPNPASEWDR

SEQ ID NO: 140706 - protein, 182 aa, Triticum aestivum
  unsure (1)..(182): unsure at all Xaa locations
  Clone ID: PAT_TA_35124.pep
MGLTFTKLFSRLFAKKEMRILMVGLDAAGKTTILYKLKLGEIVTTIPTIXGFNVETVEYKNISFTXVWDVGGQDKIRPLWRXHYFQNTQVSFLSWDSNDRERVXLRERDDFTGMLNEDDCXSVLLVFANKQXPNAMNAAESLTSLAASPAQRHWYIPEHMCTXGEGLYEGLDWLSNNIANKA

SEQ ID NO: 140707 - protein, 236 aa, Triticum aestivum
  unsure (1)..(236): unsure at all Xaa locations
  Clone ID: PAT_TA_35125.pep
PAGSGSLSPFLSSSSCHRSRTREEPGARRAKEEKRRSPSPARAQDSRRRDLGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLXGLHSLRQRHWYIQSTCATSGEGLYEGLDWLSNNIANKA

SEQ ID NO: 140708 - protein, 231 aa, Triticum aestivum
  Clone ID: PAT_TA_35126.pep
MLRLSRFLPSTSRGVTDLKDVLWSGSLTFKHALSTSAANVDENASVKKYASYTVFKGKAALSISPILPLFTKVESGGSRVDRNGSVMLTFFPAVGQRKYDYTKKQLFALSPTEVGSLISLGPAESCEFFHDPSMKSSHEGQVKKSLSITPLGSDNGYFVNITVLNNVQKTNERLSVPVTKAEFAVMRTALSFALPHIMGWDQALSTHPQSTSTSASKPRFEQPNPASEWDR

SEQ ID NO: 140709 - protein, 226 aa, Triticum aestivum
  Clone ID: PAT_TA_35127.pep
MAAAAQRLLAASTKIVGVGRNYVAHAKELGNPVPKEPVLFLKPTSSFLHAGVATAAVEVPEPLESLHHEVELAVVISRRARDVPEASAMDFVGGYALALDMTARDLQSVAKSTGLPWTLAKAQDTFTPISAVVPKSAVPNPDDLELWLKVDDELRQKGPTSDMIFKVPFLISYISSIMTLMEGDVILTGTPEGVGPVRIGQKIKAGITGLIEAEFDVQRRSRTFSP

SEQ ID NO: 140710 - protein, 309 aa, Triticum aestivum
  unsure (1)..(309): unsure at all Xaa locations
  Clone ID: PAT_TA_35128.pep
MRAPMRGGGGRGGGRGFGDSGGRGGRGRGFGGRSDGGGRSGGRGFGGRSAGRGRGGGRGGGRGGPGMKGGAKVVVVPHKHDGVFIAKAKEDALCTKNMVAGESVYGEKRVSVQNEDGSKVEYRVWNPFRSKLAAAVLGGVDNIWIAPGTRVLYLGAASGTTVSHVSDIVGPTGLVYAVEFSHRSGRDLVNMAKKRTNVIPIIEDARHPAKYRMLVGMVDVIFSDVAQPDQARILALNASYFLKNGGHFVISIKANCIDSTQAGRXPVFASEVEKLKADQFKPSEQVTLEPFERDHACVVGGYRMPKKQK

SEQ ID NO: 140711 - protein, 193 aa, Triticum aestivum
  Clone ID: PAT_TA_35129.pep
CIQRVEYRVWNPFRSKLAAAVLGGVDNIWIAPGTRVLYLGAASGTTVSHVSDIVGPTGLVYAVEFSHRSGRDLVNMAKKRTNVIPIIEDARHPAKYRMLVGMVDVIFSDVAQPDQARILALNASYFLKNGGHFVISIKANCIDSTQAAEAVFASEVEKLKADQFKPSEQVTLEPLERDHACVVGGYRMPKKQK

SEQ ID NO: 140712 - protein, 232 aa, Triticum aestivum
  Clone ID: PAT_TA_35130.pep
TSSRSPHCTTAILRAVPSSYSHARLPRDQEEHARCTGAPRPRGLRLHPGGEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 140713 - protein, 181 aa, Triticum aestivum
  Clone ID: PAT_TA_35131.pep
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 140714 - protein, 181 aa, Triticum aestivum; identical to SEQ ID NO: 140713
  Clone ID: PAT_TA_35132.pep

SEQ ID NO: 140715 - protein, 181 aa, Triticum aestivum; identical to SEQ ID NO: 140713
  Clone ID: PAT_TA_35133.pep

SEQ ID NO: 140716 - protein, 181 aa, Triticum aestivum; identical to SEQ ID NO: 140713
  Clone ID: PAT_TA_35134.pep

SEQ ID NO: 140717 - protein, 181 aa, Triticum aestivum; identical to SEQ ID NO: 140713
  Clone ID: PAT_TA_35135.pep

SEQ ID NO: 140718 - protein, 148 aa, Triticum aestivum
  unsure (1)..(148): unsure at all Xaa locations
  Clone ID: PAT_TA_35136.pep
GPRELDTSCVEEIDPSAEDKELKHQLLRKYGGYVGSLRQEFCKRRKKGKLPKEARQKLLHWWELHSKWPYPSETEKIALAESTGLDQKQINNWFINQRKRHWKPAPEDMPFSVMDGGVGVQLPPRPAXPALYMDRAPFMVDGMYRLGS

SEQ ID NO: 140719 - protein, 334 aa, Triticum aestivum
  unsure (1)..(334): unsure at all Xaa locations
  Clone ID: PAT_TA_35137.pep
MARFLVALLAATLVAVQAGGQLGHAAPATGEVFWRAVLPHSPLPDAVLRLLKQPAAESTSFSTVAASGAGGFDYDNYSGADEQATSAGRDIDKGPPFDYRDYSRSSSDDEPSKRTGAASGAGGFDYDNYSGADERRGATDEYKAPSSSPAGSGASMARGGKAETTTVFFHEEAVRVGKRLPFHFPPATPAALGFLPRQVADSVPFTTAALPGVLATFGIASDSATVASMEATLRACESPTIAGESKFCATSLEALVERAMGVLGTRDIRPVTSTLPRAGAPLQWYTVRVVRPVEGGPVFVACHDEAYPYTVYRCHTTGPSXAYMVEMEGARGGN

SEQ ID NO: 140720 - protein, 445 aa, Triticum aestivum
  unsure (1)..(445): unsure at all Xaa locations
  Clone ID: PAT_TA_35138.pep
ATFHLGPRHISTSHLAHIHGALPRRPPRGLSPSASSSARRTSIARVVVAVVVTTRVAVHAGAQLGPAAPATAEVFCRPVLEHSPLPAPVLRLLKXPPSCDELLTGSPQASLRNGGDRLRLEYRGSTAPSRPRRMEAAAKYPRVHPAGTAGEAXSEQTTGGGPHNGCVRGGHGGRRHFGSTTRTSGPTSAVRAANEFPCPHAPAAPATALGFRPAPGRRRRPVQDACAARRPRVVQRRPFLLHPATPAALGFLPRQVADSVPFTTAAHPGVLPTFGVASDSATVGSMEATLRACESPTIAGDLPFRPVPLPHHRPLAREVLGHGGRARGRRGDHRRRVPHRHDTVEPGPRLEGGPVYQARHDDGYPHTVYRCHTTGPSRAYMVDMEGARGGDAVTIATVCHTDTSLWNPEHVSFKLLGTKPGGTPVCHLMPYGHIIWAKNVNRSPA

SEQ ID NO: 140721 - protein, 182 aa, Triticum aestivum
  unsure (1)..(182): unsure at all Xaa locations
  Clone ID: PAT_TA_35139.pep
IFRAPPRAAVPYSAWELGFAPLVGVELRRPSWCSGGHGRRPLPRPNRRGREAGRGEEEGGRRRGGRLLHLLRRWRPRRLRLEVRRRSARLLPDCSQCRRRLQAAESRSFPPVRFLSVRSXRDVPNLLCVLLTEFPTVRLLSVRWIIELPHVLPSEKAXYAAVSSLGIYSKDGYDXKGLFSAA

SEQ ID NO: 140722 - protein, 155 aa, Triticum aestivum
  Clone ID: PAT_TA_35140.pep
MATVQVRSHPGQIKIIVVSQMVTGGCPCRLQQVFRLPDACTVMQCHGAEAALVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 140723 - protein, 151 aa, Triticum aestivum
  Clone ID: PAT_TA_35141.pep
MIGIDLNTVEGDEEEGGPSAEPPRGTVCLELWHACAGPVGPLPRKGSAVVYLSEGHLEYIGEAAGAVAAVPPHVFCRVVDVNLQADPATDEVYAQVSLVVDNEESKRRMRQWESEEACEGDGEDTYAVKLRARMPYMYCMTLTVCDTSTHG

SEQ ID NO: 140724 - protein, 221 aa, Triticum aestivum
  Clone ID: PAT_TA_35142.pep
LHLPHPPSPPPAAATARPAWWCAPHHHTITIASSHDHLHHAPPAPLPTSRTSHHHQHHAISIFAAAPPLAQSLLPLLLLPSPHHAAASPLTPLVLLLLTFLLLLLVLCPWCCSSFPRPCCCSLPLCCSSLNPLLLLLHFLCSPSSSLNLAAAAPPLKTAAAPSPTFLAAVPSLFSPKLLLSSSPFACCYTLPEALSTLFCSVLVLFLSVCQLVCCNNSDYL

SEQ ID NO: 140725 - protein, 179 aa, Triticum aestivum
  Clone ID: PAT_TA_35143.pep
SLGLGLRTPQLVLAIHFFFSIDLFFSGSISSSMAPPAPRSAWRLDCSPSCFGVGTSWAATCPWIDGGCLRSGPSPPVRSAGALGWKHLQAPGRLRSTCRPARTAPAACVLLSCSCRLLSAHVCLQLDLILANAAASCRPRVPLLAGCCSAPARPSACCCCSAALCCSTQLMRSASLLAS

SEQ ID NO: 140726 - protein, 194 aa, Triticum aestivum
  Clone ID: PAT_TA_35144.pep
MRHHHLLRCRAMPILPSPPRTLRVSGSLVHHRLIRCRGLPIPPRTPGVSGGRLFSSLPLPPPLQSPREVHVWYLCPDELNNQSQLNMYEELLSPSERKYADSMKATLLRKDAVLSRALLRTTLSRYTDCKIDPRSFEFKKNKFGKPEVLWPHDDSTAEQPLHFNISHTTSLDACGIAINARIGIDIEEKKRNTN

SEQ ID NO: 140727 - protein, 447 aa, Triticum aestivum
  Clone ID: PAT_TA_35145.pep
QNGNTGYDDIRAAIKEAKEVKDKPTLIKVTTTIGYGSPNKASTHSVHGSALGSKEVEATRKNLSWAHEPFHVPDEVKRHWAHHLDEGASLEAEWNAKFAEYEKKYQHEAAELNSIVSGKLPDGWDNALPKYTPESPADATRNLSQQCLNALAKVIPGFLGGSADLASSNMTLLKMFGDFQKDTPEERNIRFGVREHAMGAVCNGIAVHSPGLIPYCSTFFVFTDYMRAPIRLSALSESGVIFVMTHDSIGLGEDGPTHQPVEQLFSLRAMPGILMLRPADGTETSAAYRIAVINRKRPSILALSRQKLPQLEGTSVEGVAKGGYVISDNSSGNKPDLILISTGSELEIAEKAAGQLRKEGKSVRVVSLVCWELFEEQPEEYKESVLPSEVTSRISIEAGVTLGWEKYIGQKGKAIGIDRFGSSAPAGRIYKELGLTVENLIATAKSL

SEQ ID NO: 140728 - protein, 375 aa, Triticum aestivum
  unsure (1)..(375): unsure at all Xaa locations
  Clone ID: PAT_TA_35146.pep
PRVRPFGLFVGVNXHFQSIIFGGVLVRDETTETFEWVFTEFIRMMGGKHPQTILTDQCRAMELAIEKVMPNTTHRWCKWHILKKAKESIGAHYTKRSKFRMDFHKIIHHMLTVDEFETAWNQLTETHGLQRHPYLTQIYETREKWAKPYFNGKLCAKMSSTQRSESANHMLKTYVPASCPMHIFVRQYMRLLFDREAAENYEERRTMINAPVMRVNTPLEQHASNVYTRAMFEKFGEVLYESGQYKIEEVSRWKTYIARRHHPEKHXKMXVEFSTXVEXXDDGALIVCECGNFEYTGLLCCHALKVXXMSLVVDHIPANHILKRWTKDARDLLPDHLAHLQKDKINVNSITFRHLNLYTHALGKLSVFGDANTSI

SEQ ID NO: 140729 - protein, 189 aa, Triticum aestivum
  Clone ID: PAT_TA_35147.pep
PARHRQPVSSTTSTLTWPGLKKLYQGKGRRVHPAPAPAPGQDASAVALAMLPATLLALVAALTAEEQEVLAYLLSGGAGGAAGGAGGGRRRRLNGPHQPEMGCGCFGCYKSFWARWDASPNRHLIHRIIDAVEEGNGGGGEGAAKGAGGPGGATRRRPPPPPPWPRRAVRHRPPRRGARSRGGSGRVRG

SEQ ID NO: 140730 - protein, 306 aa, Triticum aestivum
  unsure (1)..(306): unsure at all Xaa locations
  Clone ID: PAT_TA_35148.pep
MEPSDRAAVQRLWSMDKINIICATVAFGMGINKPDVRFVIHHSLPKSIEGYHQECGRAGRDGQRSSCVLYYNYSDYIRVKHMITQGSAEQGRSSSSSSHGQALVTHKENLLCMVSYCENDVDCRRLLQLIHFGETFDPSHCSKTCDNCKKGLRWIEKDVTNIAKQLVELVLTTRQSCSSSHILEVYRGSLNQNVKKNRHDNLPLHGAGKNLAKGEAARVLRHLVTEGILTEDVKKSDTYGSVSSVLKANQVKVGGLRSGNQIVLKFPTADXAPKMXKLDESSISQVNKTVQRQSEMDENFSSLLYE

SEQ ID NO: 140731 - protein, 156 aa, Triticum aestivum
  unsure (1)..(156): unsure at all Xaa locations
  Clone ID: PAT_TA_35149.pep
GLPATPLPGCLPVALAPRPGPTVLGLVCPSRDAPAVQGLXIHVVDLAGGHXIAALEKLFATPXDIGCVAPSXGRGSGTTVLEMVSAFEKAYGKKIPVKMCPRRPGDSEQVYASTAKARXELGWXAKYGIEEMCRDQWNWAKKNPYGYCGDAAENKD

SEQ ID NO: 140732 - protein, 320 aa, Triticum aestivum
  unsure (1)..(320): unsure at all Xaa locations
  Clone ID: PAT_TA_35150.pep
AFFGSKLQKKMRDSNIFVVGSGALGCEFLKNFALMGVSCGRKGKLTITDDDVIEKSNLSRQFLFRDWSIGYANSTGAATAASAINSSLHIDALQNRACPETEHVFNDAFWEGLDAVINALDNVNARMYMDMRCLYFQKPLLESGTLGPKCNTQMVIPHLTENYGASRDPPEKQAPMCTVHSFPHNIDHCLTWARSEFEGLLEKTPNEVNSFMSNPAEYAAAMRKAGDAQARELLERVRECLDKERCDKFEDCIAWARLKFEDYFSNRVKQLTFTFPEDAATSTGAPFWSGPKRLPRPVQFSAVDSSHIQXILAASILRAV

SEQ ID NO: 140733 - protein, 547 aa, Triticum aestivum
  unsure (1)..(547): unsure at all Xaa locations
  Clone ID: PAT_TA_35151.pep
MATATPQQCCLPARARPPPTSTPLRLRYLSRAASSFHFPGRRTVTARRRGRAALAFSPRCTLETGGPAFDPLGLYREDPSSSDYQSPFSTLFGVLSPVFGSSSGSRKEKSSYGRGAAAAMEDSTIDFGDFFKGPLPGKFLKLLGFLALSRLGVYIPLGGVNQAAFAGNLDQNSLLGTLDSFSGGGIGRLGICSLGIVPFINAQIVFQLLTQLYPKLQELQKKEGXARRKKILQYTRYASVGFAIAQAIGQVLFLRPYVNDFSTAWVLTSVTLLTLGSVFTTFLGETISELKLGNGTSLLIFTSIISYLPASFGRTVAEGFQAGNYVGLLTIRLSFFFLVLGIVYVQEAERKIPLNYASRYGSRTGGPQRSAYLPFKVNSSGVMPIIFSTSSLALPATLAXFTGLDFLKRCHSLTPGGSFYLPTNVLLIAFFNYYYTFLQLDPDDLSEQLKRTGASIPLVRPGKNTAAFIKTVLSRISVLGSAFLAVLAAGPSVVEQISHLTAFRGFAGTSVLILVGCATDTARKVQTEIISQKYKDIEFYDVKSSDK

SEQ ID NO: 140734 - protein, 142 aa, Triticum aestivum
  Clone ID: PAT_TA_35152.pep
SCTNLAWNHQYLSKICRHTKVVPIKQTTTKYAGIQRYFPIKQNTTICRTSSSRPPFLSLQHRAPRDNDEDATYFFSSSLSSVPHSEGRGRRHILLDLVRVSGAARDGARMMAAPRRVDSDPEGVFAVGCPESRNRRCRCHSS

SEQ ID NO: 140735 - protein, 241 aa, Triticum aestivum
  Clone ID: PAT_TA_35153.pep
GSHLVPHALPLPRPPPPPLLPRRQVPAPAHPLPGAPRPPAPPRQLGRRPPRVRPRRGASPRRLGPAGSVLLRSPRPRTLGERDDAPRQDCFDGSGAGKGNNSSGRGGGSGGAGGNGQSAGMGEHYRRLLRLEPDNPLLLRNYGKYLHEVERDLAGAEEYYGRALLACPGDADLLSLYGRVLWEANQDKDRAAGYFERAVQAAPDDCYVLGSYASFLWDAEDEDEEGASTAAASSPALVPAC

SEQ ID NO: 140736 - protein, 474 aa, Triticum aestivum
  unsure (1)..(474): unsure at all Xaa locations
  Clone ID: PAT_TA_35154.pep
GRDVRQEAEAGGMWGRHYWGGRRPSDGAAGAEAGGGVVVMFAWLSSQERHVRAYVDLYAALGWACLVCHSDFITLFMPEKAAVLADRVLTELVKELNIRPVPVVFASFSGGPKGCTYKVLQLIERRCKGQLNLDDYQLVRDCRTRGIYDSSPVDFVSDLGTRFLLHPSVLKMPEPPRVLSWMTRGIASGLDTLFIGKFEAQRKEYWETLYSSVHVGPILIFCSEDDELAPCSVVQNFGRRLLELGGDVNLVKWHSSPHVGHYKHHTEEYRAAVTELLMKASALYTSRKRLNDYSVGTSEDSDTPYSSRNLHKTAVSSSDRLGRVSADPANHFFLPSXMEYHESSSEVLKPELFNMPSVESAKNPDGVLGTMLYDACVPKNVEGWDFKLASIDGQRMHFTARQHGTSNPTKCIRRSIVMILTQHPSAFQQTALYCQSILVSGECYCVDLFWKGMAKRMLFNGNFSCREDGKFQKK

SEQ ID NO: 140737 - protein, 246 aa, Triticum aestivum
  unsure (1)..(246): unsure at all Xaa locations
  Clone ID: PAT_TA_35155.pep
SPAVTESQLPLTLAAPVVLLLLAVSPSATGVPHLPGLQDRLPVRRETGYPSGREESGAELFYYFVESERSPDTDPVILWMTGGPSRSGLLFLWVAGGPFCSGMVFFEVGPIKFVLAPYNGSLPRLTLKPFSWSMTACINVLDSPVCTGFSYARDVKGYHDIGDFSVALPAVITPNQWLSVLPRYQSCPKFVAENPSAGNVXNLLRNTFRKGYVVGNPYDDNFXVPYAHGVGIISDQLYEAAILNTS

SEQ ID NO: 140738 - protein, 230 aa, Triticum aestivum
  unsure (1)..(230): unsure at all Xaa locations
  Clone ID: PAT_TA_35156.pep
RVEKSAQTLETQFSGNAESRAAGMVINTAGWVEGLGXRINDVRDLVNAIDIFKANVKLVLAQEKLWKMLKDAVQIHPNIDVVKLHKSEDLVLRNLKXLRKTRSFRIKEYFYGIANDLAPHSNVVNFRDFTVFRIGSGHQAPRSALPIGAEPVADPTRLVAVNISTDMVHTVLAVSYAKEPDEIISSNDAGFIHVTDVDIXRKKLTYIAPCPGDLPSRLLIASSLTWYEQA

SEQ ID NO: 140739 - protein, 297 aa, Triticum aestivum
  Clone ID: PAT_TA_35157.pep
GGDHISPPKAREAVGSRLHLPLRRWLEGGAPVLCRLVDRCRGRFPWGAAMVVEAASRRAVYAAARSPLRRSSLWWSRRASGRVFSLVKSDRRDLSAGAGSARRRRRPSRCFLSSRSASVLAVFPPAQLEGLGGCTGANRPAVAASFGSVDGDLQGAVCLEQGSWKREGRSGVLLRLRGMEPADLQSVEHGDAPPPTCPKVSVPSFYGGSLNRLTKLLQRWCFGGFGFVGSLSSHPPAVLWRRRRMETRVEDVVCKGLQGLGCTFVFWGVFCAKFQGHMCFWVLLVCAACVRCNCFEL

SEQ ID NO: 140740 - protein, 67 aa, Triticum aestivum
  Clone ID: PAT_TA_35158.pep
HQHVSSFFIQHTQVQMYYLTPHDNQHIQLAITSNYVVKLHLPLVHPRHQLPNLLRFLVVSHPEKQRE

SEQ ID NO: 140741 - protein, 361 aa, Triticum aestivum
  Clone ID: PAT_TA_35159.pep
RPPTRPVEEARARVARLIGAEPREIFFTSGATECNNRLVRGVMHFYRDRRRHVITTQTEHKCVLDSCRYLQQEGFEVTYLPVRPDGLIDVAQLADAIRPDTGLVSVMAVNNEIGVVQPLEEIGRICREKGVPFHTDAAQALGKIPIDVNQMGIGLMSLSAHKIYGPKGVGALYLRRRPRIRVEPQMSGGGQERGIRSGTVPTPIVVGFGAACEIAAKEMDYDERRVSALQQRLLDGIRSKVDDVVINGSMEHRYAGNLNLSFAYVEGESLLMGLKEVAVSSGSACTSASLEPSYVLRALGVDEDMAHTSIRFGIGRFTTEEEVDRATELTVHQVLKLREMSPLYEMAKAGIDIKSIQWSQH

SEQ ID NO: 140742 - protein, 125 aa, Triticum aestivum
  Clone ID: PAT_TA_35160.pep
EKRSQKQGSVEEQSDGGQSEEETLENGDVFENLMLLKMMNFMGRDNEMQLVSLVLKKATSLKQLILFTPKINHPEELHKDHMNTSHLLERKLFSLRRASPNAQIVLSEPDDSAVQPLHEALVKIY

SEQ ID NO: 140743 - protein, 112 aa, Triticum aestivum
  Clone ID: PAT_TA_35161.pep
PHAFVDSGGEPHFDLAPPRYGAQIKGTLDEAHVPFVTKRCGEVKRPSKRAKHTNPYDNTEMKVNRSSRSAQGRRVGSGGSKGGKGKKGAERRKGGMRRKARQKAGKAEELET

SEQ ID NO: 140744 - protein, 232 aa, Triticum aestivum
  Clone ID: PAT_TA_35162.pep
RHQAASPSSMPPPRTASWARPPPRGPPLRAEKVCRCSLTRPRVAPLGRLGRPPTLARRRPLPSSLPTLPPPETAAGKPARRRGRWRRGLPLLPRAEGMVCRGGGPGQGGQRCSLRRTAAAGARLGSSACLGGEAPVDGARGGRISSVGRPPDLNRPAPNPPSSPSPVRSQLRCGPARRIRWLPVFWRWGSWDRGKPLAAAGGHNHDDAAASNYFLEASLRYPTPHPSAPASR

SEQ ID NO: 140745 - protein, 219 aa, Triticum aestivum
  unsure (1)..(219): unsure at all Xaa locations
  Clone ID: PAT_TA_35163.pep
MAGFSYTSTSHVAVALVSVLLLSLAHGSLGAHGARRLMELYKPDPSELLTYHNGAVLQGAIPVTVLWYGRFTPAQKAVVSDFLLSLTAASPAPTPSVSQWWGTIAQLYLSKAKGASANAKRATQVALAGQASDERCSLGKSLALPQLAALAARARPRMGGIALVXTAEDVAVEGFCRSRCGLHGFDXRGPHGVXVGSGNSAAQCPGXCAWAVPQARRTG

SEQ ID NO: 140746 - protein, 114 aa, Triticum aestivum
  Clone ID: PAT_TA_35164.pep
MIAAARTNHPQRGPGQERRPPPGPRSSRSGAQLRRTPREPRARGARRREGRTRSDRASRPPTPRAAGPRSRRSTGGRPAPAAPRPPQGAGPGTRQAGRRSAPRGARARRAPVPA

SEQ ID NO: 140747 - protein, 454 aa, Triticum aestivum
  unsure (1)..(454): unsure at all Xaa locations
  Clone ID: PAT_TA_35165.pep
MHAMAEPGGALDPPPPPSPAAPTPPVQWPKDGSLDPPPSPSPVAQPPPVEWPEDGVLTRAARASFTAALDWCSRSIPPDQLPSVLSADFVRRLVVAAAVILHREPNIVRVDPRPDQSVVVVGDVHGQLHDVMFLLRDAGFPSEERIFVFNGDYVDRGAWGLETLLLLLAWKVFLPNCVFLLRGNHESKYCTSVYGFEQEVMVKYKGQGAQVYRKFLRCFEDLPLASIIAGCVYTAHGGIFRGAVVLPLKRSKRAKKGHKYKAGPTDDSTTLKLGSLDELLKARRTVLDTPYEGSNLIPGDVLWSDPSLDKGLSLNNERGIGLLWGPDITQQFLYTNNLKLIIRSHEGPDARDKRHDLLAMDSGYTIDHHVACGKLITLFSAPDYPQFQASVDRYNNSGAYIVLSPPDFATPDFHTFQAVKPXRPKAHPYYDFEDVIDPDEELNLGAMDTGRPSI

SEQ ID NO: 140748 - protein, 94 aa, Triticum aestivum
  Clone ID: PAT_TA_35166.pep
VWLSRSIESIQRPLAGLKDACTHGIISARGGASKNGVGGSSSEPEDEERKERVDSLAAVALAVVDQAIDNPKLFKGIFEQVRGLLSRLGVEGYI

SEQ ID NO: 140749 - protein, 133 aa, Triticum aestivum
  unsure (1)..(133): unsure at all Xaa locations
  Clone ID: PAT_TA_35167.pep
PNGTIRXNILNGTVFREPILCKNIPRILTGWKKPICIGRHAFGDQYRATDMIINGPGKLKMVYENQCXDGAEPVELNVYDFKGPGVALAMYNVDESIRAFADSSMAMALSKKWPLYLSTKNTILKKYDGRYLE

SEQ ID NO: 140750 - protein, 475 aa, Triticum aestivum
  Clone ID: PAT_TA_35168.pep
RSGPIRVAQRRVSCLRPSLQGAAIRRKKRIPLQQGPTNSESNDARRRQCHLQSTKVASERPPKQHKISVGFGQIEMSDLRVVLYGKDGVAVKMSVHKNILAENSTFFSDKLARQSPVSSIEVPDCEDVEIYVETVGLMYCNDVKQRLIKKSVPRVLRILKVAELLGFRACVLSCLNYLEAVPWAGEEEENVVSSVRHLQTEGGGVTPILKRVCSDLTSPPNDTFVRIIELVLKSSDDRGRREMKSLVLKLLKESSSRCASSSADLCVETLYSYCQNCLESLLTLFQQASDSDFSEQSLELKEPVLRQITLEADNLLWLTEILAGRNAAEEFAGLWSNQRELAGLHSKLPTKSRHLVSCVTARLFVAIGKGEMLPSKDTRQLLLDVWLQPLMDDYNWLQHGCRSFDRTVVEEGIGSTILTLPLEDQQTILLSWLGSFLKVGNSCPNLQKAFEVWWRRTFVRPYVEQQGSRSQSCRS

SEQ ID NO: 140751 - protein, 163 aa, Triticum aestivum
  Clone ID: PAT_TA_35169.pep
MDGCVWDGEEAPNRAAGKDEVKLSGSSSYPFSVCSCYKQAQYHLISLVSLVWTSPLDACSASCTCAKKGDRRGLRQRVSLIRSCNKGGDPPFFMSCATRVIDADYRCPVGVVLFNHSEVDFAVKSGDRVAQMIVQVIVTPEAAEVEDLDSIIWGEGGFGSTSV

SEQ ID NO: 140752 - protein, 237 aa, Triticum aestivum
  Clone ID: PAT_TA_35170.pep
MAQCLRGKGGAAAVGEALRKAAPWRREASASYHHTIQAVPRETAGPRAAARERRNGNVPAVLLTLAGAGPGEGVAHRKLLTTDKKQLAEMLKQSPYFLSTPVRLQVRAGERSTAVVHSGTVLPIKVQTDESTGNILNLVMVEADEGTMLKVNLPVVFKGEDVCPGLKKGGFLQKIRTSLVYLCPAEHIPPKIEVDLTNVDIGDRVLMQDIPVHPSLKLLSKNETMPVCKVLSSKPAE

SEQ ID NO: 140753 - protein, 118 aa, Triticum aestivum
  Clone ID: PAT_TA_35171.pep
LTCFTTPLKTSMVWTTMPEKSRPKTHHLPDAGRPLHHTMCRWWAHLKNATAMMRMVQTRTNLVRYHQSVDVIGAALNRVAERTAIPAQETMILWKTPKTKKTPSNQHPNRMIGRTGKS

SEQ ID NO: 140754 - protein, 163 aa, Triticum aestivum
  unsure (1)..(163): unsure at all Xaa locations
  Clone ID: PAT_TA_35172.pep
GRPILIEXXFSXMSCPSXACVYPLCQGRSPRVVHGNHMSNVHRKVMHVSDGKNQPLASILLLVLDSSNCCRKCSAWQLMSFGRSKVQVSNNRVCHVLYVYDSLYHSGILGSLIVGAIKPWHRNVADWSPKVNCGGVERDELHGSCHPHEQRAQYSSGDNSEMR

SEQ ID NO: 140755 - protein, 344 aa, Triticum aestivum
  unsure (1)..(344): unsure at all Xaa locations
  Clone ID: PAT_TA_35173.pep
MGATRADADEKERTSFGEGVMATDFFWSYTDEPHASRRREILAKYPLINELLIPELLAFIKWTAVVSFQLWTATLLRDAGWSKMLVVAYFFGSFLTHNLFLAIHELSHNLAFETPSLTCPLGIFANLPIGVPMSVTFQKYHLEHHRFQGVDGIDMDISSQTEAHVXWVQRQLFYYALRPALLKPTPPGLWEFTNLTIQVALDAGMFYLHGRKSLAYLILSTFLGGGMHPMAGHATSAHYVVRPAQETNCXYGRRNLMRWHVRCHSEHRTWRRTPSXHDFPSIPGRKLHKVQAEAPQYXESLDSHVSWGPVIWMYHPDQAGRAQERCVGGTSPCKISRTTHSCLR

SEQ ID NO: 140756 - protein, 40 aa, Triticum aestivum
  Clone ID: PAT_TA_35174.pep
FRSFRYFVKLCLLHHNYPCNIWQPPNIFVTISGNLYCGPG

SEQ ID NO: 140757 - protein, 334 aa, Triticum aestivum
  Clone ID: PAT_TA_35175.pep
MASGEGTGDSNAAGAGMEVPEVELCLDLTSCQLHDLSEVEIPPTLEELDLTANRLTAVDPRIGHLPRLRKLSFRQNLLDDDAVAPLFTWDAIAGLQEIVLRDNKLTKIPDASIFKGLLVFDVSFNELSSLNGLSKVSSTVKELYFSKNEVPKMEELEHFHALELLELGSNRLRVMENLETLTNLQELWLGRNRIRTINLCGLKSIKKISLQSNRLTSMNGLQECVALEELYLSHNGIQKMEGLSMLQNLRVLDVSSNKLTAIEDIEPLTRLEDLWLNDNQIPSLSGIESALSGSREKLTTIYLERNPCAKTPNYSSTLKEIFPNLEQIDSDMLA

SEQ ID NO: 140758 - protein, 160 aa, Triticum aestivum
  Clone ID: PAT_TA_35176.pep
MGMEYASSTTASSMFLPFLAMFGAIYLLGYFVVFRRWSPQQRPDASSCLTSLFHGTPAMLLALRAVLSSPGAGDLAAPNAPADDLVLDFSTAYFAVDLLHYLVFLPHEVLFVAHHLATLYVFATCRMAVHRGAYGLLALEVLAEATSLAQNLWTLADMRR

SEQ ID NO: 140759 - protein, 190 aa, Triticum aestivum
  unsure (1)..(190): unsure at all Xaa locations
  Clone ID: PAT_TA_35177.pep
PLFPTPLRALFSPPCAASSTSALPPPRRPPLAGALLFLSLGAVAGCALSTRRVPFLRAISSAGMDSTSTTVPSIVVYVTVPNREAGKKLSXSIISEKLAACVNIVPGIESVYWWEGKVQTDAEELLIIKTRESLLKXLTEHVKANHXEYDVPEVIALPISGGNLKYLEWLKDSTKGEVIWLELSMDLICE

SEQ ID NO: 140760 - protein, 137 aa, Triticum aestivum
  Clone ID: PAT_TA_35178.pep
MRWGASRRFRGGRGLLVGAAGAGSMLGRDELLRRSLVTLAAAVVVTGVATASVRKALATYVFGILAIAGVLLPDWEFFDRDFSQWLTPMPASRRTAAAAAAEREHDIWRFKPYPLRMAVLATIYGFGLYKWWTYVSH

SEQ ID NO: 140761 - protein, 122 aa, Triticum aestivum
  Clone ID: PAT_TA_35179.pep
CFLPSQQGSHPILSTSRHHNLWPCPPADRRRAHAFVFFPSFFLCPRSASSNRRSGPADGYHRNHASEIAQAATFKRVLSDLVHHLPPVNDTSKSTSSNKWHFGIVFLQRTPAGSIEQSDHLK

SEQ ID NO: 140762 - protein, 111 aa, Triticum aestivum
  Clone ID: PAT_TA_35180.pep
SSLIVSITLFFILDVTCGRKCMFHTWSSKFSCCYYFLPLLVANIFSVCNGDMLELKFQCFMLLKSKMRRLYDLKVSGVDTTIHGLQSSLIVYCSLYIHMLVFVSYFFCDYV

SEQ ID NO: 140763 - protein, 169 aa, Triticum aestivum
  unsure (1)..(169): unsure at all Xaa locations
  Clone ID: PAT_TA_35181.pep
MARGLKKHLKRLNAPSHWMLDKLGGAFAPKPSSGPHKARXECLPLILILRNRLXKYALTYREVQSILMQRHIMVDGKVRTDKTYPAGFMDIISIPKTGENYRLLFDTKGXFRFHSVGKIYSKLKLCKVRQIRSDSKGIPYLNTYDGRTIRYPDPLINANDSIELDLVTN

SEQ ID NO: 140764 - protein, 173 aa, Triticum aestivum
  unsure (1)..(173): unsure at all Xaa locations
  Clone ID: PAT_TA_35182.pep
MYTSKQPFLKSKQPFSKSKQTFNKSKQPFRKSKQTFRKFKQPFRKSKQPFRRRPRIGPGDRIDYRNMSLINRFISDQGKILSRRINRLTXLKQQGLITLAXIKQARILSFLPFRNYENXEKQFQAQSISIITGSRPRKNRHIPQLTQKYNSNRNLRNNNQNLRNNNRNLSSDC

SEQ ID NO: 140765 - protein, 373 aa, Triticum aestivum
  Clone ID: PAT_TA_35183.pep
MASSAGDLPEVKFKRTGSLGSSDYVRADKIDLTSLDIQLEQQLNKKWGKTNIKSQGPKADWEIDLAKLEIRHVIAQGTYGTVYRGTYDGQHVAVKLLDWGEDGFATEAETTALRTSFKQEVAVWHKLSHPNVTRFIGASMGTTDLKIPVNDNGARANLPARACCVVVEYLAGGTLKQYLIKNRRRKLAYKVVVQLALDLSRGLSYLHSRKIVHRDVKTENMLLDTQRNLKIADFGVARVEAQNPKDMTGATGTLGYMAPEVLDGKPYNRKCDVYSFGICLWEIYCCDMPYPDLSFADVSSAVVHQNLRPDIPRCCPSAFANIMRKCWDGNPDKRPDMDEVVQLMEALDTSKGGGMIPDGQSSGCLCFTRARGP

SEQ ID NO: 140766 - protein, 195 aa, Triticum aestivum
  Clone ID: PAT_TA_35184.pep
CSPAKRTADWIRALCRQRGLCVRARPTVRPVGRDSPATAALGDGGDGHTRERRRDPFEVTEACKTRRPCDAHVHKQEERGRIDSSRTVARGTASSQHRRPRAASAVRTPEGGDIDAASYGTVELMISSGEDEQQQWHRDDVVVERQQLIQELRRWQREAADTALRWPAMETAFPLLQHTPRSVGFAGIKGWISCT

SEQ ID NO: 140767 - protein, 138 aa, Triticum aestivum
  Clone ID: PAT_TA_35185.pep
RSSRHSGDKYHRDGTDQHESKKSEEGTRARKYNSLDDPLSSDKKNLHKGRSPGSDSDGFKHDTEVRLRNASLEGADLVIQEDQQFPDETGTDKCSADALLPASKQRAEEDMCSTVSDINGQHGLEGDGALGGTEESAM

SEQ ID NO: 140768 - protein, 58 aa, Triticum aestivum
  unsure (1)..(58): unsure at all Xaa locations
  Clone ID: PAT_TA_35186.pep
KVLXTCDDQQREMILTRIKAHLNTLKKYTYGKHIVARVEKLVAAGEKRQGLQPACTAA

SEQ ID NO: 140769 - protein, 350 aa, Triticum aestivum
  unsure (1)..(350): unsure at all Xaa locations
  Clone ID: PAT_TA_35187.pep
WFGDITVRFWDLSTQTPLYTCKGHKNWVLCIAWSPDGKHLVSGSKSGELILWDPKTGNQLGTPLTGHRKWITAVSCEPGPLRAPSRRFVSASKDGDARIWDITTKKCVISLSGHTNAVTCVKWGGDGLIYTGSEDCLIKVWETTQGKLVKTLQGHGHWVNSLALSTEYVLRTGAYDHTGKTFSSPEEMKEAALARYEKMRGNAPERLVSGSDDFTMFLWEPTISKQPKARMTGHQKVVNHVYFSPDGQWLASASFDKSVKLWNGITGKFVAAFRGHVADVYQISWSADSRLLLSGSKDSTLKVWDIXRARKLKQDLPGHADEVYAVDWSPDGEKVVSXGGKDRVLKLWMN

SEQ ID NO: 140770 - protein, 93 aa, Triticum aestivum
  unsure (1)..(93): unsure at all Xaa locations
  Clone ID: PAT_TA_35188.pep
MEVVNLIDDGXKNPDEFTRDVLNSCIAKNQITKGKTDAFKSLRKHLLEELEEAFPEDIEAYRQIRATSAAESKRLAQSQNVLPNGDSNVKPEH

SEQ ID NO: 140771 - protein, 206 aa, Triticum aestivum
  Clone ID: PAT_TA_35189.pep
LRPLPLGPSAFDRDPAPSKLFLPSAAATAAVVAAAAASGNGVQGGDRPEDPSKQNLAQVTASIQRTLGLLHQLNLNVSSFSSASQLPLLQRLNALVAELDTMQKLAEGCNIQVPMEVVNLIDDGKNPDEFTRDVLNSCIAKNQITKGKTDAFKSLRKHLLEELEEAFPEDIEAYRQIRATSAAESKRLAQSQNVLPNGDSNVKAEH

SEQ ID NO: 140772 - protein, 263 aa, Triticum aestivum
  Clone ID: PAT_TA_35190.pep
PRVRENNCLARALFVEEYRLALDWPTRRKICLGIARGLAYLHEESAIRIVHRDIKASNILLDKDLDAKISDFGLAKLNEDGHTHISTKVAGTIGYMAPEYAMRGYLTDKADVYSFGVVALEIVSGKSNTNYRPKEDFVYLLDWACVLHERGTLLELVDPDLGSNYSTEEALLMLNVALLCTNAAPTLRPKMSNAVSLLEGHTPLQPFLSELSLAANSLSSSGLRRNFWENPSESQSITAQASCNNTSDSSSLDVDGSLRHFAT

SEQ ID NO: 140773 - protein, 124 aa, Triticum aestivum
  Clone ID: PAT_TA_35191.pep
HAAAPGPVSHPANCPRPPPQDDKMYRRRTICFLIIVLLLPPLLASYPCVAAAHGPPHHASGDDAGACGQMNGLHCQGGKVSGMGVARHLGQRIPLKDPPSPIPNENSGVVIPLTPPPPPPPSIN

SEQ ID NO: 140774 - protein, 182 aa, Triticum aestivum
  unsure (1)..(182): unsure at all Xaa locations
  Clone ID: PAT_TA_35192.pep
ISRGNTRAHVHMHSHMMLASVQKLYTTQPRPTSYVQSSDQREPMSNNCMLRVSRNLVFKRHCPQRSSSKQGIIKKHQPCCSQIRVHFSLQEGSTLPMVAPVFASAVYKPYYVSGCHTLQTKIGGRVGAKLHHGKPVLLTNFCWITHLAEHNTQGYSTQIFRIRSHQRKCMPKVVQMTXDPCG

SEQ ID NO: 140775 - protein, 89 aa, Triticum aestivum
  Clone ID: PAT_TA_35193.pep
SFVFFLFLCKTKHLIIVSLHREYYITFCSNSCWWWSRCVCSATAEAPLHVLRPRITDAHPEGVILLAAVLNAWPILTRTSICHAGFRTM

SEQ ID NO: 140776 - protein, 203 aa, Triticum aestivum
  Clone ID: PAT_TA_35194.pep
SRASVTYSVMCLYLLAIIIFFVQVNGSVMPASVISVYCAYLCYTSLSSEPYDYACNGLHMHSKQVSMSALVLGMLTTVLSVVYSAVRAGSSTTFLSPPSSPRSGARNPLLGDSNVEEGKGNSEGSEPRPVSYSYTFFHLIFALASMYSAMLLTGWTSATSERSELMDVGWTTVWVRICTEWSTAALYIWTLVAPLLFPDRDFS

SEQ ID NO: 140777 - protein, 177 aa, Triticum aestivum
  Clone ID: PAT_TA_35195.pep
MEKGKGLARRWAVELHDASSSSSSPAFPDPPGFTRSAPEAEDAASARQRKETEAAWKGQKAWEVAQAPFKNLMMMGFMMWMAGSTVHLFSIGIVFSALWQPFNALRSVGKVFEPFKDPRVDTLAPKLLFTALNLAAMGLGVWKLNTLGLLPTNASDWVSSLSPAREVEYAGGGIPLM

SEQ ID NO: 140778 - protein, 148 aa, Triticum aestivum
  Clone ID: PAT_TA_35196.pep
LDRTVKVWSSDSATCHVTLGGHPDGVLCLQYFSDDNQQLLIAGSSDGTAKIWDLATESSAGITEGYGNQLNALCLHPELPVLIAGLQDGTIQIWKSTSTTTYRIENTTGFNLGAVKALVYIKGLRRTSWMSVRCHGMANNIHTNRTPQ

SEQ ID NO: 140779 - protein, 124 aa, Triticum aestivum
  unsure (1)..(124): unsure at all Xaa locations
  Clone ID: PAT_TA_35197.pep
LGLMAPEWVTGLPITAKVDVYXSYGIVLLELVSGTRILDFVVNLEEDVHVVLKKFIKMLSYRLEGDELLWLTEFVDVRLDGDFNYLQAKELIRIAVSCLEEDRKNRPTMESIVESLLSVEEASV

SEQ ID NO: 140780 - protein, 49 aa, Triticum aestivum
  Clone ID: PAT_TA_35198.pep
CLTEVKKGKKAVDKIGGGGTMKASGGSSRDDYEGGGSGRSRINFERRGR

SEQ ID NO: 140781 - protein, 180 aa, Triticum aestivum
  Clone ID: PAT_TA_35199.pep
QSLIGDEEPTPQTVEVVMGRHLEVPLGANGCAYFQFEDLCDRPIGAADYFGLFKKFHTLAVEGVPKFGYHNRTAAYRFVTLVDVMYENKGRLLCTAEAEPIELFENVVTVAEAQKSSPRSSRSQKSDDPDLCVDNELGFAKDRTISRLTELNSREYLEDFEAKWQHPLHAVDNGGDVVLA

SEQ ID NO: 140782 - protein, 195 aa, Triticum aestivum
  unsure (1)..(195): unsure at all Xaa locations
  Clone ID: PAT_TA_35200.pep
DRESTLQTVQAAGTHKKSKLSRDRDRDVGEKVALGMAHTGAKTGEVMYDQRLFNLDKGMDSGFAADDQYNVYSKGLFTAQSSMSSLYRPKKDGDSEVYGGDTDEHLDKVMKTERFKPDKAFTGAPERAGKRDRPVEFDKQEEADPYGLDQFLTEVKKGEKAVDKMDGEGTMKGSCESSRDDXKGGASGCFRINFE

SEQ ID NO: 140783 - protein, 165 aa, Triticum aestivum
  Clone ID: PAT_TA_35201.pep
KIAGASRIIGIDIDAKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 140784 - protein, 381 aa, Triticum aestivum
  Clone ID: PAT_TA_35202.pep
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 140785 - protein, 207 aa, Triticum aestivum
  Clone ID: PAT_TA_35203.pep
RANAHAHAQLGLAAAGHPPPTCARGLRCRYAHGVFELWLHPSRFRTRKCEAGTRCQRRICFFAHFTHELRGEDPVAAFPATAVPPSTFAMLRTPPRIFQRTPSTPVTRPQVVSTPQLFDDLTLQATPNRLRMLSLYSAITGDDVFSSPVATASAVATAATTMPTLRAPLPANEDGHEEDTKSVHYADDEDSLLNDYPHRDLIMDFMR

SEQ ID NO: 140786 - protein, 248 aa, Triticum aestivum
  unsure (1)..(248): unsure at all Xaa locations
  Clone ID: PAT_TA_35204.pep
MGLRLVCVRLACVSAGAGCWDAGLSYEEAVRAKPDFFEGFLALAHQQFEQAKLSWYYAIGTNADLDTWPSSEVLELFNRAEDNMEKGTEMWEEVEEQRLKNRSKPSQENAVLEKMGMEEYIKDVSTDDAAERASNMRSQINILWGMLLYERSVVEFKLGLPAWEDCLMAAIEXFKLGGASATNIAVLVKNHCANETAQDGLGFNVDEIVQAWNEMYDIKRWLLGVPSFRLEPLFRRRTPQLHMALEHI

SEQ ID NO: 140787 - protein, 276 aa, Triticum aestivum
  Clone ID: PAT_TA_35205.pep
RTRRRRASGGTAPIAPRGGSGAGSACPPAPTLTALPRASRTACSSSQCPRLPSTKGESRASSTSPGRTPTAAARARTRRSGRRRPRCELSCRKPRRERCVTFGCVVVGSCLPLRVMLGSTLVALVLVVALVLVVALVLSAAEKLGSPLVALVLILLFYFFETQKKKKKKKRTRSSAMPGIFIVLPIHLASASTRAIRRSGLSSTISSSRTCSGITILYSSLRLSYCLSINNPNNWANCVSHPPQSPAANNSLFALCSNNGHIRPFCPHPQLLTLRG

SEQ ID NO: 140788 - protein, 324 aa, Triticum aestivum
  Clone ID: PAT_TA_35206.pep
DSSPLEVQIRTQRMHEYAEYGLAAHWLYKESSVNTGSGMGNKIKQSTSYASSSSEDEITDGVPSKYISMKVGHPVLRIDGNHLLAAVIVSIEKGGKELLVAVRFTLEASEDVAERRSSFQLKRWEAYARLHKKVTEKWWCAPGHGDWSTNLEKYTLCRDGIYHKQDQFGRLLPTFIQIIDLTEEEEEEYWMVVSAVFEGKETSTLTSESSNGDRSTSDLPISTPLSDPINNKVHLLRTMLQWEEQVRRRASVAERSLGSLTDPILREVAIICWPYGKIMRMSTGSTAADAGRRMGVDGKLLWVNGQLVLPQTELKDGDIVEVRT

SEQ ID NO: 140789 - protein, 212 aa, Triticum aestivum
  Clone ID: PAT_TA_35207.pep
LSKEDRYVWHTLYWRNGTRKNSKEALDVMMNYNPTREVVKALLDKHNEDHLLEDLAYEIKKVVSYKAHFPRKGSQHECRSFSHLNVLVERGPNAIEDRMRIEMTCTTDGEFEEYTLSCICVVSSEDDGECCECGDDVKHPTGAEYKKCEAKPHVRCRKPISEEEFNEFIVVRDEDWLETEEAAVRWQFRMRNAADGHGARGKYIVPAKRVQA

SEQ ID NO: 140790 - protein, 301 aa, Triticum aestivum
  unsure (1)..(301): unsure at all Xaa locations
  Clone ID: PAT_TA_35208.pep
DISNSGNPLGKPRNDVLSGVAKVQAHRYVLFNCSDVNSYLRAHADEITNGRNLNPDVVERIQNDKFHEWFQAHIKKLEKENGIHNIEKDIRLLARGPVNAAKTYCAFNSRGYHFRPKRLDKETQNSGVMVTAKTSSYASAHDANPVLRDVTYYGRVIDIVELNYSGQFSXVVLFKCEWXNVFSETGMKKDRYGYTLVNFSHLIHKGEKIEHEPFIFPNQANQVFYVEDELNPGWSVVMKLPKPRDLYDLGNLEWEAQTENEPFHVSQLGESLKIKNNEEHSGGPPGGGTIVDANNASSNEE

SEQ ID NO: 140791 - protein, 491 aa, Triticum aestivum
  Clone ID: PAT_TA_35209.pep
SHVTPVSSVDCPSGLLFVAENCLHLVEMVHGKRLNAQKFSVGGTPRKVLYHSDSRTLLVMRTGLTGASCSSDIVQIDPNNGILLSRFKCELGETAKCIQIAKIGSEQVLIVGTSKSTDRPMMPNGEAESIKGRLIVLSLDTLGSPHECSSFIPTSNLSSSSHTGSFPEIVGYANEDFSSNSMCSSPDDICYNQIQFEQIAGHLRSLTHVTFTGAVLAVYPYLDRYVLAAAGNTLSVFGFVNENPHRMKKYAVSRTRFTITCLKTYASQIAAGDCRDGVLFYSYHENLRKLELIYADPAQRLVGDVVLLDCETAVVSDRRGSISVLSCPGLEVSESPEKNLAVQCSFFMGEIAMSIQKAAFKYRLPIGDETDPVLESAYNCVVASTLLGSVFVMIPLTSEEHQLLQDVQERLSLHPLTAPILGNDHAEFRRRGIPSGVPSILDGDMLVQFLELTSEQQQTVLDDGSSVKAPRRSISVFQVMRMLERVHYALN

SEQ ID NO: 140792 - protein, 49 aa, Triticum aestivum
  Clone ID: PAT_TA_35210.pep
SRADETTIKRPLSCPSRCGAKWFAPRRYIHLRLSDMMRDKVICHLEMLY

SEQ ID NO: 140793 - protein, 224 aa, Triticum aestivum
  Clone ID: PAT_TA_35211.pep
EMPGGSGGAGALARQGSIYSLTFDEFQSALGGAGKDFGSMNMDELLRNIWTAEESNAIAATLTPATTAAPASNVDALPQPPPQPLQPQQQAILRQGSMTLPRTLSQMTVDEVWRDIMGFCDEEPPAPPAPAPAQAQAQAQAEAQAQRQQTLGRMTLEEFLVRAGVVREDMGGQTVVVPARAQALFPQGNVVAPTMQVANGVVHRVLGQGPGVAMTVAAPTSRAC

SEQ ID NO: 140794 - protein, 121 aa, Triticum aestivum
  Clone ID: PAT_TA_35212.pep
STVFTTKIKHSFLLFRISCQLIPDGGILAFLLLPSLTDPTTKIKHSFLPFRISCQLIPDGGIFAFLLLPSLTPAFLLLPQAPTLMSFCYLHSTINTCFLLSFCHLHSTINTCFLHQSNKPL

SEQ ID NO: 140795 - protein, 101 aa, Triticum aestivum
  Clone ID: PAT_TA_35213.pep
MSNGTAGTAGGTAATSPEIDVHGFAFNSSVLWDPERWGRYPTSEPDKSQDSMRLEQQVVSEDYSKVKGIPPDCLEIMVWGVDTPPPPAPSSSQQTPGNKRR

SEQ ID NO: 140796 - protein, 101 aa, Triticum aestivum
  Clone ID: PAT_TA_35214.pep
MNDTSALEYRQGKDMQEIPWERLNYSRDQYRQMRLKQYKNYQSLARPRDALQKECQRAERRDAFYDFHLNTRHVKPTIVHFQVPIFMDISFRPRHSHVYDY

SEQ ID NO: 140797 - protein, 61 aa, Triticum aestivum
  unsure (1)..(61): unsure at all Xaa locations
  Clone ID: PAT_TA_35215.pep
GNKXTHFVYLAXEXRAGPXELQXAVAXXENIPKVAYXTSLLSSLNIITXEFXNHTKSSKTS

SEQ ID NO: 140798 - protein, 209 aa, Triticum aestivum
  Clone ID: PAT_TA_35216.pep
MSPRWRPGRAPPPQCRRPPPLRRRNRGTVAFSSAASSRSPGATAGRKPSARTPTAAPVGGGRGRARSRCPTAPNPRRMPPPGRRRGGPSTPLGATRAAPPRKPHSHPTNRCGAGGAAGAAHGTRRSTGSSGTWYGGGSSSGGRISAGFSVELTKQEIEVDFLAMTGKKPPRRYKRRPKVVQRQINSISPGEFLSEVNRDRYKVNEKGGF

SEQ ID NO: 140799 - protein, 347 aa, Triticum aestivum
  Clone ID: PAT_TA_35217.pep
MAPRLLVVLPVVLLGLAFQAILRPPPTKRCGSAGGPPVTSPRIKLRDGRYLAYREDGVQRDKAKYKIITVHAFDSTKDFPSPVSKELVEELEIYLLAFDRAGYGESDPNPGRSVKSEALDVEELADQLELGQKFHVLGVSMGGYTVWGCLQYIPHRLAGAALVVPVINYWWPSFPPEVSRQAFKKLIVPEQRTLWIAHNAPYFLYLWMTQKWLPSSAAAMHHPEIFSDHDMEVIQKMMAMPRTIENKSRQQGIYESIHRDLLVAFGNWEFDPMNITNPFPTNEGSVHIWQGYEDRLVLVELQRYLSKKLPWIQYHEVQEGGHMFMLVGGWTDKIIKALLVGEEASPM

SEQ ID NO: 140800 - protein, 507 aa, Triticum aestivum
  unsure (1)..(507): unsure at all Xaa locations
  Clone ID: PAT_TA_35218.pep
GPPQASLHFPEAAVGSSMPNVIPDSVSTISQYINLMRDSFRREGFNGNAQTVGNIDPGTAGSAHASGTQSQESQPGSTSAHHVLPTAALLAETMHSTRQLLVDLAGELLSQLSPLLRHLGIVGDATARRNLLQTAGSLAVRLLGPGAVRRVLARATMMLRINPAPSEAVVNSGPAVFISPSGPNPLMVPPVPFFPGPRSVQMGQMFSSLGSQALFXHPRDADVHIRTSGSVPVASTNPSESVGAQQAQEHTDRTGNASHSNARGAFARGAGGAPFAVGSGVRLLPLRTAGAVPAGISRSPSGSSSGGVGVIIPMITRVHQRVNSNGSGARNGQTSNEPHSDTHANLQPNPQPPQAREAGNLGHPVEVNVGNSSQASHGQQNGQGPFSQLVDSLQWIGSLFSGENPPANVSSQHAPAASAEPVDARTVASDEGIRFANLVRQIMPHISQVENQSQSTPADTSSTPSQAAVPESANGSRDGPSDSRNSRQHSRDPVEGPNSKRQRRMSE

SEQ ID NO: 140801 - protein, 218 aa, Triticum aestivum
  Clone ID: PAT_TA_35219.pep
SHECVNTEFGQLSTQEQMTVDAIVQASAFPLSIILVGVGDGPWDMMNEFDDNIPARSFDNFQFVNFTGIMSKKISQSNKETEFALSALMEIPLQYKATLQLGILGRRLAKSPEQVPLPPPFASYNTTSRAAPSWANNFRSVPSNLREEATLDSTITPSVTPPPAADARASELQFCPVCLAKPRDMAFGCGHQTCSGCGPQVADCPICRRPIDTRVKLY

SEQ ID NO: 140802 - protein, 128 aa, Triticum aestivum
  Clone ID: PAT_TA_35220.pep
SIGQTAATSVVTAPQAAENKKVEAKAKDSDGEQDGDKNKKGNKEESKALKMFKLALADFVKDALKPTWKEGQLTREVHKTIVKKVVDKVTSTVENTPPTKEKIDVYMSYSKEKLSKLVQAYVGKYVKA

SEQ ID NO: 140803 - protein, 87 aa, Triticum aestivum
  Clone ID: PAT_TA_35221.pep
LKLQHARYPWNTSWVSDLYTASAFVLQSGLILQKQQLKSPLRGRGALCLSYGWDFREGAHAPHGRISEKQTHAVTTGNYVDPKFTSS

SEQ ID NO: 140804 - protein, 158 aa, Triticum aestivum
  Clone ID: PAT_TA_35222.pep
GKGGRRGEPPERGDRPDRRTGGWGVAGGWRARPPHPPPAPPCRRAPPPSRPPLAGHPPPPSFPRAAARPPPPPPPTVLPLPPPRSRPPPSPTAAPPSAPPPTRRAGRRPPGRAPRPATGPPGLPSAPPPATASARGSSSPTRLRLQHLQLRIEDHQVP

SEQ ID NO: 140805 - protein, 120 aa, Triticum aestivum
  Clone ID: PAT_TA_35223.pep
TNDTYQCIRHGDMQSIFFQSPNRWQTKLMPQHYRNSTTVYRGTSVEQSSPNTLENPQIKSPQYTNALQNRGPPRGLVWCRCTGSDLQGCCSCIFQASRLLFLHLTLLSGDRRHNSVNSRP

SEQ ID NO: 140806 - protein, 398 aa, Triticum aestivum
  Clone ID: PAT_TA_35224.pep
EAPAQGVQVAGAGARWGRAGDDRRERLVSKHGHGLGSRVRNDGPFEEGGRVRSDARFEEGGRFAAAESAESSLLERTLEIRDRSYRLKIERRGGALRRARRAPAAPPVALAGRRAAGVAARPLTDDDEGGAAAGGSDGEEFSRNINEAAEILRKARECMMARDDEEAADALLYRSARLLSTAVALRPASLVAVGQLGNTYLLHGELKLKISRELRTLLANSGAYLNGGERVSRSRKLDRRILNRENISSALVGVCEECESLLVEAGRSYRTAVSIDSGDVKALYNWGLALIFRGQLLADIGPEAAVDADRVYLAAIDKFDAMLSKSNTYAPEALYRWGSALQQRSQLRSRNNKEKIRLLEQAKSLFEDVLYVEGNNKMVREALSSCISELNYHGRWLQ

SEQ ID NO: 140807 - protein, 391 aa, Triticum aestivum
  Clone ID: PAT_TA_35225.pep
MGYIGAHGVETLKRYRYSGQDHSVVAKYVLQPFWSRCVTLFPLWMPPNMITLMGFMFLLTSSLLSYIYSPHLDTAPPRWVHLAHGILLFLYQTFDAVDGKQARRTSSSSPLRELFDHGCDALACAFEALALGSTLMCGRLTFCYWVVAAVPFYLATWEHYFTNTLILPVINGPTEGLMLIYVSHLFTFFTGAEWWAQDFRKSLPLISLVPLPFVPEIPLYVIVLILMIMFAVIPTVGSNIGNVQKVVDARKGSMELALAMLLPFIALLAGVAVWCYLSPSDIMKNQPHLLVIGTGSAFGYLVGRMILAHLCDEPKGLKTGMCMALVVLPAAIANALTAKINDGTPLVDELLVILLYCATSVGLYMHLAISVCHEIKDALGIYCFRIARKEA

SEQ ID NO: 140808 - protein, 80 aa, Triticum aestivum
  Clone ID: PAT_TA_35226.pep
KKHRAHAHKAEHPVYGQRDIHYHRVGTVNIFFFHNQDEQSPLQLTLKDIWLEIPGANMLMGDIMNDRIKYCLRHVAGDSR

SEQ ID NO: 140809 - protein, 407 aa, Triticum aestivum
  unsure (1)..(407): unsure at all Xaa locations
  Clone ID: PAT_TA_35227.pep
IDDGAPSDAGSWETVDDNEMDLPDDPANDDLQNAVHNRIEMENGSFNSQDETSVGSGPLSVAFGFVPRLGSEILARETGDDSSKNEDKNRMALSESLTLTTCVSKAEKEEDRGVADEPADSDCLKHFDVLQCPPDHHYLENIAHGTGGRKWVKKVQQEWGILEKNLPDYIYVRVFEDRMDLMRAVIIGASGTPYQDGLFFFDFYLPPEFPQAPPSAYYHSGGLRVNPNLYVDGKVCLSLLNTWTGRGNEVWDPSXSRILMVLVSLQGLVLNEKPYFNEAGYEKQVGTVEGEKNALPYNENTYLLSVKSMLYILRRPPMNFEDFVKSHFCKRGDYILKACEAYLQGAVVGTLNDDACPTDTNKEYSCSMGFKLALGKILRRLITALKDIGADCSQYEHLGKTETAQES

SEQ ID NO: 140810 - protein, 197 aa, Triticum aestivum
  Clone ID: PAT_TA_35228.pep
MSVPEAGQSAGRDEQEMDDYEQHQTRVLMALMQGLCAARYRKADNTPCLVDQGLYLGSVGAALNNEALKSLNITHILVVARSLNPAFPAEFTYKKIEVLDSPDTDLGKHFGECFTFIDEGICTGGNVLVHCFAGRSRSVTVILAYLMKKHQMSLQSAMSLVRSKRPQIAPNAGFISQLVNFEKSLQVEQGQRTLQSN

SEQ ID NO: 140811 - protein, 176 aa, Triticum aestivum
  Clone ID: PAT_TA_35229.pep
TASSTDSSKSDLKPNQTSAGGDPHAGDAPQAAPAPDPGTMPNQLERDDRIPLPQATSLDRLSRPCPCAKSRHRWRRPTSQTTIAPKGRTPQAPRQHLPQRRRAGARAGGHYFDGAPTIAPSIHRRRKPNLGTTPRTYIHAAPRSKVPLTSSRPGGRWGRGKRSGGPAEERARRSRR

SEQ ID NO: 140812 - protein, 233 aa, Triticum aestivum
  Clone ID: PAT_TA_35230.pep
LAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQPGLAPSGVLPSRLIRPSPLPPSRFAPPAATRTCWRWIGFFSLRDLCAKLRTVLFYSSDQTC

SEQ ID NO: 140813 - protein, 413 aa, Triticum aestivum
  unsure (1)..(413): unsure at all Xaa locations
  Clone ID: PAT_TA_35231.pep
SSACRILTPVADCEVLENLQPHQNLKELSILRYLGVTSPSWLQMALLRELQSLHLVNCRSLGVLPALGLLPSLEQLHMKELCTVERIGHEFYGTGGMAFPSLKVLVLEDFPSLVEWSEVRENPLPCLQRLKIVDCPKLIQVPAFPPSVSELTVERTLLISNMKLAPYSSSQSEILTLDISTTSVLSRGLFHQSHLASIIVLXNINAGCKHLVAAEGLHTFTSLQKLQLCHSDISDQNLGSLLQVLPSLYSVEMIDLPNMTSLLVPANNSLCTTVTELQISNCPLLSSVVSLGTFVSLKRLVIEKCPKLTAASFPVSFWRLTALKVLSISYCTEFQSLPSCGLPNSIEALHLVGCHPKLHESSSNRTVNSXEKISTLHKTLMAKFMFYVCTCFFRSYYFQWVFFSLFCNCAAMC

SEQ ID NO: 140814 - protein, 229 aa, Triticum aestivum
  Clone ID: PAT_TA_35232.pep
MATAMRSARLLRLGFCHVPSLLFRGPLFPSPSPGLGLGLSVARVGLVHLRCSAAEAGDGRGKKVSARLALAQQVMRDAEERAASAGSDPAPKITMDHVTVSFARSGGAGGQNVNKVNTKVDMRFNVEKAHWLGERIKERILQTEKNRINKDGELVMSSTKTRTQKGNIEDALQKIQAIIDAASYVPPPPSEEQKKKIEKIAAAAERNRMQNKKVLSQKKELRRSKPSWD

SEQ ID NO: 140815 - protein, 216 aa, Triticum aestivum
  unsure (1)..(216): unsure at all Xaa locations
  Clone ID: PAT_TA_35233.pep
LLDNTAVPARLLYLQEHYEFAIYKVQVDKPVQLATFTECVRSGQDVFRLGRDESLNLSITHGMVAYKIPSWYERCHYMYLSCDPSSPSLLRDDGGPIIDLEGXVVGLVNNHIKETFIPSFLLHKCLDFWRRFNCMPRLHLGMTFTSIKHLDPSCIERMTRNHNIESGLIVEQVSKGSHAEKIGIREGDVIESFNGKVHFYYNRVGANADRHMLGIF

SEQ ID NO: 140816 - protein, 153 aa, Triticum aestivum
  Clone ID: PAT_TA_35234.pep
MELSGSPGTWSGLSLRLGQFLFAAASVCVMSSAIGFANYTAFCYLIASMGLQALWSLGLACLDGYALRMKKELNSAVLVSLFVVGDWVTSILSFAASCSAGGVVVLFDKDAYFCSRDPHLPCGTFELATAFAFLSWALSATSALVMFWLLASS

SEQ ID NO: 140817 - protein, 88 aa, Triticum aestivum
  Clone ID: PAT_TA_35235.pep
AWLNMVVRVVSCSFALAKNILRFETMGSVLGNATVFAVSMLTFLQLHQLASGKQMPAVQYRRTDNVSLSGGSRKDTKGKHLEVLLARG

SEQ ID NO: 140818 - protein, 160 aa, Triticum aestivum
  unsure (1)..(160): unsure at all Xaa locations
  Clone ID: PAT_TA_35236.pep
SAQVLGETLIELTHVIFYEGDGPEIQSALAEWTGQRTVPNVLIQWENTSVAVDGELIAPYNHVKLLIVVWSNEQAANSIVRALLLAIGLLPDITPCQVSVXNTCTDKEGSGARRXGGRXGLSKHARXLVAXCVXVXVMIDVLXXTIVFGIXXSHIQTXTX

SEQ ID NO: 140819 - protein, 112 aa, Triticum aestivum
  Clone ID: PAT_TA_35237.pep
MFSTAFMKLTSEAPCEGCPQTSLKCRGNSNNFLHEDKEVMDFNTFDPLFPKKPKKACYEMDPPWEQDRKSQPWWQVADEEGLASLVAERAMQHIENNDLPKPTQIVRIHVDA

SEQ ID NO: 140820 - protein, 337 aa, Triticum aestivum
  Clone ID: PAT_TA_35238.pep
HGVCRSAALKAAVDLRISDAIHRRGGAATLPEVATETGIQPTKLSHLRRLMRVLVTFGIFSVDQGRHADANDVRYKLTPVSRLLVGDYNQSPIVRLFLDPSYVTALCGIAEWFTDEHASARTLFEVVHGCTRDEMVARMDTRGEYNVGVAADSRLVMEVALKEHRGIFEGVSSLVDAGGAHGAAAEAICKAFPHIKCIVLDLPHAIAGAPAIENVQFAAGDLFEYVPPADVVLLKWVMCLWQDEDAVKVLRRCKDAITTGRSDGGKVIIIDVVIGSGVSRDEVLLREMQVLYDVFMMRVDGTDRDEHQWRKIFFEAGFKDYKITPMLGYRSIIEVYP

SEQ ID NO: 140821 - protein, 281 aa, Triticum aestivum
  Clone ID: PAT_TA_35239.pep
MAAKMAKNVDKPLFTATFNVQASSADYVTFINGIRNKLRNPGHSSHNRPVLPPIEPNVPPSRWFHIVLKTSPASTGLTLATRADNLYWEGFKSSDGTWWELTPGLIPGATHVGFGGTYRDLLGDTDKLTNVALGRQQMADAVTALYGRTKADKTSGPKQQQAREAVTTLLLMVHEATRFQTVSGLVAGVLDPQVLDQKSGRISNALKAQVNGWQDLSEALLKTDAKPPPGKAPAKFTPIEKMGVRTAEQAAATLGILLFVQVPGGMTVAQALELFHKSGGK

SEQ ID NO: 140822 - protein, 92 aa, Triticum aestivum
  Clone ID: PAT_TA_35240.pep
LHYLPQMPSQMLVLQIGALLEISASRIQHDHLLLRTMVLLPAASLLAFICRFFRIIYLILNRVILKCCRARLQESWCKGREVLRLSRQRKLQ

SEQ ID NO: 140823 - protein, 211 aa, Triticum aestivum
  Clone ID: PAT_TA_35241.pep
MRPEARLDSAAFQLTPTRTRCDLVVVANGRKEKIASGLLNPFVAHLKVAQEQIAKGGYTILLQPDPGADAPWFTRGTIQRFVRFVSTPEVLERVTTIESEILQLQDAIASQNIPNIVDKSVGAHSFPITPDLCKNIYDPRVVKWYWFTKPDTNQENSLLENTGAHKKHSKVQLLRVLETRKTVLRKEQAMAFARAVAAGFDINNLIYLISF

SEQ ID NO: 140824 - protein, 367 aa, Triticum aestivum
  Clone ID: PAT_TA_35242.pep
KGQAQGRDNSYLKQLSDYIVPALVEAMHKEPDTQICASILESLNESIQMSGTLLDEGQVRYIVEGIKEVITASSNRRTERTERANAEDFDSEEDELLREENEQEDEIFDQVGDCLGTLVKTFKTYFLPFFDELSVYLTPMLGKDKTSEERRVTICIFDDVAEHCREAAVRYYDTYLPSLLEACASENPDVRQAAVYGIGICAEFGGSAFRPHTGEALSRLYNVIKHPNALDLDNAMAYDNSVSALGKICQFHRDSIDASQVIPAWLSCLPLKNDLVEAKIVHEQMCAMLEKSDSELLGHNNQHLPKIVSTFAEILCAGKDLATEQTASKIVNLLRQLQTTLPPSVLASTWSTLQPQQQLALQSVLTS

SEQ ID NO: 140825 - protein, 209 aa, Triticum aestivum
  unsure (1)..(209): unsure at all Xaa locations
  Clone ID: PAT_TA_35243.pep
RTRGPFHIPGGTTVRVPSMTLGRPSHTALYPGFRALKLPYRTDGDRQAAAFYMLILLPDNATLSLTDLYGMAVSMPEFIRKHTPEXEVPVGQFMVPKFKFTSEYEASSDMQKLGVTTAFKGGDFSGMVSGGDGRLSIGGVLHKATIEVDEQGTMAAAATAIAMYGSALRREPPHLVDFVADRPFLFAVVEERTGTTLFLGHXVVNPLAN

SEQ ID NO: 140826 - protein, 654 aa, Triticum aestivum
  unsure (1)..(654): unsure at all Xaa locations
  Clone ID: PAT_TA_35244.pep
EQRLPPQXTFIPLQSIRVKPITERLRTLGGSAQLIFDVIQFDRALEKAVLYAVGNTLVCDKLDEAKTLSWSGERYKVVTVDGILLTKSGTMTGGVSGGMEARSNKWDDSRIESLKKKKSKLEAEMSELGSPRELQRKELAVSEKITGLEKKLHYSNVEQNNLKEKLHKLASEKRNIEKEIDHLEPGKEELESRLAKNEREVRKREKKINEIVDRIYKDFSMSVGVKNIREYEEKQLKDAQALQERKLSLSNQLSKLKYQLEYEQKRDMHAPIAKLNNTHETLEKELKGLQERETRAKADAEHISNQMEELKAEAEDWKLKSDECETAIEELKKQNDSVAAALAKLDRQVKLKEGQIVQLRSRQREIHEKCELEQLKLPTVNDPMDTGSSSQELVLDYSQLSEIYLKEVQLSDRDKLEAEFKQKIGILMAEIERTAPNLKALDQYEALQTKEKEVSEKFEAARKEEREVADKYNSVKQRRYELFMEAFDHISKGIDKIYKQLTKSHTHPLGGTAYLNLENEDEPFLHGIKYTAMPPTKRFRDMEQLSGGEKTVAALALLFAIHSFRPSPFFILDEVDAALDNLNVAKVAGFIRSKSCERAGEEQDGDGGCGFQSIVISLKDSFYDKAEALVGVYRDSERSCSRTLTFDLTKYKEA

SEQ ID NO: 140827 - protein, 68 aa, Triticum aestivum
  unsure (1)..(68): unsure at all Xaa locations
  Clone ID: PAT_TA_35245.pep
QXIRHEGFRFDRERARRRAVEKRRRFRPLSPCWSLIFSLIHGCHGSRVLLWKALVDAAICSASRGTSW

SEQ ID NO: 140828 - protein, 63 aa, Triticum aestivum
  Clone ID: PAT_TA_35246.pep
CFIPIHGLYCLGASCFPGQGVIAVAFSGVMCAHRVAADIDLEQRSPILDTGLLGVLRWLRTLA

SEQ ID NO: 140829 - protein, 481 aa, Triticum aestivum
  Clone ID: PAT_TA_35247.pep
MGSYSPISVSYALVGVAAAAAAQTAAQMLPRQCFKHVFPAEGSSSSILHGPGSRGAGSRGRTTLNFHRCCVRASLWRTDHLHISTARSSEIKVHTLLQVPDVFNTIKSWSKLQLVTVTGLAACVVLLVPSAGATDALKTCTCLLKECRIELAKCIANPSCAANVACLNTCNNRPDETECQIKCGDLFENSVVDEFNECAVSRKKCVPKKSDVGEFPVPDPSALVKNFNMADFRGKWYISSGLNPTFDTFDCQLHEFRLEGDRLVANLAWRIPTPDTGFFTRGAVQRFVQDSSQPAILYNHDNEYLHYQDDWYILSSKIENKDDDYIFVYYRGRNDAWDGYGGAVVYTRSKELPETIVPELERATKSVGRDFSTFIRTDNTCGAEPPLADRIERTVEKGEKLIVDEVKEIEGEIEGEVKELEREEETLVKRLADGIMEVKQDVMNFFQGLSKEEMEILDQLNLEATEVEELFSRSLPIRKLR

SEQ ID NO: 140830 - protein, 192 aa, Triticum aestivum
  unsure (1)..(192): unsure at all Xaa locations
  Clone ID: PAT_TA_35248.pep
HGIVRFFARSSVSPALAASPGLRSPITHVDVTYDGKWILGTTDTYLVLICTIFIDKDGKEKTGFGGRMGNRIAAPRLLKLSPLHSHLAGDNSKFREGRFSWVTDNGKQERHLVTTVGRYSVVWNFLQVKEXHQECYKKQEGLKSCYCYKVIPKDESIVASRFMHEKYDVSDCPEAPLVVATPMQVASFSGSS

SEQ ID NO: 140831 - protein, 151 aa, Triticum aestivum
  Clone ID: PAT_TA_35249.pep
KAAAVAVALGGMMAWMCHYCLPSTVGSLTEKLIEIASLLSRLMPTINREQILAHITGRFEFDGLYKRPAVPLILPGIFTPALARGERFSVCVGTDHHSALSQACVSPLHGLLLLLLNTYHIPYCERKTMFNWLGSCLPRCLLRSITGSLHV

SEQ ID NO: 140832 - protein, 164 aa, Triticum aestivum
  unsure (1)..(164): unsure at all Xaa locations
  Clone ID: PAT_TA_35250.pep
LITDITQELWYRERTSSFRITRVMCHRPALEARDHLYFVCPFAKLCWQYXVLHGTLPTGTDIQDEVAHRKQLLNLPFAMDIIILISWAIWTTRNDFIFQHIPPNLYNCRRRFKEEVKWFTYTTKRKELTGPHGLGSGFQIQLLIALLYLLYFLPLFVLLFVLSF

SEQ ID NO: 140833 - protein, 205 aa, Triticum aestivum
  Clone ID: PAT_TA_35251.pep
MASGNRALPIENGEVLPAAGGNGEGGNGGSGDGFNRNRSSVDQQIDDMRRRLRELEETEREMLAAAAAATHEDPAAAVTALEKAEVDARSIYVGNVDYGCLPEEVQEHFQDCGTINRVTILTDFYGNPKGYAYVEFHEAEAVQNALQLNDTELHGRPLKVCPKRTNVPGMSHHRGRHPFQPYYPPYPAFGRSPRFRRSPRFYPYY

SEQ ID NO: 140834 - protein, 374 aa, Triticum aestivum
  unsure (1)..(374): unsure at all Xaa locations
  Clone ID: PAT_TA_35252.pep
VRGWAEVGTEVRTYEQKHMCDAPANDSVGWRDPGFVFDGLMNGLEPGRRYFYKVGSDPGGWSKTYSFISRDSDANETIAFLFGDMGTYVPYNTYIRTQDESLSTVKWILRDIEALGDKPAFISHIGDISYARGYAWVWDHFFSQIEPIAANTPYHVCIGNHEYDWPSQPWKPSWSTYGKDGGGECGIPYSVKFRMPGNSVLPTGNGAPDTRNLYYSFDSGVVHFVYMSTETNFVQGSDQHNFLKADLEKVNRSRTPFVVFQGHRPMYTSSNEARDSAMRQQMIQHLEPLLVMYNVTLALWGHVHRYERFCPMKNSQCLNTSSSFVYPGAPVHVVIGMAGQDWQPIWQPRRDHPDVPIFPQPXISMYRGGEFGYT

SEQ ID NO: 140835 - protein, 48 aa, Triticum aestivum
  Clone ID: PAT_TA_35253.pep
PRVRQHTAAGTGTGGDYGQQGHPGMAGAGAGEKKGLMDKIKEKLPGQH

SEQ ID NO: 140836 - protein, 366 aa, Triticum aestivum
  Clone ID: PAT_TA_35254.pep
QRLFHQITFLMPVPLSTLFPDSNMNESEGGDHVAELKRKKGKKPKPLKWRSTNSDMNNHRNGEAEEGSDGGRDDDDTVLSSLTRSATPSSTGKEITTAWAIANNDKLSLPENGGSAKTWKRSVTHAYVSHLIQNHLDKDKASQNQVITQERSHSRISSSPSVSTLNKNGMHFDGGNPVQPSIGVCDMAPGRQAMVSTDYLNLPTSAAFSGPQYVQYMHPQMIATHHGPAPYQSYSHLPCSRGNVAPVMSIQQQMQQYMCGPGYAPHPGVPASQAAMKLQQFAPTPQQQQQMWQYHFSQYQPRQAAEGAAAAWQSGRLRDMPSSGSLRPMQALHAPPAMAPPQMELLCAPYQGGGGGAARPPQLRLI

SEQ ID NO: 140837 - protein, 73 aa, Triticum aestivum
  unsure (1)..(73): unsure at all Xaa locations
  Clone ID: PAT_TA_35255.pep
GDRWNRTWGEGXNGSGWVXKYGRSSSGEHWDTHEPQETWYERYPHFGFHHCFENSVQLLSVPRQPPKNFKPGK

SEQ ID NO: 140838 - protein, 372 aa, Triticum aestivum
  unsure (1)..(372): unsure at all Xaa locations
  Clone ID: PAT_TA_35256.pep
MRPRTADHLEALSLEIERKLHKALNSNSQRLKLLQQLFADIALKVDDRARDKILSTNNEGIAPVDDREDGHLCFLCRFLTHHYAKGSXEWLAYHFVLVPQRGSRSLAAIVLPWRLPCAAFIFALLFHRWLFEVSLAGDEVSLRYSSALVQAATNVXFWIDIQINTRYFLPLXLYLLEEVALVPDQLIKISPQAGRNLFCLLSRFMLFYDQDHLLTSFLGHFPAFPNSFLVGGAADYFVIELTDQLQKLKVEPVLLHYLSRMTILQGWELRMSTSTRLKSCLYSFTSPGGPAYPTRAVRHAAWNTLDLLFPVGRYPRHVISLFFRLLYPWYWPSSCWNFVMTCVSTIYYYILNLLVSIWENMRRRDHQRMHRE

SEQ ID NO: 140839 - protein, 199 aa, Triticum aestivum
  unsure (1)..(199): unsure at all Xaa locations
  Clone ID: PAT_TA_35257.pep
DTVVLAAVYGPRPGTRKGENPEKASVEVVWKPKTGQIGRQEKEYEMTLKRTLQSICLLTVHPNTTTSVILQVMGDDGSLLPCAINASCAALVFAGVPMKHLAVAIGCGVLADGAVILDTSKAEEQQLKSFAHLVFPNSSKSVDVKESQQKDGQPERGLITSITHGVMXRGRLLQLYREGSCRIRADLGFHEDHLAEAHT

SEQ ID NO: 140840 - protein, 128 aa, Triticum aestivum
  Clone ID: PAT_TA_35258.pep
IRASSALFIILLTILSIESSKTSKLNSSESQTDYHRSGLKDRLNNMICKTSSLQDRLPQVRSEGQAKTSKLNSSESQTDYHRSGLKGRLNNMICKAPWLPDLTVIRITDRLPQVRSEGHAKTWTSYLA

SEQ ID NO: 140841 - protein, 267 aa, Triticum aestivum
  Clone ID: PAT_TA_35259.pep
YFSCLSGSYSCKLQAYFKDSSIAMIWIEKVKVQYHMKAPIYVYYELHNFYQNQRRYIKSRSHKHLRYGLKYTDSSCSPIEKSDGLPIVPCGLIAWSLFNDTYDFTRGSMGIVVDRKNISWRSDREHKYGKDVYPFNFQNGSLIGGGKLDPDIPLSNQEDLIVWMRAAALPQFRKLYGVIEEDIQADEIITMHITNNYNTYSFGGKKSLVLTTSTWLGGKNDFLGYAYLITGSSSIFLSILFALIHVKIPRPHGDAAYLSWSRKNGNN

SEQ ID NO: 140842 - protein, 156 aa, Triticum aestivum
  Clone ID: PAT_TA_35260.pep
PPRPAPRRPPLRPAPVLPPPRRCAPPPPRPRPGSPRPSEPLRRPAPPPAAPPIEIGACRRPYPLSSLPPPRSRDAPQPLRPPANAPAAAACTPAASALPDRHYVVAPPPCLRADLHLTAGGRRPLPRRRALCLLRTSLDPRAAPFCHGGIQMQMLQ

SEQ ID NO: 140843 - protein, 136 aa, Triticum aestivum
  Clone ID: PAT_TA_35261.pep
MREYQHSADKAKVTAVEESANEVLPENPTVHNPLAVTTNLTPCSEIIEEESEQNTSFKLDNLAAGFSNQPAGQVQQVENKSFTSPDRTVKQAQQVENKPMISPEVQKALGILDTAIAVLQGNRSANIKCSQKAPQL

SEQ ID NO: 140844 - protein, 154 aa, Triticum aestivum
  Clone ID: PAT_TA_35262.pep
PAAAPPGLRCGPLAPASGVLGSWTGTLDCDFLATSTCKITKAGIGGPLVTLDGDVIGMNFYDKRIGTPFLLLVDIYKILASFEIKSELGEVGNDRHPPGAPFWKMDEDDKTKLNRWPVPGQARLIAISFHVPHVNSVRLGLEALLSVLMGMLLA

SEQ ID NO: 140845 - protein, 124 aa, Triticum aestivum
  Clone ID: PAT_TA_35263.pep
MSATALRAPRVAAILLAVVLAAVLATAVNGDQKCGDQARGAKCPNCLCCGKYGFCGSGDAYCGEGSCQSQCRGCRDDVVGAGAACRTGFYKSYCGVLGVGHGIKLDCYNRRPLNSGLTAGLASQ

SEQ ID NO: 140846 - protein, 109 aa, Triticum aestivum
  Clone ID: PAT_TA_35264.pep
GPRYPGPQLSTYTSTPTNLQRLLLSSMSIANLPCCQIALERCLSNLKYLRGLHKHCCCLVHTISSHSSLLLTNILSWVCQDDCLPPSGGGFYGQNEEGEEGYQEHRQED

SEQ ID NO: 140847 - protein, 206 aa, Triticum aestivum
  Clone ID: PAT_TA_35265.pep
VSLVSRRTLSVSQVVGMPLPLWSHHGGELVTPVLRIMSELQKLCGEPTLPISMVLPEEIGSLGGDLAMPTATSSFSLEPSQPLAFVDLGGLAAAAALSPEVVGPVASVGAEFDEVGALTPVSKAPKPVQSLIFDRDAMLARIDEVVFAKKLGRLLTSLDAACPGSAKTIACLLAEEVSTGKIKKVKKAIRNIGKKTDVIRKASATA

SEQ ID NO: 140848 - protein, 72 aa, Triticum aestivum
  Clone ID: PAT_TA_35266.pep
MPAAWRAAGLTYNRYLAIAARVVRRSLKDDKRIVAERRGEMDLRFSKWENGKQGEMQNLAKANAAIAAENAA

SEQ ID NO: 140849 - protein, 137 aa, Triticum aestivum
  Clone ID: PAT_TA_35267.pep
LCAGRAGRFGTTNNQLHLPTTSSNTFNTFPLSQNQLHHTKCSSLLSPLSSPSSPLPSLLPTAAEATTPSALLRTTRSAVTVSSTVLSRFSAATAMATLTAARLTPLLALSSTLLSSTVSSSSRGPVALAARSSLSEC

SEQ ID NO: 140850 - protein, 110 aa, Triticum aestivum
  Clone ID: PAT_TA_35268.pep
MTLTHTVLFQFKSDVDLSEIKEICDSFLALKDQCIHPTSNSPYIVSLVGGKDNSPEGMQNGLTHGFVAIFNSAEDRDYYVKSDPAHQVFIAKVGSVLEKATVIDFTDGVF

SEQ ID NO: 140851 - protein, 105 aa, Triticum aestivum
  Clone ID: PAT_TA_35269.pep
VDTAVAVLANLATIPEGRTAIGQARGIPALVEVVELGSARGKENAAAALLQLCTNSNRFCSIVLQEGAVPPLVALSQSGTPRAREKAQALLSYFRSQRHGNSARR

SEQ ID NO: 140852 - protein, 137 aa, Triticum aestivum
  Clone ID: PAT_TA_35270.pep
MGLSHFALPCGEHYVEMRDFYKAVLAPLGYEFKFEAQGPTGAYYCAFGEKNKGPDFWLGGGGSSLKKYDGNMENRTCPVHFAFDAENPKHVDEWHEAAMKAGAVDNGKPGPRNYRPGYYAAFVLDPVGNNVEVLHLG

SEQ ID NO: 140853 - protein, 72 aa, Triticum aestivum
  Clone ID: PAT_TA_35271.pep
MAGIAYYTIAGKQVAGHYLAMAWLGTLFAGVQYATSGSSAKPTATATPPINASSSDEASFIQDFLNQQDKKN

SEQ ID NO: 140854 - protein, 123 aa, Triticum aestivum
  unsure (1)..(123): unsure at all Xaa locations
  Clone ID: PAT_TA_35272.pep
YXTLVCSARAGRSGGKGSHPRHFEHLPVVLSPSPNSSTQVSSYNTQWLVSLTTPLPASRSPATTWPWPGWEPSSPVSSTPPLEAQLSLPLPLLLPSTPPAPTRPASSRTSLTSRTRRTRRLHQ

SEQ ID NO: 140855 - protein, 136 aa, Triticum aestivum
  Clone ID: PAT_TA_35273.pep
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 140856 - protein, 140 aa, Triticum aestivum
  Clone ID: PAT_TA_35274.pep
MQLTNLFCLASVLTSVSAITVSYDPGYGEAGRAMTAVSCSDGTNGLITRYGWKTQGQIPKFPYIGGAQAVAGWNSPSCGTCWKLTYKGKSINVLAIDHTAAGFNISPAAMNALTNNQAVQLGRVDATATQVAVSNCGLKK

SEQ ID NO: 140857 - protein, 277 aa, Triticum aestivum
  Clone ID: PAT_TA_35275.pep
RGISRSFQSNRLSTNGTLGTLSEVAAETTDNNGDGLDNGAEGSAGKGVEDGGKDVKNTGNDVADEVGNEVDQSTEKTEDEVKDSAEDVVEAESAQDVLGDSNELVDKLDDKANNDLDVRERDVDLDNILELVNDNGEELVDDGDVLVDVGDGSGLAKSAGLDLGDGLLDGANLDGDLVDGNGQNLDNASGVGDLGGGDLLDNGLADGGADNLGNGRDSSRNGGNLSGVDIGSGTSGLGLDLDGGSSHGGRGQSNDGEEAELHGEGVLKIKQVKRVTW

SEQ ID NO: 140858 - protein, 81 aa, Triticum aestivum
  Clone ID: PAT_TA_35276.pep
GPPAFFYYFFFFFLNNMACFLLLIHYDLKQINQLSLCQTPKHNKISMRCHGCSFDRRARPLVTVQELLPLNKHLLVGQGKN

SEQ ID NO: 140859 - protein, 127 aa, Triticum aestivum
  Clone ID: PAT_TA_35277.pep
VIFRAPLAVRASGDGPRDGFIKRVVAKGGDIVEVTDGQLLVNGVVQDEDFVLEPPDYEMDPVSVPEGYVFVLGDNRNNSFDSHNWGPLPVKNILGRSVLRYWPPSKITDTIYDHIDHDVVHGMAGIS

SEQ ID NO: 140860 - protein, 136 aa, Triticum aestivum
  Clone ID: PAT_TA_35278.pep
MPLSGHCLCKAVTYKVDDEPLVVGYDHCDDCQRQSGSTYSLVAVVKKDKLTINGPVKTYSGTKGSSGNIVHRLFCSECGSPIAHDPDAAPEIIALKAGTLDTEIKKNLKPDTEIWTVGKLPFCQEHLAKPFKHMPE

SEQ ID NO: 140861 - protein, 94 aa, Triticum aestivum
  Clone ID: PAT_TA_35279.pep
MRSTAVLRMFRQTPRMLRPVPKEDQAGHTISQRLRKLKQIPPELYPLAVVVGFALGAAGYSISRKFIVDKNLRLARQGPAARAANSGHGESEEH

SEQ ID NO: 140862 - protein, 234 aa, Triticum aestivum
  Clone ID: PAT_TA_35280.pep
MGFTDLLSETGAHVLNSWLSTRSYIVGQSASQADVAAFKALSGPPSGESYPHAARWYKHIASYESQFATLPGDASAPYSTYGPGSAEVTLNPAKAPEKAEEAAAEEDDDVDLFGSDDEEEDAEAARVREERLAEYRKKKENKPKTIAKSVVTLDVKPWDDETDMAALEAAVRSIEKDGLTWGASKLVPVGFGVKKLQINLVVEDEKISVADLEEEIQEFEDYVQSTDVAAMQKL

SEQ ID NO: 140863 - protein, 266 aa, Triticum aestivum
  Clone ID: PAT_TA_35281.pep
MVQQIPKANHILDLLSLKGKVVVVTGASGPRGMGIEAARGAAEMGADVAITYASRKEGADKNVEELVKEYGVKAKAYKLNAADYNDVERFVGEVVKDFGKIDGFVANAGATANAGVIDGSAADWDHVIQIDLNGTAYCAKAVGALFRKQGHGSFVITSSMSGHIANYPQEQTSYNVAKAGCIHMARSLANEWRDFARVNSISPGYIDTGLSDFIDAETQELWRSMIPMGRNGDAKELKAAYVYFLSDASTYTTGSDLVIDGGYTCR

SEQ ID NO: 140864 - protein, 151 aa, Triticum aestivum
  Clone ID: PAT_TA_35282.pep
MSAIPTSTSVIESAVIEASFSDVWHLIKLQDFSKFYSALESSEWVKGSSPDTDIVKWTFKDGTVLEVKQEEHSSIDHYITYSVISSQPALSYTSVVSTIRAYPITSGQNEGQTFVTWSGNFSSDADAGVIADAKFKRREALADLAKAASKK

SEQ ID NO: 140865 - protein, 206 aa, Triticum aestivum
  Clone ID: PAT_TA_35283.pep
LPLGLGLEEASPDILRRPPRSLRSGVFTFDLVRDQLVYGFCSGSLCLAAFMIVNYASSGQGYYNMVPHCNESGTEGCDLVYRARATTFSTGPILLLVTAWEVKHFHRSLFNMDEHASGPFSVFKTIYHNKFLFWSVVAGFVMIFPIVYIPYLNTEVFKHKGLTWEWGVVAGCVIVYVALIETWKAMKRRFNWGIDTHPITQGQVDV

SEQ ID NO: 140866 - protein, 95 aa, Triticum aestivum
  Clone ID: PAT_TA_35284.pep
MQFTTSFIVAAFLGTAFAMPQAAPVDCPETSAIPTCGAPCITSAAAAAGCTDIACQCASSEVIQASALGCVVGNCGIPVALSVQAAAAAVCTACA

SEQ ID NO: 140867 - protein, 95 aa, Triticum aestivum; identical to SEQ ID NO: 140866
  Clone ID: PAT_TA_35285.pep

SEQ ID NO: 140868 - protein, 95 aa, Triticum aestivum; identical to SEQ ID NO: 140866
  Clone ID: PAT_TA_35286.pep

SEQ ID NO: 140869 - protein, 82 aa, Triticum aestivum
  Clone ID: PAT_TA_35287.pep
RYQTAASSQHPPKSPTRTPLYASLTPDISTRLDHVFVNFSVGSLDGAVSAAATAGLAGALNGSAALGAGVVVVVDDRLHLES

SEQ ID NO: 140870 - protein, 82 aa, Triticum aestivum; identical to SEQ ID NO: 140869
  Clone ID: PAT_TA_35288.pep

SEQ ID NO: 140871 - protein, 213 aa, Triticum aestivum
  Clone ID: PAT_TA_35289.pep
MHASPITLLALSASLVSAAKHVVKVGDGGLKFDPAETTAKTGDTVEFHFYKGTHNVAQSGFAKPCEPINSTAFFSGTWDVTQGMSDKVFTINVTSEDPIWYYCAVQGHCQNGMVGAINAPTSGQRSFSNFAKAAEDSEDSVAPRSTGGGEIATATGTMAASGTSEPTGTSTETGASSTESAGANAGLEARGEIRWGLMTAGMAMAGLFGGLMM

SEQ ID NO: 140872 - protein, 85 aa, Triticum aestivum
  Clone ID: PAT_TA_35290.pep
KKSGSVTGTVFKFFVFRYRKGWWQKYNYVLSAALDAGTAFMGVLIFFALQNAHHDLKWWGTEVDHCPLATCPTAPGIVVKGCPVF

SEQ ID NO: 140873 - protein, 114 aa, Triticum aestivum
  Clone ID: PAT_TA_35291.pep
MVVKIRLARFGRRNQPFYNIVVAHARTARNSRPLEVIGTYDPIPKTDPYDDSGKLHKDIQLDRARARYWIGVGAQPTDTAWRLLSMLNILPKKEFGPKKDEIKGVVQKDQIQIR

SEQ ID NO: 140874 - protein, 165 aa, Triticum aestivum
  Clone ID: PAT_TA_35292.pep
MPPKFDPNEVKVIHLRATGGEVGASSALAPKIGPLGLSPKKVGEDIAKATGDWKGLRVTVKLTIQNRQAAVSVVPTASSLIIKALKEPPRDRKKEKNIKHNKSVALDEIIEIARTMRYKSFAKDLSGTVKEILGTAYSVGCQVDGKPPQSVIEAIDSGDIDIPEE

SEQ ID NO: 140875 - protein, 84 aa, Triticum aestivum
  Clone ID: PAT_TA_35293.pep
MSETYTTAEVQKHKDEANGFWLIVENDVYDVTNFIDEHPGGAKILKRWSGKNATKAFWKYHNEGVLKKYGKDLKIGAVGESAKL

SEQ ID NO: 140876 - protein, 169 aa, Triticum aestivum
  Clone ID: PAT_TA_35294.pep
RPMPCGDFCGVSINWHVSSDFNKGWSARVTLFNWGDVDMANWFAAMVMDKAYDGFEKAYSFNATAEGNNTIFMQGLEGLNYLVKQTNMSGSDYLVPGKQQSVLSFTKKLTPDIDVVAGDGFPTKVFFNGDECAMPQRLPIKSGGFRTHLSSAFALVLLMAASALLLLQQ

SEQ ID NO: 140877 - protein, 100 aa, Triticum aestivum
  unsure (1)..(100): unsure at all Xaa locations
  Clone ID: PAT_TA_35295.pep
AGRSGDSPSGIQSPHTNXPSEPPRTRITDFKMSLVDAKNPVPNYQRFYQNAYKNHTRLWKIGPRSRMLMTPYLILLWGSLGASFYGAGRKVLGYNSYFGN

SEQ ID NO: 140878 - protein, 112 aa, Triticum aestivum
  Clone ID: PAT_TA_35296.pep
NSKKKKKKKKKIKKKKKKKKKNPFHHPTRTPSEPPRTRITDFKMSLVDAKNPVPNYQRFYQNAYKNHTRLWKIGPRSRMLMTPYLILLWGSLGASFYGAGRKVLGYNSYFGN

SEQ ID NO: 140879 - protein, 116 aa, Triticum aestivum
  Clone ID: PAT_TA_35297.pep
MSSSSAEQRSDLEEEQVDQEKPQRKTKTKKSKGERRKRRARFDDYDDEQDNQMSQSNYNAQQQQMQQQQQQQQMQQQGGGGGGKSDALSLHLELNLEIEIQLKARIHGDLTLCLLN

SEQ ID NO: 140880 - protein, 39 aa, Triticum aestivum
  Clone ID: PAT_TA_35298.pep
PAGPGKSRGLNKGHRYNKTKAGRRKTWKRHNTLSLWRYR

SEQ ID NO: 140881 - protein, 203 aa, Triticum aestivum
  Clone ID: PAT_TA_35299.pep
MGALKYVEELQKKKQSDVVAFLLRVRCWELRQLNVIHRASRPSRLDKARRLGYKAKQGYVIYRVRVRRGGRKRPAPKGATYGKPTNQGINQLKYQRSLKATAEERVGRRCANLRVLNSYWINQDSTYKYYEVILVDPQHKAIRIDPRINWIVNPVHKHREARGLTATGKKSRGLNKGHRYNKTKAGRRKTWKRHNTLSLWRYR

SEQ ID NO: 140882 - protein, 194 aa, Triticum aestivum
  Clone ID: PAT_TA_35300.pep
MEKQADKAAAPADDGIHEESPASAQNGRPGSEPAAAPEVEVQLFRRGRGPVAVFRSPLGGYTQDQLEVGDILEKHGLKCVFAFDAASRARGVAIRFNPRNGRSLLPYAADSTIFLDGEPKDPLLKPITKVMLTVCTMTVVVAVLLKEGKMPEWLKGTKLGNLKFPPWVLACMVIVFMRLRKRTRDVMKKIGWSS

SEQ ID NO: 140883 - protein, 262 aa, Triticum aestivum
  Clone ID: PAT_TA_35301.pep
MPPNKSGKKVAPAPFPQGKAGKKAAKNPLLEKRPRNYGIGQDIQPKRNVSRMVKWPEYVRLQRQKKILQMRLKVPPALAQFQHVLDRNTAAQAFKLLNKYRPETKAEKKERLLQEATAVKEGKKKEDVSKKPYTVKYGLNHVVGLIENKKASLVLIPNDVEPIELVVFLPSLCKKMGIPYAIVKGKARLGTVVHKKTAAVLAITEVRSEDKTELSKLISAVKDGYLEKHDQARRQWGGGIMGAKAQMKIIKKQKALEAATKI

SEQ ID NO: 140884 - protein, 253 aa, Triticum aestivum
  Clone ID: PAT_TA_35302.pep
MFTLQALQLVSMCTLVYGHGYLSKPMSRTGLNAEAGPDTCPECTILEPVTAWPDLDAAKVGRTGPCGYNARVSVDYNQPGANWGKEPIATYKPGQVADVQWCVDNNGDHGGMYAYRICQDQDIVDKFLDPNYVPTESEKQAAEDCFEEGLLPCTEVDGQECGYSPDCSTDQPCHRNDWFTCRSFQGDSDGKGCRGVDNAPINSCYTSIAGGYTVSGKIKIPDYISNHTLLSFKWNSFQTPQVYLTCADIAISA

SEQ ID NO: 140885 - protein, 136 aa, Triticum aestivum
  Clone ID: PAT_TA_35303.pep
MDGKKKPTAATGSSIVDDLFGPKDGAASSSAGYFSTVFPTPSGATGKDASLRAAAAAGNKSSSAGHQQQGKQHGGSPESPYFGSSSVHYGGRDFYAGAESQRQYSAAAAAPAPKHKDDGDTSAATRGDWWQGSLYY

SEQ ID NO: 140886 - protein, 246 aa, Triticum aestivum
  Clone ID: PAT_TA_35304.pep
SVNSSPLPPTRSALYYTKCISSWTPPTFYHIKPQLPIPSITMPRITASVSKVTRTLTESHRHAGVALMPKYAELLGSSSEQSESRGLKTTHRPTPQPSIAGRTRPLMQSFSSSASSRAPVNHVDTMVLPKIYATPSHNEPLPRMPLLPDNYGSYHNSMSDATDLSTGHRPIIFAINPDIVVPGAPLANMDATNMDSIDVKFVHDQPKISTAAAGEQYNPERSTFMIDMYRSMKEDLLSVAPQLKRN

SEQ ID NO: 140887 - protein, 70 aa, Triticum aestivum
  Clone ID: PAT_TA_35305.pep
CGARAGGPLAGRALILTSNINYYNTLFNNFLPTTKQSSQWLATVAALVPLLATAALAALALAAANKQLDL

SEQ ID NO: 140888 - protein, 154 aa, Triticum aestivum
  Clone ID: PAT_TA_35306.pep
KAVEILMGSAGSKKFQTKVEWGIDLASEHERYLTEVIFKKPVIVYNYPRGIKAFYMRLNDDQKTVAAMDVLVPKVGELIGGSQREERFDILKQRILDAGLPMESYEFYLDLRRYGSVKHSGFGLGLERMLLFATGLDNIRDVIPFPRYPGKADL

SEQ ID NO: 140889 - protein, 261 aa, Triticum aestivum
  Clone ID: PAT_TA_35307.pep
MKFLNPIAVILSLASSIAQGAEAATTESSHLRGEEVKYQGLTLYVSKPHKSLGYKTPGTRVGVLFLTDIYGLKLKENKELVDKFAKEGYITVAPDLFKGSPAPSEDTPGFNVTEFLAKYPPSVTDPVVAKAIKYIREELKVSKVAATGYCYGGRYVFRQLDKKGGVDVGFTAHPSLLQTEEIEAVTKPVSIAGAADDNIFPQPRQAETNAILTKIGKPFSSALYSGTTHGFAVRANTSDPQQAFAKNEAFYQAVRFFEAWD

SEQ ID NO: 140890 - protein, 68 aa, Triticum aestivum
  Clone ID: PAT_TA_35308.pep
MDASKQPVKLVKVTRVLGRTGSRGGVTQVRVEFMDDQTRSIIRNVKGPVREDDILCLLESEREARRLR

SEQ ID NO: 140891 - protein, 68 aa, Triticum aestivum; identical to SEQ ID NO: 140890
  Clone ID: PAT_TA_35309.pep

SEQ ID NO: 140892 - protein, 155 aa, Triticum aestivum
  Clone ID: PAT_TA_35310.pep
AGPLREAGRSHQKSCPKQASIYSSRPRPPPNPPISLQSQQWTPPSSPSSSSRSPESSAEPVLVVVSPRSALSSWTTRPDPSSETSRAQSVRTTSFASSSPSVRPDDYDKCAFWGAWGSWKTVNDGWSMHAEACAPCIGTLTWSCTLPFWHSSFIC

SEQ ID NO: 140893 - protein, 204 aa, Triticum aestivum
  Clone ID: PAT_TA_35311.pep
MSQAFVQRPAPEFTATTLFPGGEFKDIKLSDYQGQWVVLLFYPMDFTFVCPTEIIQYNNALDRFKEINTTVFGVSTDSHFTHLAWVEKPRKQGGLGPDLELPLIADKSTKISRNYGVLIEDEGIALRGLFIIDPKGVLRQITVNDLPVGRDVEETIRLVKAFQFTDEYGEVCPAGWQEGGKTMKADPKGSLEYFSAQGENGAKA

SEQ ID NO: 140894 - protein, 235 aa, Triticum aestivum
  unsure (1)..(235): unsure at all Xaa locations
  Clone ID: PAT_TA_35312.pep
MTPSLQDAKITFLGGGNMAAAIIGGLLAKNTNKQNIYVSEPWDVNRNKMADLGVRTTADNKEAAADADVVILAVKPQVAKGVCEELSSAWAGRDSLPVVISIAAGITLASIAQWFKGDSGKAPHIVRVMPNTPALVGEGASGLYAAEDVTAAEKELTSALLGSVSKATEWVDKEELLDVVTGISGSGPAYFFAFVEHLISSGVSLGLXREQATRLATQTCLGAGKMLVESSDEPS

SEQ ID NO: 140895 - protein, 87 aa, Triticum aestivum
  Clone ID: PAT_TA_35313.pep
MENDRGEIVDLYVPRKCSATNRIIKAKDHGSVQISIAKVDENGRAIQGENHVYALCGFVRAMGESDDSLNRLAQRDGLLKSVWSGQR

SEQ ID NO: 140896 - protein, 87 aa, Triticum aestivum; identical to SEQ ID NO: 140895
  Clone ID: PAT_TA_35314.pep

SEQ ID NO: 140897 - protein, 154 aa, Triticum aestivum
  Clone ID: PAT_TA_35315.pep
MSSSEQTFIAIKPDGVQRGLVGPIISRFENRGFKLAAIKLMTPGKEHLEKHYADLAGKPFFAGLIEYMNSGPICAMVWEGRDAVKTGRSILGATNPLASSPGTIRGDYAIDVGRNVCHGSDSVENAQKEIALWFKEGEVVSWKSAQFNWVYEKA

SEQ ID NO: 140898 - protein, 106 aa, Triticum aestivum
  Clone ID: PAT_TA_35316.pep
MAADTPAKSGLAVGLNKGHKTTPRVVKPRVSRTKGHLSKRTAFVREVVKEVAGLAPYERRVIELLRNSKDKRARKLAKKRLGTFGRAKAKVDELQRVIAESRRAGH

SEQ ID NO: 140899 - protein, 106 aa, Triticum aestivum; identical to SEQ ID NO: 140898
  Clone ID: PAT_TA_35317.pep

SEQ ID NO: 140900 - protein, 284 aa, Triticum aestivum
  Clone ID: PAT_TA_35318.pep
MGGVLGLVQVDQSTVAIKETFGKFNEVLEPGCHFLPWCIGQRIVGYLSLRVKQLDVRCETKTKDNVFVTVVASVQYRALVDKASDAFYKLSNTKQQIQSYVFDVIRATVPKLELDDAFVQKDDIAKAVEEELEKAMSMYGYEIVQTLIVDIEPDVHVKRAMNEINAASRMRSAANDKAEAEKILQIKRAEGEAESKYLAGVGIARQRQAIVDGLRDSVLAFSENVPGTTAKDIMDMVLVTQYFDTMKEIGASSKSSSVFIPHGPGAVKDVASQIRDGLLQANTL

SEQ ID NO: 140901 - protein, 210 aa, Triticum aestivum
  Clone ID: PAT_TA_35319.pep
AGRSGFGIYYNHGQCCCAGTRIFVQESIYDKFLAAFKKRAEENKVGDPFNEETFQGPQVSQLQYDRIMGYIKAGKDEGATVEIGGERLGDKGYFIKPTIFSNVRPDMKIMQEEIFGPVCAISKFKDEAEVIDLAHDTAYGLAAAVHTKNLNTALRVSNALKAGTVWVNCYNMLHHQLPFGGYKESGIGRELGEAALANYTQNKSVAIKLY

SEQ ID NO: 140902 - protein, 192 aa, Triticum aestivum
  Clone ID: PAT_TA_35320.pep
MPAYNSVFNSDPNVPRIIGNFPLLPLRTKTRGPAYTLPAPSPPLPANESPDPDSDSYDILDEVLALFRANTFFRNFEIQGPADRLLVYGIWFVSDCLTKIRPHASLRDAQKDVMNLALDLNFAIPGDPGWPLNQMYEAPKDRQEAEQLKQYMSQVRQELAARLLARVYDEDETKPSKWWLSFTKRKFMGKSL

SEQ ID NO: 140903 - protein, 149 aa, Triticum aestivum
  Clone ID: PAT_TA_35321.pep
MPTRLSKTRKHRGHVSAGKGRVGKHRKHPGGRGLAGGQHHHRTNMDKYHPGYFGKVGMRYFHKQQNHFWKPIINLDKLWSLVPQETRDAYVKGEKKDTVPVLDLLPLGYSKVLGKGRLPEIPLVVRARWVSRLAEEKIKQAGGVVELVA

SEQ ID NO: 140904 - protein, 69 aa, Triticum aestivum
  Clone ID: PAT_TA_35322.pep
MESLKQGVNYVAETVQQAASGASKETNKQVAKDSNAPIGTRASAAKDALSDKADEKTHEGKASVHKEAI

SEQ ID NO: 140905 - protein, 244 aa, Triticum aestivum
  Clone ID: PAT_TA_35323.pep
ARSRAGRAEILLPIEHSQTKQHHTNSVLKIPQTSATTMSDETATKFETVSDLPPSLAAAASQMVQYAGTCVELETDEVTKQDKRRFDWPSFKKCFDDYGGIDLAMLDYKEFTISRSEIDLSMMVQRIVESFVREFHIIGYENVTTLLRTTIEKTFTNLEEKSSNECLYFSKSAGGQGSFWEYGVHIAVPIPSSANSFHSFITTIKLEADVSDQNDWWGLTGSSRKNFSATMNGMKFEVEEGFKN

SEQ ID NO: 140906 - protein, 156 aa, Triticum aestivum
  Clone ID: PAT_TA_35324.pep
MSLVSGEKSNFQFILRLLNTNVDGKQKVMYALTKIKGVGRRYSNLVCKKADVDLNKRAGELTSEELERIVTILQNPTQYKIPTWFINRQRDIVDGKDSHILANGVDSKLREDLERLKKIRAHRGLRHYWGLRVRGQHTKTTGRRGRTVGVSKKKGG

SEQ ID NO: 140907 - protein, 156 aa, Triticum aestivum; identical to SEQ ID NO: 140906
  Clone ID: PAT_TA_35325.pep

SEQ ID NO: 140908 - protein, 62 aa, Triticum aestivum
  Clone ID: PAT_TA_35326.pep
MGKVHGSLARAGKVKSQTPKVEKQEKSKVPKGRALKRLKYTRRFVNVTLTGGKRKMNPNPGS

SEQ ID NO: 140909 - protein, 62 aa, Triticum aestivum; identical to SEQ ID NO: 140908
  Clone ID: PAT_TA_35327.pep

SEQ ID NO: 140910 - protein, 76 aa, Triticum aestivum
  Clone ID: PAT_TA_35328.pep
MPRNGDGSSDNGPFEEAKHDIVHGAGKVESDHVDRADKTADLPEGKDEKGLALEGVNASGGQSQGLAKGKDVGQGN

SEQ ID NO: 140911 - protein, 262 aa, Triticum aestivum
  Clone ID: PAT_TA_35329.pep
PAGPGQDYHYNTRKTITMPRKKLRILCFGDSLTSGYYCQGLMSHPYAAKLEDRLTGTFPEVDFDIVVSGVPGDIASSERFSIRTKTAWRARAYDWTIVLGGTNDIAFGIPPDVIFSSLKKTYDFARDKGAKVLALTVPECSADNERTMAARNALNERILKNKSRNYYAFDLRSKIPFHSLSQQDRHRYWDDHVHLGKEGCDWMGNHIADALIDILWHEGTFEQPSEPSDEVDVEEEFVYDEEDGNPHNINEGYIVVRKKDLD

SEQ ID NO: 140912 - protein, 144 aa, Triticum aestivum
  Clone ID: PAT_TA_35330.pep
MPRQRSVGRAPSRPTAAASAPKPQQTRPAATHAAPAAHPPAQAMPPQAAGSQGPGLFGQMASTAAGVAIGSSVGHAIGGMFGGSSEPAAPVQAQAAPQEQSWNQNNCAGVAQNFTKCMDDNNGNMQICNWYLEQLKACQAASGQ

SEQ ID NO: 140913 - protein, 82 aa, Triticum aestivum
  Clone ID: PAT_TA_35331.pep
LPQNAATRLACRTLVTTALDSDRSRREAALMKFRMKRKDRCFEKKVRYHSRKKLAEQRPRIKGQFVSQKLKSATTTEDAETD

SEQ ID NO: 140914 - protein, 113 aa, Triticum aestivum
  Clone ID: PAT_TA_35332.pep
MKQKMVIRVHMTCDKCRSKAMGLVASIYGVERVEIQGDDRDRLAVVGDGVDAANLTAYLRKKVGNADLLTVEAVVPEKKPAPAPETTEAPWCPGYYSWPAGAYSHCYPYTYSM

SEQ ID NO: 140915 - protein, 435 aa, Triticum aestivum
  unsure (1)..(435): unsure at all Xaa locations
  Clone ID: PAT_TA_35333.pep
SFTDKSEASTNEKIHSRVARAQSKSDEPASRASSPRPTGSSSPRLVQRKAESERRSRPPVSPESPSKKSNEAASPRRGARSKPSQVRSNRDNEASQSPGRRISLAKQIDVSVMDCQSPLAARSSFIDPNTPSQKSPSSILGSDHKIHSLENALSPVSVLDTSFYHKSISDSFKDGETHTSDECWNXTACRTRRKSKTSSEVSQIKXENLEALIQKLEQLQSMNDEAANSKDHQYIYEILLASGLLHKELSFAAMPAQLSPSSCPINPELFLILEQTKPHFISATQAVTGAKKSSDPNMGKLHRRIVFDLVNEIIAQKMNIYSSASGTAKLLRSRKLSGWRLFKELCTEVDRLLSESSAAKCSEEDEDENIPLSEDALYEMKDWGSPEGELQGMVLDIERSIFRDLIDEVIGCEATERMQAGQWKLRRQLSFSSIN

SEQ ID NO: 140916 - protein, 103 aa, Triticum aestivum
  Clone ID: PAT_TA_35334.pep
LCGAGRAVSRLTHIQASISQSPLLNVKMLSRAATRTTTSLVTKRGFQTTRARMSSPYHYPEGAYSNIPFNPRSKWFGVGYWTFMATGFFAPFGIAVWQTYKPQ

SEQ ID NO: 140917 - protein, 106 aa, Triticum aestivum
  Clone ID: PAT_TA_35335.pep
AALAAAGAGLVSSLTHIQASISQSPLLNVKMLSRAATRTTTSLVTKRGFQTTRARMSSPYHYPEGAYSNIPFNPRSKWFGVGYWTFMATGFFAPFGIAVWQTYKPQ

SEQ ID NO: 140918 - protein, 234 aa, Triticum aestivum
  Clone ID: PAT_TA_35336.pep
MPPLPRLLHRHLSAPFARRLTPCHLWQPAADVFLRRGLASSSAAAAAAAAGREKSSRKTLGYLVGVAVAMVGASYAAVPLYRRFCQATGYGGTVQRRESVEEKISRHARVGTTPSREIVIQFNADVADGMPWKFIPTQREVKVKPGESALAFYTAENRSSAPITGVSTYNVAPMKAAIYFNKIQCFCFEEQTLLPGEQIDMPVFFYIDPEFETDPKMDGVNNIVLSYTFFKVKE

SEQ ID NO: 140919 - protein, 139 aa, Triticum aestivum
  Clone ID: PAT_TA_35337.pep
NTWPHCKPRNFNGTMELYILSYRLRRRLIGEHTRSYISMKYTGSRLICHIRPGREWKGRRGVVRAARSRLLIFFSFPCSFFITCCCFFLPPSPESLTNEEEEGEEEDVFLGSTWTSEGPQQNPMSEASYLASLLPLSLR

SEQ ID NO: 140920 - protein, 118 aa, Triticum aestivum
  Clone ID: PAT_TA_35338.pep
VTDSGVVYIGEHTRSYISMKYTGSRLICHIRPGREWKGRRGVVRAARSRLLIFFSFPCSFFTTCCCFFLPPSPEPLTNDEEEEEEDVFLGSTWTSEGPQQNPMSEASYLASLLPLSLS

SEQ ID NO: 140921 - protein, 120 aa, Triticum aestivum
  Clone ID: PAT_TA_35339.pep
TNKRTHKIVYFYEIHCCSRLIYHMRPGREWKGRRGVVRAARSRLLIFFSFPCSFTPCCCFFLPPSPESLAEDEEDEEEEVAVFLGSTWTSEGPQQNPMAAASKLASLLCFLSQLTLFFSK

SEQ ID NO: 140922 - protein, 139 aa, Triticum aestivum; identical to SEQ ID NO: 140919
  Clone ID: PAT_TA_35340.pep

SEQ ID NO: 140923 - protein, 135 aa, Triticum aestivum
  Clone ID: PAT_TA_35341.pep
INRTCGKITKLETSTELWKLCILSSRLGHRLIGEHTRSYISMKYTGSRLICHIRPGREWKGRRGVVRAARSRLLLFFSFPCSFFTPSCCFFLPPSPESLVEEEEDEEEDEEEVVVVWGSTWTSEGPHQNPMAAAR

SEQ ID NO: 140924 - protein, 121 aa, Triticum aestivum
  unsure (1)..(121): unsure at all Xaa locations
  Clone ID: PAT_TA_35342.pep
QEVFQPLKNHPXRFNELLENIYTVLDFFNSRMDMQQLDGEWSVDKVLELINKNCRSWRGEGMKMFTQLRFTYEQESHPEEFFIPYAWRLILSRGFSFNPGAINLFPVEIHVDDSPSSEQKV

SEQ ID NO: 140925 - protein, 228 aa, Triticum aestivum
  Clone ID: PAT_TA_35343.pep
MVSFTYLLAAVSAVTGAVAAPNPTKVDAQPPSGLLEKRTSPTTGVNNGFYFSFWTDTPSAVTYTNGNGGQFSMNWNGNRGNHVGGKGWNPGAARTIKYSGDYRPNGNSYLAVYGWTRNPLVEYYIVENFGTYNPSSGAQKKGEINIDGSIYDIAVSTRNCAPSIEGDCKTFQQYWSVRRNKRSSGSVNTGAHFNAWAQAGLRLGSHDYQILAVEGYQSSGQATMTVSG

SEQ ID NO: 140926 - protein, 88 aa, Triticum aestivum
  Clone ID: PAT_TA_35344.pep
MVSYTPIRMAEFKSNYGPKYHAQPNLAGYTAQSAFRIASRLAMYGAPAAVGVMLFANGIPRVQRDILQKIPVLGGFFRKEVHPADNPF

SEQ ID NO: 140927 - protein, 115 aa, Triticum aestivum
  Clone ID: PAT_TA_35345.pep
MGKEFGSMEEFWGFYLGQHSKPATRRWHFAGTLASLVCALLAAATGRAALLVACPVLGYGMAWYSHFFVEGNWPATFGHPVWSFLCDYRMFALILTGRIDAELARLRVHPRLASD

SEQ ID NO: 140928 - protein, 139 aa, Triticum aestivum
  Clone ID: PAT_TA_35346.pep
RPGSPAGSGLSYHHPVSFLRNQLLILLDHTTMAAQLRLQDSKEKFQAAYNAAVTQKESSEKDWKDEKEAGMHDQEFDQWFPINAPAYAVAFQQYRGARAAYEAALHAVDEQAARSWQEKVRQAVIDNKLNYNILIGPDE

SEQ ID NO: 140929 - protein, 215 aa, Triticum aestivum
  Clone ID: PAT_TA_35347.pep
PAGAANATTSIESRSLAIMAALRSQSAARMLRSAAVPRVALSAAPRRFQSNITSATGTITGPVANEPDYNIQADKATSTYTPVPRSIQDGSEEILPAAIMSGAPMELQARTVRIYQEAKPATQSGDWRGRRWRMDWDILPKGHRWENPLMGWQSSGDFMQGTHINFESKEDAIHFAEKQGYEYFVQEPNSRKFAPKAYANNFLYSARKLKHIRTK

SEQ ID NO: 140930 - protein, 94 aa, Triticum aestivum
  Clone ID: PAT_TA_35348.pep
MGRRSSNASKAEAGGEQHRKEEKHHKHMEQLAQLGAVAAGAYALHEKHKAKKDPENARSHRIKEEIAATVAVGSAGFAFHEHHKKKDAKNQGHH

SEQ ID NO: 140931 - protein, 122 aa, Triticum aestivum
  Clone ID: PAT_TA_35349.pep
MATEVLRPHNILQPQPQRIRAAHRRPSNPGTTRKSPPPSASTTGRRNHGRPSSSSSSSSYGKVTSAAAPARRPAAEVYAGPAFSAASPEPSSLPLPQFPLHKPAAAVNDAATRDLRRMLRLE

SEQ ID NO: 140932 - protein, 121 aa, Triticum aestivum
  Clone ID: PAT_TA_35350.pep
MATEVLRPHSILQPQTQRIRAAHRRPSNPGTARRSPPPSASTTGRRNHGRPSSSSSSYGKVTYAAAPARRPAVEVYAGPAFSAASPEPSSLPLPQFPLQKPAAAVVNDAATRDLRRMLRLE

SEQ ID NO: 140933 - protein, 233 aa, Triticum aestivum
  Clone ID: PAT_TA_35351.pep
MAGADVDVGTELRLGLPGGGAEAAKAGKRGYEDTIDLKLTLPTGGMQEDSAGKPEPAADKAKRPAEAAAADPEKPPAPKAQAVGWPPVRSYRRNAMTVQSVKIKKEEETEKQQPAAGAAAGANGSNFVKVSMDGAPYLRKVDLKMYNTYKDLSIALQKMFSTFTATGNEGKMVEAVNGSDVVTTYEDKDGDWMLVGDVPWEMFAASCKRLRIMKGSEAIGLAPRAKDKYKNKS

SEQ ID NO: 140934 - protein, 254 aa, Triticum aestivum
  unsure (1)..(254): unsure at all Xaa locations
  Clone ID: PAT_TA_35352.pep
MAADLGFEATELRLGLPGGGEGEARSSSGKRGFAETIDLKLKRXPAGEEAPAEEDRADVAVVAAAAAENQEETATDAGGGKMKRSPSQSSVVTTAALPDPAEKPRAPKAQVXGWPPVRSFRKNILAEKSSPAAAAAFVKVSMDGAPYLRKVDMGTYKSYQELSKALEKMFSSFTIGNDCSQAQGMTGMNESKLVDLLNGSDYVPTYEDKDGDWMLVGDVPWEMFVASCKRLRIMKGSEAIGLAPRAMEKCKSRS

SEQ ID NO: 140935 - protein, 447 aa, Triticum aestivum
  Clone ID: PAT_TA_35353.pep
LPAPRGRGGRRGGGGAAGRGNKKPAAAGRGRPAPKARGKRVEAIDLTDQPFEDIPEAIVGEAVAATAQQDLGLNKVADRAANFKMEGASGDRLAAAEDEATTTPVPERVQVGGSPEYITDRKLGKGGFGQVYVGRRITGGASRTGPDAYEVALKLEHRRSKGCSYGPPFEWQVYQSLNGCYGIPSVHYKGRQGDYYILVMDMLGPSLWDVWNSMGQAMSSHMVACIAVESISILEKLHSKGFVHGDVKPENFLLGQPGSPDEKKLFLIDLGLASKWKKASSSQHVEYDQRPDIFRGTIRYASVHAHLGRTGSRRDDLESLAYTLIFLIRGRLPWQGFQGDNKSFLVCKKKMATSADVLSCFCPPPFKHFLEMVTNMKFDEEPNYAKLISLFDSLIEVPASRPIRIDGALKVGQKRGRMVVNLEEEEQPKKKVRLGSPATQWIWAYGA

SEQ ID NO: 140936 - protein, 188 aa, Triticum aestivum
  unsure (1)..(188): unsure at all Xaa locations
  Clone ID: PAT_TA_35354.pep
RRGSKRGNGDGRRRGEDEESPSQSSVVTSAALPDPAEKPRAPKAQVGEGGPPVRSFRXNILAEKSSPAAAAAFVKVSMDGAPYLRKVDLNMYKTYQDLSKALEKMFSSFTIGNCGTPGMNGMNESKLMDLLNGSEYVPTYEDKDGDWMLVGDVPWEMFVESCKRLRIMKGSEAIGLAPRAMEKCKNRS

SEQ ID NO: 140937 - protein, 232 aa, Triticum aestivum
  unsure (1)..(232): unsure at all Xaa locations
  Clone ID: PAT_TA_35355.pep
MSAGAYDRHITIFADNGRLYQVEYAFKAITAANIMSVGVRGKDCAVVLSQKKVPDKLMDPASVTHIFQLSPSVGCVITGSIADARAFAQRAQGEAAEFRYKYGYEMPADALAKRLANISQVYTQRAYMRPYGVATTLISLDSEYGPQLFKCDPAGYYIGYKGTAAGPKQQEALNHLEKKLRNKEHAEGSWEEVVELAITTLSTVLSMDFXKGEIEIGIVGGPPTEVKRGTTR

SEQ ID NO: 140938 - protein, 152 aa, Triticum aestivum
  Clone ID: PAT_TA_35356.pep
MSQAMRIVPGNSNVQSYTHISHTSSAPSAPGIHDTLRHGVGASPFDSKTTPASAHPLEARLKNWEATQESLKMETLRRTYGMAEPIRRGMELKIVQNGEWRPMALGGGLPSVHEEILRGRDTTITWEDVFKGDETRAVAGFHDEMEKKLKIQ

SEQ ID NO: 140939 - protein, 103 aa, Triticum aestivum
  unsure (1)..(103): unsure at all Xaa locations
  Clone ID: PAT_TA_35357.pep
CAALEPAGNRYFYFSSSNISKRKAFACLQKNNGIFSAAIEELGGVVQEVAGGDAAVRYKTKFLEQGKRCEAGGSGVFPRRCQRRSVDLGPGQXEVXPQPTRHI

SEQ ID NO: 140940 - protein, 56 aa, Triticum aestivum
  Clone ID: PAT_TA_35358.pep
MSHESVWNSRPRNYGKGSRSCRVCKHKAGLIRKYDLNLCRQCFREKAKDIGFNKYR

SEQ ID NO: 140941 - protein, 56 aa, Triticum aestivum; identical to SEQ ID NO: 140940
  Clone ID: PAT_TA_35359.pep

SEQ ID NO: 140942 - protein, 166 aa, Triticum aestivum
  Clone ID: PAT_TA_35360.pep
MKKSFCFRGSAAKRAGRTPMADWCVFCDIARRAPASTAVLLYSDDKVVAFQDINPSAFRHYLVIPIEHIPTVKNLQRTNEDHQLVSHMVKVGKDLLSRDAPKSEEHRFGFHQPPFNSIDHLHLHCLALPFIPSWRQVKYTPLGPLGGFIDAEKVLEKIKPETEVYS

SEQ ID NO: 140943 - protein, 392 aa, Triticum aestivum
  unsure (1)..(392): unsure at all Xaa locations
  Clone ID: PAT_TA_35361.pep
CRHHLAATGRRRSPGGLEAPPAARLLGAARQRDYPPEFRRWYVVLAENTTGAGVTGGGEINGQGGAFVVTPSAQKNVMVSWNATGDCLGDECRPRLLGFIDSKDVAVHDITLNQPALWCLHLVRCDNSVIRNVSIYGDFDTPNNDGIDIEDSNNTVITDCHIDTGDDAXICPKSSTGPVYNLTATNCWIRTKSCAIKFGSASFFNFEKLLFDNITIVDSHRGLGMQIRDGGNVSDVTFSNIKMRTRYYHPSWWGRAEPIYITTCPRHPDSKEGTISDVRFINISSVSENGVFLAGSKHGLLRNLKFKNVDLTYKRWTNYTGGLYDYRPGCQKMVKHKTGGMMLEHISGLEVDNVSMRWWRGSLKGWDVNPLLFRPSTIDGLSFHDWQSLDVQ

SEQ ID NO: 140944 - protein, 227 aa, Triticum aestivum
  Clone ID: PAT_TA_35362.pep
SVLSRLTSIFLGFAPPFLLLSIGYEAVFYSAFALVLMGWIFLESANLFCSEGSNSSCHSSLADGSVYGYDERCLQLSDLRIPRRPMILFNVAFFGTGNFASIASFEISSVYRFITIFSPFLMTALLIFKLFIPYMLVICTFSAITKIVRVPRIGCYFLVILFSDVMTIHFFFLVQNTGSWMEIGNSISHFGIVSAQVVFVLLLFALTNIYTKDIEVSSWQLTSRKYM

SEQ ID NO: 140945 - protein, 194 aa, Triticum aestivum
  Clone ID: PAT_TA_35363.pep
MPRVVSRSPPSHRRRRSPSPRYGSRRRSPSPRYGSRRIRRDRSRSPYSSRRKSRSPSPRWDRSQSPIPRRRKSPPSPRRHRRRRSRSSSSSLVNNSSPSHGSEQNSLIEKQRKEEEKKSFHRRRQKEAELKLLEEELARRVEEAVRKNVEECLNSEEVKDEIKRRVEEGIKKLFDEVDAQLQKKKKKSLLGARR

SEQ ID NO: 140946 - protein, 187 aa, Triticum aestivum
  Clone ID: PAT_TA_35364.pep
RGKHGDPRRTDPNQTFSTPILTTPSPPPPPQSPPPTDRSDGRLHRRVQGRGRPRRPVGRRPLRRLRAGGPGAEPRVGRRRSGAGPPPPRPSPPAPPSASPPSASDCGRLRPLRPSFRSFDGLLLYIYLSSRRAVSRLRDRMSCLYLASFVRLFVLALGSDLPATVRRSVTMMMMIITSLVEIVPVCL

SEQ ID NO: 140947 - protein, 257 aa, Triticum aestivum
  Clone ID: PAT_TA_35365.pep
MKFTVSFAALAAGAFQAVAGQTVYFAGDSTMARSGANDGATDGWGNYIGKYLKVNAVNKAIGGRSARSYTNEGRFQEIVNLVKPGDVVVIEFGHNDGGSPNKNDNLRSACPGAGTEVCTSDKTGEKVYTYVFYISQAAKALVAKGAQVVLSTQTPNNQWETGTFEPGAPRFVGYVSTAHRALASSSVTWVDHFAAVTKMYQKLGNQKVNSLYPRDHTHTSPEAADLIAKAFVQAINEEMNGRTSLKSLIKTPVSNVY

SEQ ID NO: 140948 - protein, 146 aa, Triticum aestivum
  Clone ID: PAT_TA_35366.pep
YNDVRKHSSEAYVIMSNRLSSPDPTELLEFAGGLSKTVIDVHYYVLFNSMFDTFTVQQNIDFIKTNYSSALSTVTKQNGPLTFVGEWVAEWQVPNATKEELQMLANAQMDVYGKATFGWAYWTLKNVNNHWSMEWMIKNGYISLKN

SEQ ID NO: 140949 - protein, 507 aa, Triticum aestivum
  unsure (1)..(507): unsure at all Xaa locations
  Clone ID: PAT_TA_35367.pep
RVLCPLSRRSAPSAAPRLPVRAVNLVGWLVMEGWILPSLFDGIPNNGPLDGTQLQSQSVTQSAAVGRRSGGGAGLVADGPQASGWETFKLWRINQCTVDLKGFGSQFARGSVGGSLVATATAPGAXETFRLVRSPGKDIGMRIMAPNGLFLQANKVDSGKSTNGDHTGRGDDDPSGFVGTRVTGLQGEYQICNGYGTTKATPILRNHWSTYIVEAISXSGLTAVRIPGGWWXSLGEPSPPPPYVRRLAFKPWTKEFRTGHSKYNLGVIIDLXHAAPGSQNPFQQSPSKDGPPDGGINXDWGTTDTNIAQTVQVVDFLAXPRYPKSPSLLALELMNEPLAPGVSLRTAXNDAAREALFRRHTLXGPYVSLSHRPTAPLQVRLAGFPGPSLDVRYYXRSNGMFDTFXVQQNIDLIKTNYSSALNTVTKQNGPLTFVGEWVAEWQVPNATKEELQMLANAQMDVYGKATFGWAYWTLKNVNNHWSMEWMIKNGYVTSHYNTRLSSMCHYS

SEQ ID NO: 140950 - protein, 129 aa, Triticum aestivum
  Clone ID: PAT_TA_35368.pep
PAGLGKQKADPLPFFSRKISPCSGLSSLQVPYIDPLPVVARETTNGFFFFQRPRQPRGHMPRAASPARQPARSLRRAPATAGRRRVQRGEVPGGRRQVRAPSARHAAEGPDSAVRPERWHERGQELIDL

SEQ ID NO: 140951 - protein, 171 aa, Triticum aestivum
  Clone ID: PAT_TA_35369.pep
GPLEAGPGPGKHKKKTDKHKKQTISLPFFQRPSLVVQQLRRQLTASSLHRSSPADAGETINGFFFFFQRPKQPRGHMPRACSPACQHARSLRRASAPAGRRRVQRGEGPGGRRQVRAASARHAAEGPDSAVSPERWHERGQELMKQPQGFPLGWMDGSIYSTEIVRHTYAQ

SEQ ID NO: 140952 - protein, 98 aa, Triticum aestivum
  Clone ID: PAT_TA_35370.pep
MAAAASSSAWKARWLRPEAYPIFAATGVAVGICVMQLVRNITTNPEVRVTKENRAAGVLDNHDEGRRYARHPFRRFIDGKSAEIMPGINSFFTDPPKN

SEQ ID NO: 140953 - protein, 98 aa, Triticum aestivum; identical to SEQ ID NO: 140952
  Clone ID: PAT_TA_35371.pep

SEQ ID NO: 140954 - protein, 98 aa, Triticum aestivum; identical to SEQ ID NO: 140952
  Clone ID: PAT_TA_35372.pep

SEQ ID NO: 140955 - protein, 260 aa, Triticum aestivum
  Clone ID: PAT_TA_35373.pep
MAASTGSTKVDAVVQNIKAETPEKKSGLALYSRFALAGAVCCSVTHGGLTPVDVVKTRIQLDPATYNRGLIGGFRQVVKNEGAGALLTGVGPTFAGYFLQGALKFGGYEFFKQQWIDALGYETASKNRTAVYLASSATAEFFADIALCPLEATRIRLVSEPTYASGLVSGFGKIVKNEGFGALYAGFGPILFKQIPYTMAKFVVFEKVSEAVFRTFPKKDLSDGMQTVANLGSGLIAGFAAAIVSQPADPCSPDHKTRVS

SEQ ID NO: 140956 - protein, 267 aa, Triticum aestivum
  unsure (1)..(267): unsure at all Xaa locations
  Clone ID: PAT_TA_35374.pep
MSSVKEYSLFCLENPLLDIQAQGDQALLDKYGLKPNDAILAEEKHIPLYEDLLNNYDAKLIAGGAAQNSARGAQYILPPNRVVYVGGAGDDKYSAILHDAVKAAGLRVEYRVDPKEKTGRCGAIITGHNRSLCTDLGAANHYDLDHLKKPEIWKLVENAEVYYVGGFHFTVCPPAIMELAKQAAKDNKPFVLSLSAPFIPQFFKEVVDASAPFWDYIIGNETEAAAYAESHDLPSKEPKGCRKHLANLPKENXQRKRVAIITQGTDP

SEQ ID NO: 140957 - protein, 249 aa, Triticum aestivum
  unsure (1)..(249): unsure at all Xaa locations
  Clone ID: PAT_TA_35375.pep
MTSSPLRIGFVPEHFSTPLHFAQKHFGLDATLIPFPSGTGHMVTAIRSGEIDVAVGLTEGWIAGLGKEGVEGDGGYRLVGTYVETPLCWAISTGSGRPEITSVDSLKGGKIGVSRIGSGSYVMGFVLADQQGWLTPGAAEKPFKDTVVLNNFENLRNAVNSGEADFFMWEHFTSKKFYDSGEIRRVGEIYTPWSSWKIVASTXLTQDGLDGRVEDLFGKLDQGIKHFNENQEESVAYISSSLGYTSLMR

SEQ ID NO: 140958 - protein, 85 aa, Triticum aestivum
  Clone ID: PAT_TA_35376.pep
RAIAAMTPATPATPNISTPIVGAAAALEVLEAALVLVALAVSVDVVVLEAAMTGAATRAAVRRKFSFILSCGCCLRDLWKECEIC

SEQ ID NO: 140959 - protein, 209 aa, Triticum aestivum
  Clone ID: PAT_TA_35377.pep
MSNPRVEELPDEEPKKTTVQEHEDDSSDDSEVEEVGEGQLPAGSTVIHNRNEKKARKALEKLHLTRIPGITRVTLRRPKNILFVINTPEVYKSPNSNTYIVFGEAKIEDVNAAAQQAAAAQLASQNAEDHSGHNHGEPSKAVEADEKKEDKEDDEDEEEEEEEEVDASGLEDKDIELVMTQANVSRNKAVKALKENDNDIVNSIMALSI

SEQ ID NO: 140960 - protein, 259 aa, Triticum aestivum
  Clone ID: PAT_TA_35378.pep
AGRVWGTILPYSGTFLNFVSYAAGSVRLSALSRVRTIWVATHDSIGLGEDGPTHQPIETLAHFRALPNTMVWRPADGNETSGAYYVCLTSKHTPSIIALSRQNLPQLEGSTIEKAAKGGYVLHEVEGADITLVSTGSEVSIAVDAAKYLEEKKNIKARIVSMPCFEAFDLQDKEYRLSVLPDGVPSLSIEVMSTMGWERYTHEQFGINRFGASGAYKDVYKKFEFTPEGIAKRAVATIDFWKDVPNVRSPINRAFQQII

SEQ ID NO: 140961 - protein, 164 aa, Triticum aestivum
  Clone ID: PAT_TA_35379.pep
MSAPNDNEHEMTFDSADAGASLTYPMQCSALRKNGFVVIKNRPCKIVDMSTSKTGKHGHAKVHLVATDIFTGKKYEDLSPSTHNMDVPNVSRREYQLLDISDDGFLSLMTDDGDTKDDVPLPDNEVGQKITKLFKEEEKDTNVIVLTSMGEECAMEAKEAPNQG

SEQ ID NO: 140962 - protein, 123 aa, Triticum aestivum
  Clone ID: PAT_TA_35380.pep
VRRSSRPVLHGHLSFNSFVLYFSLKTRYHALCSPIEQFGRTREEQILLIPNDPRIKCLDQGKKKQSAEETDSAEEENRALKKFISTWKDTEADSKSSSNCHAIRCYYLIFFSLIPAHNRFYWE

SEQ ID NO: 140963 - protein, 203 aa, Triticum aestivum
  Clone ID: PAT_TA_35381.pep
MSAQALNKIAPNSPSRQNPSELETSIAQALFDLESNTSDLKVALRPLQIVSAREIEVGHGKKAIVIFVPVPSLQGFHRVQQRLTRELEKKFSDRHVLILASRRILPRPKRSARSRNNQKQKRPRSRTLTAVHDAILEDLTFPVEIVGKRVRTKEDGSKLLKVILDEKERGGVDYRLDTYSEVYRRLTGRNVNFEFPQSGPADY

SEQ ID NO: 140964 - protein, 117 aa, Triticum aestivum
  Clone ID: PAT_TA_35382.pep
MGRLSNGDWLLVGNSIFSDDNGTEFRMQDDGKVAVYHGEECAWQNTAEQNWQVHGIKMQEDGNLVIYDNSGTGHAIWHTDTAGGKGNQSTTLVVQDDGNVVLYNEGGDPIWHTASNK

SEQ ID NO: 140965 - protein, 174 aa, Triticum aestivum
  Clone ID: PAT_TA_35383.pep
MGRLQEYEVIGRHLPTEADPTPALYRMTIFAPNETVAKSRYWYFLRGLKKVKKATGEIVSVKVLHEKHPLKVKNFGVWIRYDSRSGTHNMYKEYRELSRTDAVESLYTDMAARHRARFRSIHVLRVVEIEKTEDIKRPYIRQLTQKNLSFPLPHRITKENTQKLFSAKRPSTFA

SEQ ID NO: 140966 - protein, 174 aa, Triticum aestivum
  Clone ID: PAT_TA_35384.pep
MGRLQEYEVIGRHLPTEADPTPALYRMTIFAPNETVAKSRYWYFLRGLKKVKKATGEIVSVKVLHEKHPLKVKNFGVWIRYDSRSGTHNMYKEYRELSRTDAVESLYSDMAARHRARFRSIHVLRVVEIEKTEDIKRPYIRQLTQKNLSFPLPHRITKENTQKLFSAKRPSTFA

SEQ ID NO: 140967 - protein, 184 aa, Triticum aestivum
  Clone ID: PAT_TA_35385.pep
MGIDLDRHHVKGTHRTAPKSDNVYLKLLVKLYRFLARRTDASFNKVVLRRLFTSKINRPPVSLSRIVANINKEGEKRTVVVVGTITDDNRLLECPKVTVAALRFTATARARILAAGGEAITLDQLALRAPTGSNTLILRGPKNAREAVKHFGFGPHSHKKPHVESKGRKFERARGRRRSRGFKV

SEQ ID NO: 140968 - protein, 278 aa, Triticum aestivum
  Clone ID: PAT_TA_35386.pep
SSLSLSIRSLIELAVQKGLGRHIEWVLTVVSENAVPIGLLGQVSQPLVIMSCAFGKVSFSISLMRLAVQPFIHRFLWFIVVTMLTLHILISIIIFVRCKDPRTTWNPAIVSQCWAPHVYLGVMYFIGAYSAATDFILALLPWAMLWNLNMKSREKFGVAIAMSLGVFAGSIAIIKCTKLKANATSLDPTFDVGELLLTAGAENALIIIAACLPTLRPILRKVFPSTAKSSANSHPLKNLPNNIIFVPKHKAGQWSALVETEAHRERHSDNQSDRSILT

SEQ ID NO: 140969 - protein, 231 aa, Triticum aestivum
  unsure (1)..(231): unsure at all Xaa locations
  Clone ID: PAT_TA_35387.pep
MEFGNAGVLNEDGIHVDMDRLKKGEVNLGTSIMAVTFKDGVILGADSRTTTGAYIANRVTDKLTRVHDTIWCCRSGSAADTQAVADIVQYQLGLFAMTNGKPPMTQTAASIFQEICYANKDRLSAGLIIAGWDERFGGQVYSIPXLGGSLHKQSYAIXGGSGSTYIYGYCDANWREGMEKDDAVNFVKGALREXIKWEAGSGGHFPMVVLTKEGADRHLYLPETDYAVRHE

SEQ ID NO: 140970 - protein, 265 aa, Triticum aestivum
  unsure (1)..(265): unsure at all Xaa locations
  Clone ID: PAT_TA_35388.pep
MSSAEPQKVLGMPPFVADFLMGGVSAAVSKTAAAPIERVKLLIQNQDEMLKTGRLDRKYNGIGDCFKRTMADEGVMSLWRGNTANVIRYFPTQALNFAFRDKFKKMFGYKKDKDGYAMWMAGNLASGGAAGATSLLFVYSLDYARTRLANDAKNAKSGGDRQFNGLVDVYKKTLASDGIAGLYRGFMPSVAGIVVYRGLYFGMYDSIKPVVLTGNLQGNFLASFALGWIVTTGAGIASYPLDTIRRRMMMTSXGEGVKYKNTMDA

SEQ ID NO: 140971 - protein, 186 aa, Triticum aestivum
  Clone ID: PAT_TA_35389.pep
MSSLARPMLRSPALRVAARRFESTTAQKAAENAKQAATRAQEGLSRVTSTAGPAIAGYAKGVASTLGKVGGRTGKIIGFVERQVPFVVYYSKVGLELGKFVFHNQKMSPPNMATFQTTYQNLIKSIQNRTIIQSSQNLVQQVRNIGPAQLAAGGVVAAEVLGFFTVGEMIGRFKLVGYRGEVSSHH

SEQ ID NO: 140972 - protein, 107 aa, Triticum aestivum
  Clone ID: PAT_TA_35390.pep
MSPNQTRHSTLITHVACWRNLRPGWRRSERRGRRWPRRACTGPPAPWRSRAASMRPRQSISGWCMSGWRRRKLRRQGATICVRRMELLFFMFFWFSARLVKSGQLTH

SEQ ID NO: 140973 - protein, 77 aa, Triticum aestivum
  Clone ID: PAT_TA_35391.pep
LVLLLAPCRLAASRRGFLRRQPLMHYPDIRRRGRVDAAPLRNGAGGPVHARRGHLLPLRSDLLHPLDADFSNTRHVG

SEQ ID NO: 140974 - protein, 91 aa, Triticum aestivum
  Clone ID: PAT_TA_35392.pep
PGSIIHSVQTKQNTLTPVSHMSRLGEICVQRVEKIGAEKKTVATASVHGAAGVVVQRAGIDAAAAEYIRMVLERLAAEEAVAAATAAARRY

SEQ ID NO: 140975 - protein, 106 aa, Triticum aestivum
  Clone ID: PAT_TA_35393.pep
AVSKHSLVWFHFQLSSTSTCTSISNIYRVVTQADGAAQPAWLVLVTGEQASVSVLKHGVRKSLESSTVAAGTGRTRSPGACFGEPGPSSTHPPSPSPPRFGSAWTR

SEQ ID NO: 140976 - protein, 138 aa, Triticum aestivum
  Clone ID: PAT_TA_35394.pep
LVLSPLARHPASGVGAAPYPGGRGPGGCVQAAPRSPHPPPRRRRRPGPAAPAGHSRPVLPVMGLQSYNDKGEWWFQTSRSGSEDAESSSSQPSQVLEERLSTLNQAAAAMARADVWKKDQAHRNRHPDYEFFLSRQQR

SEQ ID NO: 140977 - protein, 127 aa, Triticum aestivum
  Clone ID: PAT_TA_35395.pep
MNAPDRFELFLLGEGEKKIEEKVFSGMSNTSDFVLMKEDHTLGNLLSEHLKMHPNVHMAGYKIAHPNVPELFIRVQTDGTITPRDVFTSVCEKLINQLEMLHQEFTREWELRRITTAGEQGNMQNGH

SEQ ID NO: 140978 - protein, 108 aa, Triticum aestivum
  Clone ID: PAT_TA_35396.pep
AGRVRILYLFIQSSLKHLSLLNWPVQLYLVLLISSNSIPQSKCLLKSSSLLHSQLLVWPCPNVVATTTTITGTRNRRVLRTYATKDSRVTTEVTASLFAMTASVVTVS

SEQ ID NO: 140979 - protein, 164 aa, Triticum aestivum
  unsure (1)..(164): unsure at all Xaa locations
  Clone ID: PAT_TA_35397.pep
CECIHYSDTGCSSTRSVAACNTERRCGSSTALGLSFITADRDPSDKPGVSIVXRQENYSSAREERAKRREREKKVYASNNHIAYXSHGNXNDFLTRRSIPSSRRWRHGGRQLVRNREGKTQISRIEFMKKNEENRGGEERGRGREVRDEDTAAAAAAEARCWEP

SEQ ID NO: 140980 - protein, 151 aa, Triticum aestivum
  Clone ID: PAT_TA_35398.pep
MAAKDTKGKKGGNKAAQAAKAALKGTNSHKKVKARYSTSFHRPKTLITSRAPKYPRRSIPHQPRLDEHKVVIHPLNTESAMKKMEENNTLVFIVDVKANKAQIKLALKKLYDIDCLKINTLIRPDGSKKAYARLTPDVDALDIAANKLSLV

SEQ ID NO: 140981 - protein, 177 aa, Triticum aestivum
  Clone ID: PAT_TA_35399.pep
YPTKRLTLAIHLKDLHHIMGDDAPQDTPQQDWWEAFPEPKAECTRTDPAIISKLIEVNAALGKNAKRDFLLVDVRRTDWEGGTISTSINLPAHTFYQTRPQVYQLVKQAGIKRIIFYCGSSNGRGPRCARWMQDYLDEVGETDIKAEILTGGIKGWQKAYDGQLMDFYDEKAWEKKE

SEQ ID NO: 140982 - protein, 169 aa, Triticum aestivum
  Clone ID: PAT_TA_35400.pep
MSAQDKAQQYLGQLDRELSKYPALNNLEKQAGVPKAYAVIGVGALYFFLIIFNLGGQLLTNLAGFVIPTYYSLGALFTHNKEDDTQWLTYWVVFALFTVIESFVQVVYWFPFYFVFKFIFLLWLSLPAFRGADLVFRSFLAPTLGRYFQQSGSTASGLRAKADGLDKTE

SEQ ID NO: 140983 - protein, 123 aa, Triticum aestivum
  Clone ID: PAT_TA_35401.pep
MSAKVYVGNLGWNTTDDSLRNAFQDYGQILDSIVMRDRDTGRSRGFGFVTFGSSQEAETAIISLNEQELDGRRIKVNLANARPGGGGGGGGYSGGGGYSGGGGYSGGGGYMGGGGYNGGSGFN

SEQ ID NO: 140984 - protein, 152 aa, Triticum aestivum
  Clone ID: PAT_TA_35402.pep
MSDVQERLKKLGLGARTGGKGTPRRKVKRAPARSGADDKKLQLALKKLNTQPIQAIEEVNMFKQDGNVIHFAAPKVHAAVPSNTFAIYGNGEDKELTELVPGILNQLGPDSLASLRKLAESYQNLQKEKGEDDDEIPDLVEGENFEGEPKVE

SEQ ID NO: 140985 - protein, 104 aa, Triticum aestivum
  Clone ID: PAT_TA_35403.pep
AAAACPPPTQMLTPPPPPAASTACRGRRRRRTGPRRRPPPRPASRRRRRRAPASPTVEGSCAGTPAWCCSPRTGSSSSASPPPPPPPWISSGRSDPPLPTTTRR

SEQ ID NO: 140986 - protein, 188 aa, Triticum aestivum
  unsure (1)..(188): unsure at all Xaa locations
  Clone ID: PAT_TA_35404.pep
QATPAAQNQPPAPTPKPARXPXPPPPGRARLPCACSSSPHGASRSTALSTPRRLPLRSPHRPPHGLSPPTPPPTARRQPLPTASWPPLAPPPPTPPPTSRRCPPPGLSSARPCRRRGRPLGGPRLPRCPKAGALAALVGAGIYMALAPDDDEEDFPGAITGCWSTKGGLFGARLKGHQGTAPEHWLQS

SEQ ID NO: 140987 - protein, 226 aa, Triticum aestivum
  Clone ID: PAT_TA_35405.pep
NPEHGGRVRGMGHIPWKIGFPQNDDPYGYRSRKRKMDREADVVARLASEMDVMKKTVSVLVAERDAARAQHEDHPADLRSQQRRSSVASTEAPPAGADAPTIEITAPEPLVVEITAPEPLVVEITAPEPPRYPVDDIKEMKECHLYYPIGNMSMKVAIGSALPCLPGALHHNNPIQDGYARVTVEDIVQGFEDLEIDIATPEGEKRLGDVKRHFILWQKKFIKFPG

SEQ ID NO: 140988 - protein, 114 aa, Triticum aestivum
  Clone ID: PAT_TA_35406.pep
SQERMALNTRNAIVAVLLLVVMVVAVSTPAVTAQEDCWDKCFKDCKAKMAMEVCNQKCIDFCIYQAGAREYVKMAGDKLKETKTASPEQATKLKNQATTYLERAKVLSDKAVTP

SEQ ID NO: 140989 - protein, 83 aa, Triticum aestivum
  Clone ID: PAT_TA_35407.pep
REQKLELHRGGGRSRTCGARAGQEFGTSSPSSPSRTPPPSPRLTPFPNSSQRPCIQIHGGIDREEERNTRPLSLHSSDPRPEQ

SEQ ID NO: 140990 - protein, 233 aa, Triticum aestivum
  Clone ID: PAT_TA_35408.pep
WLGNRRRIIVMNREDMVSADDRNAWATYFSSQGIKVIYSNGQLGMGTMKLGRMAKSAASTVNTRRREKGLLPRPVRAGIVGYPNVGKSSLINRLLKRRMCPAAPRPGVTRELKWVRFGKDLELLDSPGILPMRISDQTAALKLAICDDIGERSYDFADVAAILVQILLRHPAVGSEAFRKRYKIDVDSDCGKLFVTKLSVHLFNGDTTQAAFRILSDFRKGRFGWVALERPPT

SEQ ID NO: 140991 - protein, 199 aa, Triticum aestivum
  Clone ID: PAT_TA_35409.pep
TCNTWLGAFLSVLGVGILELSGSPPCVGDLLTLLSAFCFGIHMLRTEHISRKMKKENFLPLVGCQVVVVAVVSAVSFIVKCFLQNVVPWNLKSGTPTELFSMMSSFPWLAILYTGIIATTFCLWAEIVAMRDVSATETAIIYGLEPVWGDTFAWAIHGERWGITGLIGAIFIIAGSLMVQVLGSFLDIDVSEDSYQMNS

SEQ ID NO: 140992 - protein, 139 aa, Triticum aestivum
  unsure (1)..(139): unsure at all Xaa locations
  Clone ID: PAT_TA_35410.pep
PSRGTHARSHARSLGVAAVAGVLVSSSSPAAAAGSRWRPAAAGPVGDDGLDDAASLGVPVPVGLRPQALAAILPIHGVARVQGSPGRPAQRNVGEWTSVVGRPVRATGLVKTLTGNWVQLXLQNPLPTGXQSXRXSXSX

SEQ ID NO: 140993 - protein, 276 aa, Triticum aestivum
  Clone ID: PAT_TA_35411.pep
MAKQTTLDEFNAVFPKLEEVLLDHARSYKLPQEQLDWYKKSLEANPLGGKCNRGMSVPDSVSLLLEKPLTEEQYFQAATLGWMTELLQAFFLVSDDIMDSSITRRGQPCWYRQEGVGMIAINDAFMLEMAIYTLLKKYFRTHPAYVDLIELFHETTFQTELGQLCDLLTAPEDNVNLDNFSLEKYSFIVIYKTAYYSFYLPVALALHQLNLATPSNLKQAEDILIPLGEYFQIQDDYLDNFGKPEHIGKIGTDIKDNQCSWLEKQALAVAHPRSSA

SEQ ID NO: 140994 - protein, 183 aa, Triticum aestivum
  Clone ID: PAT_TA_35412.pep
RDPGRCSKEEGHQEIEGLCQEQEQGGSPWRGGSRHPHLETEASLLWKTRSWKDPEAINQSMWTLLLAITRSGTIGSLPFFVLGIGGGFSVNLAAGDTTIYCNFIFIWHLLCVPLCLLDYIVVELYGCTFGLLCTCAERSRILFDGVINVKKRGEKKKKKKKKKKKKKKRKKNKKKKKKKKKKK

SEQ ID NO: 140995 - protein, 326 aa, Triticum aestivum
  unsure (1)..(326): unsure at all Xaa locations
  Clone ID: PAT_TA_35413.pep
AACEGRLGLRVESRKESKRRINDCLSAFHVAMPALRVIRARTRRSQPVERADAAEVAAQGRWKLQRDLEWQARGDGVXSESLIKHYLSADCKWRNGCRHQGWGANNVGDQVVPGIWQKXCTELQREXGRRLDQEAEPDAFLIXDAKKLVSPGRRKPVGKIRKKRALLIQKHRMKKXTAEGRPIVPRKHDKDRNFTTKRLGRQLTSMGVDPTAAVNRLRSQSRGRKRERSLSRADGDDAMEVDGQHSDKKLRMRSRSRSKSRPIEEVVPGDGIRDVAQKKKAIKKSRDSVKNRNKEARRGEADRVIPTLKPKHLFSGKRGVGKTQRR

SEQ ID NO: 140996 - protein, 202 aa, Triticum aestivum
  Clone ID: PAT_TA_35414.pep
MSSFEQVVVIDGKGHLLGRLASIVAKQLLSGQKIVIVRCEALNISGEFFRAKLKYHAHLRKITRYNPTRGGPFHFRAPSRIFYKAVRGMIPHKTARGAAALERLKVFEGVPPPYDKTKKVVVPQALRVLRLQPGRKFCTVGRLSHEVGWKYQDVVARLEERRKAKGAAYYERKKIAARQLADAKKNATVKEETSKALANYGY

SEQ ID NO: 140997 - protein, 100 aa, Triticum aestivum
  Clone ID: PAT_TA_35415.pep
MSVVGFDLGNESCIVGVARQRGIDVVLNEESKRETPAIVCFGDKQRFIGTAGAANSTMNPKNSISQIKRLLGRKFADPELQRDLQSFPFRVSEGPDGFPL

SEQ ID NO: 140998 - protein, 230 aa, Triticum aestivum
  unsure (1)..(230): unsure at all Xaa locations
  Clone ID: PAT_TA_35416.pep
TRPAHFYEGYYASKGINIVKGTVASGFDADANGDVSVVKLKDGRVLDADIVIVGVGGRPLTGLFKGQVEEEKGGLKTDTFFETSVAGVYAIGDVATFPMKLYDEPRRVEHVDHARKSAEQAVKAIKAKESGESVAEXDYLPYFYSRSFDVAWQFYGDNVGETVLFGDNDPAAPKPKFGPYWVKDGKVIGVFLKGGSPDENQAIAKVARAHPPVADVEALGKEGLDFAPKI

SEQ ID NO: 140999 - protein, 117 aa, Triticum aestivum
  Clone ID: PAT_TA_35417.pep
EATPVLLVLPILTFWFHKYCTHRYKPAFVRNPLQEAMRKDTLEHAREPNFDLKSYLADSYLHPVFKSDDVDKFYVAEDPGAEEVIVATKRQSRRTTPVQSKYDGSDRLSVPDSIPER

SEQ ID NO: 141000 - protein, 234 aa, Triticum aestivum
  Clone ID: PAT_TA_35418.pep
MSVVGFDLGNESCIVGVARQRGIDVVLNEESKRETPAIVCFGDKQRFIGTAGAANSTMNPKNSISQIKRLLGRKFADPELQDDIKAFPFRVSEGPDGFPLVHVRYLGEERSFTPTQLLAMVLSNLKAIAEGNLNSAVIDCCIGIPVYFTDLQRRAVIDAATIAGLRPLRLFHETTATALAYGIYKTDLPENDQLNVAFVDVGNASMQVSIVGYKKGQLKMLSHAYDRSLGGRDF

SEQ ID NO: 141001 - protein, 243 aa, Triticum aestivum
  Clone ID: PAT_TA_35419.pep
RAGSGSRVPAIIRIITEFFGKEPRRTMNARECVARGCALQCAILSPTFKVREFQVNEGFPFSIALSWKPDSQNNEPQQTVVFPKGNPIPSVKALTFYRSNTFAVDVLNVETEDSQLFNSCKKTHKISTYTIGPFQSSKGEKGKLEVKVRLNIHGIGYLESTTMLEEEEVEVPVSSTSEGPKDATRMETDDAPQDPASSAGDHIQEPKGAGDPAWGAAEYGAQDFQELTEMSNTKVEDLPFEQL

SEQ ID NO: 141002 - protein, 435 aa, Triticum aestivum
  Clone ID: PAT_TA_35420.pep
MASEKHFKYVILGGGVAAGYAAREFGKQGVQPGELAIISKESVAPYERPALSKGYLFPQNAARLPGFHTCVGSGGEKLLPEWYTEKGIELILSMEIVKADLASKTLTSADGATFTYETLLIATGSSTIKLTDFGVQGAESNNILYLREIDDADKLVAAMQAKKDGKAVVVGGGYIGLELSAALKINNFDVTMVYPEPWCMPRLFTAGIAHFYEGYYASKGINIVKGTVASGFDADANGDVSVVKLKDGRVLDADIVIVGVGGRPLTGLFKGQVEEEKGGLKTDTFFETSVAGVYAIGDVATFPMKLYDEPRRVEHVDHARKSAEQAVKAIKAKESGESVAEYDYLPYFYSRSFDVAWQFYGDNVGETVLFGDNDPAAAKPKFGTYWVKDGKVIGVFLEGGSADENQAIAKVARAQPPVDDVEALGKEGLDFATKI

SEQ ID NO: 141003 - protein, 310 aa, Triticum aestivum
  unsure (1)..(310): unsure at all Xaa locations
  Clone ID: PAT_TA_35421.pep
ADSLSRGTNLPRSKRNVYEAIVPVGSMLCGSWGLAGRAKDWKEVSEMALQXRVMEQTKDKKISVEAYVYAMRNXIHAKYNNCVMWEDIEGLMAKLQEVEDWLYEDGEDETKGVYVAKLEELKKFGGVIEKLYKERTERGPALEQLGYCIRNVGEAALSADQKFDHIDISEKQKVVNECSAAETWLMEKKQQQDALPKHANPXVLLVSDIKKKAEALDRFCKPIMTKPRPAPKPQDPXREQETPSPEAHTPDQQSNGADESAEPASDGDQDQQAAEQVDTDYDDTSQAEELWIMGDSMPIIQMTALVLYAC

SEQ ID NO: 141004 - protein, 120 aa, Triticum aestivum
  Clone ID: PAT_TA_35422.pep
MADTTEQQPKLVDDSPISPVERRNSLEAHLKHRPERSELVEKNILPASNAAPGLQAHQKELEKHMLEDKLNDKISHRPDPESLIKEGVLRDDPRDVTQDEAAKKYDEAIEDEYAKREGGA

SEQ ID NO: 141005 - protein, 247 aa, Triticum aestivum
  unsure (1)..(247): unsure at all Xaa locations
  Clone ID: PAT_TA_35423.pep
MSKTKSKKRKQNAQAQAQSDNPRKIAKTTSPSIPTPPPDGSTFEPKNLHTVVSEEELEIAIDTLTSLAQYPGLIKSKLCKDLRVAVYDFRQACTTGVNNAAGANLTAQVTAALADRKYTEARIHLAEMKIRGEQPKLGALCRWVRDLDVISGLSTVPDQQGLVVRSEREETLIKVIDAVLRVCGHEDRNPNXXGTPSSIALQEIWDLRPDTPTGQVYATVLDGSLVASAPDSLKKTYSPPITTMASY

SEQ ID NO: 141006 - protein, 225 aa, Triticum aestivum
  Clone ID: PAT_TA_35424.pep
CGARAGRIGTFSFTQDDDLAIHIPTRKTLYSAPFKQPNTHYQPNTDINMADTGLPPGWEVRHSNSKNLPYYFNSAEKLSRWEPPSGTDTEKLKHYMATNHSAGSRPGAVPGVPEGKIRAAHLLVKHRDSRRPSSWREAEITRTKEEAFEIIKEHEQKIKSGSVSLGELALTESDCSSARKRGDLGYFGRGDMQKEFEDASFGLSPGQMSEIVETASGLHLIERLE

SEQ ID NO: 141007 - protein, 285 aa, Triticum aestivum
  unsure (1)..(285): unsure at all Xaa locations
  Clone ID: PAT_TA_35425.pep
SLSLLSSLARSALRFFSSHSFNNIGVDHPLARYTSLNHSQSTCVFISPEYDYRRHFPSPPKHFRKSTSRRKKKKKEKKQQPPKMRFVNLITVFVGLAAAAPAPAVAPVATPTKDDMIAVTTVAPTASGDPVTYWSASPESVKVCDEDTYVGREGPKEMKRANYRDCAALLSSFGSRNGTFFVPRACEDDSEYGLKDGHVDIVKSGSCAFSVRADAGLMVGDEDIVWIMRKAVLNNSDGMEMAARGSVKCKPEDGRVMXGLYWEITGLSHWLLTRLXFSLGGLMTS

SEQ ID NO: 141008 - protein, 101 aa, Triticum aestivum
  Clone ID: PAT_TA_35426.pep
MQFTKLTLLAVTALFSMGEACKCYGTKGNLNNGATHKCCNDYKGVYSGNDCKAGSISEHLSGFDRCCKGQGSDCDFPRLASTEAKMVKAVKHVEIKTAYSG

SEQ ID NO: 141009 - protein, 60 aa, Triticum aestivum
  Clone ID: PAT_TA_35427.pep
CKIISLQQHFTGKQGTTLLSFYTCKKAKSKNLGLPIKWMFEAAITEIFGINNLSRSFSFD

SEQ ID NO: 141010 - protein, 148 aa, Triticum aestivum
  Clone ID: PAT_TA_35428.pep
EPREACRVSPTKRSKQARKGGLEGRKKKEEIGGRSTLLPPPIRQPPTLQLHAALQGATTDRSKKGVEGNDQKNEAAGRKAAALQRRSISAPLPPLLSNDADLRLLSKHTQPNETKLRSVSVVALVALPHPTTPHRRRPRCSPLPPIYY

SEQ ID NO: 141011 - protein, 101 aa, Triticum aestivum
  Clone ID: PAT_TA_35429.pep
MSFVTRRALSTLIPPKVASPKAIGAAPDAIRMQRVVSFYEKLPRGAAPEVKAKGLLGRYQAKHFGKNPTAKPIIHLIVFLVGIGYAQNYYFHLRHHKNNAH

SEQ ID NO: 141012 - protein, 115 aa, Triticum aestivum
  Clone ID: PAT_TA_35430.pep
RLLHAHRRAGKYKYNTIPSGIFLFLFFASVLQMNKPVHHFFQPADGGGAGGQQLLPQQAWPQVLVGCCTIQQHWHGSEAVAVVMKSASRSSMSQDARARRVFLLMPPVLSAVSPS

SEQ ID NO: 141013 - protein, 104 aa, Triticum aestivum
  Clone ID: PAT_TA_35431.pep
RPGRDIYLPPPVLALQTRRSPLKALNREAYQEGNTANKTGGMRRNTLLALASWLMLLLLALFITTTTASLPCQCCWIVEHPTRTCGHACCGDNCCPPAPPPSAR

SEQ ID NO: 141014 - protein, 82 aa, Triticum aestivum
  Clone ID: PAT_TA_35432.pep
SLHLALALLLGTLFLRHILGHGGSGVSVEGRDLVLGFILDGLDGELLLAILLLLGASHFGNLFSWFVFGKEKGFVGVRLFFG

SEQ ID NO: 141015 - protein, 82 aa, Triticum aestivum; identical to SEQ ID NO: 141014
  Clone ID: PAT_TA_35433.pep

SEQ ID NO: 141016 - protein, 131 aa, Triticum aestivum
  Clone ID: PAT_TA_35434.pep
KKAAAYNFVASQMQYSRGSSRRRFGFGVHLLLHEAKESPPAARTTSSSSLLLSGGAGGLRVLAALCAVERRRGFRLVHAPHLLLVGVPEHVGLHEVSSHHGRHLSLISSSPSPQLFLVLPLLPWLSKAQVS

SEQ ID NO: 141017 - protein, 104 aa, Triticum aestivum
  Clone ID: PAT_TA_35435.pep
MAQVLVVYPSGPSFDMDYYLKTHMPLVASKWGPLGLKSYKILNFQEGAPYQVQATLEWEGVEVFDKAAANEVAKEIFGDIKNFYNGEPMLLKGPVVAHESVSSS

SEQ ID NO: 141018 - protein, 104 aa, Triticum aestivum; identical to SEQ ID NO: 141017
  Clone ID: PAT_TA_35436.pep

SEQ ID NO: 141019 - protein, 245 aa, Triticum aestivum
  Clone ID: PAT_TA_35437.pep
AGLESPRSTFVVTSLPRARRQNTPVRHVSLALLLLALALPLALATPGPASETQEDDVRCLRGVKSALADPDGRLSAWTFGNTSAGAVCDFPGITCWNPQESRVLGLSLAGFGLQGTVPSALKYCRSTNILDLSKNALEGPIPPALCDWLPFLVVLDLSGNRFSGPLPSELANCRYLNSLKLSHNNFSGQIPASLSRLERLKSLDLSENRLDGQIPPQLSATFPKESFSGNPGLCGRPVSSHCGRD

SEQ ID NO: 141020 - protein, 150 aa, Triticum aestivum
  Clone ID: PAT_TA_35438.pep
MAGGVTVRDVDAQKFITAYSAFLKRQGKLPIPGWVDTVKTGPAKELPPQDIDWFYVRAASIARHVYLRKTVGVGRLRKVHGTAKNRGSRPSKHVDASGSVDRKVMQSLEKIGVLEQDEEKGGRRITQAGQRDLDRIAQTTAEAEEEEDDE

SEQ ID NO: 141021 - protein, 111 aa, Triticum aestivum
  Clone ID: PAT_TA_35439.pep
MPVRVPRLPAAKPSEIFCMGAAGVGVLTPLYLVMPGAEERLSNQTNKWAPRWERNVSYFIPPMEKGVQRIEPPVAKMVQRVEDRLPLERMAKSVDKGIRSGIARFNGENKP

SEQ ID NO: 141022 - protein, 228 aa, Triticum aestivum
  Clone ID: PAT_TA_35440.pep
MYHPTRGGVRGGRDQFKWDDVKVDKHRENYLGHSVKAPVGRWQKGKDLLWYTRDKQSDSEDAMKEEIRRVKEEEEQAMREALGLAPKRSSRPKGNRLDKHEYAELIKRGSTAEDLGAGHAEAAQVQGLGLYKAPHNEEEPSSLSPDPPGTEPEQVDFAPATKQEDSEDDRKGKRRREERRGDREKERRREKHYEGKERKRDKYESRHDSEDREKRHRKDKQKRRHDSD

SEQ ID NO: 141023 - protein, 313 aa, Triticum aestivum
  Clone ID: PAT_TA_35441.pep
MVDRPNKPSALASTPAAPPQAVADITHDNSRVKAVLPSGESVEVLLHGATVISWKDASGAEKLWVSETAALDGSAPVRGGIPIVFPVFGTAPDHEPVAKLPQHGFARNSRWEFLGKSTSEGSSSSVKLDFGLSSESISDDFKALWPYKFALIYSVSLDSESLNTSIVITNDGDAAFDFQTLLHTYFKISDIASTEVTGLEDSVYLSKVSGSEATQSGAITFSGETDSVYTPANGPKHPVVISESGSPRYRIVRDNLDQVVVWNPWVDKSAGIKDFSPKDGWKNMLCVEPGSVKGRQKLEKGDAFEAAQTITLA

SEQ ID NO: 141024 - protein, 174 aa, Triticum aestivum
  Clone ID: PAT_TA_35442.pep
IASPINCTTVNKDFLQKTPQGLPRSRRRSGGGGERARVVAAPAPAARPGGGADPPGVGLIGGLFSATDWEEIRARSRRIGPAAGASYTTSTTRSSTIYKHLLSLTMDSIKNTVNQATEKVQEGLSGTSKEANKEVAKDSNAGIGTRASAAKDAASDKIDESTHGAKSEAYKQNP

SEQ ID NO: 141025 - protein, 236 aa, Triticum aestivum
  Clone ID: PAT_TA_35443.pep
MSEAVPVRLLGSFGSPFTHRAEAALRLKGVAYEFVQEDLGSKSELLLRHNPVHKKVPLLLHGEDDDDVRAVAESLVIVEYVDEAFEGPPLLPVDPLARAASRFWAQFASDRCSRTLFKALWTPEGEARRGFVEEAKENLALMEAQLEGRRFFGGDSIGLLDIAASGLAWLPVLEEVAGVETSMIREEDYPELCRWRGEYASDEAVKKCLPSRDEMVAYYAAMKDRFVLHAKSMHKK

SEQ ID NO: 141026 - protein, 221 aa, Triticum aestivum
  Clone ID: PAT_TA_35444.pep
AGRSSATMPSSLSSDSNYTFTEDLEWTLGLRVSIRENMRKSLSQYEKNPQSLHTLEDVIKFTLTTPEEQPEKWGVDEWLKCEQLGTQYGPDSSEFRDSIELRNRIGMQIAELLDRTECDFIFAPSIDTSANVGGCPTIGVPLGFYPKDQPVTRRKSNRLVTVGPNVPFGGLFVGRRWDDFKLISAAHAFEQASLIREQVPPVVSSDIQLPVRTEEKFRGSL

SEQ ID NO: 141027 - protein, 348 aa, Triticum aestivum
  Clone ID: PAT_TA_35445.pep
MKSVVASIGMIAAVANAYQFPQHAHYRRDYNGTDSQTTLTVKTTVVETITSCAPTVTNCPSRDQTAIAQLPESDKTTLTATHTVILTEVVCPVADASSIYTSVLQHAETGGVTGKTITADVPMNTGGAYPPPPEKTVVSDYTTDPVVTLTQGGETITTTIHKTIQKTLTVPAGPEVTDDGSKGNGTPEDDTTTTTTKTTTGTITKTIQRVDETGPATGGDNGYSTGKSEDDGSKGTGNGNGNGSNNGGSNNGNGNGECSPETVTVTAPASTVYVTVVPEAAKTNGADDATVTGKTVKGDDSEDDDDDEDEICDTTTTLEATVTVVPYPVNGTATGGYAKPTGFSRRLR

SEQ ID NO: 141028 - protein, 128 aa, Triticum aestivum
  unsure (1)..(128): unsure at all Xaa locations
  Clone ID: PAT_TA_35446.pep
XQAQPPRALNDALKQEVERLKMATGEMSNSSDAYSVGLQHVLYNSSFFPQSQQNTAQHQGGARFPPPFHPPHPNVPNHQMLSHPNTLSDIMQQDHLARLQGLDIQQRASSXVKSESSSISASESSSTF

SEQ ID NO: 141029 - protein, 50 aa, Triticum aestivum
  Clone ID: PAT_TA_35447.pep
PIVNTLCEYIPSCPSSRRAALINPAPPFTLASDDDRRTTVSVLKTRLQIH

SEQ ID NO: 141030 - protein, 129 aa, Triticum aestivum
  Clone ID: PAT_TA_35448.pep
RPGSKAGRRPRTFTKKSLQIEDGTPRIGAFGVSGYLAWHIISLLFFRYAPCTKESSGGRKGKKALHGWKAEKAFTRVSTLALIGWLDMRTWNRFLMIASYPSAVGSGGWSLCFCEIHNGFHKKKKKKGP

SEQ ID NO: 141031 - protein, 203 aa, Triticum aestivum
  Clone ID: PAT_TA_35449.pep
MLASATTLGERKFREPTACHEGVKPTGPAYTTEVVTKLTTYCPEKTTLTYGNQTIPVTKPGTVTVTGIHHTTTAPVVPTGYAPPATPSTPAQAKDCAEMCTDKYNSCRSASGANMATCAAEYSGRPGYAPFDSNGSLVKPTACHGPAPVGPTGTGSKPSGPAPVVPSGTAPVAPPTTPTAVTAGAAQVVPAGIMAVIGAIALL

SEQ ID NO: 141032 - protein, 106 aa, Triticum aestivum
  Clone ID: PAT_TA_35450.pep
MSQASTKVQQLIDNNSVVVFSKSYCPYCKQTKKTLDDLNTEYELLELDEVSDGSALQDALEKISGQRTVPNVYIKQQHIGGNSDLQSLNSGGKLKNLLKEANALKA

SEQ ID NO: 141033 - protein, 72 aa, Triticum aestivum
  Clone ID: PAT_TA_35451.pep
MPPKRIRCTAATCREPAQRIVGDCTFCQGHFCGKHRLLEDHKCTGLEDCKKQSYERNAIQLESERTQVIRGV

SEQ ID NO: 141034 - protein, 181 aa, Triticum aestivum
  unsure (1)..(181): unsure at all Xaa locations
  Clone ID: PAT_TA_35452.pep
MSYAHLFKYIVIGDAGVGKSCLLLQFTDKRFQPLHDPTIDTEVDVFASKMITVDRKPIKLQXIWDTPGEDRFRSITRSYYDEVDGALLVYDITRRETFNHLANWLRDVRQFAKDNMTIMLVGNKCDLSQRRTVSYEEGRKFANEHGLIFVEASAKTAQNVEEGFVXKTAGVIYKKIQDGAF

SEQ ID NO: 141035 - protein, 137 aa, Triticum aestivum
  Clone ID: PAT_TA_35453.pep
MVSSMKHHRDEAGASSSLSLSLALGAVADRSKKMRRGGVDGEFVCKTCGRSFPSFQALGGHRTSHLRGRHGLALGLAAGSDKPATKKTTDQKQAHQCHICGLEFEMGQALGGHMRRHRDEAVATTAQAPPVLLQLFV

SEQ ID NO: 141036 - protein, 136 aa, Triticum aestivum
  Clone ID: PAT_TA_35454.pep
MVSSMKQCRDEAQEVPLSLSLSLGVMADRSKKQRRGGADGEFVCKTCSRAFPSFQALGGHRTSHLRGRHGLALGLTSGSDQPGTKKTTDQKQAHQCHVCGLEFEMGQAMGGHMRRHREQEAATTAQAPPVLLQLFV

SEQ ID NO: 141037 - protein, 134 aa, Triticum aestivum
  unsure (1)..(134): unsure at all Xaa locations
  Clone ID: PAT_TA_35455.pep
MVSSMKQYRDQAAGVPMSLSLSLSLGAVADRSKKMRRGGADGEFVCKTCGRSFPSFQALGGHRTSHLRGRHGLARRIRSAXTRKTTDQKQAHRCHICGLEFEMGQALGGHMRRHRDEAVATTAQAPPVLLQLFV

SEQ ID NO: 141038 - protein, 138 aa, Triticum aestivum
  Clone ID: PAT_TA_35456.pep
MVSSMKQQYRDEADAPSSLSLSLSLGAIADRSKKMRRGAADGEFVCKTCSRSFPSFQALGGHRTSHLRGRNGLALGLAAGSDQPATRKTTDQKQAHRCHICGLEFEMGQALGGQMRRHREHGAATTAQAPPVLLQLFV

SEQ ID NO: 141039 - protein, 163 aa, Triticum aestivum
  Clone ID: PAT_TA_35457.pep
PAGPGLEPLADGFTNYGHGTARARTEEILVDRAGLLTLTPPEMTVLVGGLRALNANFDGSSNGILTGKKGQLTNDFFVNLLSPAYKWSKKDERGELWTATDRSTKSTKWTATRADLVFGSHAELRAISEVYGSADAKEKFAKDFIAAWTKVMNLDRFDVKVSK

SEQ ID NO: 141040 - protein, 334 aa, Triticum aestivum
  Clone ID: PAT_TA_35458.pep
METTVPAATATTSSSVGHGAGGGAARVLLLPYPGAQGHTNPMLQLGRRLAYHGLRPTLVATRYVLSTTPPPGAPFDVAAISDGCDAGGMASCPDMAEYVSRLAAVGSETLRELLLSEARAGRPVRVLVYDAHLAWARRVAQASGVAAAAFFSQPCAVDVVYGELWAGRLALPATDGRALLARGALGVELGPEDMPPFAAVPESQPVFLRASVRQFEGLEDADDVLVNSFRDLEPTEAEYMALTWRAKTIGPTLPSFYLDDDRFRLNKATDQLLQQQSMFFGLKTTPLVFPPMDFFDEITKGTGNGKHHLGFRPMKFDNFQRRFPWAKSCKVKGS

SEQ ID NO: 141041 - protein, 436 aa, Triticum aestivum
  Clone ID: PAT_TA_35459.pep
AGRPRTSFIFTHHLSCAVDSRERIAKMRSFLLALLPLALATAVPSSKKVDYNGFKSLRVTLPKGADAEAINKLAATILNPGAGEELDIVVAPENVAKVKKLASDATVLVEDVGAVLAKEETSTVYAVPSESWFTAYHPYADHLQFLTDLQTSYPTKSEVFTLGNSFQGRALTGIHIWGSGGKGSKPAVVFHGTVHAREWIATMTAEYLAYQLLTKYASDAAVKAIVDKYDFYITPIVNPDGFVYTQTTNRLWRKNRQTLSGSTCVGRDVNRNWPYKWELTGGASTNPCDETFKGRAAGDSPELKAIVGQIDSLAAGRGISFYVDFHSYGQYILWPYGYDCSVVAPEETALSSVAARINAGIRGQSGLSYTAGNSCRALYATTGDSIDYVQGVAKAKYAYTIELRDKGTYGFSLPASQIQPTVCETWAGVLAGLQAI

SEQ ID NO: 141042 - protein, 275 aa, Triticum aestivum
  Clone ID: PAT_TA_35460.pep
MTVVTLPEPFASIPRENFLFGASPLQPLPRISAALGGKVNVYAKREDCNSGLAYGGNKVRKLEYLAAEAQAEGCDTLVSIGGVQSNHTRAVTAVASKLGLKAATVQEHWVDWEDPGYEKVGNIQLSRLMGGDVRLDPSTFGIEHKTTLAKLKDELKSNGQKPYYIPAGASDHPLGGLGFARWAFEVEAQEKELGIFFDTVIVCAVTGSTFAGMIAGFKLAQKKNGSPARKIIGIDASGKVQQTFDQVLRIAKNTAAKIGLSEDDITADDVILDPT

SEQ ID NO: 141043 - protein, 102 aa, Triticum aestivum
  Clone ID: PAT_TA_35461.pep
PNHPINYNLHHLARLIQREKQPMPEPERSARNGSTASGDAAGGGACALSAAATPLYLRRADGRGRFSGTTFSSELACHGGHWLRRRTRAGACARTSAAPKRR

SEQ ID NO: 141044 - protein, 243 aa, Triticum aestivum
  Clone ID: PAT_TA_35462.pep
MHCNTLSLAAVALLASSVNAHGHVAKVIAGGQEYTGGIPHGAPSNAVGWAAGNQDNGFVEPAAFGTADIICHKSAKPVSNAVTVAAGDVVTLKWDTWPESHHGPVTEYLAPVSGDFASINKGSLRWTKVAEKGYISGSNPGNWASDELIRDGFAWKFTVPRNLKAGNYVLRHEIIGLHSANNNNGAQAYPQCINLKVTGSGSQALSGGGDFTKFYSATDPGILFNLYASFSSYQIPGPAVQRI

SEQ ID NO: 141045 - protein, 246 aa, Triticum aestivum
  Clone ID: PAT_TA_35463.pep
PAGLGAKAKGRTDVDLNDEEIAALERRRKRDEAAKKKKSSKRRKDSSRVAIPLTQLESSSSRKKDSFTSQSRQPSRSNSNLTEGQDRPSRPSLGSLPPTSSTGRPRSGTTTSSQSRVRAPSTSRQPSDSSAVVRRGRNSSQAPADPFQFQVPGAPRGSGSRKSSRPVHDDGSSESDDSDAEYVGREDSIETTSSDGSGAQIVVEESSPEPAKPETSRRNPTRSSTSSSTSKRKPTTTTSSSARRKK

SEQ ID NO: 141046 - protein, 139 aa, Triticum aestivum
  Clone ID: PAT_TA_35464.pep
MKFTGILSALALTSAVSATTVSYDTGYDDKSRPMTAVSCSDGSNGLITKYGWKTQGNIPTKYVGGVNIIAGWNSPNCGGCYRLEYKGRKINVLAIDHAASGFNIGLDAMNALTGGQATALGRVNAQVYHADPSACGLKK

SEQ ID NO: 141047 - protein, 120 aa, Triticum aestivum
  Clone ID: PAT_TA_35465.pep
GLRECYSKYVRLGTGMLHRCMLWSTIYNNNRYVFDPGSRSATYMIVGPISDKLHLKQVPSHMMFVLVLSTAFEHPDGTLSCSQTSLPVGRGLRCHVVWFCSWRETYTERSALLGPYGWMP

SEQ ID NO: 141048 - protein, 39 aa, Triticum aestivum
  Clone ID: PAT_TA_35466.pep
RPGPEAGHRLGTPSLICLARTCSGLILCLIKYLLILFYE

SEQ ID NO: 141049 - protein, 110 aa, Triticum aestivum
  Clone ID: PAT_TA_35467.pep
GRSRASPAHMIRSSQPRSRLEPQSNLDDTRERERERDGKCSAVHRPLSSASWIINLTSSSVKCSPASMASRWMSMSGLDGLICPKDDMVSNPQSGTPQTMTEERGGVMRL

SEQ ID NO: 141050 - protein, 177 aa, Triticum aestivum
  Clone ID: PAT_TA_35468.pep
RPGRGLTPVLLATPRQFQARRNTLAKFESRFSRLCKAHLTNCLNILLDNSLYRHRILFLLFLPFLRTLPVNSQLNTYSVLQFLYPIQSFIMHVSKLIAFGAMFLAVDAFKCAVGQQGSCTYVESDAKQHRCAIKCSYKGGYAKCTCPQYYPRNDKKWPYGGKHACISTPQYVDRFKC

SEQ ID NO: 141051 - protein, 199 aa, Triticum aestivum
  unsure (1)..(199): unsure at all Xaa locations
  Clone ID: PAT_TA_35469.pep
RPGFGYTXLTHPECLKKXLREELNSLPPVKDGQYSLATLENLPYLNGVIHEGFRLAFGPISRSGRVATQENLKYKEHVIPKGTPISQSTYFMHTDPKNFPEPEKFKPERWIEAQQKGIPLKKYITNFSQGSRQCIGYTMAFAEMYLALSRIARAYDIELYDTTKADIDMTHARIVGYPKAIPGKKEHLGEVRVKVLKAL

SEQ ID NO: 141052 - protein, 124 aa, Triticum aestivum
  Clone ID: PAT_TA_35470.pep
MSESAAWPLADQKLEQELLDLVQSSQHARQLKKGANEATKTLNRGVSELVVLAADTQPLAILLHLPLLCEDKNVPYVYVSSKMHLGRACGVSRAVIAASITSNDASELAGQIRAMRDKVERLAI

SEQ ID NO: 141053 - protein, 284 aa, Triticum aestivum
  Clone ID: PAT_TA_35471.pep
MPPRIPALPSLGSLNLCLRPASKPATPNFLPIVQTANLSQREKKRKAKQDPYRWAQAQQRKAANVQRREELSRERDEAWGDPVLGKKTPFIESLETAGLKNSDSSVSNIGIRNHFLTDAEVKKATAHAYQLTKPMIGAVEEQMEPETKEDKMKQHKENHQKVLEALNRITSLENGSSKDRFHANVQRIINEFGRHTTDSKFMMKPRLSTDGEEKLGRCGPDTGSSEVQIGILTAKIHNLSNALQINRGYKDKHNKRNLRLLLHRRQKLMKYMDRKEKGNQRWTH

SEQ ID NO: 141054 - protein, 347 aa, Triticum aestivum
  unsure (1)..(347): unsure at all Xaa locations
  Clone ID: PAT_TA_35472.pep
MPPAFALAGASEAVVLVGAATAVLLELPRLSTEINESSEHLDASQQELFGLQTTIDVLTDSPVAAEEVASEALNDEKTANANILSLTEEGVTLVNELVQAVKAEKQGLQAQLAHMDSAVAEASKAAQXATSECLQLXKDRLLXNEERIAKVFNPRRNDEIQASVEXADPMKNIEELSALLAEAMEKKHPGEEENLVVVDEVHSSAREVAETAAETEDTEGESDKKPSMELVVANGNSNGDMNQEEEKHDSKVEQQEAKGDFTTIHESDKVVEKQLQADVKQETESSKDDLSSKEDSSTEHANANGTAASAEVTSKVAMSPTTTTKPQKKNKPLLKKFGNLLKKKNSK

SEQ ID NO: 141055 - protein, 96 aa, Triticum aestivum
  Clone ID: PAT_TA_35473.pep
MLRTSFRQAAAFRPIRCFSTTPRVMTEGATGAPRPTGGSGDAFQRREKASEDYAIRQREKEKLIELKKKLQEQQQHLDRLSKHIDEITKEQGGEQH

SEQ ID NO: 141056 - protein, 99 aa, Triticum aestivum
  Clone ID: PAT_TA_35474.pep
ESLIERHLQSKSNGEGTSKTTEAKGGGAGGGLGAGAGTRSGTRARAVTGLSTVGRGTGSSDGSSNGGHRGLGSSRNSDESEDGSGGVHFEGWFGLLGLV

SEQ ID NO: 141057 - protein, 221 aa, Triticum aestivum
  Clone ID: PAT_TA_35475.pep
MARRPARCYRYCKNKPYPKSRFNRGVPDPKIRIFDLGRKRANVDDFPLCIHLVSNEYEQLSSEALEAARICANKYLVKNTGKEGFHLRVRAHPFHVVRINKMLSCAGADRLQTGMRGAWGKPNGTVARVNIGQILMSVRTRDANRAIALEALRRSQYKFPGRQKIIVSKNWGFTPLRREEYLDKKAAGRVKVDGAYVQFLSNHGSLERNIRRFPDAFKSEA

SEQ ID NO: 141058 - protein, 61 aa, Triticum aestivum
  Clone ID: PAT_TA_35476.pep
MAVQPIIGMLRRNLVLDLSIALGSGFVMANFFWYGFHMPRTNARDNYYIKLEEERAAQKNE

SEQ ID NO: 141059 - protein, 61 aa, Triticum aestivum; identical to SEQ ID NO: 141058
  Clone ID: PAT_TA_35477.pep

SEQ ID NO: 141060 - protein, 123 aa, Triticum aestivum
  Clone ID: PAT_TA_35478.pep
MKYSLAPFILRRPWLARFFKPAATWYVNTAGYRQMGLKYDDLLEEENETAQAALKRLSNRESYERIYRIRRAVQCSYQHKLLPKDQWTTSAADKPYLQPLMEEVAAEKAEKNELDSIAVVRKH

SEQ ID NO: 141061 - protein, 104 aa, Triticum aestivum
  Clone ID: PAT_TA_35479.pep
RPGLDGGYHFAHADQYIPERWLDNSGPRFANDAKQALNPFSIGPRDCVGKNLAYAEMRMILARVLWNFDVSLHPDTPGWEKRTKSYFLWERGAMNVMLTPRKTE

SEQ ID NO: 141062 - protein, 103 aa, Triticum aestivum
  Clone ID: PAT_TA_35480.pep
MKFFIASTLLLANGIAAMPWSSPNAKQSNGEEITLHIQVSQPASNHASSPMHRGVVNVHNYEVCLKVCWPEEPTCPEGWNSKKFGDGDYPCWTCCKKTGDDDL

SEQ ID NO: 141063 - protein, 259 aa, Triticum aestivum
  Clone ID: PAT_TA_35481.pep
GRSSRRGRPLPLSHDEVTPIDLASMRPTARVFARYLEAGTPTGLTGLWTHATPRSTLLYLYGTTLNRLQKVPENSMYRQSVEAVTKHRMSLVEQMVPPGYNEWAARAKELVSKNSSQFRVSSGRIDGSEAHTVKLGDKVFVVGRKHEAGDVRIEEWDGEEDEGSEYEGIRTLKEREDQATWAERKPLEDHEKVEWEDEPQMTAEQVHELEQKIGAGLIEEIIQVAEGELKLVETMEKTKVWEDLDEKPVPGQWTYFDRT

SEQ ID NO: 141064 - protein, 275 aa, Triticum aestivum
  unsure (1)..(275): unsure at all Xaa locations
  Clone ID: PAT_TA_35482.pep
PALESNRSNSAAHLQQMESGENNMGSNDGPNSKANLAARQRLRWTDELHEQFVEAVTQLGGPDRATPKGVLRIMGTPGLTIYHVKSHLQKYRLAKYIPDSSSSXNKQMEVQKRLHEQLEVQRQLQLRIEAQGKYLKKIIEEQQRFGGGGIKSETPGAGATVTVSSDQFPDSERTDPSTPAPTSESASQGGAFKRDSGSQTEAIKSPCHDEPLLTADSNCHPGSPTLSPKHEKAAKRQRGSDAEFPEAELSLSQHIFESSSGPEIQQCSVPYYSGH

SEQ ID NO: 141065 - protein, 306 aa, Triticum aestivum
  unsure (1)..(306): unsure at all Xaa locations
  Clone ID: PAT_TA_35483.pep
TVYPPALESNRSHSVAHLQQMESGENSMGSNDGPNSKASWPARQRLWWTDEEHEEYVEAVTRLGGPEPTNTKAILRIMRLPGLXVXHLKQNLRKYRSRKXLSSGLQISEALKMEMEVQKRLHEQLEVQRQLQLRIEAQGKYLKKIMDGLKYKGSCSCESRHRESTLRKXIEEQQRFGGGGIKSETPGAGATVTASSDQFPDSERTDPSTPAPTSESASQGAAFKRDSGSQTEAIKSPCHDEPLLTADSNCHPGSPTLSPKHERAAKRQRGSEAEFPEAELSLPQHIFESSSGPEFQQCAVPYYSGH

SEQ ID NO: 141066 - protein, 57 aa, Triticum aestivum
  Clone ID: PAT_TA_35484.pep
MPFTASDICKIILAIILPPVGVFLERGCGADFFINILLTILGYIPGIIHALYIILKY

SEQ ID NO: 141067 - protein, 72 aa, Triticum aestivum
  Clone ID: PAT_TA_35485.pep
AGRVKGVLAYTEDDVVSSDLNGNTNSSIFDAKAGISLNDNFVKLVSWYDNEWGYSRRVLDLLAHVAKVDASK

SEQ ID NO: 141068 - protein, 137 aa, Triticum aestivum
  Clone ID: PAT_TA_35486.pep
MGEIKKGTIKHRNKEGTLDASALLWRALTSEKPDVMWKYITKDAVLCEPDQKVYSPRSEPALDEYLEEQYEPWTAYKIHDEPEFVEIDLMASALNYRVTCWKLQNGQMNATEAWCHSVFRQGPGGDWKCCLHHMAKI

SEQ ID NO: 141069 - protein, 166 aa, Triticum aestivum
  Clone ID: PAT_TA_35487.pep
LLLKSLNETTQVSINKLSTIKMKFSAAILAAAAATGATADAVFNVRDFAASCTPHSAMCSYSFNVIQPGTMDTKGYECTAKLPGAGPGELPEVKVGTCLPSSRTFDVVRSDKGLTLTVSVQVSPNSFTKGSHLIPTKDIKTVKGDTPTGDAQAYVGPKDFPLERVD

SEQ ID NO: 141070 - protein, 118 aa, Triticum aestivum
  Clone ID: PAT_TA_35488.pep
NSRLPIPKGSRIFINVWAIGRDKDVWDEPDKFMPERYLGSTVDFRGADFELLPCGVGRRICPGMTLATRMVHLMLASLLHQFKWSLPIELERDEIDMEDKFGLTLTKVVPLRIVATPV

SEQ ID NO: 141071 - protein, 125 aa, Triticum aestivum
  Clone ID: PAT_TA_35489.pep
MAGNFEEVAKQFVEYYYNTFDSDRKGLNALYRPNSMLTFESASVLGAEAIAEKLVSLPFQQVKHKVATLDAQPSNDQGGVIILITGALLIDEEQNPMNFSQTFQLQRDQAGNYYVYNDLFKLVFG

SEQ ID NO: 141072 - protein, 80 aa, Triticum aestivum
  Clone ID: PAT_TA_35490.pep
PAWYKTEKQVTDEMLKNPKPEWGNDIPDTKEAYWYRCMFDEHLPPHCASTVMRWTPTWSKQTDPSGRAIATHNAKYDSAA

SEQ ID NO: 141073 - protein, 144 aa, Triticum aestivum
  Clone ID: PAT_TA_35491.pep
MSYTIKVRVYQTNPNAYFHIVEKGCWHYANGSQWNEQNGILTLSMGGSGTSGMLRFKTEQNKEGFFVAMGVHNYKPWVDTITGLGDDITCVKALPEYYGNASDRTRSRESQRTEQTILNIDRRNISTHYKVKEGNNLELDITIG

SEQ ID NO: 141074 - protein, 255 aa, Triticum aestivum
  Clone ID: PAT_TA_35492.pep
MSAPETQPTAEGDEYEKTLLQLRCFDTMFLVDDSEAMQPYWPEIKTLIERIAPICAKHDPDGVDLYFVNHRPGGVLAKLPGVQSIRKSGYTHIGGFAGSMLLTSKGKQVGAIFDKVKPAGKCNMGARLGGLLKWYCDKFTAGEEKAALNIIVLTAGAFDDDIKTPLIQAARTLDEAKAPIHQAGVQLFRLGGPDLVRQKTLQHLDDELHKEAGTRDIVDTVTWSGHGTSMSDDELLKIVLGAVIKKDDIVLLCTW

SEQ ID NO: 141075 - protein, 391 aa, Triticum aestivum
  Clone ID: PAT_TA_35493.pep
MSHRKFEAPRHGSLAYLPRKRAARHRGKVKSFPKDDPKKPVHLTAAMGYKAGMTTIVRDLDRPGAKANKKEIVEAVTIVDTPPMIVVGLVGYIETPRGLRSLTTVWAEHLSDEIKRRFYKNWYKSKKKAFTKYAKKHSENNGASITRELERIKKYCTVVRVLAHTQIRKTPLKQKKAHLMEIQVNGGSIADKVSFGQELFEKPVDVSSIFEQDEMIDVVAVTKGHGFNGVTARWGTKKLPRKTHKGLRKVACIGAWHPSHVQWTVARAGQMGYHHRTSVNHKIYRIGKGDADDNAATEIDVTKKTITPLGGFVRYGEVKNDFVMLKGSIPGVKKRVMTLRKTMFPQTSRRALEKVSLKWIDTSSEFGHGAFQTPAEKKQYQGTLKKDLSSA

SEQ ID NO: 141076 - protein, 206 aa, Triticum aestivum
  Clone ID: PAT_TA_35494.pep
MSDAAYPPGGTIVQSLKRSFVDVPVDAANGDAVSTTEFLEASESLTTIFDAIGGMAFGPVKKDILGNVEKLRARQAAAPAESGTVQDLVRNELKTGKHTATEGCLWLVRGLDFTCQALERNVANSSEELADSFRTAYGNTLKPHHSFVVKPIFSAAMSAVPYRKDFYAKLGENPQQVEADLQTYLASFTKIVNILKTFINGPEGKW

SEQ ID NO: 141077 - protein, 78 aa, Triticum aestivum
  Clone ID: PAT_TA_35495.pep
MPQEVADIKKFIEICRRSDASSARIKKNKKTNNIKFKVRCQKNLYTLVLKDTDKAEKLKQSLPPTLQLTDVSSKKKSA

SEQ ID NO: 141078 - protein, 647 aa, Triticum aestivum
  Clone ID: PAT_TA_35496.pep
MAATGVGAGCLAPSVRLRADPATAARASACVVRARLRRLARGRYVAELSREGPAARPAQQQQLAPPLVPGFLAPPPPAPAQSPAPTQPPLPDAGVGELAPDLLLEGIAEDSIDSIIVAASEQDSEIMDANEQPQAKVTRSIVFVTGEAAPYAKSGGLGDVCGSLPIALAARGHRVMVVMPRYLNGSSDKNYAKALYTGKHIKIPCFGGSHEVTFFHEYRDNVDWVFVDHPSYHRPGSLYGDNFGAFGDNQFRYTLLCYAACEAPLILELGGYIYGQNCMFVVNDWHASLVPVLLAAKYRPYGVYRDSRSTLVIHNLAHQGVEPASTYPDLGLPPEWYGALEWVFPEWARRHALDKGEAVNFLKGAVVTADRIVTVSQGYSWEVTTAEGGQGLNELLSSRKSVLNGIVNGIDINDWNPTTDKCLPHHYSVDDLSGKAKCKAELQKELGLPVREDVPLIGFIGRLDYQKGIDLIKMAIPELMREDVQFVMLGSGDPIFEGWMRSTESSYKDKFRGWVGFSVPVSHRITAGCDILLMPSRFEPCGLNQLYAMQYGTVPVVHGTGGLRDTVETFNPFGAKGEEGTGWAFSPLTVDKMLWALRTAMSTFREHKPSWEGLMKRGMTKDHTWDHAAEQYEQIFEWAFVDQPYVM

SEQ ID NO: 141079 - protein, 70 aa, Triticum aestivum
  Clone ID: PAT_TA_35497.pep
PLRLGLPSEGSNRRIKKICSVTNLDLTWNTGCLSSCGYPKYEVAELQRKLDIAEDDTALINRRLDDSQGI

SEQ ID NO: 141080 - protein, 163 aa, Triticum aestivum
  Clone ID: PAT_TA_35498.pep
MKFMPILLGLVATSIAQPIAKRAVFTQSTYDDLSISGGTAGNAQQEALQKLGGLPNDLSTVEKADLDFLNSVNQIANDAEKEAFNPAIDAASGEEADALQRGKIKNKVLKLTATILKLEAQQAQGDDVADKLADENKMLQNNISQDKEAAGQASTFLPFNAST

SEQ ID NO: 141081 - protein, 126 aa, Triticum aestivum
  Clone ID: PAT_TA_35499.pep
AGSTPQYTHTDHSQSPQIKMVYTIVVHLYAKDDEESLKKLTAKLIEASRVYSQDKETLSWHVMQSTSDKRAFTIVERYEQESSQKYHLENPYWKTFDPYVIPLLEKPMDLRRFEELDTSKDVEVPQ

SEQ ID NO: 141082 - protein, 134 aa, Triticum aestivum
  unsure (1)..(134): unsure at all Xaa locations
  Clone ID: PAT_TA_35500.pep
GRSXGRRGQASTPQYTHTDHSQSPQIKMVYTIVVHLYAKDDEESLKKLTAKLIEASRVYSQDKETLSWHVMQSTSDKRAFTIVERYEQESSQKYHLENPYWKTFDPYVIPLLEKPMDLRRFEELDTSKDVEVPQ

SEQ ID NO: 141083 - protein, 76 aa, Triticum aestivum
  Clone ID: PAT_TA_35501.pep
MSAPYDPNQGYYPPQQGGYPPQGGYPPPQPMQYQQAPPPQEEKSHGCFYTCIATLCCCWVCGETCECCLECLDCCC

SEQ ID NO: 141084 - protein, 116 aa, Triticum aestivum
  Clone ID: PAT_TA_35502.pep
MANMRVQYRRRNGYNTTSNRTRVIKTPGGDIRLLHIKKRGTVPKCGDCGSKLSGIPALRPREYSQISKPKKTVQRAYGGSRCGNCVRDRIVRAFLIEEQKIVKKVLKEQEQSQKKK

SEQ ID NO: 141085 - protein, 116 aa, Triticum aestivum; identical to SEQ ID NO: 141084
  Clone ID: PAT_TA_35503.pep

SEQ ID NO: 141086 - protein, 73 aa, Triticum aestivum
  Clone ID: PAT_TA_35504.pep
LFLANNIYPPSSVKNTSGTGKNRQNKKKKKKKKKKKKKKKKKKKKKIKKKKKKKKKQKQKTKKKKKKKKKTPL

SEQ ID NO: 141087 - protein, 289 aa, Triticum aestivum
  unsure (1)..(289): unsure at all Xaa locations
  Clone ID: PAT_TA_35505.pep
MMNPKSRVQEWEADHIELIPGMPDDVAVDCLARVPHGSYRSMRRVCRGWRSAAAAPEFALARAEAGRQRXIWSFSCSLATRWPGTTGRPRTPRRTGVAVYNVTTGEWHRESSAPPVPMFAQCAAVGTRVAVMGGWDPKTFEPVADVNVLDAATGVWRRGAPMRSARSFFACAEAGGKIYVAGGHDKLKNALKTAEAYDAEADGWDPLPDMSEERDECDGMATVAGDRFLAVSGYRTGRQGGFERDAEWFDPATREWRRLERVRAPPTAAHVVVLTWWCAAACGASRARP

SEQ ID NO: 141088 - protein, 113 aa, Triticum aestivum
  Clone ID: PAT_TA_35506.pep
RNTASTFEANSRKTLMTMPQVTLHSLPNLGLLRTFGLDGGGLVSLASSSLLVKEETEKANGNNADDAEDDDNTSLLRSPVLALGELVGDRVAGHERLDSGHCVVGTERLLCEL

SEQ ID NO: 141089 - protein, 162 aa, Triticum aestivum
  Clone ID: PAT_TA_35507.pep
TCQSHLKTLHTPLSPVIAMSRKRKQDEEEELVSLPEDSDGEEEEEYVSTADEEEQSEEDEDAEEEEEEDDDDEDKEADAKVEPPVKKRKTAEADDQELNGDAEDDEEEEEEEKEELDDEEDAEGDDEAADVPARTKEAVKTAEAPVATETPESKAVTAGGDE

SEQ ID NO: 141090 - protein, 200 aa, Triticum aestivum
  Clone ID: PAT_TA_35508.pep
MRFTSILAAGAFATMASAQSKTVSMDPAQASQMDCLKDCEAGDVKCQSYCITVPSPNEQDIEKTTKCVAACPKGKGSEADTQKYTTCMNECIADNYWKSVDGTPRGTDVPDVKSQASEAASSAADKATATGTASESDATATAAATNSESGSESSSEETSTATGSGTATGTAAEVSETGNAASSLIGGVSFLGLVAAIFAL

SEQ ID NO: 141091 - protein, 86 aa, Triticum aestivum
  Clone ID: PAT_TA_35509.pep
MGSEAITEPRQATREEMRDAKLPLAYRDSCAHLLIPLNKCRRDTWYAPWKCSDERHSYEKCQYVEFKKRVAKMDELRESKGGARSN

SEQ ID NO: 141092 - protein, 229 aa, Triticum aestivum
  Clone ID: PAT_TA_35510.pep
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGQ

SEQ ID NO: 141093 - protein, 178 aa, Triticum aestivum
  unsure (1)..(178): unsure at all Xaa locations
  Clone ID: PAT_TA_35511.pep
MDMDMTSSSAPAASYFNFSVAQAVVTISINVILVWLSALVKSSTSSSSSASRRSAAPAPEPEPAQPAPASGASEVDLDVVLGVMGAGGAASVGFEEAAALFEEEEATVEEAAAAFRVFDRNGDGFVDAGELRSVLRSLGFTAGVAAAECQRMIDAYDXNKDGRMDFQEFLNFMERSSS

SEQ ID NO: 141094 - protein, 169 aa, Triticum aestivum
  Clone ID: PAT_TA_35512.pep
MSESTSPQKVWLASNDSANIEVDRVVAERSMLIKNMLEDVGDEITQGNPIPIPNVNEAVLRKVIEWCDHHRNDPPQAQDDESDARKKTTDIEEWDQKFMQVDQEMLFEIILASNYLDIKPLLDVGCKTVANMIKGKAPEEIRKTFNITNDFTPEEEEQIRRENEWAEDR

SEQ ID NO: 141095 - protein, 213 aa, Triticum aestivum
  Clone ID: PAT_TA_35513.pep
MSDNGEIEVENSALYEVLPKDVVKEVGNVKLFNKWDYDVEVRDISLTDYISLRNPVYVTHTAGRYATKRFRKANCPIIERLTNSLMHHGRNNGKKLMAVRIVAHAFEIIHLMTDQNPIQVAVDAIVNCGPREDSTRIGSAGTVRRQAVDVSPLRRVNQAISLLTTGAREASFRNVKSIAECLAEELINAAKGSSNSYAIKKKDELERVAKSNR

SEQ ID NO: 141096 - protein, 248 aa, Triticum aestivum
  Clone ID: PAT_TA_35514.pep
MGATVPTNDQILVPETLLKKRKSQEKARAERSDAVEKKKAANKEKRQVIFKRAEKYVQEYRDAEREKIRLHRVAKSEDSAYVPAEANLIFVVRIKGINKMPPKPRKILQLLRLLQINNGVFVKVTKAITEMLKVVEPWIAYGYPNLKTVKELVYKRGYGKVNKQRTALTDNSIVEENLGKYGIVCVEDLIHEIFTVGPNFKQASNFLWPFKLSNPTGGFRPRKFKHFIEGGDLGNREHAINALVRQMN

SEQ ID NO: 141097 - protein, 79 aa, Triticum aestivum
  Clone ID: PAT_TA_35515.pep
MAQFDWFSKIGATDEAVAVLNDQPILFTILLVVLVAVILQMVLLWYIHYATMKPEQRKAAQDKKDKKKAAKTKKPANAR

SEQ ID NO: 141098 - protein, 151 aa, Triticum aestivum
  Clone ID: PAT_TA_35516.pep
RLPVVVLAARVDGKHLSGAYKVEKDRLLSLIQNLDVRAESTILMPAELQVKTEAEKRLKELLREEELKWALRAKVRKVVQGDANTQFFHLIANGKHRKKRIFQLEQDEGTILGQDNLKTYITEYYRQLFGPPKDSCVSLDESRIDDVPQLS

SEQ ID NO: 141099 - protein, 208 aa, Triticum aestivum
  Clone ID: PAT_TA_35517.pep
THSKLPKITMHILQFSIFAAAMAASANGAKVEQRDIDSCTSAASGLVDAMSDMPTADKTLASFLAKQTDFEDVADSCVIPAVTGSMAAAYTSYAKSMENWISEFKDDLSSVYDACKDVPQVQEQLESYAIPSGLCSSYAWATASATETATATAKTTNSVADTATSTATESISSISTPSNVAENSAVRSTGLGVIAVVAVVGLTVAGAL

SEQ ID NO: 141100 - protein, 76 aa, Triticum aestivum
  Clone ID: PAT_TA_35518.pep
MSAAPFFWRAPLKYCRWAARERPALFWSVIIGAAGPVAMPIVPPIRHYFGDIDAPPVPVTYPIPNTPRKQLTGYDD

SEQ ID NO: 141101 - protein, 105 aa, Triticum aestivum
  Clone ID: PAT_TA_35519.pep
MSAPQSEAFKTAVEDSKKLTSKPGPTELLELYSLYKVGNGEDFTKAEKPGMLDLKGKAKYNAWKKVAEDDKLTPEAAKAKYVEHVEKLKKSCGYDANKVPETVGA

SEQ ID NO: 141102 - protein, 66 aa, Triticum aestivum
  Clone ID: PAT_TA_35520.pep
MAFANTLYRSLFSTNYLMLATVFSAGFAWEIGFNNVMDKVWDNHNRGRQWKDIRHKFIEGGDEDEE

SEQ ID NO: 141103 - protein, 171 aa, Triticum aestivum
  Clone ID: PAT_TA_35521.pep
MSTRRPQFSQQVLIDTTPLPSDIPAVKEVGASSAPLLSASFFIGARCRDYNDDYMQCKNENPGRGEFECLKEGRRVTRCATSVIKDINTHCLAEFRKHWECLDDRNHQLWQCRPAEWKLNKCVFDNMKLEKKIPDQPTNSTPVHLRPVQTFADVRIGPGDGKPFVPAQEDA

SEQ ID NO: 141104 - protein, 158 aa, Triticum aestivum
  Clone ID: PAT_TA_35522.pep
GPFFFFFFDILECIRCLWLSYSTLRYIGQVSNSGLTDGCAVPCVSTSHASYPQGSPHAALQLLVYLVVQKERAMWRDGNNVAMRLELKRTGKPSGVSLWGLSEEQGLVRQSVGDFVEFICWSLGFTALKNSVSVWALNLWAAVFGSFSYVWAVPEPAR

SEQ ID NO: 141105 - protein, 281 aa, Triticum aestivum
  unsure (1)..(281): unsure at all Xaa locations
  Clone ID: PAT_TA_35523.pep
EPSSLLTLSYSFNSLISTQTTTQQTLHLYLTMGVRVATQQDIPALKEIILKGLSEDSVFKYCFPSTRSETATNHVETVLKRIIDPENASWLCFVVDAPKTHDPVSLAICQTIHQNADGQKGVAEQAEQVFGLEADDNQTKTIKRLSALQQGITETQQKYLVRHTEIIFLHAVITHPHWIRQGFAKTLSKQTLQVARQKGAVVVALASPFTGYVFYSGTSFANCGRTKVETDNDIENLELQIMVCTPPKPLEQRRSSIMDYLXGKKCHPLVADASHTIKTLL

SEQ ID NO: 141106 - protein, 78 aa, Triticum aestivum
  Clone ID: PAT_TA_35524.pep
SADDLQSLTTNLCYTYASCTRSVSTAPPAYYAHKPAFRARFYLGQVPDMASEISAGSAPPPLMLPEIKDELKSHMFYC

SEQ ID NO: 141107 - protein, 614 aa, Triticum aestivum
  Clone ID: PAT_TA_35525.pep
VRGRVGLNRKDLSRGFQNEFDYVKIKKALRGLRVEVTHRGQMRRKYRIAGLTKDSARELRFQLSTGETKTVRDYFRETYKLQLRYDFLRCLQVGTEQKPNYLPIEVCNIVPGQRYQKKLDDGQVSKMMSIACQHPAGRETSIRKSVLENKYNSAKRANEFGIEVDSNPTSVQARVLPAPMLRYHGTASCHPENGAWNMRATHAADGAKVGIWACVNFCNELPEDEVRIFCHKLSEMSSTTGVNFNGAKLKIFHARSDQVEAKLREVRQQAGNMKIDLLLAILPNKNGSLYGDIKRICETDIGLMSQCCLLKNVEKSSPQFLANVALKINAKCGGRNSVFSDIQVSLPVVWKKPTIIFGADVTHPSALDDTAPSIASVVASQDWPEVTKYHGDVHAQGHRVELIEGLEGIVKKLLLSFEKQSKQKPQQLIFYRDGVSEGQFRKVLEDEIPLIEKAWKALYSEKPAITFIVVQKRHHTRLFPSDGKYQDNSGNVMPGTVVDRQICHPTEFDFFLCSHAGIKGTSRPAHYHVLRDDNNFSADDLQSLTNNLCYTYASCTRSVSTAPPAYYAHKLAFRARFYLGQVPDMASEISAGSAPPPLMLPEIKDELKSHMFYC

SEQ ID NO: 141108 - protein, 94 aa, Triticum aestivum
  Clone ID: PAT_TA_35526.pep
MEQQPINTQEATTQPLNETPVVGSPPQDRRASDAAYDRRMSDEWDASKVPPSRFQKRKGSIYATPGSRDGHVDRNYADKYWNKMTEKNWGSSSK

SEQ ID NO: 141109 - protein, 226 aa, Triticum aestivum
  Clone ID: PAT_TA_35527.pep
NSGTFPGHRLRAMGTPIVDKILSSLDRDNKLKNGMEYEDSEEQHAQLSTTDRTFLAKDLPGQLSSKAQALVEALEGKRFDSFMDALRDTAEESGLLFKKLDKRLERSMLHSYRKDLIAQVSSETDPVSFLPKVVALLFLQAHNKGLQAPGRAVGAVITLLKDKLPASTFKVLTEYHATTVKVLALQAAATGDDDDCASDRMLEKKEDLEERLMPELKSLALGTSKE

SEQ ID NO: 141110 - protein, 270 aa, Triticum aestivum
  Clone ID: PAT_TA_35528.pep
IQFPIINMSDSYGNDSYGSSRRDNDDNSYGSSRRDNDNNDSYGSSGRDNNDSYGSSRRDDDNDNSYGSSRRDNNESSYGSSNTGIGGNTSYGSSDRDNKDTFGSSNNDSYGSSRNDSDTFGSSNDNSYGSSRKDNDSSNTYGSGLSGGNDSYGSSRDNDNDNSYGSSRRDNDNNDSYGSSRKDNDTYGSSNNDSYGSGRKDNDSYGTGNTYGSSNNDSYGSSNNDSYGSSNTYGDDNDNNKKSGGFLDKVKDKVEEKVKGHKNRDNDNEY

SEQ ID NO: 141111 - protein, 259 aa, Triticum aestivum
  Clone ID: PAT_TA_35529.pep
LLGLLLRNYRDFLFFSSLLLLLQLDVEATAPICYISLFFLVFSSKMASRPIFTATHPRACSTAFERVFMARRDILESVHEPFGDAFYYGPEILSDRFRNDTATREQSGFSHKTYKDVLDEVMDAGKDGKRIFIKDMAYYLMTPDSKPTKVAPSLGEEEPGNPTVLPLEVLKQFQFTFLIRHPRRAIPSYYRCTVPPLDEVTGFYEFMPNEAGYKELVRFFDFLIKENIVDKDNLVVIDADDLLDNPEKDVRLYCEKTGI

SEQ ID NO: 141112 - protein, 131 aa, Triticum aestivum
  Clone ID: PAT_TA_35530.pep
MSWQAYVDSSLVGTGHIDKGAIISAAGDSAWAASADLQLKPEEMKAISAIVSGDEKAKDKAFAEGLYIAGERYVMARADGRSIYARSGRSGVAVAKTTQAIVVGHHGEAQIAGNATTTVESLADYLIKSSY

SEQ ID NO: 141113 - protein, 78 aa, Triticum aestivum
  Clone ID: PAT_TA_35531.pep
MSSLIDIWTVEVDRIRAMRRTVEPFRPTASPGAQEAGHVAQPSGDGAKDQAAGAGSPASPVLVREDAFLSILVDCFGQ

SEQ ID NO: 141114 - protein, 195 aa, Triticum aestivum
  unsure (1)..(195): unsure at all Xaa locations
  Clone ID: PAT_TA_35532.pep
MSLKGPSPQHHDGSGLRIGIVHARWNSTIIDPLVTGAKEKLLAAGVKESNIVIQSCPGSWELPIAVQRLFSASQIQGTSTGGPSAGDLLASSTTDLTSLCSXGAFDAIIAVGVLIKGETMHFEYIAESTCQGLMRVQLDTGVPVILGVLTVLTEDQAKARAGVDGKGHNHGEDWGMAAVEMGVKRKEWSNGTIDG

SEQ ID NO: 141115 - protein, 90 aa, Triticum aestivum
  Clone ID: PAT_TA_35533.pep
MGGGGGKVPYPKHVWSPAGGWYAQPANWRGNTLIAGVVMAGIVAVTWKFSSEREQWAHRPEPGQWYASRHWSKQLKQWDAEDRENSTKSE

SEQ ID NO: 141116 - protein, 259 aa, Triticum aestivum
  Clone ID: PAT_TA_35534.pep
PAVYGTLDETVQFSAHQGLSKSAPRSSTSYVNTGKHPPPKYISKMTASVDSTLSTAVEPYIRRTVTALRSAASEHDAVKEDTTLQEAFHEAGRTLPLIQKALEESPAELQGVTQKTLESLRECHVKAEICKAIFLAVADAQPEKRQEAYKEAVQKRSKGRTVEELVIGIATDICGLGEILVIQKHVEGLRGAIDRLSKMEPSLPKAKTDGVFNNYGSGDQLNAPGGTVNKSTGSGNQFPGANFSGSVYFDKEGSREHGP

SEQ ID NO: 141117 - protein, 247 aa, Triticum aestivum
  unsure (1)..(247): unsure at all Xaa locations
  Clone ID: PAT_TA_35535.pep
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLXPAFVDIINATKQ

SEQ ID NO: 141118 - protein, 126 aa, Triticum aestivum
  Clone ID: PAT_TA_35536.pep
MSAVRFTRAATRATAQLRAPAQRRFASTQNEFIKERQHIKEHAAGTTELWKKISLYGVAPCLIAAGANAYWLWSEHWEHWSHMPPLEERTEYPYQNIRTKNYQWGNGDKTLFWNDEVNYHNKDKTS

SEQ ID NO: 141119 - protein, 193 aa, Triticum aestivum
  Clone ID: PAT_TA_35537.pep
MQFKTLLVAAGVASAAPKDTTPKNFEFQGLALRSASPIHFNYLQASQESFELKLKDQKASCYSSKDKPQEATFQLYGDELWLYSVGNPRQQAYVDFSGMGQGKFGYTTGAQPAPKNASRKGWKVDKDGMLTCDGASFVACPMGDNLEKTSWSVWVYNSINNPGGNKNCLPFSVKAVKVEKPIPCSYSAIQPKA

SEQ ID NO: 141120 - protein, 186 aa, Triticum aestivum
  Clone ID: PAT_TA_35538.pep
MAAPAEKTITDLSGKWVLNKSLSDSSEPILALQGIGYLTRKGIGMATITLDVNQYSAPPKEPNTSTDVFTHIDITQSASGLTSTQENRCLDFEQREHSDWLFGSVKGRSRFVTLDQVEDDFLKQGWLVEADGKFVQSIAESVDNGWVANQIWGFEEIKGERRYVRHVLVTKGSQRVTAKLIYDYQA

SEQ ID NO: 141121 - protein, 255 aa, Triticum aestivum
  unsure (1)..(255): unsure at all Xaa locations
  Clone ID: PAT_TA_35539.pep
MARKGEGAGPNPPATTMIYAMVARGTLVVAEHTAYTGNFRDIAAQCLHKLPAGDSRFTYTCDGHTFTFLLHQGYAYCVVATESAGREVPLAFLERIKEEFNKRYAGGKAATATVNSLITWSRPRLKEQMQYCMDHPEEVSRLSKVQAQVSEVKGIMMENIDKVIDRGEQIDGLVTRTEQLHDHAMDFRTEGTRLRRRMWXKNMKIKLIVAGIVVAIILIIVLSICHRGPLQVAIAYHPSFVHSLNRKFKSQSLIL

SEQ ID NO: 141122 - protein, 173 aa, Triticum aestivum
  unsure (1)..(173): unsure at all Xaa locations
  Clone ID: PAT_TA_35540.pep
MVNEQDREHLRLAVSLAHEALKAGDAPFGSVLVSSDNKVLQTDXNRTVTGSDGDSRPDATLHPEFTLARWAQLNLSAEERKNSTVYTSGEHCAMCSAAHAWCGLGRIVYVSSTEQLEAWKKEFGVEAPVAPLSINQVAPGLQVEGPVEDLAKEVYQLHVENWTGKGFESKSKA

SEQ ID NO: 141123 - protein, 72 aa, Triticum aestivum
  Clone ID: PAT_TA_35541.pep
MAHLNVKPDPAYLKYAAMMKSRHHYFRWTPRTAKITFIYVGVIPAIMGYIAYKTDGLWDFRAKRKGDLVYEK

SEQ ID NO: 141124 - protein, 76 aa, Triticum aestivum
  Clone ID: PAT_TA_35542.pep
HGGGPGYGQPGGGFGGGGMGGGRKPGGGGMGMAGGAALGAGAGLLGGAMLMNSFDNDEQEAYQDGFEDGADFDGGD

SEQ ID NO: 141125 - protein, 164 aa, Triticum aestivum
  Clone ID: PAT_TA_35543.pep
CMQSAIFFIRGAALATVGAARMASSCRQQPAINGRLGFGRPETTGSIARHGRHARAPAMLMLRRRRLQRPRAPHHHQLPLGGGFLWTRHFRDGKAPDSMQERKSHQEEEAGHEQQRLAVVVVAARDPHLDLKLRTLPTTGERNQFVEISCFFAEKENGFQDRPA

SEQ ID NO: 141126 - protein, 281 aa, Triticum aestivum
  unsure (1)..(281): unsure at all Xaa locations
  Clone ID: PAT_TA_35544.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXEVESSDTIDNVKAKIQDKEGIPPDQQRLIFAGKQLEDGRTLADYNIQKESTLHLVLRLRGGMQIFVKTLTGRHITLGXGESSGPIDNGKAKIQDKEGISPAQRRLFPQAAWDG

SEQ ID NO: 141127 - protein, 54 aa, Triticum aestivum
  Clone ID: PAT_TA_35545.pep
PAGSGLQWESDFLAHLKTNETELLATIDKEGAISKDTEAKLKDVVQSFVKSFLG

SEQ ID NO: 141128 - protein, 166 aa, Triticum aestivum
  Clone ID: PAT_TA_35546.pep
GRSSRPGSGLIKYNHQQLTMATAETVDLGSAHPPKEDSIVAFEQVLPELKKTLVHLRHDYNKHEPEYFAAVENLSDHDLVGFSADNFESVRAATSAYGIHLFGKLRIPAMSDPSGPAYVHFRIFIGGGDEPPKLHCIHTEERDDPSGGKTYKAIFTKDDELEWFDT

SEQ ID NO: 141129 - protein, 504 aa, Triticum aestivum
  Clone ID: PAT_TA_35547.pep
MAAAPSSTGSDEEPTATPTRGIEGIRSTINPGNLPCPVVCATGEQVGVSGSKRKRRKHYVYLVFDDWSYGYSIHKVNLFPCSRRRKQTAFSAPADVPCLPPALFRLEAAHGSPEYFASAFGTRILAMHTRDPGGKRLLSGTFVPMLDVSSLSMTFCPGQEYPINPIYLSVGNTRLFCLSEASFEMLHWEPLCPPPLGRRRSKEWSWQRLEKPPFKSYNVTSYAVHPQRCTIFVSTKMNDIEATFSFDMEKQKWEQLGSWALPFAGRGHFDPYLNAFVGLSKDSDTLGQVYSCCLSSSSTGHGLEWKLGKERLFSQDPAERHVGATLVYVGQSKFCLVQCVSIEDESDGPKLKEEGNVGGPVYRTEDRGADLKLNEGDVQELKEEGDVQELKEEGDVDGPGYSIEDEGYDQELMDEGYDQELMEERYVPCCCLYRLTTFSLSYDIKGDLTTGNSCRVLYYKVPEAITSSFLVRRSCRILHVIKCSVVFSSFVYFSLGCGSMSFLL

SEQ ID NO: 141130 - protein, 165 aa, Triticum aestivum
  Clone ID: PAT_TA_35548.pep
MFVARQRAAFVARQLQRTARTYASDAHAHHKAAEVNESFSTGSLFAVAGFFGSVLVYQFVPAEGEQSAILNFINKYTSRSKDWEEINALHTKAMEQAGYDRNLFENGGNKHRFVDVAYPEAISSYANRNHIAGHLPNMDYVVEHYRQQHLKEEERKATKLAQKQE

SEQ ID NO: 141131 - protein, 120 aa, Triticum aestivum
  Clone ID: PAT_TA_35549.pep
MSTAAAGQVPAKKQQDLQVTYSNYKNTLQQIAQRIGDIEQEAEEHKLVLETLEPLSEDRKCFRLINGVLVERTVKDVVPALKTNQEGLRKVLEDLVKQYKTKQDDLEKWKKKHNVQVVQQ

SEQ ID NO: 141132 - protein, 369 aa, Triticum aestivum
  unsure (1)..(369): unsure at all Xaa locations
  Clone ID: PAT_TA_35550.pep
RTRLYYAVAKARPXLAFPAGVCSTMGLGGHFSGGGMGMMMRKYGLSIDNVLDATLVDANGRLLDKEAMGSDLFWAIRGGCGGNFGAVLSWKIRLVPVPSTVTFSNIQKTIDQGAASAVTKWQTLAPALPEALSIRVIVRRQQAVFQTLYLGGCSALVRAMSSLFPELGMTRADCREMSWLKSTVYINSGDTKTPVETLLNRTTSLSTFTKNKSDYVKQAITKDTWDKIFPWFNGSAAGLMILEPHGGRVGSIADEDTPYPHRSGVLYNIQYVAFWTGNGTDGPDWISGLYNFMEPFVSKNPRGAYVNYRDLDIGENAVVGGVTSYESGKVWGESYFGGNFERLAITKGKVDAGDYFRNEQSVPPLLSRK

SEQ ID NO: 141133 - protein, 209 aa, Triticum aestivum
  Clone ID: PAT_TA_35551.pep
MKYTIATIAAFATMALAKPAFLNTDFALTEGKPYTIRYSGCDSGCTIILQNGESTDLKDYKTLTSGAKGDSFTFTPSQLPSDTYNFKITDSAGDINYSAQFTYEGSYDAPSVTSATKSAVETTAAQTTEQATTLASVTKPVEEATTAKPIIPTHVPVPPKNATTPIATPTKTGGAGQTGVPEVPVSGATRMTSSLALIAGAAMAMVYLN

SEQ ID NO: 141134 - protein, 54 aa, Triticum aestivum
  unsure (1)..(54): unsure at all Xaa locations
  Clone ID: PAT_TA_35552.pep
GAXFFFFFFFFFFFFFFFFFFFFFFFFFFFFFFFFFFFFFRENVLLLLLIKTWE

SEQ ID NO: 141135 - protein, 75 aa, Triticum aestivum
  Clone ID: PAT_TA_35553.pep
CAPLEPAGSGLLQEYGCLFLECSAKTKVNVEQCFEELVLKILDTPSLLADASSGAKKNIFKQKAPEADAAASGCC

SEQ ID NO: 141136 - protein, 274 aa, Triticum aestivum
  unsure (1)..(274): unsure at all Xaa locations
  Clone ID: PAT_TA_35554.pep
MDSSSSSTASSSQAQAQPDFDYLFKLLLIGDSGVGKSSLLLRFTSDSFEDLSPTIGVDFKVKMVNIAGKKLKLAVWDTAGQERFRTLTSSYYRGAQGIIMVYDVTRRETFTNLSDIWAKEIDLYSTNQDCIKMLVGNKVDKESERAVTKKEGIDFAREXYGVNLWECSAKTKLDXSSAFEELVLKILDTPSLLAEASSGAKRNILKPTAVESDAAASGLLLISFTDGSPGHLFVIYLSRCGGWMIMLVVCINHLLAPCLNRSSCGCIKVNKIHW

SEQ ID NO: 141137 - protein, 154 aa, Triticum aestivum
  Clone ID: PAT_TA_35555.pep
VRRSSRPGRELNHKFSRSNPPTSLKSLNQKAPSMSQYTTIMDGVLVTDNGIPPPANWVNTYEDMGGDMLWGQAGQMEDEVRGRGIEGDIRPHYGMAPYTGEALYLFEVGSSQFYLFNAIDGSMLMIKDQTDLKSIVDILDDDNKGLPALDIEEI

SEQ ID NO: 141138 - protein, 239 aa, Triticum aestivum
  unsure (1)..(239): unsure at all Xaa locations
  Clone ID: PAT_TA_35556.pep
MSFTLTVRQGPARLAQRLPELSKTAFRNSASARSFHIQAKPTANFFTSRITSTATRNVFQRTSRAGGRSYHQGSPTGVATAPQSTSRRLLVGGAIFGGTLVAINAVFNRETREDGGMPVYEREYLNNTFLHTGLGIGIIGLTARQMVQTGFVYRIMVTNPWVVXVLGGLALSFATMIGTRSISPDNYIPKYAMWTAFNATQAAFVAPLLAFVPPVLLGRAGLYTLAMMGGLAIVGALLS

SEQ ID NO: 141139 - protein, 115 aa, Triticum aestivum
  Clone ID: PAT_TA_35557.pep
MTATATAPATATKLAADDFSAELAGVPVGAPEGVAEGTEGVIVEGASVVGAGVEAIGDGDAAVGGVATGAGAVVGDLAGGAGSGAILGAGMGPCAAVATARRAMMAATTARRAIW

SEQ ID NO: 141140 - protein, 119 aa, Triticum aestivum
  Clone ID: PAT_TA_35558.pep
MTATATAPATATKVAADEYTAELAGVPVGAPEGVAETADGVIAEGASVGASVGGAGGEAIGDGDAAVGEVATGAGAVAGDLAGGAGSGAILGAGMGPCAAVATARRAMIAATTAKRAIW

SEQ ID NO: 141141 - protein, 171 aa, Triticum aestivum
  Clone ID: PAT_TA_35559.pep
MASATSFYDFKPLDKRGQEVPLADYKGKVVLIVNTASKCGFTPQYAGLEKLWTDLKGKYPDDFVILGFPCNQFGGQEPGTDDDIQEFCQLNYGVTFPIMQKTEVNGDGTNPLWVWLKDQQSGLLGLKRIKWNFEKFLVGRDGKVKGRWASTTKPESLEKPILEALAEKPAA

SEQ ID NO: 141142 - protein, 226 aa, Triticum aestivum
  Clone ID: PAT_TA_35560.pep
MFSRQVLRAARVAAPQRALALRAAPVRSFAAAASSDVKSPVSVFGVDGTYASALYTAAVKTSSVDAAADALLKLGALIEKDPKLVAVLKTPTLADADKKAIVDELVKQINTKDETVKNFLATLAENNRLGLIPGVVDKFSTIISAARGEVELTVTSAQALDKRTLSRLETAVAKSSYVGQGKKLKVTNEVNPDIVGGLVVEVGDRTIDLSVSSRIAKMNKLLTDTL

SEQ ID NO: 141143 - protein, 125 aa, Triticum aestivum
  Clone ID: PAT_TA_35561.pep
EGKGYMLYVNDGVYGNFSNIMFDHQQPTAKILRTSGKTLFETAAAEPTPVGEGFEYSIWGPTCDGIDRITDSTRFDPILDVGDWLYFEDMGAYTKCSATQFNGFSNAHDVIYVCSEPGAKALLGL

SEQ ID NO: 141144 - protein, 299 aa, Triticum aestivum
  Clone ID: PAT_TA_35562.pep
FYFANMAPISVLLNSNVTDDKGLQVFYVTSQDNLGVALRNSAAKGVDSQDFYEAAADAHVGLIPVKSEIGSAVMNGLNLVVAITKHKLKDECEKPTLNDVSIVSPVYQVLDTTGITNTTAAIVSNEDNSNAWVYYLKGSDPKEIQICEYELTTGNIGPISNLNIDPDCSLGAFYDTNGNGRSIIYQDKDQGHIKEYQIESGQTIDIGDSAGAKLNTSLAVAYFEGYAYLYYTDQFMNLYRIIKDKNASKWGEHKKITPGANPDPSSQLTAIGANGTIHLFYQAQGNKKITHFREKAVGQ

SEQ ID NO: 141145 - protein, 113 aa, Triticum aestivum
  Clone ID: PAT_TA_35563.pep
MSSPRPSSPVNGGAAASGANIGRPSSPAIPGGPRTAIRRRAAADQKEKIANARPSSTRAAGAGGSSSTMLRLYTDESPGLKVDPVVVLVLSLVFIFSVVALHIIAKITRKFSS

SEQ ID NO: 141146 - protein, 207 aa, Triticum aestivum
  Clone ID: PAT_TA_35564.pep
MFNLRRLFASALFLGLGLLFLAQTAEAAKGPKITHKVYFDITQGDQPLGRVVMGLYGKTVPETTENFRALATGEKGFGYEGSAFHRVIKNFMIQGGDFTKGDGTGGKSIYGDRFKDENFKLKHTKKGLLSMANAGRDTNGSQFFITTVVTSWLDGKHVVFGEVLEGYEIIEKIENSKTGAADRPVEAVKIAKSGELDVPPEGIHVEL

SEQ ID NO: 141147 - protein, 248 aa, Triticum aestivum
  Clone ID: PAT_TA_35565.pep
MFNLRRLFASALFLGLGLLFLAQTAEAAKGPKITHKVYFDITQGDQPLGRVVMGLYGKTVPETTENFRALATGEKGFGYEGSAFHRVIKNFMIQGGDFTKGDGTGGKSIYGDRFKDENFKLKHTKKGLLSMANAGRDTNGSQFFITTVVTSWLDGKHVVFGEVLEGYEIIEKIENSKTGAADRPVEAVKIAKSGELDVPPEGLVGTSEFAAEEVASAGWSPMQKAGLFAIFAGVLFVGLRSARQHSRF

SEQ ID NO: 141148 - protein, 100 aa, Triticum aestivum
  Clone ID: PAT_TA_35566.pep
PAGSGSFSHRPFLASPIPFPLSLSFLFGSPSGFAFNSFFLSYLRCSSTSSPTLSFIYFHLTHLWPVYLDCTSFVILTAFVSKMACIFFPTPRGLSAPFSR

SEQ ID NO: 141149 - protein, 126 aa, Triticum aestivum
  Clone ID: PAT_TA_35567.pep
MYFSKNAIFALVTSVGLVSAALPKANEYKSHDCSGDLNYGHHAFDLHMVTMDDSSHSVYQAGTGWYLFDGKTGNGGRCEGEILGTVISGTSNCLDLDNTFPGKRIRCLCNPLIGANKNGINSCQYA

SEQ ID NO: 141150 - protein, 276 aa, Triticum aestivum
  Clone ID: PAT_TA_35568.pep
MNCVARAAPGNPSGPSQKLLFTMGRVIRNQRKGRGSIFTANTRLNKAPAKFRNLDYAERHGYLRGVVREIVHDAGRGAPLAKVVFRHPYRFKQVTETFIANEGMYTGQFIYAGKKAALTVGNVLPLGEMPEGTVVSNVEEKIGDRGTLGRTSGNYITIVGHNPDEGKTRIKLPSGAKKVVHSGSRGMIGIVAGGGRTDKPLLKASRAKHKFAVKRNSWPKTRGVAMNPVDHPHGGGNHQHIGKASTISRYAAQGQKAGLIAARRTGLLRGTQKTKE

SEQ ID NO: 141151 - protein, 334 aa, Triticum aestivum
  unsure (1)..(334): unsure at all Xaa locations
  Clone ID: PAT_TA_35569.pep
MAVGIALLLDLAARAPRSSASLHSHAAFSAAAAAAAAAALSASGVPLSARPFFGFPGFTVAHCDAGATYGSIDSPDLANDLIEKIHDSIHDLQLPIKEYPLELKPLLYAFGFKHFSMTTIRAFLLYYLPLQQPRPPTDDDDHDDLXNHDSARPPVEMVHPSLKALRPTAPATTVGTPGRASLKVSCLAFLXEREVWNLWELSPPFQDIQLAXLGAQTLMNNYACMVNSFSVAQCLWVLCNAYFWHIXITSYCTSVPVVATAXFDEKEKLRLFARRIYSVTIKCGFSLVFASIGAGLGVLLHPVHGQWIGCILGDFAGPVVAILIFEKLQFPLEG

SEQ ID NO: 141152 - protein, 220 aa, Triticum aestivum
  Clone ID: PAT_TA_35570.pep
MVNAEAGRSGKPLSVFIQHPSRTRPSPLTTIKMVNLRTQKRLASAVIGCGERKIWLDPNEQSEISNANSRQTIRKLISDGLIIRKPVTQHSRSRARELNLARREGRHRGYGKRKGTADARMPSQVLWMRRLRVLRRLLVKYRASGKIDKHLYHELYHSSKGNAFKHKRALVEHIHRAKAEKARETALQEEMDAKRAKNKAARERKQERAAAKRNALLAEE

SEQ ID NO: 141153 - protein, 82 aa, Triticum aestivum
  Clone ID: PAT_TA_35571.pep
MADTHTYEFDIAMSCGGCSGAIDRVFKKLDGVESYEVSLENQSAKVITALPYETVLQKIVKTGKTVKSGKADGIEQSIEVAA

SEQ ID NO: 141154 - protein, 78 aa, Triticum aestivum
  Clone ID: PAT_TA_35572.pep
QSSQLFNKNNLIIQKFHIQIDIRKRETKNKHKVDAFSFSRNDGCSFPRLSYLPKNAFKREISFHQFGSCVKEQILPEI

SEQ ID NO: 141155 - protein, 381 aa, Triticum aestivum
  Clone ID: PAT_TA_35573.pep
MHFLGLIVAFAPAALAQSAIWGQCGGTGWSGSTTCQSGLKCEKINDFYYQCIPGSDNGGGTTPDPGTPSPGNGNADATGLDAKIRAKGKIYFGTEIDHYHLNNNPLINIVKKDFGQVTNENSMKWDAIEPSRGQFTFSNADKVVDFAQANGKKIRGHTLLWHSQLPQWVKNIRDRATMTSVIENHVKTMVTRYKGKVLHWDVVNEIFAEDGNMRNSEFYQVLGEDFVGIAFRAARAADPAAKLYINDYNLDIANYAKVTRGMVDHVNKWVSQGIPIDGIGSQAHLAKPGGWNPASGFPAALKVLAGANVKEVAITELDIDGAAANDYVTVVNSCLTTPKCVGITVWGVSDKDSWRSESNPLLFDRNYQPKAAYTAVSNALN

SEQ ID NO: 141156 - protein, 193 aa, Triticum aestivum
  unsure (1)..(193): unsure at all Xaa locations
  Clone ID: PAT_TA_35574.pep
MTLTREEAHESKEMESLRVHADALLSLSSPAASSTAPAGSKPVTAAGGQEGAGXEGVFECKTCSRRFTSFQALGGHRTSHTRLQARMLLHDQAADVPGAAERDRARVHECAVSGLEFSMGQALGGHMRRHRGEAPPGPSTSSAAVHGDASSGATQQQEVMPDLNYPPMDDCGGDGQETSADRSSGHQLLDLLV

SEQ ID NO: 141157 - protein, 138 aa, Triticum aestivum
  Clone ID: PAT_TA_35575.pep
IPLGLAYYGFQEYTTSNYLESVKDLDSVFFEIWKLVNGSDQMSFRDAMKHVYEENLFPLRKRDLEHELSQPVSLGLEKKFRRCTAGVNREVPEWLARVLISQEVSFKCDLPRRYVHYARKKLKIAEIIGLIPISKIPA

SEQ ID NO: 141158 - protein, 410 aa, Triticum aestivum
  unsure (1)..(410): unsure at all Xaa locations
  Clone ID: PAT_TA_35576.pep
MAAMWSPIIGLLLLLLPIAPSSSIKFPLEGNVYPVGHFYATLNIGEPAKPYFLDVDTGSNLTWLECDHPVHGCKGCHPRPPHPYYKPAADKLRVQCGGPLCAAMRRDVPGIPECSRKDPHRCHYEIQYVTGKSEGDLATDIISVIGKDKKNIAFGCGYNQEEPADAPPSSVDGILGLGRGKAGFAAQLXGLKMITENVIGHCFSSKGKGVLFVGDFNPPSRGVTWVPMRESLLYYSPGLAELFIDKQPIRGNPTFEAVFDSGTTYTFVPAQIYNELVSKVRGTLSESSLVEVKGRALPLCWKGKKPFRSVNDVKNQFKALSLKITHAGGTSNLDIPPQNYLIVEEDGKTCLAIRDASSDPVLKELNFILIGAVTMQDLFVIYNNESKQLGWVRAQCDKAQELESVIDSRL

SEQ ID NO: 141159 - protein, 113 aa, Triticum aestivum
  Clone ID: PAT_TA_35577.pep
IHCMIILLCNSSLTSEFASASTPRSNYQTSIMKRASTCPAIRRDDTNYTIGQCLSFLRDSFQLLLSVSSEVVVEELAKEATLGCLIRHTRSAGSAVLRTTLLLGEASEGGHEA

SEQ ID NO: 141160 - protein, 51 aa, Triticum aestivum
  Clone ID: PAT_TA_35578.pep
IQYINIGNFEFMLLYVHIHADEIISLCRPYDETRNDAYNQWYHNNTCTRCR

SEQ ID NO: 141161 - protein, 234 aa, Triticum aestivum
  Clone ID: PAT_TA_35579.pep
MFTGIVEEVGVVSKLDNNDSTGGTSLTISIPSGSQLLSDCHDGDSISVNGVCLTVTSFTPEAFTIGVAPETLRITNLGDLKENSNVNLERAVRADTRMGGHFVQGHVDTTAKILSVTKDGNALTFRFQPARRDMLRYIVYKGYIAIDGTSLTVTKVNDQEGWWEVMLIAYTQERVVVAQKKEGDTVNLEVDMMAKYAEKSLGGVVGSEPGSVASFPFIEKIVERIVAQGFGAKQ

SEQ ID NO: 141162 - protein, 101 aa, Triticum aestivum
  Clone ID: PAT_TA_35580.pep
MPKAAAPAKRATRTKRAKKDPNAPKRGLSAYMFFANEQRENVREENPGISFGQVGKLLGERWKALNEKQRAPYEAKAAADKKRYEDEKQAYNADQEEEESS

SEQ ID NO: 141163 - protein, 93 aa, Triticum aestivum
  Clone ID: PAT_TA_35581.pep
LNKQNVRRIRPPSAITGGDPRPRGRCCLYCPGCHHHRCSSVPLSLRSRPCRQDPLDYDHPLCKRRAVHAKTVKGIMILADDGFASTPCTIKPV

SEQ ID NO: 141164 - protein, 99 aa, Triticum aestivum
  Clone ID: PAT_TA_35582.pep
MKPIAVLATMAAVFSTATEARACTQGLKYCSFNLLKIGDYYNEIEAELKRNGLPNSYSYVRNSLFRCASDGWIVFESYCGVCIDGGSGKSDRCPTGIGK

SEQ ID NO: 141165 - protein, 157 aa, Triticum aestivum
  Clone ID: PAT_TA_35583.pep
TEAPKSSASATRASLSIPESPSTANSSTLSAKPTAFLPAARTRERSAVLPPSSSPMSAVSTATAMSSSPASKLHGATRNSSRPSSHTLLEQISSTPRSTQHSDSPLLLSSYRALLVSASCCRTAIVSREQSRFRSTMCRVLMVWFMKASLMLGLVHL

SEQ ID NO: 141166 - protein, 148 aa, Triticum aestivum
  unsure (1)..(148): unsure at all Xaa locations
  Clone ID: PAT_TA_35584.pep
MTGMTMAGASSPSKKSGLRGPRPQPLKVASAPPSSRPSTKKAHGGGAPVIVYEHTPKVVHARPHEFMTVVQRLTGKPAPAPALFPXAYDVPVAPMEEGAGVGDPLLLTLGHGQHPPMAAGQLMSPGGFIFSPNTMQSIQELCSTPCAN

SEQ ID NO: 141167 - protein, 92 aa, Triticum aestivum
  Clone ID: PAT_TA_35585.pep
GARIRIQPRRLSLLHLRSCFSDLNIGKFKSKNKVSIVRDEGCCWYSHVRSCILTCRCIGVKSGSCVLRRPDQAHNKNCESWGGCHGRAGGGI

SEQ ID NO: 141168 - protein, 124 aa, Triticum aestivum
  Clone ID: PAT_TA_35586.pep
MAITPTQFAKKTAQSANWSDAKRRVLSSYREWIRAAPEVQTMYNMPMPVSTIRTRMRQEFERQRFVNKLSVVDVLLFKSHAEYQETMNFWKQTNHIMAYFKEENFRGDKRLPSSFMTGFLEGRN

SEQ ID NO: 141169 - protein, 580 aa, Triticum aestivum
  Clone ID: PAT_TA_35587.pep
MGSAKSSKSSKKRKPVAPPPESDSEQEETVHETAAAEEFNQEEQPQPQQQSDAGDEHHEHDKEVQETGKEKKKKKDKEGSGILTSMLFSELPISELTAKAIREMNYTHLAQIQARSIPHLLEGRDVMGAAKTGSGKTLAFLIPAIELLYNLHFSSRNGTGVIVVCPTRELAIQTHNVAKELMKYHSQTLGYVIGGNGRRTEADQLAKGVNLLVATPGRLLDHLQNTKGFIYKRLKCLIIDEADRILEQNFEEDMKQIFKRLPQNRQTVLFSATQTKEVEDFAKLSFEKNEERKEKPVYISVDDGKSNATVEGLQQGYCVIPSDKRFLVLYAFLKKKQSKKVMVFFSSCSSVKFHAELLNFLQIECEDIHGKQKQQKRTTTFFNFCKAEKGILLCTNVAARGLDIPDVDYIVQYDPPDEPKDYIHRVGRTARGEKGKGSALLFLLPQELKFLIYLKAAKISLTEYEFNNKNVPNLQSHLENIVVENYFLNQSAKEAYRSYILAYNSHAMKDIFNVHDLDMKAVAASFCFKNPPKVNLDLESSASKRRKTRKVDGGARRHGINAANPYGRKGGDDNRQFARF

SEQ ID NO: 141170 - protein, 157 aa, Triticum aestivum
  Clone ID: PAT_TA_35588.pep
MPKNKGKGGKNRRRGTKENDDQRRELTFKEDGQEYAQVIKMLGNGRLEALCFDGSKRLANIRGKMRKKVWINQGDIILLSLRDFQDNKGDVILKYTADEARTLKSYGELPENAKINETDSFGQGEDGEAYFEFGDADSDEDSDDGAAGKKEVDIDDI

SEQ ID NO: 141171 - protein, 145 aa, Triticum aestivum
  Clone ID: PAT_TA_35589.pep
HTIMSFMRRQLYCFIRHFYEPFSRAKADAKLPYKYHVLFPLLLDSVGQQQTTHRATHKTVHNINMSSNNIKETTASVPKDLQGGAGPDLTDGREQPWKKFLAAENECNNRPWTGWQPTEEKPFEKPWLRWSVEFGVDNFRHMTGS

SEQ ID NO: 141172 - protein, 212 aa, Triticum aestivum
  Clone ID: PAT_TA_35590.pep
MALVPAVLCYVALVMSVSLLLILYCAPRYGHTNIMIYVGICSVIGSLTVMSIKAVGIAIKLTIQGVNQAGYFQTWMFVTVSAICLIIQLVYLNKALDTFNTALVSPIYYAMFTTLTILASAIMFKDWSGQSASIIASETCGFLTVLAGIIVLHSTKEPDQNLSPDLYASLTAPLPPKIYWHIQGNGGDVGKQKEDDSLPCDFITVVRQDYFV

SEQ ID NO: 141173 - protein, 105 aa, Triticum aestivum
  Clone ID: PAT_TA_35591.pep
AGRVGTPTQFAEPPSQFAPQDTGFKLQAPPVKAPSATPKLNQSAFTPTDTTPPSLPMVPTVHVSEHGPVGSDEPTYDAVPIPGAYTGQAIKSPPPAQTSFGQGYY

SEQ ID NO: 141174 - protein, 134 aa, Triticum aestivum
  Clone ID: PAT_TA_35592.pep
MGIWDTFTDIVEAVTPWSVVEAEAPAEEPQEENESKTESKDEPEEEEAAEEDEEEEEEDEDDEEELVDQKETLEEECKNAPQCAPAKHHFDECVERVQQQESEGGAKEDCVEEFFHLAHCATACAAPKLWSQLK

SEQ ID NO: 141175 - protein, 48 aa, Triticum aestivum
  unsure (1)..(48): unsure at all Xaa locations
  Clone ID: PAT_TA_35593.pep
LDFMKANTDVWKGXWWSAGPWWGDYMYSFEPPSGSAYQYYNSLLKTYV

SEQ ID NO: 141176 - protein, 138 aa, Triticum aestivum
  Clone ID: PAT_TA_35594.pep
MSATKEFTMQDVAEHNTSKDIYMVVHDKVYDCSKFLDEHPGGEEVMLDVAGQDATEAFEDVGHSDEAREVLEGLLVGELKRLPGDEGPKRRIANSNQGSGQDPTGSSLISYALVVAVGFAAYMGYNYLQKQNEAQGSA

SEQ ID NO: 141177 - protein, 137 aa, Triticum aestivum
  Clone ID: PAT_TA_35595.pep
RLHSFSPLSSLLRSWQSPSLTTRLSRTVNTLTLASIRGFYPSAVLKSAAIASQNAAGRPPTAVQANVNVLGTMAAGHAVVVVCSASQDLAQESAGRSRYGFPIRNVKARARCSFLDDVQCNISHHPLLLKKKKKKGP

SEQ ID NO: 141178 - protein, 135 aa, Triticum aestivum
  Clone ID: PAT_TA_35596.pep
MKFLKVGRVAIITRGRYAGKKVVIIQPVDNGNKPHPFGHALVAGIERYPSKITRRMSKTRQEKRNKIKPFIKVINYNHLMPTRYTLELEGLKGAVSNDTFKEVSQREDAKKTVKKVLEERYTSGKNRWFFTPLKF

SEQ ID NO: 141179 - protein, 144 aa, Triticum aestivum
  Clone ID: PAT_TA_35597.pep
MSLSRLVPSLIKTKSIPCFTTVRTLRTMASGAVTVPPGKYEFLVVVHDKPGMLEKRLEVRGQHFDNMKPNVESGNWKMGGAILNSVPKDDSPSSLDFAGSTLVCIADSAEQVRENLSKDIYATSGVWDMDKVQIYPFKAAFRFN

SEQ ID NO: 141180 - protein, 153 aa, Triticum aestivum
  Clone ID: PAT_TA_35598.pep
MSQSGATVSQDCITAFNDLKLNKKYKFIVYKLSDDYKEIVIDKASESRDWEDFRETLVNATAKSRTGAVGKGPRYAVYDFEYNLASGDGIRNKITFIAWSPDDAGIQPKMIYASSKEALKRSLTGIATELQANDTDDIEYDSILKTVSKGLAA

SEQ ID NO: 141181 - protein, 254 aa, Triticum aestivum
  Clone ID: PAT_TA_35599.pep
MKHPYLVMDEKQPSQRVMLPIQARRSRPTMTLIVMAIVTYTFWIWQPFRPLIDDESWVHITNDDIQPTDSLVPLEAHIMSKCPDAKEALELLVLPVMQRVHDKVNFTLSYIGRPTANDGVDCMHGPSECMGNIIELCARELYPDPKINLGFIMCLSRDYSDIPGRSLVEDCALESAIDFQQLNECAVKEDGGYGLSLLRHSIKRTADAGVTKSATIRLNGEIYCIRDGGEWSDCPHGSSVNDLLIAIEKLRRQS

SEQ ID NO: 141182 - protein, 114 aa, Triticum aestivum
  Clone ID: PAT_TA_35600.pep
MSGYSNVGNRGVYEAGDQRNVSEAERKAEESDPYNEGKENSHNNLDSKDERSIANRLAAEEKKSESGDDTETAQLKKDPTLPARAHGNEPSKGAKIDAQLQAEEEEELKRKGKA

SEQ ID NO: 141183 - protein, 318 aa, Triticum aestivum
  unsure (1)..(318): unsure at all Xaa locations
  Clone ID: PAT_TA_35601.pep
TDGMIVILLDXLLQKGYGLGSGISLFIATNICESIMWKAFSPTTINTGRGPEFEGAVIALFHLLFTWPNKQRALQEAFYRQNLPNIMNLLATIAVFAAVIYLQGFRVEIPVKSSRQRGARGSYPVRLFYTSNMPIMLQSALSSNVFLISQMLYSRFSENLLVRLFGVWEAKDGSSQLHAASGLVYYMSPPQSMKDALLDPIHMSAYIIYMLGACALFSKTWIEVSGSSPRDVAKQLKDQGLVMAGHRDQSMYKELKRIIPTAAAFGGACIGALSVTSDLLGALGSGTGTLLAVTIIYGYFEIAAKEGDMSGMKGMIMG

SEQ ID NO: 141184 - protein, 378 aa, Triticum aestivum
  unsure (1)..(378): unsure at all Xaa locations
  Clone ID: PAT_TA_35602.pep
MSFPVVNGVEVAVPPPAGYQVDFSNPETDGSMVRNAYWIFGMEFAFATAFLGQRMYTNGVILRKFMIDDYLILFAWILSIAAQSFLLDAYRRKLLGVHAWEMPVDSNTESALLVMCTTLTYIPTTILSKLTLCFFYYRLSPARWYQYSVYVTGIICTTSLVGIWFSVLFACKPIAAGXDVRLSVNATCINRPPIYITQAGRPCMADVMLLILPIPXVVGLQMSTRQKLGVLGLFAIGSITLITSVVRLVLLLPSLSNPDQSWSLAEGCLWVIIEANLLIMCGSLPTLRVFLKNVAPRVLGDKSQSKPSEQNSASASFGLRTFGGSNGPRRKFDTLVELEHDVHFNRTTLRPEGMGKTDVKVLSGQSNESLMNHGPTGD

SEQ ID NO: 141185 - protein, 113 aa, Triticum aestivum
  Clone ID: PAT_TA_35603.pep
MARGETQQTKVHFKGSDDFVIFIDDVETYQKWKTDKSVPLAHFISSFKIFCTHGQGAQGTLDAASKAALENEFGTSVDDDVIKQILEKGETQNTEFPERQGSKNDSKGPMASH

SEQ ID NO: 141186 - protein, 352 aa, Triticum aestivum
  Clone ID: PAT_TA_35604.pep
MASRPTVTILGKDGAPTGATHAIPAVFTSPIRPDIVQQVHTGMAKNKRQPYSVSEKAGHQTSAESWGTGRAVARIPRVSGGGTHRAGQAAFGNMCRSGRMFAPTKIWRRWHIKVAVGQKRYAVCSALAASAAVPLLQARGHQVNSVPEVPLVIDSAVFEAAAIAKTSAALGLLKAVGAGEDVSKVKNSKKIRAGKGKLRGRRHRQRRGPLVIYSPETDGKELVTAFRNITGVETCPVTALNLLQLAPGGHLGRFIVWTSGAFKALDSIYGSTTEASAHKRDFLLPSNVVSQADLTRLINSSEIQSSINAPKGDAITRRSAVQKKNPLKNKQVMLRLNPYATVFAQEAQKKQN

SEQ ID NO: 141187 - protein, 151 aa, Triticum aestivum
  Clone ID: PAT_TA_35605.pep
TNLQPSPSTNQPSPSPCSSARSSSSPPLASSPQRLPPKSPNPPSSAVTSATTSRTGPRPRPAKRSQTSKTGPRPTPTRSSSGLPSTAATPRAGSRTTTATPATTFPQRPTQLVILCLPRPTPPAPRSRLPLAVLPPAPLLLPRTMTMLLLA

SEQ ID NO: 141188 - protein, 131 aa, Triticum aestivum
  unsure (1)..(131): unsure at all Xaa locations
  Clone ID: PAT_TA_35606.pep
RAAAFFFLDPLDADDWLRTMGKKLEVAQTDEGDKVPYVTHYLEGAAAIWWEYEKAMWFADEEITWSRFKERFQKYHIPAGIMTTKXHEFLALLQGSQSVGEYLQKFNHLSXYSQYDVATEERMIDRFLGVL

SEQ ID NO: 141189 - protein, 226 aa, Triticum aestivum
  Clone ID: PAT_TA_35607.pep
MSAPAPLRLGSTAPNFQAETTKGNIDFHEFIGDNWVILFSHPEDYTPVCTTELGAFAKLQPEFTKRNVKLIGLSANTIQSHEGWIKDIGEVTGGNVEFPIIGDKERKVSLLYDMIDQQDATNVDEKGIAFTIRSVFIIDPKKTIRTIFSYPASTGRNAAEVLRVIDSLQTGDKYRITTPINWVPGEDVIVHPSVKNEEAKTLFPEFRIVKPYLRFTPLAKEKVLPQ

SEQ ID NO: 141190 - protein, 196 aa, Triticum aestivum
  unsure (1)..(196): unsure at all Xaa locations
  Clone ID: PAT_TA_35608.pep
AAAGRNRKSDNHPQPSPCLPVCRRPASTAATFPPVRDVVGKNARSRCPIKLVSARHAPHKQYIIPPGWVRWGFPFGPWGGGVPKGNPNPTPGNPQPIGGNPKGXNPPFPPGVLPFPGGKKGVWGENGAGKKLFPPPKGPKAPKKNPPPFFLLGGKKTPPPXFFLKNPPPSGKKKKRLPPGGGAPPPPGGGFFPPPP

SEQ ID NO: 141191 - protein, 335 aa, Triticum aestivum
  Clone ID: PAT_TA_35609.pep
MSSFITKTVLAALVAAAGVRAHGHVESITVGGTEYEGLNPGAAAFENPRKELAAWFATNTDNGFVEPSAFGDADIICHRGAENAVKSAKVKAGEKITIKWDTWPESHKGPVIDYLASCGSAGCAKVDKTSLKFFKIAEAGMTSGGKFASDDLIAAGNTWEVTVPTSIKAGNYVLRHEIIALHAAGQENGAQNYPQCFNLEVESDGTAEPAGVAGTSLYTASEKGIVFDLYNNPTSYPIPGPKMNIAGGSSGAAPSTPATPTTGSGSDTPSNTAAPVESAPAESAAPVESAPAAGNGNQNNGGASPVETEAPATPQPTKTGCKAKKARRHARDMMN

SEQ ID NO: 141192 - protein, 201 aa, Triticum aestivum
  Clone ID: PAT_TA_35610.pep
GKEMDSEKYDRVLEWCSLKKDLEILPFGDKTVIGERGINLSGGQKQRIQIARALYQDGRPYLVDDPFSAVDAHTGSHLFKECLLGALASKTVVYVTHHIEFLPSADLILVMKGGRIAQAGKYNDILGSGEELMELVGAHQDALTALDVIDVANGGSETISSSLSRSLSSAEEKDKQSGKDNGDKVQSGQLVQEKKKKKRPL

SEQ ID NO: 141193 - protein, 396 aa, Triticum aestivum
  unsure (1)..(396): unsure at all Xaa locations
  Clone ID: PAT_TA_35611.pep
MAVPRPSWSRSVTETVRGSHQYTVKGFSLAKGIGPGRHLSSDTFAVGGYDWAVYLYPDGKNHEDNASYVSVFVALASEXTDVRALFVRTRLDXSGRARHKVHSHFDRSMQAGPYTLKYRGSMWGYKRFYRRTQLEASDFLKDDCLVMNCTVGVVKNRLETPKNIQINVPPSDIGRCFKELFELHIGCDITFEVGDEKVQAHKWILAARSPVFKAQFFGPIGKPDMDRVVVEDVEPIVFKAMVNFIYSDELPSIHEVAGSFSMWTSTVVTQHLLAAADRYGLDRLRILCEAKLCDELTSETVATTLALAEQHHCAQLKSACLKFTAVRQNLGAVMETEGFNYLEETCPSLLSDLLATVAVVVDDPSSVNRKRGVCINEDVNPVESVEASDRRTRRRV

SEQ ID NO: 141194 - protein, 136 aa, Triticum aestivum
  Clone ID: PAT_TA_35612.pep
MSTVGRTLTNLRKVGIKDYFKQMLYIGDTKAGVLIGTDRAGNKYFENNEELPLRTRWVEYAVHDYDAAHIEPGWHAWMSYSVDKPPTQDPLLNAGTRAFEPSRAIPNFTQTKGAFKTYNTAKPKMATWQPVAAPRE

SEQ ID NO: 141195 - protein, 101 aa, Triticum aestivum
  Clone ID: PAT_TA_35613.pep
YTEYVKVCSSSATVIMPVPFEALLPYAIMIGMFGISGTGLAVIKGIQNEGKRPRYSVDQWDRQMMDRDRRLTGTLRGQTDKAEAPLGFELNNPWKLETRFS

SEQ ID NO: 141196 - protein, 295 aa, Triticum aestivum
  Clone ID: PAT_TA_35614.pep
ICRPQGWWNYAGQFVVYDLPDRDCAAAASNGEYSLDKDGKNKYKAYIAKIKGILQDYSDTRIILVIEPDSLANMVTNMNVPKCANAASAYKELTIHALKELNLPNVSMYIDAGHGGWLGWPANLPPAAQLYGQLYKDAGKPSRLRGLVTNVSNYNAWKLSSKPDYTESNPNYDEQKYIHALSPLLEQEGWPGAKFIVDQGRSGKQPTGQKAWGDWCNAPGTGFGLRPSANTGDALVDAFVWVKPGGESDGTSDTSAARYDYHCGIDGAVKPAPEAGTWFQAYFEQLLKNANPSFL

SEQ ID NO: 141197 - protein, 245 aa, Triticum aestivum
  unsure (1)..(245): unsure at all Xaa locations
  Clone ID: PAT_TA_35615.pep
MTSFRRLALALGALLPAVLAAPTEKRQELTAAPDKYIITLKPEATENKIEAHLNWVSDVHRRSLNKRDTSGVEKKFNISSWDAYSGEFDKATIDEIKKSPEVAFVEPDYTVYLDFETELTDRALTTQSGAPWGLASISRRTSGGSTYTYDTTAGSGSYGYVVDSGINVNHRDFGGRASLGYNXAGGAHVDTLGHGTHVAGTIASPTYGVAKAANVISVKVFTGNSASTSTILAGFNWAVTTSLPR

SEQ ID NO: 141198 - protein, 240 aa, Triticum aestivum
  unsure (1)..(240): unsure at all Xaa locations
  Clone ID: PAT_TA_35616.pep
MPSSHAIYPSLRDKTVLITGGAEGIGSATVELFSLQGCQVIFIDIAEDSAQKTIDRVISRQKDSNSPIKPPIFYKCSVADLPGLQETVKSIQDKHGAVHVLVNNAAAAGNRARLTTENVTSDDWDFNVNTNLRHVFFLTQAVIPAMKEAGSGSIINLGSITWRIPAAGTPVYGACKAAIMGLTRTQSKEYGKYNIRINSVMPGAIATQRQRDEVLTPEYREEVMRXQSLQRDLEPERWPR

SEQ ID NO: 141199 - protein, 118 aa, Triticum aestivum
  Clone ID: PAT_TA_35617.pep
MRSKFKDEHPFEKRKAEAERIRQKYADRIPVICEKVEKSDIATIDKKKYLVPADLTVGQFVYVIRKRIKLSPEKAIFIFVDEVLPPTAALMSSIYEEHKDEDGFLYITYSGENTFGEA

SEQ ID NO: 141200 - protein, 132 aa, Triticum aestivum
  Clone ID: PAT_TA_35618.pep
CQGTSTVTCFKCGESVHYMRECPQTNPNQTAKTVGCGKPTGKVLYAKPSTTARGHVNCVSAEGAQEDPNVVLGTLLVNRHPASVLFDTGASHSFISESYARVHNTTLCEMPTFMVIQTPRSKWQTTRVMPSI

SEQ ID NO: 141201 - protein, 260 aa, Triticum aestivum
  unsure (1)..(260): unsure at all Xaa locations
  Clone ID: PAT_TA_35619.pep
MRFSILPTVALALYNGLVAANPVPELESRQTSGLDAAMKAAGKKYFGTALTVRNDAGETNVLNTKGEFGSITPENAMKWEAIQPNRGQFNWGPADQHANAATQRGMELRCHTLVWHSQLPSWVANGNWNNQTLQQVMKDHINAVMGRYKGKCTHWDVVNEALNEDGTYRDSVFYRVIGEAFIPIAFRMALAADPTTKLYYNDYNLEYGGAKTAGAIRITKLIQSYGLRIDGVGLQAHMTSESTPTXSTVTPSANLASVLT

SEQ ID NO: 141202 - protein, 522 aa, Triticum aestivum
  unsure (1)..(522): unsure at all Xaa locations
  Clone ID: PAT_TA_35620.pep
MLVSALQMDNSPPARTGSGPSRKAKLNSKDLSFVGYTYKNFDAGARMRPCRLARQLATSEVPREQQINLIKDLERKETEYMRLKRHKICVDDFELLTIIAGGAFGVLRLSREKTSGHIYAMKKLKKSDMVIRGXVEHVRAERNLMAEVASHCTVKLYYSFQDTEYLYLIMEYLPGGDIMTLLMREDTLTEPVARFYIAETILAIESIHKHNYIHRDIKPDNLLLDKNGHMKLSDFGLCKPIDCSKLSTLSEDEPMGDDNLKESMDVDSSLSETANGRRWRSQHEQLQHWQMNRRKLAFSTVGTPDYIAPEVLLKKGYGMECDWWSLGAIMYEMLVGYPPFYSDDPITTCRKIVHWRNHVKFPDDSRLSPEARDLICRLLCDVDHRIGGAGADQIKAHPWFRGVAWDKLYEMEAAFKPQVNDELDTQNFMKFDEMDNSPPARTGSGPSRKAKLNSKDLSFVGYTYKNFDAVKGLKHADMQRSSSLTRPSIGAIFGSNGMESSREPNGKDTHMHTFSSGDPMSP

SEQ ID NO: 141203 - protein, 125 aa, Triticum aestivum
  Clone ID: PAT_TA_35621.pep
MNRSWRKVFCHRFKLSTIIFISTLLNRQMSGPAIATIATGVAIVAVPAIVAGPILGALGFGAAGVAAGSTAAGVQSGIGSVAAGSLFATLQSASAGGYGVAIVHGAVQAVGAVVGVRGIGAWFRG

SEQ ID NO: 141204 - protein, 160 aa, Triticum aestivum
  Clone ID: PAT_TA_35622.pep
MGHSYGKRAGTRYAFSRDFRKKGMIALNTYLRQYRVGDIVDIKANGAVQKGMPFKVYHGKTGVIYNVTKSAVGVIIYKQVKHRYIEKRINVRIEHISQSRSREDFLKRVKANAEAKREAKATGTVVQVKRQPLGPRGAHTLSLSENPPMTVTPLAYETTI

SEQ ID NO: 141205 - protein, 71 aa, Triticum aestivum
  Clone ID: PAT_TA_35623.pep
PAPPGPICALNLGLLSGGALTGRTWAAQVIYLEDEHSTRLFLNVSFWSLVVKTLAMLMTGSDTLWWCRALG

SEQ ID NO: 141206 - protein, 303 aa, Triticum aestivum
  Clone ID: PAT_TA_35624.pep
RPGRANGDVNHPTVQFEYREIRETIKAEQMADNTSSYIDFFKTKGNRYRLVVLFSLGLFSQWSGNGVVSNYSSILYEQAGLESEQDRLIITAGKTILDMIVSIGCALFVDRLNRRFSFLFATGGMFLVLIFWTLTCGLYEQHQAAGANYGMIFLVWMHGVFYSTCWSGLLIGYAVEILPYSLRAKALMILNISVQIALLLNNYLNPLAFKAWQAGDDQIFGGNTWRLYLIYTIWVFGEVTFIYFMYVETRGPTLEEVAKVIDGDNAAVGHVTMEKVEKEALNEEVDKISSEGQQIHEVAPTKV

SEQ ID NO: 141207 - protein, 226 aa, Triticum aestivum
  Clone ID: PAT_TA_35625.pep
AGRRRATAHLILPPPQTTLSPTWRKYTLGITGKDFTIIAASKAAMRGATILKTTDDKTRALNKHTLLAFSGEAGDTVQFAEYIQRNAQLYSMRNESDLSPSALAHFVRGELATSLRSRKPYNVNLLMGGVDPITGKPSLYWLDYLASLAEVPYAAHGYAQYYCLSILDKHHHPDITLHQGIKILTMCIDELKRRLPLDFKGMVVKAVKADGIVDIEFDDDKVVKCA

SEQ ID NO: 141208 - protein, 84 aa, Triticum aestivum
  Clone ID: PAT_TA_35626.pep
FFLSYFLFFKLEAEENISYNPERTSPTLWCYYGIMFDDLAFAMTDFAWLMGLNGGCVIYLLRALVSSSGLDSRQDMVDREELKS

SEQ ID NO: 141209 - protein, 88 aa, Triticum aestivum
  Clone ID: PAT_TA_35627.pep
MSDDGQELVTKPFKFVTAGTDARFPNMNQTKHCWQNYVDYHKCIIAKGEDFAPCRQFWLSYRSLCPSGWYQRWDEQRESGNFPVKLDA

SEQ ID NO: 141210 - protein, 88 aa, Triticum aestivum; identical to SEQ ID NO: 141209
  Clone ID: PAT_TA_35628.pep

SEQ ID NO: 141211 - protein, 117 aa, Triticum aestivum
  Clone ID: PAT_TA_35629.pep
EMDENQITGSVQYAFGPDGVLVTGPVLMDDPATGKIICACCRVPKSEHSFLTMGPYNFKSQFCLDCERPRLEQPPPSTLGKRGLDTESEPEHTVSKPEVAKKSKGTETDEKIESSGS

SEQ ID NO: 141212 - protein, 84 aa, Triticum aestivum
  Clone ID: PAT_TA_35630.pep
MKRSSSAYGDKLSRKESGNYFTYFSPSTEDEDVCPTCLEDYTSENPRIVMQCSHHFHLGCIYEWMERSEACPVCGKKMEFNETT

SEQ ID NO: 141213 - protein, 526 aa, Triticum aestivum
  unsure (1)..(526): unsure at all Xaa locations
  Clone ID: PAT_TA_35631.pep
MAMAKSSSLVLVAFTLLCCYASTVSSQGNSSDGFLSCLSASIPRQLVFTPSSPSFTPLLKSSIRNPKFFTPSTVRPLYIITPTNASHVQAAVLCGRRSGVRHPVRGAGGHDYEGLSYPSVRAESSALLDLSSLRAVRVDPQAATGWDHSGAQRGEVYYAIGKASGVLGFPAGLCQEQGIDQQFGPVALCCVYMIAKXLATHLSLFAHVSVDIGLRLLXTMGSDVFWALRGGGGESFGVVVSWQVKLLPVPPKVTVFNVPVTASQGAADLVTRWQQVAPALPEDLIIRVVVQQKTANFQSLFLGTCDALLPVMSSRFPELRFNRSDCREMTWIQSVPYIYLGSASTVEDLLNRTTAESVFSSGYKATSDYVRQAIPRDAWASIFAKLAQPNAGLMILDPYGGQIAAVPESATPYPHRAGVLYNIQYMNFWSMASGDGAVQTRWIREFYAFMAPFVSSNPREAYFNYRDLDLGENVVVGNVSSYQAGMVWGQKYFKGNYQRLAMAKGQIDPDDYFRNEQSIPPFANSR

SEQ ID NO: 141214 - protein, 112 aa, Triticum aestivum
  Clone ID: PAT_TA_35632.pep
AGRVQNVDWCPTGFSLGICYQAPENVPNGDLAKVSRAVCMLSNTTAIAEAWSSLSLKFDLMHSKRAFVHWYVGEGMEEGEFSEAREDLAALERDYEEVATDSMGDEELEAEY

SEQ ID NO: 141215 - protein, 161 aa, Triticum aestivum
  unsure (1)..(161): unsure at all Xaa locations
  Clone ID: PAT_TA_35633.pep
AAAAASAKLEPITMKGSKLFYTNGTQFFMKGVAYQQDSAAGGESTCXIKTYADPLADEKACKRDVPLLKELGTNIIRTYAIDPTVDHSACMKLPDDAGIYVISDLSEPSLSINRDDPKWDIELYQRYRXVVDELAQHHKVAGFFAGNEASNKVSNPRTPAF

SEQ ID NO: 141216 - protein, 249 aa, Triticum aestivum
  Clone ID: PAT_TA_35634.pep
MKPTQVLVALAAIAYAAPVSDDTKAKALEIDDDFPLAELEAYFEAHMNGETSEANSLHARQFSSSTYNQLTDGTPCRPVTMIYARGTTQAGNVGDPAAVGPVLFNNLASRIGLNNLAVQGVAYPANIAGYLAGGDAAGSRTMADLISRAATQCPSTKIIISGYSQGAQLVHNAAGMLSASVTNRVTAAVTFGDPKQKQAFGTIPSSRTRIFCRAGDNICDGGIIVTPAHSQYQQDAPAAAEWIAAVLSI

SEQ ID NO: 141217 - protein, 142 aa, Triticum aestivum
  Clone ID: PAT_TA_35635.pep
AGRVGDEKPLFLRPFCIFNRTTYSLPLLKMPITNADVPPTSTDDTHYVVYFASGEPSWCPDCRNALPALNAVFGDASAPNAHLVMAGSREEWRGNPDNKYRKAPYDIQCLPTVVKVKYGEEIGRLGDNESQNESDLRKLVKL

SEQ ID NO: 141218 - protein, 254 aa, Triticum aestivum
  Clone ID: PAT_TA_35636.pep
MKFSIVFAGLFASTAIATPQGNVTPNTMGALEKRASFPIPASKGSVTYKKVEYISGTFDGGMKTYGRGVKCTGQAEGGDSDAVFILKNGATLKNAIIGADQIEGVHCEGSCTIENVWWKKVCEDALSLKGDGNALIKGGGATGAADKVIQHNGLGTVTIDGFTVVDFGKLYRSCGNCKKMGTRNVVVKNVKAYNGKVLTGINSNKGDISTITGTCASSVKEICVEYQGTTPGNEPKKIGSGPSKACKYSSVSSC

SEQ ID NO: 141219 - protein, 265 aa, Triticum aestivum
  unsure (1)..(265): unsure at all Xaa locations
  Clone ID: PAT_TA_35637.pep
MALMDSVKLCFGYVHAALITPWLLSHFLFDITLCLIPYLRPSRKWSLNQAVRVRLIRLVLLYWSLTKYGDRLRLDPKREKNRFEVVSPRSPKLYRGILSDYVVRPAQLGMTWTPARPPPAGLVNSNMVVALHFHGGGYVIGNGRDEDTGFLAKTLVRRMGCSHVCTPQYRLSSSNNGQFPAPLQDALTAYLDLIKSKGIPASQIILSGDSAGANLALALVRYIHEHGKDDNIPXPEAMALWSPWVDIAGALEQDIKQSPNYKTDY

SEQ ID NO: 141220 - protein, 247 aa, Triticum aestivum
  Clone ID: PAT_TA_35638.pep
VRRSRRPGPENSYEYECSFALGENVGMKNERWVPMMSADNAWLPRNELLASHQKMVADVDMKEALASGQFRPLVRKEIESHCANFGLDAELVSHSRMRGLSGGQRVKTVLAACSWQRPHLIVLDEPTNYLDRDSLGALSKALKKFEGGVIIITHSAEFTKDLTEEVWAVMDGKMTPSGHNWVQGQGAGPRLKADDGDEEEKFDAMGNKIVTTKKKVKLSSSEARKKKKGRMARRKRGEEVFSDADDL

SEQ ID NO: 141221 - protein, 83 aa, Triticum aestivum
  Clone ID: PAT_TA_35639.pep
QAGLVGIIFLLFTPQALARAHDAKALSILRNHGFSPLLVVLFHLLLYVGRACWSSASTFATKLKDEHLTSNCTRICYEQQLRH

SEQ ID NO: 141222 - protein, 297 aa, Triticum aestivum
  Clone ID: PAT_TA_35640.pep
MLDFLSPRKLLTQLTLGAGLVAAQLQTISNFGPTYDTRLVMQAYVPSNLPANAAVMVALHPCGGTGPGYFQQTKYKSLADSRGVILIFPSSPKDSNCWDVASTKTLKHGGQGDSQVIVSMVDYAINTWKADRNKVFVTGTSSGCMMTNVLAATYPDRFAAATCYSGVAAGCMAGSPGSSPISSDRKCSDGKIVKSGQEWANQVKAMYPGYSGSYPRFKTWHGTADYLVTYQNLQEQIKEWSTLHGVSLTSSQQNTPQPNYTTMIYGDGTKFVAVSAAGVGHVVPTHEDDDFKWFRLT

SEQ ID NO: 141223 - protein, 158 aa, Triticum aestivum
  Clone ID: PAT_TA_35641.pep
AGRAGVQYTELIIYSQSHIKPPNMVNFVTSITLLLTAVSTVVALPNTLEKRAVTCRDDRPNSELANANEAAACIDYLASLGNQACVATISGQSFCRRGDTQITGLARGAPTRTSTCQEVARGAGLILDRCTRGDGKVRGANEAWGNGNLLVDIRRVVQ

SEQ ID NO: 141224 - protein, 272 aa, Triticum aestivum
  Clone ID: PAT_TA_35642.pep
MDAEAVAQAAAAAAAGAPLDPHGAMVSAIVPPATGNQLTLSFQGEVYVFDSVSPDKVQAVLLLLGGRELNPGMGAGASSSTPYSKRLNFPHRVASLMRFREKRKERNFDKKIRYTVRKEVALRMQRNRGQFTSSKPKPDDGTSELATADGSPNWGSVEGRPPSAASCHHCGTNAHNTPMMRRGPEGPRTLCNACGLMWANKGMLRDLSKSTPPSLQMVSTGPNDSQNGNTLSQQNGSTLSQQNGNAAIVPFAEQQNPAPATDANGHDHGSST

SEQ ID NO: 141225 - protein, 114 aa, Triticum aestivum
  Clone ID: PAT_TA_35643.pep
FYSGYTLSKNKHHTQVCTQTTKMGANLSSTFVPDLSGVVLSPQDKDSDIHLAVFWGATLYICAMIFSTCALIDRWKGPYDRIRTTGGSVIGALLLSTAWPVVMAYLMFNPAFAD

SEQ ID NO: 141226 - protein, 173 aa, Triticum aestivum
  Clone ID: PAT_TA_35644.pep
MSGLFARQAWATASKVRSTALRAPKVAFTCRVNNIAPRRSFSVSMNLLARKYTESHEWIDVAADGKTCTIGISNYAAEALGDVVYVELPAVGEETAQGESFGSVESVKSASDINSPVSGSVVEVNDPIVETPADLGKDPEKSGWLIKVEAEDVSALDALMDEAAYAEHIKGEH

SEQ ID NO: 141227 - protein, 93 aa, Triticum aestivum
  Clone ID: PAT_TA_35645.pep
MSAQQLNIDNADLEKLNDKDRTELRQFLANEQQRSQIQAQTHSLTQMCWSKCVPGTIKNPKLDKSEETCLANCVERFLDVNYLTMKHLNGMRN

SEQ ID NO: 141228 - protein, 164 aa, Triticum aestivum
  Clone ID: PAT_TA_35646.pep
SSPPPLFSPPLPASPLLLPSLRSRTSLPAALPTAPSATTSSRSSSPTPWRPGSTPSSATPALSPPTTLFPTSRTESARTLPAPSLSPVVTRVFSSRSLSPSAPRATPLESTSSPTLCSSSPRFPTPRSRCTTDPRTSSSLRALRLAPFYFLCLYACMFRQFCLD

SEQ ID NO: 141229 - protein, 66 aa, Triticum aestivum
  Clone ID: PAT_TA_35647.pep
MNSHVSIIQSQYPSQQRPPIRRPPIIPPIPPPIRPPPIPPPILRPPPIPPRPPPMRPPPIPPWWWW

SEQ ID NO: 141230 - protein, 139 aa, Triticum aestivum
  Clone ID: PAT_TA_35648.pep
NGLCYKCGQPGHLARNCYQNPNQNQLALPAAGRGSNQPRYNNDMSYGHFHANHVDLNEAQDQPATVMGTLLVNSVPASVLFDTGASHSFMSEDFAFMQGIKSEYMNTSLLVNTPAGQCRTSMICNDVRVEIEGLEFLVS

SEQ ID NO: 141231 - protein, 337 aa, Triticum aestivum
  Clone ID: PAT_TA_35649.pep
MSPSADIPEISNSADSTVLSLKKSLCSEDSPLPIRFRALFSLKHVATTADDDATRVAAIEAIAAGFASPSALLKHELAYCLGQTGNTAAVKPLRQVLSDLKEDPMCRHEAAEALGALGWADNLDILREYRDRKEEDISIVETCEIAIERIEWENSAERQKEKLRPSDFASIDPAPPMPESDKEAEVEDLGRKLMDTNADLFSRYRAMFALRAVASPPDLPTATPAVLALAKGLSDSSALFRHEIAFVFGQLSHPASIPALTEALSNTNEASMVRHEAAEALGSLGEKDGVEDTLRKFLHDKEKVVRESCIVALDIAEYEKGEDAEYALIPESAGAAA

SEQ ID NO: 141232 - protein, 265 aa, Triticum aestivum
  Clone ID: PAT_TA_35650.pep
MASHHVLLVGGHGKIAQLLTPLLLKRSWTVTSVIRTAEQTPAIEQLGAGLPGKLNVLVRSIEDIDSRDKALGVLSEVQPDYIAWSAGAGGKGGAERTFKVDRDAAVHLIEAAASVPSITKFLLISYLGSRRAGAPWWPAGEWDDFHEKVNNGALANYYKAKIEADDVLYKVSKKSPSLVGINLRPGTLNDKPATKVELGKTKHISSPDGISREAVAEVASHLLAADGVKNGWYDLLDGDEDIPAAVDRVVKEGVDAAQGEAIYNA

SEQ ID NO: 141233 - protein, 275 aa, Triticum aestivum
  Clone ID: PAT_TA_35651.pep
RPVRDPLFVSLNIPVHTYSKMKSFLATALSTLLLVNNVAAAAIEDPIEIFNRQAAGQVIRQCSKPGVLALAYDDGPGQYTNQLIDTLDRAGAKGTFFWTGKLYGCVYNNQAAVKKAYNSGHQVASHTWTHPQNFGSLSTDQLKQEMQKFEQAMVNIIGKKPAYMRPPYLATGGNVLPTMQQLGYKVITNDVDSGDWNGQSAQQSQQKFQQAGAGGNGHIPLMHETYASTVNTLTPWLLNWAKQNNLKIVTVAECLGNAAGAYQPGTFQGNGQNTC

SEQ ID NO: 141234 - protein, 133 aa, Triticum aestivum
  Clone ID: PAT_TA_35652.pep
MSNCIFCKIIKGDIPSFKLFESDKTLAFLDIGPLSKGHALVIPKYHGAKLADIPDEDLAEVLPVLKKIVNATGATDYNILQNNGRIAHQEVDHVHFHMIPKPNNEEGLGVTWPTKPANMEQLKAYCEEIKSKI

SEQ ID NO: 141235 - protein, 70 aa, Triticum aestivum
  Clone ID: PAT_TA_35653.pep
MSDQVQEILEVPSEFVRDGVQFMRRCTKPDQKEFLRLCQAVGVGFLIMGAVGYVVKLVHIPLNHALVGSA

SEQ ID NO: 141236 - protein, 154 aa, Triticum aestivum
  Clone ID: PAT_TA_35654.pep
AAARAGRSGNQSLYSSLHMRYLQNIVLLIGFLGAAPAVLAVAPSTESSGVEIAQPNAADAQPPQAIQPQDVEEENDEEENDLTGNDGAAVLAQLESRARVKCLTRGRPGKNCYHSQCPGNKQCKVNTRGNCVFKLSQKKRPFGCSQCLCYRSSL

SEQ ID NO: 141237 - protein, 294 aa, Triticum aestivum
  unsure (1)..(294): unsure at all Xaa locations
  Clone ID: PAT_TA_35655.pep
MSISSEPGTRGNLTAEQNHSLQEAWVHLLRLCGNQTICQDVPEKTNDFLQHLNNKSPENFSRSLWEAFLADHPDTTLLRFLRARDFDVVKAVDMFVSSINWREERQVQKTIIGGGEAVGLKTSLTPDEEAFMAQYCSGKSYVRGTDKDNQPVYVIRVRLHDPHKQTTEAMETYVLHNIETLRMMARAPNDKVCLIFDLSGFGLRNMDFHVVKFLIDVLETRYPETLGVVLVHNAPFVFWGVWTVIKHWLDPVVASKVHFTSGAKGLLKFIPKNNLQKXMGGDDPCEYKYVQPVP

SEQ ID NO: 141238 - protein, 502 aa, Triticum aestivum
  unsure (1)..(502): unsure at all Xaa locations
  Clone ID: PAT_TA_35656.pep
ESRIQSAIAQPDQCHSNPTYPLYPNPSAAAASMASMRPSDEVSENGHGNGNGPSPPRGKRPRAALISVAQIRDEFAHHDPAVARVNNGSFGCCPASVLEAQARWQRLFLAQPDAFYFDGLQPGLRRSRAAVAALVNAGDVSEISLVDNATTAAAIVLQHAAWSFAEGHFARGDAVLMLHYAYGAVKKSIQAYVARAGATVVEVPLPFPVTSPDAIIAEFHAALAVAKAGGRKVRLAVIDHITSMPSVLIPVKELVAICRQEGVDKVFVDAAHSVGQVPVDVRDIGADFYTSNLHKWFFCPPAVAFLHTRKGGPITSQLHHPVVSHEYGNGLPMESGWIGTRDYSAQIVVPEAIHFVNRFEGGIEGIRSRNHEKVIEMGKXMLAEAWGTVLGSPPVMCGSMAMVGMPSCLCIESDDDALRVRTMLRKDFKVEVPIYYNSRQVKVQEMAKDNSSDPVTGYVRISHQVYNVKEEYERLRDAVNKLVAEGFTSAELRPAEKQEALA

SEQ ID NO: 141239 - protein, 158 aa, Triticum aestivum
  Clone ID: PAT_TA_35657.pep
MYRQNHPGPLSLPTTWSPPTNDMMPNKSPTTDTNQRSRQASTCSERSCEGMTLDETRELWRCMLELQLRYGCYNSTRIDMAVDAGEDGLDLMPNRFIIDTLNESVIDLPDEGRELLNRYLCPSSPNNKQKWKFWKKKKKKGPYLIYLMALRKRDGKWH

SEQ ID NO: 141240 - protein, 126 aa, Triticum aestivum
  Clone ID: PAT_TA_35658.pep
RRRPGIINIYIYNISTLQTKPTYFFFPFTTQTSQWISSRTLWAVVTRTVLPTATPAAPRRKTTSTRPSLPSTTRLAPTSPATTRRRSPTLAATPTRRRLAARLTPSTPTKERNNLMRWMDGMLSKR

SEQ ID NO: 141241 - protein, 280 aa, Triticum aestivum
  unsure (1)..(280): unsure at all Xaa locations
  Clone ID: PAT_TA_35659.pep
MQSGISASQELQNEFNSLLSSTGTFGLLATIEKESMVPITTIPSKSSSFSDNLSGLEPHLKPDVALYIILRRHEDAPRFIAITYVPDSAKVRQKMLFASTRLTFVRELGTEHFRETIFVTTPEELSVKGFEKHDAHNKLAAPLTEEEQQLGEVKRAEQEAGQGTGHKAIHLSKNFAMPISDEAIAALKEVGEDGGRPVTMLKINPSTEKVELVPEAPTPSGISELTKAISSTEPRFTFYRFXHTHDGAESSPVLFFYTCPSTPGXKSIKFRMMYPLMKAS

SEQ ID NO: 141242 - protein, 151 aa, Triticum aestivum
  unsure (1)..(151): unsure at all Xaa locations
  Clone ID: PAT_TA_35660.pep
MANSVSGVAVNEECVKVFQELRAERKHRFVVYKMXDDDAQQVVVDKVGXALDATFDDLAAAXMPADDCRYAVYDLDFXVSEDSAGDTPXRSKIFFIHWVRRESAXTRQKQGLLYASSTEGLKKELDGVQIDVQATDAXAQLTLNIDKDYTT

SEQ ID NO: 141243 - protein, 140 aa, Triticum aestivum
  Clone ID: PAT_TA_35661.pep
SEAFREHHIPEGLMDRKREEFCSFTQGRLSVDAYSREFGNLARYATEEVSTDAKKQARFRKGLSPELRRDLRLHECTSFSKLVNKAISAETGQTDYDATRKHGRDMGSSSGAGPQKRRVWVPNTALPPRFTPRPSFQAPR

SEQ ID NO: 141244 - protein, 80 aa, Triticum aestivum
  Clone ID: PAT_TA_35662.pep
MPTGTMRRMFVESSSSSSGSGREAEPAVVLCAPRPRRVHAQPCSADLILGPPPFLLNASSGSIKQRQGKSKTREEEGEGG

SEQ ID NO: 141245 - protein, 210 aa, Triticum aestivum
  Clone ID: PAT_TA_35663.pep
DGCTAWLDSQTDGTVVYVSLGSLAIISVEEFTEFLSGLVGAGHPFLWVLRPDMVGASQNAVLQDAIKAAGRGKARVGEWAPQRDVLRHRAVGCFLTHAGWNSTLESVTEGVPTVCWPFFVDQQTNSRFMGAVWGTGLDMKDVCERAVVERMVREAMESVELRRSAQALAQQVRRDIAQGGSSAEEFKRLVGLINELSISTRGSTPSPDKE

SEQ ID NO: 141246 - protein, 98 aa, Triticum aestivum
  Clone ID: PAT_TA_35664.pep
MSDENANGTPGEQAPANSEHLNIKVTDNNNEVFFKIKRTTKLEKLMGAFCERQGKATSSVRFLFDGTRVQPTDTPDALEMQDGDTLEVHQEQVGGSSL

SEQ ID NO: 141247 - protein, 145 aa, Triticum aestivum
  Clone ID: PAT_TA_35665.pep
TKSHQVNMSGNPVPLTVIKGAGFEHIPLPNGVNATTADFHSIRTKTDSPAHITSGFYKIEAGPARPAQYNFEESKYVLSGQVDVLDEATGITHHLTAGDFAFFHVGSKVQFSTKSQGFAFYVVTRPVRDAHPNLKGREEETKSRL

SEQ ID NO: 141248 - protein, 117 aa, Triticum aestivum
  Clone ID: PAT_TA_35666.pep
MRMDSTTMTSSMNKYWIPHQDIHRKVITQELQCYLGPQATVRPYTLEGEDGFLISTPGSCLTDEQIDDICRKSKDLWDRQAAAKVQQNPEKLLKRPLHQPVIVSRGSSREPHRRYYD

SEQ ID NO: 141249 - protein, 200 aa, Triticum aestivum
  Clone ID: PAT_TA_35667.pep
RLRLYTLMGAKSLSVLGNDGAGKKALIGSLIYKCGLELPQLQQLESEGISQYEKIVPFFEKNGLAQSFYAPSGAFTVQKNQTPDVAFWVVDASDSSSWGSSAEKLSTTLSSGVLNPREKLIIIVNKMDSVNWSEQTFKDVVGAFSSVNMNNAYIIPVSALRQEGNILPTPEAPSWVQKISAGQFEGSASASGESLMNLLS

SEQ ID NO: 141250 - protein, 266 aa, Triticum aestivum
  Clone ID: PAT_TA_35668.pep
FSEDFGPKDTDTYGLGPLIKVTNDNVRARYSQEDGGKRDMLSSLKASGLPEGEAQAETLFLFIAGSDTTAAAIRVTMFYIISSPRVYQKLKKEIRKAIHEGRASSPITVAQARELPYLQAVIYEGLRIRPVTTGPQSKEVPPGGDTINGHFIPEGTSIAINFPAIMGSKKLFGPDADVFRPERFTDLQDPDLAEMRRNVEMNFGNGRWMCAGKPIAFMELHKVYFELLRAFDFQLVEPLKPMTSESYSLFRDHGLNVRVTLAEDME

SEQ ID NO: 141251 - protein, 205 aa, Triticum aestivum
  Clone ID: PAT_TA_35669.pep
PCQPRLLHLSILLHQPLICNSSASSLWLPQPWPSPPSYPPRPQHQHVWKRAQRFLNGNSQTSSTTSRRAQTPPQSSLTSTTPLSTTRPTATASQSPRRPSLTARPTTPARSPTEPTLPPSSTTTRRASSPSSSTGPASRRVVGSRPLATGLLPRPSLTATLRPSPRLAQRPPSRSPFSRCAQSCKRRNRDIIFFSFAAAFSDKHF

SEQ ID NO: 141252 - protein, 149 aa, Triticum aestivum
  Clone ID: PAT_TA_35670.pep
MAPKAEKKPAEKKPAAEVAEKAEKTPAGKKPKAEKRLPASKSAKEGGDKKGRKKNKKSVETYKIYIFKVLKQVHPDIGISSKAMSIMNSFINDIFEKLAGEAAKLARYNKKPTITSREIQTSVRLVLPGELAKHAVSEGTKAVTKFTSN

SEQ ID NO: 141253 - protein, 149 aa, Triticum aestivum
  Clone ID: PAT_TA_35671.pep
MAPKAEKKPAEKKPAAEVAEKAEKTLAGKKPKAEKRLPASKSAKEGGDKKGRKKNKKSVETYKIYIFKVLKQVHPDIGISSKAMSIMNSFINDIFEKLAGEAAKLARYNKKPTITSREIQTSVRLVLPGELAKHAVSEGTKAVTKFTSN

SEQ ID NO: 141254 - protein, 125 aa, Triticum aestivum
  Clone ID: PAT_TA_35672.pep
MSFLTKNVIRRAALAPRVIAFQAPRTFTTRFALQRTATDAVKDTAQKVDRVVSDKIVDGIEAGQEAAATVTKKTQELKGDASAKAQELKGEAAGKTEELKGEAKGAAEQAKGKAKGAAEEAKHKL

SEQ ID NO: 141255 - protein, 169 aa, Triticum aestivum
  Clone ID: PAT_TA_35673.pep
MLRTSATNLLRKSLVRSTPALASRAASTHAISNPTLANIEKRWEGMPLQEQAELWMALRDRMQSNWTELTLQEKKAAYWIAFGPHGPRAEDPPGTNARVAWGIFIGIAASVGLFGLVRLAAKPAPYTMTQEYQEETNEFLKNQKSDPFTGITSPGYAGKGMVQSPPKGN

SEQ ID NO: 141256 - protein, 257 aa, Triticum aestivum
  Clone ID: PAT_TA_35674.pep
MSSGVGGNRRRRGRRWAQVDPGVHITAHGVPQGGNDLKRIRFSREMFNKWQAQRWWAENYDKVMELYNVQRFNHQSVPLPTTPKSEDESSKEDSPVTPPLDKERVPRSLQRPTSGGGAMGYSSSDSLEHHSNHYCNGLHPHHGHQCYDSVGLASTPKLSSISGAKTETSSMDASMRTSSSPEEVDRSGELSVSISNASDQEREWVEEDQPGVPITIRALPGGIRELRRVRFSREKFSEMHARIWWEENRARIHEQYL

SEQ ID NO: 141257 - protein, 97 aa, Triticum aestivum
  Clone ID: PAT_TA_35675.pep
MEEALISPELRDVLAKVAVFLLVQGLVYLILTNSSDVFSKNKRLRSLSFRPMRSMSVRRVLAPLSDVPVGTDDDSPSPSLFSSSSWSSRRWGSRKED

SEQ ID NO: 141258 - protein, 203 aa, Triticum aestivum
  Clone ID: PAT_TA_35676.pep
PPGRYRPLIIRHIASRSQPHLQPRGTRTPLVRRPLWWTGSSIDPSAPVTMMEVALISPERRDVLIQLAVLLLVHGAGGTSSSPTPPTASPEEEEAQGPHLPAPSVHPRAAGPGPALRLPRWRRPPGALASRCERYAAWRGRCWGVQARGWGRLGFGAIAMLLRLKNGYSGFSLRYSRMRWGLVHMFIDLDLEVELVLKNCFEK

SEQ ID NO: 141259 - protein, 116 aa, Triticum aestivum
  Clone ID: PAT_TA_35677.pep
PARSISRDCPMSGGSGQATECYKCGEIGHIARNCNKSSYGNNYGGGFQQQGGAGKTCYSCGGFGHMSRECVNGMKCYNCGESGHYSRDCPKESAGGEKICYKCQQPGHVQSQCPGN

SEQ ID NO: 141260 - protein, 128 aa, Triticum aestivum
  Clone ID: PAT_TA_35678.pep
WIAAVAVATRLSPIPALVLPVATPPAYSCSCTELRLQLRHASVAASSPANRIGAWRWPLACSPSSPPQKQGALLLAAPPPAVPYLEKEGNSSRCCRSIRGRRRAHHGDELTWVTHGDASSATPPLQQL

SEQ ID NO: 141261 - protein, 252 aa, Triticum aestivum
  unsure (1)..(252): unsure at all Xaa locations
  Clone ID: PAT_TA_35679.pep
MAAPITSRTETLQKYLKLDQKGMIMAEYVWVDAEGGTRSKSRTLPEKDYKPEDLPVWNFDGSSTKQAPGENSDVYLRPCAVYPDPFRGSPNIIVLAECYDSDGTPNKYNFRHDCVKVMKTYADEEPWFGLEQEYTLLGSDDRPYGWPAGGFPAPQGEYYCGVGTGKVVQRDIVEAHYKACLYAGIQISGTNAEVMPAQWEYQVGPCTGIEMGDQLWVSRFFXHRVAEEXGAKVSLHPRPXAGDWDGAGLHST

SEQ ID NO: 141262 - protein, 271 aa, Triticum aestivum
  unsure (1)..(271): unsure at all Xaa locations
  Clone ID: PAT_TA_35680.pep
PAGSGHTSDPIQYSPPSDLAGKSLRSKRSEGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITXEVESSDTIDNVKAKIQDKEGIPPDQQRLIFAGKQLEDGRTLADTTSRRNPPSPCPPAFVVACKSLS

SEQ ID NO: 141263 - protein, 274 aa, Triticum aestivum
  unsure (1)..(274): unsure at all Xaa locations
  Clone ID: PAT_TA_35681.pep
MKLSSILSVWVFTLISTVFGAELVPRSTLKEVTGYGNNPTGTRMFLYVPKNLKANPAVVVGLHYCTGTAQAYYQSNKWASNAEKYGFIVIYPQTPYTPGNCWDVSSKMTLTHEGGGCSTSVANMVKHVLKNYSGDSKRVFVTGDSSGAMMTNVMAATYPDIFAAAIVYAGVPAGCFMSQANQAAAWNSTCSQGQSRYTQQQWANVVKNMYPGYNGPRPKMQIYHGTADPTLNVQNYYEEIKQWXGVFGYSATPSLLPTTSLAAPTSERSLVISS

SEQ ID NO: 141264 - protein, 261 aa, Triticum aestivum
  Clone ID: PAT_TA_35682.pep
MATEKVLSDDNLLEEILLRLDLPTCLVRASLACSRWLCAVSRPAFLRRFRRLHAPRLLGFYVVGDGVPRQDFVPVPSPPELAAVLRRASSGLDAYSDFSFTIDDCRNGRLLVDGYRVGGTQVVSPLLHRQHHLAPALVLPPPPPASLDGVSHGYTFLPEDGGDGASYHRVDLEHHGRQVSAQVSTLGSGAWTVQIAKAELPEPPDRIPDLTVLLRGKLYMVTTAGYILGLDLAAASFLRGPAPGRRHVPVLRQPGPVPEIR

SEQ ID NO: 141265 - protein, 230 aa, Triticum aestivum
  unsure (1)..(230): unsure at all Xaa locations
  Clone ID: PAT_TA_35683.pep
MGVQEVLSRKSGVIVGDDVLRLFEYAREHKFAIPAINVTSSSTVVAALEAARDAKAPVILQFSQGGAAYFAGKGVSNGDQAASIAGSVAAAHYVRSLAPTYGIPVVLHTDHCAKKLLPWLDGMLDADEAYFKEKGEPLFSSHMIDLSEEPVEWNIETTAKYLKRAAPMKQWLEMEIGITGGEEDGVNNEDVDNNSLYTQPEDILNIYNTLSPISPYFSIAAGFXNVHGVY

SEQ ID NO: 141266 - protein, 126 aa, Triticum aestivum
  Clone ID: PAT_TA_35684.pep
AGPGLNLITSTYNRLTPRLSRLTYIHYQASQLNMRIKAFITAAMTAMVIADQHPGAEKMCGRLGPMTWDPNDLPDGVDVSQIRMCADHPMGAGNYWGWGEYLPSWVPRNPLADIQWGRTYRSKVVT

SEQ ID NO: 141267 - protein, 122 aa, Triticum aestivum
  Clone ID: PAT_TA_35685.pep
MMVMGYFRAPRIGGRRKEKKSKAGAAPQAEEAGLREALLEPAGGVLPKGYFAVYVGEEARRFVVPTGYLREPAFRDLMERAADEFGFAQADGLRVPCAEEDFEELLRRLHRKNGSGSGKGKN

SEQ ID NO: 141268 - protein, 227 aa, Triticum aestivum
  unsure (1)..(227): unsure at all Xaa locations
  Clone ID: PAT_TA_35686.pep
MEAIKQALHLGKGSDAPAEPTPEALSELKEKYTKAGQEQVFTFYDSLSSAERGTLYQQLSGFDPSHINDITQRALNPAKTSDEPDRLEPLPESATASILDSGADDIAKWYDSGLDLISKGQVAVVLMAGGQGTRLGSSAPKGCYDIGLPSHKSLFQLQGERIAKVQELAAKKGSNAVVPWYVMTSGPTRGPTEKFFQKNNYFGLSQENVXSXEQGVLPCISTMARSP

SEQ ID NO: 141269 - protein, 90 aa, Triticum aestivum
  Clone ID: PAT_TA_35687.pep
MASSSAVSKRGDAGGVLAAISRSSVAAHGREAAAVAGKLLRSTGKAAWIAGTTFLVLVVPLIIEMDREQQMVDLDLQQQALLGSPPPLAK

SEQ ID NO: 141270 - protein, 335 aa, Triticum aestivum
  Clone ID: PAT_TA_35688.pep
MRFFSIPSQALVAFLALGSVSARVLTKRDSPVLPGLWADPNIAIVNNTYYLFVTTDGFEGWGGNSFYWWKSPDLVSWTKGEKPFLVLDGKNGNVPWATGNAWAPGFAARGGKYYFYHSGNNPSVSDGHKSIGVAVASHPEGPWKAQSTPMIKGTSDEPIVSNQAIDPAAFQDPKTGKWYIYWGNGVPVVAELNDDMVSLKSGTWKRITGLQDFREGLFVNYRKGTYHLTYSIDDTGSVNYRVGYATADNPLGPWTYRGVILKKDESKGILGTGHNSVINIPGTDEWYIAYHRFHIPDGGGFRRETTIDVLPIKKDTGLFGEVTPTLESVKPRPLP

SEQ ID NO: 141271 - protein, 262 aa, Triticum aestivum
  unsure (1)..(262): unsure at all Xaa locations
  Clone ID: PAT_TA_35689.pep
MSLDIQLTAPNGRTYKQPTGLFINNEWVKSSNGEKITSINPTNEEEITSVYAGSSEDVDKAVRAARRALHNPSWRDLPGTERGKLLSRLATLVEENKEILATIETWDNGKPYTVALNDDVNEVAETLRYYGGFADKVYGQVIETTGDKFGYTIREPIGVCGQIIPWNFPLAMAAWKLGPALACGNAVILKPAEQTPLSILYLANLIVEAGFPPGVVNIINGLGTVAGAALAXNMDVDKIAFTGSTPTARSIMKMASSNLKNI

SEQ ID NO: 141272 - protein, 206 aa, Triticum aestivum
  Clone ID: PAT_TA_35690.pep
MHYTSIFVAAAGASVAAAQDYAPPALDTTTLTSTTTRVITLTQCNPTVTDCPLRTHTSTEVVVTTSTAEPEVPAEPTTSVYVAPTTSIYEPVVNTTSHHEVPTIVNTPTISTTKKAPLPKTTYYPAGNTTVNAGPTAPVSHVTKLPVPSSNGTPEKPGYEAPPTTPEAPSSVPTAGANGLIASSGFLGALWSPPWLLSSSSTLPFG

SEQ ID NO: 141273 - protein, 75 aa, Triticum aestivum
  unsure (1)..(75): unsure at all Xaa locations
  Clone ID: PAT_TA_35691.pep
VAASLFSVREQKRLLMYVLWYLSATEHVLSRSNSCYQTPPCSIINSLCVKKKKKKDTSSSSTIYLIFASFXKKKK

SEQ ID NO: 141274 - protein, 245 aa, Triticum aestivum
  unsure (1)..(245): unsure at all Xaa locations
  Clone ID: PAT_TA_35692.pep
MAPSTFKLNTGQEIPAVGLGTWQSPAGEVEKAVTYALKDGYKLIDCAYCYGNEEEVGAGLKAAFKAGVKREDIFVVTKAWATYNTRVELALDKSLKALGLDYVDLFLVHWPLLLNPDGNDDKFPKKPDGSRDVIRDYNHVDGWKLMEKLPATGKTRAVGVCNYSKKYLEELLPHATIVPAVNQIENHPELPQQEIVDFCKEXGIHIEAYSPLGSTGGPVMSAEPVVKIADKKGVSASTVLLSYHV

SEQ ID NO: 141275 - protein, 146 aa, Triticum aestivum
  Clone ID: PAT_TA_35693.pep
GEDEMNVDTTSDEDADIDDEMTRYQSSDSHVVEKKYTLTKCSAEPETNKTKHSSLSYEEQPVSSAPIRASKTVAVPVNPISVEPPNFGTPKDVHVVEKPDITPMNANVASPAINVKELGHGEVQKDSQRSATSVSSSYSTAHPTED

SEQ ID NO: 141276 - protein, 187 aa, Triticum aestivum
  Clone ID: PAT_TA_35694.pep
AGPAWERHQHKYPQTPKDFASRKPSQDIFIPRITKPVLNPYTARRYSSQRSLNTSPTLLQNPFPKVTPSTSEFMSIENLKTYDPFAEADEDTGETKQTQNYIHIRIQQRNGRKTLTTVQGLPKKFDQKKILKVIKKKFACNGTIVNDSEMGEVIQLQGDQRKDVQDFLCDKKEGLELDAKTIKVHGF

SEQ ID NO: 141277 - protein, 252 aa, Triticum aestivum
  unsure (1)..(252): unsure at all Xaa locations
  Clone ID: PAT_TA_35695.pep
MREVISINVGQAGCQIANSCWELYCLEHGIQPDGYLTEERKAQDPDQGFSTFFSETGNGKHVPRAIYCDLEPNVVDEVRTGAYRNLFHPEMMITGKEDASNNYARGHYTVGKELIDGVLDKIRRVADNCAGLQGFLVFHSFGGGTGSGFGALLMERLSVDYGKKSKLEFCVYPAPQTATSVVEPYNSILTTHTTLEHSDCSFMVDNEAIYDICRRNLGLERPXYENLXRLIAXVVSSITAFLRFDGSLNVDL

SEQ ID NO: 141278 - protein, 279 aa, Triticum aestivum
  Clone ID: PAT_TA_35696.pep
MRSPIAFCLALLGAAQLGDAASAGCGKAPQSSGTKSMQVNGKNRQYILQVPNNYQNNKPHRLVFGYHWRDGNMNNVAQGGFYGLQGLAGDSTIFIAPNGLNAGWANNGGEDITFTDQMLKFAKDNLCIDEKQVFATGWSYGGSMSHSVACSRPNDFAAVAVISGAQLSGCNGGNSPVAYLGIHGAADNVLGINLGRQLRDKWIGTDGCQQKNVNDPGPGAQNHVKTTYTCSRKPVTWIAHGGGHVPDPTGTNGVKFAPGETWSFFNAAVGGGRSTGRRC

SEQ ID NO: 141279 - protein, 252 aa, Triticum aestivum
  unsure (1)..(252): unsure at all Xaa locations
  Clone ID: PAT_TA_35697.pep
MEGLYYNVNNGYVEGIVRGYRNSLLTGAAYNNLTQCETIDDLKLQLGPSYGDFLASLPPNPSTSALAAKTTDKLISEFRYVRAQAVGSLATFMDYVTYGYMIDNVALLITGTLHERDTRELLDRCHPLGWFETMPVLCVATNIEELYNSVLIETPLAQYFKGSLSHQDLDELNIEIVRNTLYKNYLEDFYNFVNTHPEMAGTPTAEVMSEILEFEADXRAINITLNSFGTDLXQQDRNKLYPXFGKLYPEGL

SEQ ID NO: 141280 - protein, 170 aa, Triticum aestivum
  Clone ID: PAT_TA_35698.pep
MESEKASRPASLLGTLRTAVKKVRFLLSFSATRWIINSIAGRRSAPGATAPLRLSFGSRRPGLLDAEDDDDGSPASTTGPSRTVSLGSGGVSRTSSAVAASEYSRSASSGATSSSSGGSSPAGDDDIDRRAELFIANFYKHIQMERQVSLQLRYCRVDSLQERSPPRRVS

SEQ ID NO: 141281 - protein, 173 aa, Triticum aestivum
  unsure (1)..(173): unsure at all Xaa locations
  Clone ID: PAT_TA_35699.pep
MPERNTGGEGAAGARRRRSSSILQVYHEPPETLEQISDQASLPNLNANWTNAKGAWTIHLVLILSAKIIFDAIPGVSQETSWTLTNMSYMFGSYIMFHHVRGVPFDFNSGAFDNLNMXEQIDNGAQYTPTKKFLLSVPIALFLVSTHYTHYDLTYFYINLLAVLGVVIPKLPF

SEQ ID NO: 141282 - protein, 212 aa, Triticum aestivum
  Clone ID: PAT_TA_35700.pep
MSAYSGFTKTSYGAQGGDDSGGFFAGGSQQGSQGGGGKAYQDESLRPVTIKQILDAEEAYAGADFKIDGSPVTQITFIGQVRSVQPQPTNITLKIDDGTGQIEVKKWIDVDKADDSEAGFELDSHIRIWGRLKSFNNKRHVGAHVIRPVSDFNEVNYHMLEATYVHLYFTKGPLGGQGGGANGDDGMFVWVVTMTTPVATPTRTPSSLVAVH

SEQ ID NO: 141283 - protein, 400 aa, Triticum aestivum
  unsure (1)..(400): unsure at all Xaa locations
  Clone ID: PAT_TA_35701.pep
SDRHGLRASWPANLCSLRRGLSPPDQAAVCNLASIALPRFVREKGVPIESHPAKLVGSIGSKNRYFDFDKLAEITSIVTWNLNKIIDINYYPIETARRSNMRHRPIGIGVQGLADTFILLGMPFDSPEAQQLNKDIFETIYYHALKASAEIAAKXEGPYETXMAVQSSKGILQPDMWNVVPSDRWDWPACRGMPPIVACSYSLLVAPMPTASTSQILPRVRCFEPYTSNIYSRRVLSGEFVVVNKHLLHDLTEMGIWSPVLKNNIIYDDGSVQKITEIPDDLKAIYKTVWEIKQKTVVDMAVDRGCYIDXSQSLNIHMDQANSGKLTSLHFHAWSKGLKTGMYYLRTRAAADAIKFTVDTSLLKDKKPANAEEEEDLQAKMAXQVTCSLNNREDCLSCGS

SEQ ID NO: 141284 - protein, 204 aa, Triticum aestivum
  Clone ID: PAT_TA_35702.pep
MRLLTRVLHLFTQAASRSLVLRAMCGLEHREMEGKNAAAVFSDPARAATALRRLDYGSAYQGAAMFCPSSITQASVSSNVWVGAQRDGGLAAKSSANPWKASQSEPDPSGDWTVLSHASGSVWKRGDTPAQVMGSSNRWNALESDAATSSGPTDKRKPPLRTETGSSSSAPRVGAGSSAAPSAGQSVSKLQPDVEVEDWEESCE

SEQ ID NO: 141285 - protein, 60 aa, Triticum aestivum
  Clone ID: PAT_TA_35703.pep
ATRRQIGVLSSNSGIAHFVKIFPGVSHGWTVRYKSEDAAAVKSAEEALADMIDWFNKNLK

SEQ ID NO: 141286 - protein, 245 aa, Triticum aestivum
  unsure (1)..(245): unsure at all Xaa locations
  Clone ID: PAT_TA_35704.pep
MASPQCCANPPTAQPXPSGEGKVVDSFGGIKAYVAGAQESKAAVXLISDVYGFDAPNLRKIADKVASSGYFVVVPDFLHGDPFVPGRRXTGPIAVXWIKEHTPGKAFEEAKPVIAASKGNXGASSVGAAGYCWGAKVVAELAKANEMQAAVXSHPSFITVDDIKEVKCPIAILGAPTDKISPPELVKQFEQVLASSNSGIANFVKIFPGVSHGWTVRYKSEDAAAVKSAEEALVDMVDWFNKNLK

SEQ ID NO: 141287 - protein, 343 aa, Triticum aestivum
  Clone ID: PAT_TA_35705.pep
MASNPKYDNYDFPAQGAEKQDGHAGYLTEDQTAKLEQFRMMLESEGCTDRLDTLTLLRFLRARKFDVEASKAMFLDTEKWRKETKLDETVPVWDYPEKAEINKYYTQFYHKTDKDGRPIYIETLGGIDLNAMYKITTAERMLTNLAVEYERVADPRLPACSRKAGHLLETCCTVMDLKGVSIGKVPQVYSYVKQASVISQNYYPERLGKLYMINAPWGFSTVWSIVKGWLDPVTVSKINILGSGYKGELLKQIPAENLPKAFGGECQCEGGCENSDAGPWHEAEFARPAWWEKKQDANVIENKGSEIEEPAKAPEAAPVAEGADATQTAPAPAPAAARIGGDA

SEQ ID NO: 141288 - protein, 106 aa, Triticum aestivum
  Clone ID: PAT_TA_35706.pep
MAGGDIKKGANLFKTRCAQCHTVEKDGGNKIGPALHGLWGRKTGSVEGYSYTDANKQKGIEWNDDTLFEYLENPKKYIPGTKMAFGGLKKAKDRNDLIAYLKDSTK

SEQ ID NO: 141289 - protein, 164 aa, Triticum aestivum
  Clone ID: PAT_TA_35707.pep
MTNEGRIATLDSTIADRLPAFSKTLFDGKAAKDLSFEAIAKHLGRSEVAVAALFYGQATASSEDVEKLSEILDLPKEALAAQLTGFPNRGQAGPMPPTEPLIYRLYEIVQNYGYAYKAILNEKFGDGIMSAICFSTTVEKEVDEAGSPWVVITLKGKWLPFSRF

SEQ ID NO: 141290 - protein, 260 aa, Triticum aestivum
  unsure (1)..(260): unsure at all Xaa locations
  Clone ID: PAT_TA_35708.pep
MRHFVSPLLALGCLIGNAAAAWPNGPFKTSGRWIVNANNEKVKLAGANWPGHGEVMVPEGLQYQSIKGVLSDIKGIGMNAIRLTFATEMVDQIYANGGKDIDIKTAFEEGLGKENGTIVLAKVLKNNPTFTAKTTRLEVYDAIAAECLRQQIYINLDNHISEGKWCCGGXDGNTWWGDTQFDTAKWVRGGAYMAAHAKKWPAKVSQSLRNEPREPTNNNKLRDASYNWXTFTVHAQGADAVHQAXPNAIIXISALQYDTY

SEQ ID NO: 141291 - protein, 261 aa, Triticum aestivum
  Clone ID: PAT_TA_35709.pep
MAGLYEKPSETYAKKRPRYPKEWFSMLASLTAGHHRAWDAGCGSGQASLSIAEHYDSVVATDVSEGQLRHAIAHPKVRYLHTPEDLAEDDLVALVGGEGSLDLVIVATAIHWFDVPLFYAVVNRVLRKPGGVLAVWGYNYDIHPFGDKLHGALYPAMRPYMDPRTRLAMERYRDLPFPFEPVGVGREGEPADVDMEAEMTLEDLAGFVMTGSVATTAREKGVDLEALVKGVMKEVEEGWGDRPTVPRKLVFKAFMLAGRPR

SEQ ID NO: 141292 - protein, 289 aa, Triticum aestivum
  Clone ID: PAT_TA_35710.pep
SREIDHTAARRQSRRGQHSLSARKERRDRRGDHRRAEMLAVFDQTVAKCPEGLRSPPAAGGAAAGGGGAAALMKGFAAANDAAVTVSLGAAGALAYSSANKNPLVPRMFGSVNDIFCLFQGHVENIGNLKQHYGLSKTANEVTILIEAYRTLRDRGPLPASQVVRDLSGRFAFILYDTVSKSTFVAADADGSIPFFWGVDSEDHLVFSDDNELLKAGCGNSFAPFPKGCFYTTSGGLQSFEHPLNELKAVPRVDSQGQMCGSTFKVDSEAKKDSGIPRVGSAADWSNHY

SEQ ID NO: 141293 - protein, 139 aa, Triticum aestivum
  Clone ID: PAT_TA_35711.pep
MAIAGSGRGKAKPAASAKSVSRSSKAGLQFPVGRVARYLKVGKYAQRVGAGAPVYLAAVLEYLAAETLELAGNAARDNKKNRIVPRHIQLAVRNDEELSRLLGSVTIAAGGVLPSIHTTLLPKKAGKGKGDIGSASQEF

SEQ ID NO: 141294 - protein, 224 aa, Triticum aestivum
  unsure (1)..(224): unsure at all Xaa locations
  Clone ID: PAT_TA_35712.pep
RPPAAHRSRPSLRRQPHLRVHPPSRTRRWLLPAVGGARRSPPAAPSPCHGRLGPAGPRRSARKRHADRAEPAHGKRGGRHAHRAEMLAVFDQTVAQGPEGPPRPPXAGAAAGGGGAAALMTGFAAANDAAVTVSAPSAGAPAAASANTNPHIPPTFPSGMVGFCEFQRQVQGHVQPEAKPGVSRKTADEVTIRIEPXGAFRDLRPIPASQVLKRPQWDSSHSSS

SEQ ID NO: 141295 - protein, 274 aa, Triticum aestivum
  Clone ID: PAT_TA_35713.pep
FHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPALQGRFPMRGLYQALAVAAMCLQEQAATRPFIGDVVTALSYLASQAYDPNAPTQHSRSNASTPRARDRGSVNGDQRRIRSPNHHSPDMRRKEVTTTSKYEAEVSRNSSGGGSGRQSGLDDRDVTGSQQGSPARAGKRRETSRTSERQRAIAEAKTWGENSRERKWPNARGSFDSTNE

SEQ ID NO: 141296 - protein, 214 aa, Triticum aestivum
  Clone ID: PAT_TA_35714.pep
MKAVTSLVLHCAVVTVAAAALPDGSQVVADPLEGYEIVPMQWKGVIKEGEAPVSLNGTIESVISQIKELNPEFELVEEDTAESSGLEARNPSNIICNVGGSGYVDVKAAQREQRYLRSLGTSVCGVDGGPGKCARVSCSYGDAIWLCNDNSHYIQPRCSYLADYVDRIIASCQSKTSSPPCTVRPCAPSWTAWFVRGQQFDTDRYNVIGGRKHC

SEQ ID NO: 141297 - protein, 322 aa, Triticum aestivum
  Clone ID: PAT_TA_35715.pep
MFARSCLRSTRTLNGLRKGPSAIAKRAASSSANAAGDATATRLNLAAAASTTLALGSMAWYYHLYGPVAFAMTPAEEGLHPTKYPWVHNQWFKTFDHQALRRGFQVYQEVCQSCHSLSRVPYRTLVGSILTVDEAKALAEENEYPGEPDEQGEIQMRPGKLADYMLPPYKNEEAARFANNGALPPDLSLIIKARHGGCDYIFSLLTGYPEEPPAGVQVAPGMNFNPYFPGTGIAMARVLYEGLVEYEDGTPATTSQMAKDVVEFLNWAAEPEMDDRKRMGMKVLVVSASLWAVSVWVKRYKWAWLKSRKIAYDPPKEVKVRR

SEQ ID NO: 141298 - protein, 105 aa, Triticum aestivum
  Clone ID: PAT_TA_35716.pep
MRPRIVPLIATLARSPHPKPTGPSPSRSIRPCCAASPPASTSAAPTATSSRSTSAPRPPPSPPPNPRPSRPRAPPTPSPTRSSASSTRRPTPRPPRPSAGCSTSR

SEQ ID NO: 141299 - protein, 290 aa, Triticum aestivum
  Clone ID: PAT_TA_35717.pep
PAGLGNAGRAMEVDNPFSVFPREVRDMMYSYSIPEIPATDATVSKTAYNTKNAPLLFLNEAISKDVQHVLYQDHAIVIPVLNPSEYELKETKFAPIVSQCSRLMKQRSNRVIIGTSRFIAASYSPLLHINIHDGTSAEDWIQKFCGFDNPEPLAKKLIDELISLRPELPNVKVIEFKFFEGFNVLVALRWREYFLELKEAWPEIEIEIDFIPAFLGWEHVEAFFQDAQDSMEEDGVFKPDRLRDLEERSMDCMTGLVFYRSRLHSVFTRGKLASIFICTSLSRHNSIQNL

SEQ ID NO: 141300 - protein, 172 aa, Triticum aestivum
  unsure (1)..(172): unsure at all Xaa locations
  Clone ID: PAT_TA_35718.pep
MSAIQLSFSLRVSAGVKTVHLLGSWDGYVGQLPLSKDKSSSKSGSWKGTFRFQNSTLEAGQRYWYYYIIDGYHVAHNPSVTSTVEPTTGRELNVLDVPTDSHKSSSRSSSXKSSSKSSSSSSKSSSKSSSSSKSSSSKSSSSSKSSSHSSDKESRFSHPKSKSQLNPKGRPY

SEQ ID NO: 141301 - protein, 248 aa, Triticum aestivum
  Clone ID: PAT_TA_35719.pep
MILFKATVLATGIISLALPTYGQAPKVNDLADAFELSDVSLTDSRWMDNQGRTVNYLLSIDPDRLLYVFRKNHGLDTKGATKNGGWDAPDFPFRSHVQGHSLTAWSNCYATLGNKECGSRASYFVKELAKCQANNAKAGFTSGYLSGFPESEIAKVENRTLNNGNVPYYAIHKTLAGLLDVYRRVGDNDAKAVMLSLAGWVDTRTGKLSYAQMQQMMQTEFGGMKRVLADIAYYTQDNKWLKGRQRFD

SEQ ID NO: 141302 - protein, 164 aa, Triticum aestivum
  Clone ID: PAT_TA_35720.pep
MATSQLRAIGVLARSARVSQRAFTTSARQFEAAVSTKTNEASPAAADENKPAVINQAPNRVGVWSRSQKPRAQAMTGPRFEQTDFDLQPQPKAAIEMIHKQPVTWTHDRIVACNGGGGPEGHPRVFINTDKPEIAVCGYCGLPFAHEHHRTHLESLPETSYPLS

SEQ ID NO: 141303 - protein, 260 aa, Triticum aestivum
  Clone ID: PAT_TA_35721.pep
MAFGTLFTRENNCRSTAIKAVAKANDIELNIVEAEKGNATAEHLKANGLGKIPAFVGEDGFALSECIAIAIYITSQNEKTTLLGKTKQDYASILKWMSFFNSEVLPNLIAWFSPLKGDSPYNKKTVDEAIKATEKNFAVVEEYLLHNTFLVSERITLADLFAAAIATRGFQYFFDKHWRAEHPAVTRWFDTVRSQPIFSEVAEKVELLETVTLTNPPKKADQPKKEAKKEAKKEPRRRPLPLPLPLRPAEAPAADEPAAP

SEQ ID NO: 141304 - protein, 225 aa, Triticum aestivum
  Clone ID: PAT_TA_35722.pep
MDAAGESAVTCVDFWANGFGMRARIALRELGVAFEYVEEDLRVGVRSDLVRRMNPVHRSVPILIHRGRPVCGSLNILEYIDEVWSAPGETRRLLPGDPAGRADARFWADFIDHKVFPTQTRFLKSKGEEKKAAKEELLEQLKRLEEVLGDKVFFSGEEFGFLDIVLIPFSSMFRGYEQHGGFDLEVECPNLMRWVKRCKERESVGAVLPDETKMYQLHKEWYGIE

SEQ ID NO: 141305 - protein, 248 aa, Triticum aestivum
  Clone ID: PAT_TA_35723.pep
MARILITGSTDGFGFEAARQLIERKHQVYLHARNQERADEVKTKLPGAAGVLIADLTTVAETRKLADEANAIGTFDAVILNAGLLYGPFRKSDLGVPASVFVNLVSPYIFAALLNPPKRLIFIASVLHHEADTSLKDIFWLERGEKEWKDFPAYCDAKFHVVLLVNAIARRFKDTSVIAVHPGYVPTKLAGQDAPGKMEDGIETYVMLAEGDYDTSLTGVYFDPKKERAQPHALTADLDKQEAVVKAL

SEQ ID NO: 141306 - protein, 268 aa, Triticum aestivum
  unsure (1)..(268): unsure at all Xaa locations
  Clone ID: PAT_TA_35724.pep
MRISTISFGLLVAGSATATIEKRAPLITRDESGIEGKYIVMMKPTSGNEISTARVKSAAKAVDVKPDMVFDNLGGFSASLTARDVEDLRNNPNVAYIEQDSVARISATQKQPPWGLARVSSKTTGATRYTYDDSAGKGTCAYVLDTGIDTTHPDFEGRAEFIATYVDDIWVDDHGHGTHCAGTIGSKTYGVAKKTKLYGIKLFNSTGEGVASSIIAGMDLVLRDAPKRDCXQGSCVSMSFGEIPSKGINDAAQALVTAGFFAAAAAGN

SEQ ID NO: 141307 - protein, 180 aa, Triticum aestivum
  Clone ID: PAT_TA_35725.pep
MRFSTVTACLTACLAPAAALSVLNGKAPELTISDDLKIPGDSPLEFCPGDHAADLIKIDRVDLAPNPPKAGQELLIKAKGSVKQKIEEGAYVLLTVKYGLIRLISTKADLCEQIGNVDLKCPVEKGEVEVVKTVDLPAEIPSGKYTVLADVFTADDVQITCLTATVAFSRSSKGFFGSDL

SEQ ID NO: 141308 - protein, 246 aa, Triticum aestivum
  Clone ID: PAT_TA_35726.pep
MSFFKKIAKEFENLGIGDKKEEQQQQQPPQQQPQDGNRAYGDNGYASPPPQQQYGGAPGYGAPPQQYGSPAPQGYGAPPPQQYGSPAPQQQYGAPPPQPAYQPPSDRPPLPQGWTAQFDQNSQRWYYVEQATGRTQWEAPQAQQAPPPPPPDSRPPYESQPSDGSRGYGGAPGGYGSPAPGGYGSPAPGGYGSPAPGGYGAPSPYGAPGGYGSPAPGGYGAPSPYGAPQGQYGAPQGQYGAPRVST

SEQ ID NO: 141309 - protein, 157 aa, Triticum aestivum
  unsure (1)..(157): unsure at all Xaa locations
  Clone ID: PAT_TA_35727.pep
MKAALFLSALASTAVGVVAEELKIDVTLPVICERKTXKGDGVHMHYRGTLKDSGKQFHGNYHRGTPLSFQGGGGQGIKGWEEGPPDMGIGEKRSLNIXPKSGNGXRSNGPIPRRFTLIFQNEVRRIEGXPKPKRIRTKVAKGAKLAAKASTKVTKVV

SEQ ID NO: 141310 - protein, 236 aa, Triticum aestivum
  unsure (1)..(236): unsure at all Xaa locations
  Clone ID: PAT_TA_35728.pep
MAGGGEGGELQLLGAWLSPWVIRVKVALQMKGLSYEYIEENLQHKSDLLLSSNPVHKKVPVLIHAGRPVCESLVVLEYVDEAWAGAGTPLLPADPYDRAVARFWATYVNDTFFPSWRPLFRATTAEQRAEAFENVLPQVETLERALTECSKGKAFFGGDAVGIVDLALGSFVVWIRAVDELGGTNLLDEARVPGLAAWAERFMAVDAVXEVMPEAGRIMEHYKGFLAKLAAPAGSS

SEQ ID NO: 141311 - protein, 236 aa, Triticum aestivum
  Clone ID: PAT_TA_35729.pep
PAGLRVGAPQVQQPNFGSATPVQPGFGSRPQQPTHVAHETQHPGFGTSRPWQTGYGAHQAQQPGHGAQQAQQPGYGAHQAQQPGYGAHQAQQPGYGAHQAQQPGYGAHQAQQAGYGAHQAQQPGYGAQQAQQPRYGANQAQQPGYGAHQAQQPGYGAHQAQQPRYGAHQAQQPRYGVHQAQQPGYGTHQVQQPGYGAPQASRPSFGAPEAPRSSLGSAQSLPHYGRIGNEHDQLGS

SEQ ID NO: 141312 - protein, 256 aa, Triticum aestivum
  unsure (1)..(256): unsure at all Xaa locations
  Clone ID: PAT_TA_35730.pep
MFKSGISSFARAARPAVLPRRALRPSALRLPISSRWASTGVGAGKIHQVIGAVVDVKFDGAKLPAILNSLECQNNGQKLVLEVSQHLGESVVRCIAMDGTEGLVRGAAVQDTGAPITIPVGPETLGRIMNVTGDPIDERGPIKTDKRLPIHAEAPEFVEQSTTAEVLVTGIKVVDLLAPYARGGKIGLFGGAGVGKTVFIQELINNIAKAHGGYSVFTGVGERTREGNDLYHEMQETSVIQLDGESKXALVFGQMN

SEQ ID NO: 141313 - protein, 280 aa, Triticum aestivum
  unsure (1)..(280): unsure at all Xaa locations
  Clone ID: PAT_TA_35731.pep
MVASSNTGLEREDHQRDADFNKAMHGSSAQARGGVAAMFRKGGAAKQAAVDEYFKHWDNKPAENETPEERAARQAEYATLTRHYYNLATDLYEYGWGQSFHFCRFSQGEPFYQAIARHEHYLAHQIGIKDGMKVLDVGCGVGGPAREIAKFTGAHITGLNNNNYQIERATHYAFKEGLSNQLEFVKGDFMQMSFPDNSFDAAYAIEATVHAPTLKGIYSEIFRVLKPGGXFGVYEWLMTDEYDNDNLRHXXDRLGIEXGDGISNMCXVSEGIAAIHDSGF

SEQ ID NO: 141314 - protein, 193 aa, Triticum aestivum
  Clone ID: PAT_TA_35732.pep
MLLWMIQISSMLEVLEQHQDSVDNLQSVVSEEQSGREEISVVSGDLECLVEAGHDGNDRGLTGTSKDEFESSGHVAPDNSSAGLFDENENGPNVSSVNHEGPVKEDDTPVLEDESGTNSGPQEKEIAPLSNLSSDIISTTVADTSNKSMDKPDCSGGVPFDGSPAGVLEGNDSTISSINHVDAVDKGANSSSE

SEQ ID NO: 141315 - protein, 256 aa, Triticum aestivum
  Clone ID: PAT_TA_35733.pep
MALTVELSTPVTGTYQQPIGLFIDGKWVEGVDKGKFEVINPSTEEVITSVCEGTEKDIDLAVAAARKAFDGEWKNTAPQTRGNLLLKLADLAEKNLDLLAAVESLDNGKSITNARGDVGAVVGCLRYYGGWADKIEGKTIDIAPDMFHYTRSEPIGVCGQIIPWNFPLLMLAWKIGPALATGNTVVMKTAEQTPLSALVFTQFIEQAGFPAGVFNLVSGYGKTAGAALSSHMDVDKIAFTGSTVIGRQIMKAAASS

SEQ ID NO: 141316 - protein, 240 aa, Triticum aestivum
  Clone ID: PAT_TA_35734.pep
RPGAGLPHRDTFIMGIFRIVRKTIVPGLLGTSTAAAYLASQNPVISPLPANDPIWSSRLFRRANPNGNPATQDVVIKRIPLDKIRPELLQKNGDLALEFCRGIWSGWGYDIQRRYLSFKWRGPETEQQLWDPEQLSTSTYDRGTVITDHFEVVEKTATSVTVRCGDSPRNQPLRPSDGLFQISATIDKAHEEVELRLKSVLFSSEGKVAGNKGPMPGWMTELHQWYARIWAETGSWRLLK

SEQ ID NO: 141317 - protein, 111 aa, Triticum aestivum
  Clone ID: PAT_TA_35735.pep
HRPWWRPGSASASGSGPPPAPRPGRPASPASPRTSPPPAGAPSPPATPKTTGRAGSAPLLRQQPWVCRVQEMEWRDGSGRALGDLGSGRDVGSVDRVVELEWLETLSSPAG

SEQ ID NO: 141318 - protein, 282 aa, Triticum aestivum
  Clone ID: PAT_TA_35736.pep
MASSSSSPLLLLLLLPLLLAMARPCSAVDAIGTYCAKNGTSAETQASIDQVLAALVPRASAAYYATATAGRSSSAVWGLAQCRGDVPRQDCSLCLAAAAKEVASSCRGSSDGRVFYDYCLLRYSTSNFIGLADTGYTLILLNTQNATGVDLAAFDRAQGKLMSRVASEAGGAANKGLATDTTRLGNDGGGAKTTIYGLGWCTRDITAADCGLCVAQAVAELPNYCRYRRGCRVIYSSCMARYEVYPFFFPPDSAGDSAGRRSAQCDKIVLNYPVMGGVQLVK

SEQ ID NO: 141319 - protein, 126 aa, Triticum aestivum
  Clone ID: PAT_TA_35737.pep
CGAQAAAPIHSQSPEQSSLRAHVANPPLPMARTKQTARKSTGGKAARKQLATKAARKSAPATGGVKKPHRFRPGTVALREIRKYQKSTELLIRKLPFQRLVREIAQDFKTDLRFQSSAVFESIAQN

SEQ ID NO: 141320 - protein, 218 aa, Triticum aestivum
  unsure (1)..(218): unsure at all Xaa locations
  Clone ID: PAT_TA_35738.pep
MAPVKVLGSAAFTNVARVLVCLEEVGAEYEIVDVDFRSKEHKGPDHLARNPFGQVPAFQDGDLTLFQSRAISRYVLRKHMTDEVNLLREGDPKESALVDVWLDVEXLSFDPAMRSVFYQHRVAPALGGAPDEXVIGESVEKLRKVLDVYEARLSKHRYLAGDFLSLVDHSRLPETHYFMGSLYALWFDAYPRPSAWLAEHADRFDVKKVIALMAKKGL

SEQ ID NO: 141321 - protein, 246 aa, Triticum aestivum
  unsure (1)..(246): unsure at all Xaa locations
  Clone ID: PAT_TA_35739.pep
MALTSHLLVVLLGIAVPLLFFSRAEGGQVGVCYGRMATNLPDPTSVVQLLKKNSITMVRIYDTDPTVLRSLANTGIKVTVELTNEELPSAATDQNFADQWVQNNVKAYYPATLINGVTIGNEVFKEASQLNSQLVPAMTKVQAALARLGLADPVKVTTPIAFHALNMSXPPSEGAFRDXIAFLVMTPRRLFLXKTGSLSVKIFPYLAFTENPGMSXNYLXFRXNNXVPDTVSGQTYFTLFXXQARQ

SEQ ID NO: 141322 - protein, 281 aa, Triticum aestivum
  unsure (1)..(281): unsure at all Xaa locations
  Clone ID: PAT_TA_35740.pep
ATPQIARHFSTSSSPTGPVSKQKPDMASNYTVRKVAAPNTLEHRVYVEKDGQPVSPFHDIPLYANQEQTILNMVVEIPRWTNAKLEISKEELLNPIKQDIKKGKLRYVRNCFPHKGYLWNYGAFPQTWEDPNTVHPETKAKGDNDPLDVCEIGELVGYPGQIKQVKVLGVMALLDEEETDWKVIVIDVNDPLASKLNDVEDVERHLPGLLRATNEWFRIYKIPDGKPENQFAFTGECKNKDYALDVVRECAEAWERLVTGKTPXGGVSTTNVTVQHSPTRV

SEQ ID NO: 141323 - protein, 96 aa, Triticum aestivum
  Clone ID: PAT_TA_35741.pep
MTGRGGGGGRRVLVPPINFIFKLLQSHARVSVWLYEQLSIRIEGKIRGFDEFMNLVIDDAVEVKQITKTNDKESRRPLGQILLKGDNVSLIQSAAS

SEQ ID NO: 141324 - protein, 177 aa, Triticum aestivum
  Clone ID: PAT_TA_35742.pep
RPVRMNPDARVTEDKKSSELKYGADFMKQSEKVVSSTKAKETEQVMEALALKVANKNSQVGVDVEDISAVNIDNETFVERNFTANEISYCRQAPSPQSSFAGRWSAKEAVFKSLGVASQGAGAAMKDIEIVKGENGAPTVSLHGDAAAAAQKAGVKDITLSISHSDSQAIAVAVANF

SEQ ID NO: 141325 - protein, 161 aa, Triticum aestivum
  Clone ID: PAT_TA_35743.pep
LNLKQQHLVLSIPYISSITALANRLALTTPSPSCKMTRSHKANDRDHKGIAEGTMLPTEAVPRFFGKSGFADVDPKKVKKDGSGRGNWGTVNDDIAGEQFTFTNTRRRSNSSSFSHVTDFKTKFEVNEPEPVFEESLHGPEEEDHEDLTKTDSSESGRSSS

SEQ ID NO: 141326 - protein, 290 aa, Triticum aestivum
  unsure (1)..(290): unsure at all Xaa locations
  Clone ID: PAT_TA_35744.pep
AGRAPPTGLDSNPPVPSASFQDALLSSIGVVALATLTTAAPERKTLATREVGRLPALGWNGWNQGQCNAASEKVALATAKTFIDLGLKDAGYQYINIDDCWSTRQRDSKGNLVPDPSKWPRGIKPVVDEIHKMGLKFGLYGDRGVKTCAGFPGSQGHEKQDADLLASWGVDYWKYDNCYTPCYNGNQADIQTCPIGKGPSSRPGYELMRDMLRNTGKDILYSLCNWGWDEVWTWGASVGHMWRMSVDNWGKWDDVVRIANQAAPILSXTQPGRYNDLDMMILANGALTPA

SEQ ID NO: 141327 - protein, 239 aa, Triticum aestivum
  unsure (1)..(239): unsure at all Xaa locations
  Clone ID: PAT_TA_35745.pep
MPIHQGLLPREGFCADVVVRLIRQTALNPALILPLVLLARLTKKGQDLSILHPSAAQNLKTLLYLGLARWASGWLSEKTRNNWSDDKYDWEREIVLVTGGAGGIGGRVVNLFSEMGVKVVVLDVQPMSFTTSANVHYYQCDLRAPENVEAVAEKIRAEVGHPTVVINIAGVARGKTILESQPSDIRFTFDVNAFAPFWTAKTFLPNMVEXNHGMIVTLTSYASXAXIPXLVDYGASQAA

SEQ ID NO: 141328 - protein, 152 aa, Triticum aestivum
  Clone ID: PAT_TA_35746.pep
MDDWDTATKIGSRARGPGNAQRETVVRGKAALNAAQRAGGLTTEKKYSSANAGSAPEGQRMTKVDRSDDIIKPNTIGKTVGDVIAKTRQQIEPKMTQKDLATRCNTTQAVVAEFERGSAAPDQKVLGAMERVLNVKLRGTDIGAPKFPNKKK

SEQ ID NO: 141329 - protein, 247 aa, Triticum aestivum
  unsure (1)..(247): unsure at all Xaa locations
  Clone ID: PAT_TA_35747.pep
MPPKKWDEEESEDSSSSAAPAVGAAANAARRKFDDEEDEGDVLDSWDADDSEAEREKERKATEAKQKAAAAAAAAKKPKGLRIAQHQAERAQQKAEAEESDEYEETEGEKRERLRRTEQEADLAHAADMFGDIGISANRSKARPATVVVDANDPTKTVDISKLPLFQPKTKLQFETLRTSIAPLISANAKSAHYSLFLQDFTKALAKDMNSEQIKKLASSMTALGNEKMREEKAADXGGKKVKAAKT

SEQ ID NO: 141330 - protein, 158 aa, Triticum aestivum
  Clone ID: PAT_TA_35748.pep
AGQPPEVAMDGSYTLMVRSFSQLCAALRAEGDGIYSRHFAIGGSRWYLKFCPKYHGRSFLCLGRGRMAKGEMPMTVEFSFDLKGVVNHQSQKMTHTFDRDNDDFFYDLEQIRRTSPMQDDSLLVRCCLTVVMPEETPIAVPVCSSESVLTPLLSAMHG

SEQ ID NO: 141331 - protein, 246 aa, Triticum aestivum
  unsure (1)..(246): unsure at all Xaa locations
  Clone ID: PAT_TA_35749.pep
MQLNTMSHLPHEPEFEQAYGELASALENSSLFNEHPEYRTALAVAAIPERVIQFRIVWEDDKGNLQVNRGYRVQFNSALGPYKGGLRFHPSVNLSILKFLGFEQIFKNALTGLSMGGGKGGADFDPKGKSDAEIRRFCQSFMTELSKHIGAETDVPAGDIGVGGREIGYLFGAYRKLRNRXWEGVLTGKGLFWGGSLIRPEATXGYGLVYYVDYMLKHANRGSFEGKRVALSGSGHVAQYAALRSS

SEQ ID NO: 141332 - protein, 50 aa, Triticum aestivum
  Clone ID: PAT_TA_35750.pep
IKLEPLERSDFFFFHFFFFFTFFFFFFFFFFFFFFFFFFFFFFFFLTNIL

SEQ ID NO: 141333 - protein, 275 aa, Triticum aestivum
  Clone ID: PAT_TA_35751.pep
DAWGGSSGCNGGLMDDAFEFIIKNGGIDTEDDYPYKAVDGRCDVLRKNAKVVSIDGFEDVPENDEKSLQKAVAHQPVSVAIEAGGREFQLFHPGVFSGRCGTQLDHGVVAVGYGTENGKDYWIVRNSWGPNWGEAGYLRMERNINVTSGKCGIAMMSSYPTKKGANPPKPAPTPPSPPTPPPPVAPDHVCDENFSCPAGSTCCCSFGFRNLCLVWGCCPAEGATCCKDHSSCCPPDYPVCNIRAGTCSAVTTSAFLVYYCCCSIAIIISTSVFCL

SEQ ID NO: 141334 - protein, 201 aa, Triticum aestivum
  Clone ID: PAT_TA_35752.pep
PASPRPVSSAIEAGGREFQLYHSGVFSGRCGTQLDHGVVAVGYGTENGKDYWIVRNSWGPNWGEAGYLRMERNINVTSGKCGIAMMSSYPTKKGANPPKPAPTPPSPPTPPPPVAPDHVCDENFSCPAGSTCCCSFGFRKNLCLVWGCCPAEGATCCKDHSSCCPPDYPVCNIRAGTCSATKNSPLSVKALKRTLAMRNTA

SEQ ID NO: 141335 - protein, 190 aa, Triticum aestivum
  Clone ID: PAT_TA_35753.pep
MQFKNIILTPLVAAGIASAAPNPDIKIFQAVALRSASPIHHTNLQASNNGFSLKLKDQGASCDRGEKVDSATFALNTKTKEMLLYATSFPRQSAWTDRSGMGQGMMGYRTGAQPLCTRCEDNKWSISEDNFLKYDDRDNFIACPQTDGSYTVFTSAGVNNPAGNKDCVSVTFAVSEVSKPVGCLYSQQGQ

SEQ ID NO: 141336 - protein, 161 aa, Triticum aestivum
  unsure (1)..(161): unsure at all Xaa locations
  Clone ID: PAT_TA_35754.pep
MVSELCPVYSPFFGAMGCTCAIVFTCLGASYGTAKSGVGIAAMGVLRPDLIVKNIVPVIMAGIIGIYGLVVSVLISDGLKQDLPLFTSFIQFGAGLSVGXAGLAAGFAIGIVGDAGVRGTAQQPRLFVGMILILIFAEVLGLYGLIVALLMNSKATVDAVC

SEQ ID NO: 141337 - protein, 148 aa, Triticum aestivum
  unsure (1)..(148): unsure at all Xaa locations
  Clone ID: PAT_TA_35755.pep
MSAQVISNSGHEDMIHDAVLDYYGRKLATCSGDKTIKIFEIEGETQRLVETLKGHEGAVWSVACVHPKYGNILASAGYDGKVFIWNEHGGQSNARQRIYDFPLHKASVNIRLXSPHDDVCLLACASSDGNVRVLELKDNSIDHSTVAA

SEQ ID NO: 141338 - protein, 126 aa, Triticum aestivum
  Clone ID: PAT_TA_35756.pep
MSLKNDKFPASAAFDAIQEAINASDADRKDAIKQGNGVYAFTLKNASGDVASWHIDLKETGKVATGTGEKPDVTLVLSEENFGKLVAGKANAQRLFMGGKLKIKGNVMKATKLDPVLKKAQTKAKL

SEQ ID NO: 141339 - protein, 157 aa, Triticum aestivum
  Clone ID: PAT_TA_35757.pep
RPRSARERALRAVRQSPGYNAKTKEQPPACSLRRAPELAIPIRCASPDPSSHCAPILTKPSPQSPPQRVKSKPQRLPTTHKPVHPPASNSRRRQTQQAGGRRRPGFSSRRRCRSQRRSFVWSRRCRIPSCDGLIPLGVSFATDMFAQEAAATSVAGT

SEQ ID NO: 141340 - protein, 59 aa, Triticum aestivum
  unsure (1)..(59): unsure at all Xaa locations
  Clone ID: PAT_TA_35758.pep
KKYDNYPEVVCAKIKVKADGDXEMCRDYMDEKEVLQEEINNLKSQLHYMVSSSASLGRL

SEQ ID NO: 141341 - protein, 222 aa, Triticum aestivum
  Clone ID: PAT_TA_35759.pep
MADITDQHDQTSPTELDEQNVGNGNATESRGIKRQRPSAGDDDDDDDEKGSRERRKIEIKFISDKSRRHITFSKRKAGIMKKAYELSVLTGTQVLLLVVSETGLVYTFTTPKLQPLVTKSEGKNLIQACLNAPEPTPGNENGVDGGDQVESPEEPPNQHLPPQGNRPGMPQNPHMPPNNYMPNMPMDPQQALAYQSYVQRNQAYGSGIPPQPGMPANSHHQS

SEQ ID NO: 141342 - protein, 243 aa, Triticum aestivum
  Clone ID: PAT_TA_35760.pep
MSSSPPAPTVADAAAAGAPASQLAISNGVLLAAVIFLFMVVVFVFLLYLYAKRFLGANPMLNGAGATSSRFIFVGDPPFPRRGLPASVLRTLPVAVYGGGASPKTPGGSGRRKNGEALECAVCLSEVADGEKVRTLPKCGHRFHVDCIDMWFHSHDTCPLCRAPVGADAEPAAEGLPRVPREDHATPEFPMFPTNVLFWGTHDDVANGGLGGMPPAPAPGPTIAAASPVPRPRAQEGDLVIDI

SEQ ID NO: 141343 - protein, 133 aa, Triticum aestivum
  Clone ID: PAT_TA_35761.pep
MAAPSAVVDIKSKAQFDELVKNTPYVALQAHASWCGPCKAISPIFKKQADEHTSEKFAFAKFDTDDVPDLAFELGIRSIPAFFFFENGDKDSDLMGAVPPKLTKAISGYAEKAKGGAEEKPAEDNTLKTDEAF

SEQ ID NO: 141344 - protein, 163 aa, Triticum aestivum
  Clone ID: PAT_TA_35762.pep
AGRAGCSSALTDYYKRGQYIPGLKVNGMGVLAVKAAVKYGKEYTAADKGPLVLEYVTYRYGGHSMSDPGTTYRTREEIQRMRSTNDPIAGLKQKILDWEITTEEELKKIDKEARAHVNEEVAAAEAMAAPEAKPEILFEDIYVRGSEPEYIRGRIPEENHYFQ

SEQ ID NO: 141345 - protein, 131 aa, Triticum aestivum
  Clone ID: PAT_TA_35763.pep
FKLQGLAIHGVDADFLPYDDDGDFDEAIDLDDDDDEPNPDEFQSHDALSGWSSRTKGVARYLKTLFDEESGRGRKNVVIDHLVNGKSRKEASRMFFETLVLSTKDYIQVEQPIPFGLINVKPVSKLLKTDF

SEQ ID NO: 141346 - protein, 117 aa, Triticum aestivum
  unsure (1)..(117): unsure at all Xaa locations
  Clone ID: PAT_TA_35764.pep
MRREGRQRGWVRVYDRALVDPEGKRRAVHVVDGPVVANGGYIRASRKPTNQSNRGTGXRCRRARAGARSSAAGGASRGEIGXKGSRKFKHDEIKTYYLDAADVVDEQLDSLCCDFDS

SEQ ID NO: 141347 - protein, 253 aa, Triticum aestivum
  Clone ID: PAT_TA_35765.pep
MSALGAAYGVCHCRAPGEPPGVRPGLWLSQVIAVKRKGNIQCFLTVLSGFSCHNIWGRSGFKKKEGLGSNGSKAEATISHGPTVPDLSIQLYAERIFKYAECSPSCFVLALVYMERYLQQPNVYMTPFSVHRLLITSVVVAAKFTDDAFFNNAFYARVGGIRTIEMNRLELDLLFNLDFRLKVNLETFGSYCLQLEKHAPVSPERLPVQVHRVNGSKDLSYSNSSADEFCQSKLVSYSSQASPRMQLTNLFMA

SEQ ID NO: 141348 - protein, 87 aa, Triticum aestivum
  Clone ID: PAT_TA_35766.pep
GHRRGLEQQHRYHHHHWKGQGWGCLEQQHRLESQGQGCFEQQERPRAESQLVVSSPLLPIPKLALFTASGIRSSWLDEAQVPFLPVA

SEQ ID NO: 141349 - protein, 111 aa, Triticum aestivum
  Clone ID: PAT_TA_35767.pep
VDYLRGQIGTYFAEKLLTIVSDILLHFKGKGKSESVGPSNSELDAHLHKGDAALEFIKHICAVLALDQNVQHDILRMRKNLLKLVRVKEFAREAKSQKPCSSFIARRGICS

SEQ ID NO: 141350 - protein, 185 aa, Triticum aestivum
  Clone ID: PAT_TA_35768.pep
MVRYAATEIQPAKSARARGAYLRVSFKNTRETAQAINGWKLQRAVTFLENVKEHKEAVPMRRYAGSTGRTAQGKQFGVSKARWPIKSAEFLLGLLKNAEANADAKGLDTGALVVKHIQVNQAPKQRRRTYRAHGRINPYMSNPCHIELILTEAEEVVQKSDAVAEREHLSSRQRGARLRKAITSA

SEQ ID NO: 141351 - protein, 138 aa, Triticum aestivum
  Clone ID: PAT_TA_35769.pep
KSGRRDDATPRRPAGLRKNGSRGAMAQLALPFRPAMTHLAGGRGQLASHIGHLALLLNQDGLSCGEDSSKWLTGGASLSCFGELACEHVVFWLTSHTGGGAPPLTTSTGLATAAAGRRSVRQSGQLGWERSQASTHSG

SEQ ID NO: 141352 - protein, 90 aa, Triticum aestivum
  Clone ID: PAT_TA_35770.pep
SHPCANRHAIGGLRSVYAVCRLLDKQSNNIGLPYSTASFLGRRECHISNIVNRVYNKISNRHEMCISDNIVNNFCQLCFGSNSLNKARCT

SEQ ID NO: 141353 - protein, 147 aa, Triticum aestivum
  Clone ID: PAT_TA_35771.pep
MDSIDVREDSFPSRSREISGQVNGVATEITSTSFTDKILITISQEGRLSQWIQVPLTGSSSGVVEMNLPSSNKGLLPSTHLTPTTLFGGGGEERETLGQLYAAQIASQICLRSPDDRRILVLGLGLAKTDLEREAFFDLLELVQQVL

SEQ ID NO: 141354 - protein, 183 aa, Triticum aestivum
  Clone ID: PAT_TA_35772.pep
MVCTMAASHLTILSVLALLAVAAAAQAPGAAPAAAPPAPPPPPAAPPSAMTVAPPPSAPPPPPADPPPAPPPAPTPAITPPAPADSPIPCTGAPTPGIASSPTAEPATPGSGACWSPAPPSCWLPPRPAIYALLHDPPPSPFFVSLHLLFHFSPSLPPFRPHIGVPSSSAVITSIDLIYAFHH

SEQ ID NO: 141355 - protein, 110 aa, Triticum aestivum
  Clone ID: PAT_TA_35773.pep
MKLHYIGVLRNESQPAHEIVAEKELSSYSRFTRNNYGEFMTLFAKTVADSILKIQKELDETKIVLHKTIESVLQRGEKIDDLVAKSDGLSAQSKMFYQQAKKQNSYCILM

SEQ ID NO: 141356 - protein, 217 aa, Triticum aestivum
  Clone ID: PAT_TA_35774.pep
MAPKKPEAVIDNVVAFGRVRKNLKMGCVGLPNVGKSSLFNLLTEQSAAAENYPFCTIEPNEARCAVPDARYDFLCDLWKPPSMYPAYLQVTDIAGLIKGASQGEGLGNAFLSHIQAVDGIFHIVRAFDNDQVLHVDDSIDPVRDLNTIQSELCKKDLDILDKQIVAEEMIVKNAGGKYKMLPLFYETTSKIRAVLEEGKPERDGSWTPVEIALHHEK

SEQ ID NO: 141357 - protein, 88 aa, Triticum aestivum
  Clone ID: PAT_TA_35775.pep
MCPLRVILIFLSATVAGFFLLQGLNADTDCFRDGDEGSESPTAAVPLHSKVGSAVKTGFWTTVDMASGRYLWRTLVAPPVNSESDKAR

SEQ ID NO: 141358 - protein, 146 aa, Triticum aestivum
  Clone ID: PAT_TA_35776.pep
QGARRRLPAAPRLLPGVSCPDSSLAGSVPPPTTPTLVSAPPPGRVPPSWAGDPLDFCPGRCGGNVVLFRGLLPALLPLGAGRPPCPRCPLAMASCRLTPADLLFSFEWALPEGTTIHDVNMEEEGRLILHRKEPLVLVPTAYHLDL

SEQ ID NO: 141359 - protein, 241 aa, Triticum aestivum
  Clone ID: PAT_TA_35777.pep
RTNKPRTKIAIRVQIARFRCTSLVGAFFFFFFTLKPSRFPINCMKYVQEVLAFVCTVHPPSSISKGLHMFVPPSNQKHTVTRHDCCYPSAPGPSSSPSRPHKIHMSLHPSSPRGPARRRDQPRAPAAEVHGLAERLIGAGLPPAVVGDGPRRPERGGLGGEPGKPVPRPRPRRPLPLRPHGGHRRCHPHTAHLKILPDRFVSKVLLLCSQLASLSSLCCALLALPFFSFFFFARNFTRPVR

SEQ ID NO: 141360 - protein, 245 aa, Triticum aestivum
  unsure (1)..(245): unsure at all Xaa locations
  Clone ID: PAT_TA_35778.pep
MGASAATGMQMVAARPCIPACQRMLGSRSGVSAFGRALSTRTGFASCVKTASSGSLISVSRKRFAVRAMSQGAVQGLPIDLRGKRAFIAGIADDNGYGWAIAKALAAAGAEILVGTWVPALNIFETSLRRGKFDESRKLPDGSLMEITKVYPLDAVFDSLEDVPEDVKANKRYAGSSKWTVKEVAETVKXXFGSIDILVHSLAXGPEVTKPLLETSRSGYLXAAVSASSYSFISLLXHFLSIMNP

SEQ ID NO: 141361 - protein, 225 aa, Triticum aestivum
  unsure (1)..(225): unsure at all Xaa locations
  Clone ID: PAT_TA_35779.pep
MAPCATAGAQMLAARPCVSASQSMLASRAAVSRIDLALGASSFASCPRISCSRSLGSSRSSPVAVRAVSGEGSSSGLPIDLRGKRAFIAGVADDNGYGWAIAKALAAAGAEILVGTWVPALNIFETSLRRGKFDESRKLPDGSLMEIVKVYPLDAVYDSPEDVPEDVKTNKRYAGSSNWTVKEAAELVKKEYGSIDILVHSLANGPXEVTXPLLETLRSGYLAAI

SEQ ID NO: 141362 - protein, 222 aa, Triticum aestivum
  unsure (1)..(222): unsure at all Xaa locations
  Clone ID: PAT_TA_35780.pep
KFLGGGGRKTPKGNPKGGPPIKASGGKPPPRGXKKGKKTKGGGLRGPPKERGPRGETPPPPGVKGGXKGGVPFPLGGGKYWEGGWGGALFLLPHRGKRGFFPKGLKGGNPGFFPPPGGKTRAREFILGAPKKKKLVGGAGGEKWGPLKGPPLFFFFFIIFFFFSFFFFFFFFFFFFFFFFFFFFFFFFFFFFFFFFFFFFSTIPTIQLYLLYFLNTISDVYI

SEQ ID NO: 141363 - protein, 376 aa, Triticum aestivum
  unsure (1)..(376): unsure at all Xaa locations
  Clone ID: PAT_TA_35781.pep
MAPCGIPGAQMLAARTGGSAAASMLHMAAARPWIELSHVVRGFANREIIAFSRALGSTTGGAGAVRAVSGGGSISGRPMDFRVKRAFIAGVADDNGYVWAIAKALAAVGAEILVGTWVPALNIFETCLRRGKFEESRKLPDGSLMEIVKVYPLDAVYESPEDVPEDVKTNKRYAGSSNWTVKEVAESVKDDFGSIDILVHSLANGPEVTKPLLETSRSGYLAAVSASSYSFXSLLKHFXPIMNPGGASISLTYIASERTIPGYGGGMSSAKAALESDTRVLAFEAGRKGKIRVNTISAGPLGSRAAKAIGFIEKMIEYSYVNAPLQKELLADEVGNTAAFLVSPLASAITGSTVYVDNGLNTMGLAVDSPTVSSLL

SEQ ID NO: 141364 - protein, 138 aa, Triticum aestivum
  Clone ID: PAT_TA_35782.pep
MAPKAEKKPVAEKAEKTTAAKKTKAEKRPPASKEGGEKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 141365 - protein, 206 aa, Triticum aestivum
  unsure (1)..(206): unsure at all Xaa locations
  Clone ID: PAT_TA_35783.pep
MSFSNANTGDAPADPYKKANAEDVPLQTKIEDLVHFVTKEKFGMMTTRGSESGNLASRCMALAATETGGIDLLFHTNTESGKTDDLDADPHVNISFINASGEWASIAGNASISTDRSLVAKHYSPTLKAWLGDLGDGVHDGSEKDPRIGIIRVKAVSSTYSLVSKNLLSRVADIASSTVTGKPASPNTLREISXEGDVRSWRASRE

SEQ ID NO: 141366 - protein, 161 aa, Triticum aestivum
  Clone ID: PAT_TA_35784.pep
MRREGRQRGWVRVYDRDLVDPDGKRRAAHVVDADGQAVVVANGGYVRASRRPTNHSKPGGSRALDALCRKALRALDEEEEAPPPQPAARYGYSPGWWPSSPSPSRYGAVAQRQAQAQPAPARSGAGKASSKGGPGRNFKHGKISKTYLDEDEIDYLYNYDS

SEQ ID NO: 141367 - protein, 191 aa, Triticum aestivum
  Clone ID: PAT_TA_35785.pep
PAGSGSQECPPDLHNRLVASVNNAGFLAHLEKVRDEPLHQHTKLSIGSVTEVDIGDIPYTKDEGKTGSWLLVSCDTAGGNLEEISGIDDENYVMVNEDDIVDAIATFVARCILEDPKSKSLSSKELQKAVATALSSMTDRKKWISFWEAGKVIYILATWGITIAGLYRSRAVLKMAAKGAVVSTKFIMKAL

SEQ ID NO: 141368 - protein, 111 aa, Triticum aestivum
  unsure (1)..(111): unsure at all Xaa locations
  Clone ID: PAT_TA_35786.pep
MGADKGSTSVQFDDFLPSMARKLGAEGLIQELCKGFQLLMDPRAGRITFQSLKRNAARLGLGELQDDELQEMMRXGDMDGDGALDQTEFCILMVRLSPELMEQESHRMFEC

SEQ ID NO: 141369 - protein, 134 aa, Triticum aestivum
  Clone ID: PAT_TA_35787.pep
TYAWAKITNKPSNESNPTVDHQNLPPGSPKTRWNFKHERTYARRPSCGARPRPSTAGSGRLGCWCRTTGPARPAAACTAGGAPGPRPAAGSLRRPPSPRPPAAAPRRAPPAARAPPRSPAERASSSARRPCRQP

SEQ ID NO: 141370 - protein, 165 aa, Triticum aestivum
  Clone ID: PAT_TA_35788.pep
MFYSNRILRTICVSFPLYVCTKCQPAYTYAWAKITNKPSNESNPTVAHQSLPPGAAKNTLELEAREDVRRPSCGARPRPSTGSGRLGCWCRTRGPARPAAACTAAGAPGPRSTRRPRPAAGSLRRPPSRRPPAAAPRRAPPAARAPPRSPSDRASSSPRRPCRQP

SEQ ID NO: 141371 - protein, 87 aa, Triticum aestivum
  Clone ID: PAT_TA_35789.pep
MASSEGTYHRRGPYFDGTNFASWKHKMKMHILGHNPAVWTIVCVGLQGDFFDGREPNREATADELKMLQYNAQACDILFNVLCPVGP

SEQ ID NO: 141372 - protein, 43 aa, Triticum aestivum
  Clone ID: PAT_TA_35790.pep
MASSKGNYHRRGPYFDGTNFASWKHNMKMHILGHNPIVWAIVC

SEQ ID NO: 141373 - protein, 143 aa, Triticum aestivum
  unsure (1)..(143): unsure at all Xaa locations
  Clone ID: PAT_TA_35791.pep
MASSIKDKDIKKLREAGYLAKEITHRLPAEGQIVPTPEPQERVVFVSHFVRVLGFSLHPFVRGXMFYYERDLHDLAPNPILNISAFIVVCEAFLCIPPHFGLWLKTFNVKPKVVSGQQPECRGAMVGKMPNVTWPEGSFVETV

SEQ ID NO: 141374 - protein, 48 aa, Triticum aestivum
  Clone ID: PAT_TA_35792.pep
MASSEGNYHRRGPYFDGTNFASWKHKMKMHILGHNPAVWAIVCIGLQG

SEQ ID NO: 141375 - protein, 387 aa, Triticum aestivum
  unsure (1)..(387): unsure at all Xaa locations
  Clone ID: PAT_TA_35793.pep
VGGVYDLTQNEDLWRMVCRNAWGSETTRALETVPAAKRLGWGRLARELTTLEAVAWRKLTVGGAVEPSRCNFSACAVGNRVVLFGGEGVNMQPMNDTFVLDLNASNPEWRHVNVSSAPPGRWGHTLSCLNGSWLVVFGGCGLAGPASGAGLLXVAAVPPASDGSHAVAPPTPRSRAPPPLCGGPQFRGRWRSESDXCLEDSLALRRGARMDIPVWREVPASWAPSLRVFHPXSFKTNGDLSCGVKLRLSSPXRGRGTECLAPGMDVFAPEVRYGWVCRMPWAGNPAGAGPPPRLDHVAVSLPGGRVLIFGGSVAGLYLAXQLYLLDPTEEKPTWRILNVPGRPPRFAWGHSTCVVGGTKAIVLGGQTGEEWMLTEVHELSLASSNSV

SEQ ID NO: 141376 - protein, 199 aa, Triticum aestivum
  Clone ID: PAT_TA_35794.pep
MAGASSWSSSCSCTSSLGSLDDDDVFCVVKPGSPGAAAEGSVKFLCSYGGMILPRHPDGALRYVGGNNRVLSVDRSLQFHELQRKLTDMCGWEALSLRCQLPTEDLDALVSVTTNDDLGHLLEEYDAASRDRLQPLKIRAFLFPRAKTPPLSPSTPSSKANAGVRPPPPPAPHGRPPPVVGIPAPAPAHSSPPKRIWCQ

SEQ ID NO: 141377 - protein, 66 aa, Triticum aestivum
  Clone ID: PAT_TA_35795.pep
MGMGGRGVVGDRWSQRVLWMCAIGSAVSLYFVAVERQAQNRARAVSEGFKGLDGADGGGSRGGEDV

SEQ ID NO: 141378 - protein, 111 aa, Triticum aestivum
  Clone ID: PAT_TA_35796.pep
MAAKAPALAALLLLAAASLLLARGAEAGAGEVPLSWELGVEDVADDGYGLTGGDAVARRVLQSGNGYISYGALRRDNVPCSVRGSSYYNCRPGGQANPYSRGCSAITRCRG

SEQ ID NO: 141379 - protein, 42 aa, Triticum aestivum
  Clone ID: PAT_TA_35797.pep
GRYPVKVDRDGGVGPLPGHECFPDVGGKVLGAQSSLPDALTT

SEQ ID NO: 141380 - protein, 227 aa, Triticum aestivum
  Clone ID: PAT_TA_35798.pep
GQQTFYGPGSGFNVDTTKKVTVVTQFHKGSNGRLSEITRLYVQNGKVIANSESKIAGVPGNSLTADFCTKQKKVFNDPDDFTKKGAWSGMSDALEAPMVLVMSLWHDHHSNMLWLDSTYPTDSTKLGSQRGSCSTSSGVPADLEKNVPNSKVAFSNIKFGPIGSTYKSDGTTPTNPTNPSEPSNTANPNPGTVDQWGQCGGSNYSGPTACKSGFTCKKINDFYSQCQ

SEQ ID NO: 141381 - protein, 63 aa, Triticum aestivum
  Clone ID: PAT_TA_35799.pep
SPSVPNKMTRNPFVPCFFYILLLFVKRSLIKKIARTSRLGLCVCAFWLELGSIGETISSVHQL

SEQ ID NO: 141382 - protein, 191 aa, Triticum aestivum
  Clone ID: PAT_TA_35800.pep
MQFKTLFTASLLSGLTVAAPEPKTFGLVALRSGSPFHLSSVSASESGFSLLLPKGKQGAKCADNKKEDFATFRISKDKKLVLYHKGKEQQIAYTDRSGMGQGVLQYTGQKNYPRNAETEGWKVDKDGNLVFGSNNAGFMACPGLKSTDPWSIWVATGTDHPGNSEKECYSFSARVAETKKPVSCIYSQYSN

SEQ ID NO: 141383 - protein, 252 aa, Triticum aestivum
  unsure (1)..(252): unsure at all Xaa locations
  Clone ID: PAT_TA_35801.pep
MASRNLSKALRGPARQLASAPRVQQRTFVSAARAAVRAGAVARPVASGPIQQQIRGVKTMDFAGHKEDVYERADWPQEKLLEYFKNDTLALIGYGSQGHGQGLNLRDNGLNVIVGVRKNGKSWKDAEQDGWVAGKNLFDVDEAIGRGTIVMNLLSDAAQSETWPAIKPQLVKGKTLYFSHGFSPVFKDLTKVEVPTDIDVILCAPKGSGRTVRSLFREGRGINSSFAVYQDVTGKAEEKAXALGVAIGSGYL

SEQ ID NO: 141384 - protein, 149 aa, Triticum aestivum
  Clone ID: PAT_TA_35802.pep
CPKISDFGLAKLCLNKESVISIGGARGTIGYLAPAVYSKRYGAVSSKSDVYSYGMMVLEMVGARDKNISPNTESSSQYFPQWIYEHLDEYCVSASEINGEITEVVRKMIVVGLWCIQLRSTDRPTMTRVVEMLEGSTTGLELPPKVLLS

SEQ ID NO: 141385 - protein, 201 aa, Triticum aestivum
  Clone ID: PAT_TA_35803.pep
MFLQRSAITAARRVAARPAVARTFVTSVARLDASRPATPSEQAAALAGTAEKKVGSYKVLKEIRTEEDLFGPGAAPGTVPTDLEQSTGLERLEILGKMEGVDIFDMRPLDATRLGTMKDPIMVRSAGEEQFAGCTGFPADSHSVTWLGITRERPIERCPECGSVYKMDYVGPEDDHHHHHPPEFEEPKTFADYIKPEYRYK

SEQ ID NO: 141386 - protein, 200 aa, Triticum aestivum
  Clone ID: PAT_TA_35804.pep
ITINTFQPTHKPNTTNTFNISGQPQPSTLKSVVDSTTGAVQNVIGNLTGNTSDQAAGDLKKQKAEAEHDASHATAKLPGATISGSGAAAKDDPNRTEGSWNQTAGSAKETIGGLIGNESLKQQGREQNLEGRNQEAKGQLSDLGSGIGDRVQGTVGGAISNLAGDKEKEAHYDELRAEGKTRQRGVEHDVQKQAEAEHRG

SEQ ID NO: 141387 - protein, 235 aa, Triticum aestivum
  Clone ID: PAT_TA_35805.pep
MQRKTNFKPPAISTARAPGAHTPAAVSPPSSIKSNTDVAPPELEQRVKVSPPPPFASDRWAAGGASSSDEEEDTKKTKNKKAATGKTVPARKSGKAKGKDRYLVAPKAEADQEFMPAGVPDPFADNDAPPPSSFDPFADDAAGGGAGVDEAYVHLRVQQRNGKKTLTTVQGLSASYNYAKVLRDLKRELCCNGTVVEDKELGNVIQLQGDHRKRVAGFLAKAGLAKTECIKVHGF

SEQ ID NO: 141388 - protein, 82 aa, Triticum aestivum
  Clone ID: PAT_TA_35806.pep
MPLVVPGVNSTSGDKAEEWQNKLIGKKLSDDEASTETVFAKRDLPQETRIIEPGMMVTKDFKEDRLNVHLKDDGTVSHVVKG

SEQ ID NO: 141389 - protein, 86 aa, Triticum aestivum
  Clone ID: PAT_TA_35807.pep
MSPIVARSAARAFQTRQFSLLTAMRNAGRAMESHPFERLPITQKPASPDYAKMFKRVGSQALFFFPGFAVILGWPWAAQYAFDGKL

SEQ ID NO: 141390 - protein, 173 aa, Triticum aestivum
  Clone ID: PAT_TA_35808.pep
MATRSAALKLDWTKVTSSLGLRGQTVASLQAFKKRNEDVRRKVQQLQEQPTTVDFSQYRSVLKNQAIIDEIEKRFNAFKPVTYDVSRQLKAIDAFEAEAVKNAEATKQAVDLELKDLAATLKNIEEARPFEDLTVDEVAAAEKSIDEKTDQLVSKGRWMVPGYKEKFGDLAMV

SEQ ID NO: 141391 - protein, 514 aa, Triticum aestivum
  unsure (1)..(514): unsure at all Xaa locations
  Clone ID: PAT_TA_35809.pep
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPGVVVDLPTLTEKDKEDILQWGVPNKIDMIALSFVRKGSDLVEVRKVLGEHAKSIMLMSKVENQEGVDNFDDILSQSNAFTVXSGDLDMEIPVEKFFYAQXVMIFKCNIQGKPVMTATQMLESMIKSPRPTEXEATDDANAVLDGTDCVMLSXGETAAGAYPELAVQTMAKICLQAESCVDYSAVFKSIMSSAPIPMSPLESLASSAVRTANSAKATLILVLTRGGTTARLVAKYRPSMPILSVVVPELKTVEFDWICSDEGPARQSLIVRGVIPMLSAGTAKAFDSEATEEALRFAMKNAKEMGLCNAGESIVALHRIGXASVIKLLTV

SEQ ID NO: 141392 - protein, 267 aa, Triticum aestivum
  unsure (1)..(267): unsure at all Xaa locations
  Clone ID: PAT_TA_35810.pep
MSIRSISSQLLVSTLALSSLCLGQKTGKFNFLTYNVAGLPEIINGNDVPGDKKTNSNLIGTAFATQGFDIVHMQEDFNYHAYIYATDNHPQRTPTSGGVPFGDGLNTVANYPWSTFSRKKWNKCNLNSGDCLTPKGFSFMRMAIGGVEVDLYNLHADAGSDQGDVDARSAGIDQVLAYINSNSNGRAVIIGGDTNDRWTNAGRSLNKLTDAGFSDAWVQLIQGGKYPTAGAAADPCKVPAADTXCEIVDKVXYRSGSSVKLNATSFT

SEQ ID NO: 141393 - protein, 146 aa, Triticum aestivum
  Clone ID: PAT_TA_35811.pep
HNYRASGACKHDDTQALARAWNAACSSSRPAVLLVPKGKTYLLKSITLSGPCRSSIVFKVKGTLIAPPSMSAWTDNDRRRWIFLQRITGLTVNGGGTISGNGEIWWNNSCKTNKALPCKGAPTALTFHLCNNLKVENLKLGNSQQI

SEQ ID NO: 141394 - protein, 279 aa, Triticum aestivum
  unsure (1)..(279): unsure at all Xaa locations
  Clone ID: PAT_TA_35812.pep
RAAXERVQQEARKRAERAAVERAAAEARQRQAAAAAAAAKEKHSTPNDVESFFRMDARDTSAAKQRAPTPTADSMFDSQPQDRGTVNGSQRTASTSASTRKTNPPSATNIFGNGLSDLFEFESTRSSSDAFQDVEGESEERRRARLERHQRTRERAAKALAEKNERDMQVQREQAERDRIGASLDFEIKRWAAGKEGNLRALLSTLQYILWPECGWQAVSLTDLITGAAVKKQYRKATLCIHPDKVQQKGATLQQKYIAEKVFDMLKEAWNKFNSEELF

SEQ ID NO: 141395 - protein, 558 aa, Triticum aestivum
  Clone ID: PAT_TA_35813.pep
RGRAGLAQSLFERLVILGVKPFRLQVQYRMHPCLSEFPSNCFYEGTLQNGVTANERQSSGIDFPWPVPNRPMFFYVQMGVEEISASGTSYLNRTEAANVEKIVTTFLRSGVVPSQIGVITPYEGQRAYIVNYMSRNGSLRQQLYKEIEVASVASFQGRKKDYIILSCVRSNEHQGIGFLNDPRRLNVALTRARYGIVVLGNPKVLSKQPLWNSLLTHYKEHECLVEGPLNNLKQSMVQFQKPKKIYNDRRLFLGGGQGVMQGSAFGTVGSGDKRSGRGKGHPFVPFGPPNGAHKPGVHPSGYPLARMPYPPFPGSPHSQPYAIPTRGSLHGPIGAVPAVPQPVNRNFGAPRANTGGPIGGHLAAHQQNSQQAMGSVGPTYNFAGDPSSQPSGGGLMSQSGLMAQMPVEGLSQTIRDGFPVGGMSQDFFGDDFKSQGSHVAYNIADFSTQASQGGYAVEYTQGPQSGYPGNYLNQSAHPGYPHMGATNDIVSQDHMAHGSHGMFTQAGYNDQSQDESSQMHYGLGAPGHLQSQSMMNPMYSQSYAHYNTQPQSLQPPPQ

SEQ ID NO: 141396 - protein, 136 aa, Triticum aestivum
  Clone ID: PAT_TA_35814.pep
MTKINPSVASSRRKSRAAHFKAPSDQRRVIMSAPLSKELREQYNVRSIPIRKDDEVTIVRGSNKGREGKITSVYRLKYVVHVERVTRDKANGQSVPLGIHPSNCVITKLKLDKDREDILRRSKVGRELAANNKVTA

SEQ ID NO: 141397 - protein, 123 aa, Triticum aestivum
  Clone ID: PAT_TA_35815.pep
SRLYKSTSQSPPTKSPPHGTHESTSQPSISGDTKMDKRTNKQITNQHAPHRIRIPRYGVRMILFYYVARTRIYSVGSLPRPHGLHVRALHCTRRRALFSSAPAPGTASTRPAATASLPPHVGP

SEQ ID NO: 141398 - protein, 70 aa, Triticum aestivum
  Clone ID: PAT_TA_35816.pep
MVAWRIRNMTIAFQLAVFALIATSSVLVISVPLVFASPDGWSNNKNVVFSGTSLWIGLVFLVAILNSLIS

SEQ ID NO: 141399 - protein, 111 aa, Triticum aestivum
  Clone ID: PAT_TA_35817.pep
TTTKTLKSTLNLNNCLTYSVIMKATFFISIIAATVTLVNADPVGISLPEPECPAGPTSCADIIGMSNECYNLNGGDVECSEKAICECPEGCHLVEAPDPVTYPGGACVVIE

SEQ ID NO: 141400 - protein, 210 aa, Triticum aestivum
  Clone ID: PAT_TA_35818.pep
TDPTKYTSIFSSVQINTRRRARAGNKKISKKPTNEFNQSNHVLAREKEHANTVSPPPPPGLVRQKPERGRGGRGGRPSRAAGRPASTAGRGRSGCWWCTRRQARSAAACTAAGAPGPWSSTRPAAGSLLRPPSRRRPAAAPRRAPPEVGTPPRSSAERASSSSSRRPSISSTLAFFFFCLSLLPLQQACRGAARRWVLAMSSRCILQRGV

SEQ ID NO: 141401 - protein, 171 aa, Triticum aestivum
  Clone ID: PAT_TA_35819.pep
AARAGRPLPPRRRLHLDDIAKTQRRAAPLQACSKGRRRKPRLTRSMAVARRTMRLAVPVLVAALLLLAVLGEAARPLGGADWAAAGGTPLPGASDHGPGAPAAVHAAAGRAGRLLHHQQPEQPLPAVEVDAGGATRPSSTTNPCSLGFKLVFHGPTRAAVAGSQCSHVLFP

SEQ ID NO: 141402 - protein, 127 aa, Triticum aestivum
  Clone ID: PAT_TA_35820.pep
MAGEGMPDSQLFQLLADVLQEVESMSNQEEVELRAKIEALGLEVTKVPEKAPKQLDELEIAAELDRLSARLDNVDKMISSAMTSDPEVKSLLSSTADVWMPVITASADERRGFAETSGDKEEQEKSK

SEQ ID NO: 141403 - protein, 190 aa, Triticum aestivum
  Clone ID: PAT_TA_35821.pep
MASDAPEKTAEQTPPAPEVPSEEAPPAPTVPESRLPTRKDVSLREFLNKMDDYAPIIPDAVTNYYMTKAGLPPPPQTDPRLARLLALATQKFIADIAADAYQYSRIRASSNTNNPMGSLGAAAGFPIPGQPTGQPGSKDQTKGAPLGIQRPGYGGGGQGGSQNRTVLTMEDLGMAVGEYGVNVKRSEFYR

SEQ ID NO: 141404 - protein, 294 aa, Triticum aestivum
  Clone ID: PAT_TA_35822.pep
MAPSNLPSVMNATSQDIETLLAAQCHLGSKNLQVHMENYLWKTRQDGVNVINVGKTWEKIVLAARVIAAIDNPADICVISARPYGQRAVLKFAAHTGATAIAGRFTPGSFTNYITRSFKEPRLIIVTDPRTDAQAIKEASYVNIPVIALADTDSPTEYVDVAIPTNNKGRHAIGAVWWMLAREVLRLRGTIYNRETPWDVMVDLYFYRDPEAEAEDKVEEEKVPGADEEGPAAIESGFQASAGADWEAPASGFAGASGAAGAPGWDGAAGEEWGAAPANTEWAASAEPPKESQW

SEQ ID NO: 141405 - protein, 515 aa, Triticum aestivum
  Clone ID: PAT_TA_35823.pep
MAICKVWISLLLALAVVLSAPAARAEEAAAAEEAAAAPEAVLTLHADNFDDAIAKHPFILVEFYAPWCGHCKSLAPEYEKAAQLLSKHDPAIVLAKVDANDEKNKPLAGKYEVQGFPTLKIFRNGGKNIQEYKGPREAEGIVEYLKKQVGPASKEIKAPEDATYLEDGKIHIVGVFTEFSGTEFTNFLELAEKLRSDYDFGHTVHANHLPRGDAAVERPLVRLFKPFDELVVDSKDFDVSALEKFIDASSTPKVVTFDKNPDNHPYLLKYFQSNAPKAMLFLNFSTGPFESFKSAYYGAVEEFSGKDVKFLIGDIEASQGAFQYFGLKEDQAPLILIQDSDSKKFLKEQVEAGQIVAWLKDYFDGKLTPFRKSEPIPEANNEPVKVVVADNIHDVVFKSGKNVLIEFYAPWCGHCKKLAPILDEAAATLQSEEDVVIAKIDATANDVPGEFDVQGYPTLYFVTPSGKKVSYEGGRTADEIVDYIKKNKETAGQAAAAATEKAAEPAATEPLKDEL

SEQ ID NO: 141406 - protein, 531 aa, Triticum aestivum
  unsure (1)..(531): unsure at all Xaa locations
  Clone ID: PAT_TA_35824.pep
MAPSKAWISLLLALAXVALSAPSARAQEAAASAEPAAADAAVATQHADNLHADISKHPFILVEFYALWCGHXKSLAPEYEXKAAQLLSKHDPAXFSLLKVDPNDXMKNKXPLSRQRTRVQGFPNPQRIFQGTGGERNIPCEYXGPREAEGXIVEYLKKQVGPASKEIKAPEDATYLEDGKIHIVGVFTEFSGTEFTNFLEVAEKLRSDYDFGHTVHANHLPRGDAAVERPLVRLFKPFDELVVDSKDFDVSALEKFIDASSTPKVVTFDKNPDNHPYLLKFFQTNAPKAMLFLNFSTGPFESFKSAYYGAVEEFSGKDVKFLIGDIEASQGAFQYFGLKEDQAPLILIQXPSDSKKFLKEQVEXAGQIVAWLKDYVRXQISTPFRKSEPIPXANNEPVKVVETDNVHDVVFKAGKNVLVXFSAPWGGHCQKASTHLDEAAATLQSEEDVVIAKMDATANRRARWSSMVQGYXTLYFVTLPAGKKVSXEGGRTADEIVDYIKKNKETAGQAAAADTEKAAEPAATEPLKDEL

SEQ ID NO: 141407 - protein, 347 aa, Triticum aestivum
  Clone ID: PAT_TA_35825.pep
ELYPLLAWWLIAGQPSLLRDLGRLRNVTILAPSNDALEELLKDTSIARMVDNNPSYVANLLSYHILNGTYYASNITDMDMAAFIPTHLTNSTYTNVTSGQRVEAMAMNDTVSFYSGFRAQSNVTKADLNFTGGVIHIINRVLSVPQNLSDTAIAANLSAAAGALTEAKVVTNLTAEKNVTVFVPNNSAFAKIGSVLANASESDVADILAYHVVNGTVGYSSDLKNGTLTASDGTKLNIAIYNGTVFVNEAKVIVPDVLIANGVVHVIDGVLNPDKPSATANPTASTQEAAFSGASSVSDVPFTSGVPEGTAQATGLSPSTSTEGATQATAAIALGALFGGAALIMNA

SEQ ID NO: 141408 - protein, 189 aa, Triticum aestivum
  Clone ID: PAT_TA_35826.pep
MWIVNWFYDVLSSLGLLNKHAKLLFLGLDNAGKTTLLHMLKNDRVAILQPTLHPTSEELAIGNVRFTTFDLGGHQQARRIWRDYFPEVNGVVFLIDAKDHERFGEAKAELDALLSMEELSKVPFVILGNKIDHPDAVSEDEMRHQLGLYQTTGKGKVQLEGIRPIELFMCSVVMRQGYGDGIRWLSQYV

SEQ ID NO: 141409 - protein, 128 aa, Triticum aestivum
  Clone ID: PAT_TA_35827.pep
RPPVLKDGSWVDVPVLGDGRHQLLVVVGDEMEIMSNAAFRAPVHRVMAPGEEAERVSLAPFYQPEPDKVLEPSPELIDGDRPAMYKKLQAKVFADGFWDAFALGERTIDFLKVKVDAVDPPAAAVSGA

SEQ ID NO: 141410 - protein, 103 aa, Triticum aestivum; identical to SEQ ID NO: 107316
  Clone ID: PAT_TA_35828.pep

SEQ ID NO: 141411 - protein, 131 aa, Triticum aestivum
  Clone ID: PAT_TA_35829.pep
PAGFRDPNAAKLKAGMVAHVKKWVSQGIPIDGIGSQTHLDPGAANGVQAALQQMASTGVKEVAITELDIRSAPAADYATVTKACLNVPKCVGITVWGVSDKDSWRKEKDSLLFNAQYQAKPAYTAVVNALR

SEQ ID NO: 141412 - protein, 98 aa, Triticum aestivum
  Clone ID: PAT_TA_35830.pep
YRLSDLYLTDRKQTMTNLQKIPAPLSTFTDKALPRSSLSPTTSLLSNYKRKSLEQSGMVAAAGAVHPHASAQSDHQSPPRPTPPHLYHLSRHIIFSMK

SEQ ID NO: 141413 - protein, 131 aa, Triticum aestivum
  Clone ID: PAT_TA_35831.pep
GPQVTADVNDAEIVSVCHAGKENQVNSLQNMLAAPSSSFPVNGHSSNGSTEKTDMTCLFGPKTKTERLEYLTPVSKHRSLPSCSNDRTSQHSFSFSKGHGLERKKIKPLWTSTKPTAADVSDKFRTKIIAR

SEQ ID NO: 141414 - protein, 92 aa, Triticum aestivum
  Clone ID: PAT_TA_35832.pep
RCSFLPILHMEYVSREEKEFNYRRKYPTKSKGNVTYPFLIGEYFFLMKLATKHGKINPNYLYCTPSVSKYKNVFYTCKVSKMFLYFETEGVV

SEQ ID NO: 141415 - protein, 100 aa, Triticum aestivum
  unsure (1)..(100): unsure at all Xaa locations
  Clone ID: PAT_TA_35833.pep
PLRLKQWMFEVVGKGQFKDEFXVTAGGVPLXSEISLSTMESKKQPNLFFAGEVLNVDGVTGGFNFQNAWTGGYIAGTSIGTLASNSILKEEQACLQLQGS

SEQ ID NO: 141416 - protein, 277 aa, Triticum aestivum
  unsure (1)..(277): unsure at all Xaa locations
  Clone ID: PAT_TA_35834.pep
MSGGFFRGTSADQDTRFSNKHAKLLKTQKFASELDHQVDMSKVKMDVMKPWIATRVTELLGFEDEVLINFIYGLLDAKEVDGRYSPRRLTGFMEKNTIKFMRELWSLLLSAQQNASGVPQQFLDAKEAEIQQRKAEEARIAQEIQKKREKDGRDTELDKRKMMAGDTGNSRFHGDSLGSALNNPTVYADKEXELDLKHSSRTKSREHRTPRSTSLAPPRGLRSTPPTTRSPSPARPCSLPRSASPCRSAPPRWLSPCIAPSVARRGSPAASRPPPPP

SEQ ID NO: 141417 - protein, 71 aa, Triticum aestivum
  Clone ID: PAT_TA_35835.pep
FLLFMIEFMFFPLDLKNLRRNFSNHSNLLKFEYLWASFPKPSLSPPRCPTTHNTSPVTQSDIPPTTVTPPT

SEQ ID NO: 141418 - protein, 74 aa, Triticum aestivum
  Clone ID: PAT_TA_35836.pep
ILLMGSGVHQEVLCARWPKLFIHADNLPKNNKAPLNVPSSSLGFSAQPLFCTPASGYMEYANLGICEANPLDVP

SEQ ID NO: 141419 - protein, 240 aa, Triticum aestivum
  Clone ID: PAT_TA_35837.pep
MGKLSMESGSDASSINRVLSSSGIDPYIRNLMVLGLGFRRSRSNIKQALKRHDDDSEWWMCPAIPLKDIMPAPPPSMEPPPPVEKKKKKTKKKALKDIAAGPCITCVKEEIPDPAYGDDGIFGPKAPKTGLGLSLNTEEVLKAWYDRGSVFADGNIPDASSTDGLAKLSDIELFLENGAAGAIREGSIQKLKHKQKQCTPLLSNKTRYQARKVHAESRPRVKGRFVSQAALLQKAAEKET

SEQ ID NO: 141420 - protein, 218 aa, Triticum aestivum
  Clone ID: PAT_TA_35838.pep
LKPWLHISEQVHEVNRMNILDLMSMDPDSPFFASDNFKAGVLLSVAECLRGFVIIHEGLCSFPEIFMPVSSLLQQIMEKSELPALLQEIFQDVIDLIKKKSDEHHASREPLQMRKQKPEPIKQLAPQFEENYVKGLDYDPDRERARLKKLAKQVKSEKRGAMSELRKDSYFMAAVKQKERARHEQERSEKYGKAMAFLQEQESAFKCGQMGKGKKRRR

SEQ ID NO: 141421 - protein, 192 aa, Triticum aestivum
  Clone ID: PAT_TA_35839.pep
MGQALRRASGRLRPPPPARPPPAHPPPPPPRAAPAAAAGSGGSPPQDLLDVSQDAVTPSTKEAHGVLVERDPSYDDMLKHMVGRITTKPGGKPEMGEASVVERYNRPLPKVRTSEPEPGQSRQLPPGTLNVGHIQEIIQLYQGKSGSQHGPMSVDQIASRFRVEASVVHGIVQFVSLPQDEGTEKKDERRDL

SEQ ID NO: 141422 - protein, 141 aa, Triticum aestivum
  Clone ID: PAT_TA_35840.pep
LQIRHEADDDFYSGGEAGLAASDDGDADYDFADHDSDDSPELLSHRQQQNYCILSEAGIKQRQEDDINRVSTVLSISKSEACALLRSYNWSVSKVHDEWFVDEERVRKVVGFPEKRIEMPNDRELACGICFENCPYASMSA

SEQ ID NO: 141423 - protein, 159 aa, Triticum aestivum
  unsure (1)..(159): unsure at all Xaa locations
  Clone ID: PAT_TA_35841.pep
VGKTGFDFAIRTPCTPSRWEEYQEEMTAAWEAICEAYCSDPNPTRDSNALDAVKAAILRMTYYWYNFMPLSRGSSVVGYVVLLGLFLAASMDVTASIPPGVQVDWEAILSPDPXTFVDAVKPWLYPSVKMSKSLKDYADVSVAFXTTGSVVAALTSADT

SEQ ID NO: 141424 - protein, 130 aa, Triticum aestivum
  Clone ID: PAT_TA_35842.pep
FHELSILVILIVPLFFLSSLDSLLLLLSSCFTSSPFLFRLGPKISGQDLLLVEECCNAPDPTRQVSASYSLPLPCHLLVCCILSCHHVHCIAYVFVSCIRAFSPLSVSQSGAPMPSGVPLLSPVVCPFCR

SEQ ID NO: 141425 - protein, 117 aa, Triticum aestivum
  Clone ID: PAT_TA_35843.pep
SGVLHFFVPLSYPIISVCGRLSPYDLEMLPIRPQQAYSFVVDFLNNSIQSFLLSSFYSILSILPEALHYSSRQVPSHWVKLVFYSFHLQPECCLNPFSLIRFLPRSNRSCFIVYLFP

SEQ ID NO: 141426 - protein, 731 aa, Triticum aestivum
  Clone ID: PAT_TA_35844.pep
ASAAALKNYENYYPKGKKEAPKGDGSNKDSKQESDTDGQWNFQDGTFKQLQNFLGPLLLLGLMFSSLSSSSSDQKEISFQEFKNKLLEPGLVDRIVVSNKSVAKVYVRTTPQTNGQSQNTDTQITTVDVPGRQAPSKYKYFFNIGSVESFEEKLEEAQENLGIDSHDYVPVTYVAEVNWFQEVMRFAPTAFLVGLLYFMGKRMQSGFNIGGGPGKGSRGIFNIGKATVTKMDKNSKNKVFFKDVAGCDEAKQEIMEFVHFLKNPKKYEELGAKIPKGALLVGPPGTGKTLLAKATAGESGVPFMSISGSDFMEMFVGVGPSRVRNLFQEARQCAPSIVFIDEIDAIGRARGRGGFSGSNDERESTLNQLLVEMDGFGTTAGVVVLAGTNRPDILDKALLRPGRFDRQITIDKPDIKGRDQIFRIYLTKLKLDNDPTYFSQRLAALTPGFAGADIANVCNEAALIAARTDETQITMQHFESAIDRIIGGLEKKNKVISKLERRTVAYHEAGHAVAGWFLEHAEPLLKVTIVPRGTAALGFAQYVPNENLLMTKEQLFDMTCMTLGGRAAEEVLIGRISTGAQNDLEKVTKMTYAQVAVYGFSDKVGLLSFPQREDGFEMNKPYSNQTASIIDTEVREWVAKAYKRTVELLTEKKEQVALIAELLLEKEVLHQDDLTRVLGDRPFKAAELTNYDLFKQGFQDEDGKTTEPAKNAEVPDDDGPAAALPDVVVPT

SEQ ID NO: 141427 - protein, 171 aa, Triticum aestivum
  unsure (1)..(171): unsure at all Xaa locations
  Clone ID: PAT_TA_35845.pep
MGQFLADDKYRVVGFDLEYTIGRAWHDQKVVVAQLCVRHDVLVYHYHLATRPCEHFSRFINNSNYSFIIVDTTNDLKAXQGFGLEMPESCQHPALLQGLXRDNNKLNSLVDLTSAIADPYYTKMKXREQEVQERXHSVWHERLDEEHVKYMAKDAYTSYEMYRRIVDMRNC

SEQ ID NO: 141428 - protein, 279 aa, Triticum aestivum
  Clone ID: PAT_TA_35846.pep
MEREMAASYEPKLNSEIRIFESSDEIVTDLAEYISQVSEISVKERGYFAIALSGGPLVSFLRKLCEVPYNKTLDWSKWYIFWSDERAVAKNHADSNYKLTKEEFLSKVPILSGHVYSINDGATVEDAATDYEFVIRQLVKIRTIGVSESNDCPKFDLILLSMGSDGHVASLFPNHQALELKDDWVTYITDSPQPPPERITFTLPVINSASNIAILATGVDKANAVHSAVSDSSDGLDAAAPLPARMVQPTDGKLVWFLDKAAASSLEALSDDAYQQQHL

SEQ ID NO: 141429 - protein, 49 aa, Triticum aestivum
  Clone ID: PAT_TA_35847.pep
RLRAMGKPVGVREFEGQQHGFFTIDPWSAASAELMRALKRFIDTDGRFD

SEQ ID NO: 141430 - protein, 97 aa, Triticum aestivum
  unsure (1)..(97): unsure at all Xaa locations
  Clone ID: PAT_TA_35848.pep
VIMHVIXYXGVCKCHGCSSHLSKWMFNLVMQACPYKCVCVCVCVCCCSVCNPIAQHTCLVKLNRFCSLVSTQTVRPSEPHAVYHKHLHLAYRFFCVA

SEQ ID NO: 141431 - protein, 135 aa, Triticum aestivum
  Clone ID: PAT_TA_35849.pep
YDLKSHLATIHRWEVINFRYGESFQAPAFDSAIFRCEDYGELFHISSSREGLGTALSMICIRPDNAFEEEFTYELKMPAGGRRHRLQIQSTVWNTSLRYGIGEGSDVFLLVPDKLPGVENGCAVEVCIRKVVAGN

SEQ ID NO: 141432 - protein, 243 aa, Triticum aestivum
  unsure (1)..(243): unsure at all Xaa locations
  Clone ID: PAT_TA_35850.pep
LRQNKYPHYQKLVYGIYMTTKKVAHYFSDHSITVVSDAPLSEILHNRDATGRVAKWAIELLPLDIKFEAKKAIKSQAIADFLAEWIEQQLPTQVQSEHXTMFFDGSKMLNGSGAGVVLVSPRGDKLRYVLQIHFDSSNNEAEYEALLYGLRMAISLGVRRPVVYGDSDLVVNQVMKEWDVRIPAMTGYCNAVRKLEKKFEGLELHHIPRLKNQADDDLAKIGSKREAIPSNAFLEHIHTPSVQ

SEQ ID NO: 141433 - protein, 56 aa, Triticum aestivum
  Clone ID: PAT_TA_35851.pep
LRELKTDDNLLLFKCELGAGHFSKSGRFEKLREDAFTYAFILKALGMTTPTTASSL

SEQ ID NO: 141434 - protein, 51 aa, Triticum aestivum
  Clone ID: PAT_TA_35852.pep
ECYARVPFPFFLSVYLNFFHLASFFNLYYWWFVRLAYVIQFMRLPLLILQN

SEQ ID NO: 141435 - protein, 389 aa, Triticum aestivum
  Clone ID: PAT_TA_35853.pep
MAPPSRPVAVLAWGSGEDGQLGMGRCDEKDWARCIGALDAYAVSAVVAGSRNSLAICNDGSLFTWGWNQRGTLGHPPETKTESSPAHVDALIGVKIVQAAIGGWHCLAVDDKGRAYAWGGNEYGQCGEEPERKEDGTRALRRDIPIPQRCALKLKVRQVAAGGTHSVVLTQEGHVWTWGQPWPPGDIKKISTPVRVQGLEQVSMIAVGAFHNLALSVDGILWAWGNNEYGQLGIGDTQPRSQPIRVEGLSNLSLVDIAAGGWHSAALTKEGEVYAWGRGEHGRLGFGDDKSSHMVPLKVQLLAGEDIVQVSCGGTHSVVLTSDGRIFSYGRGDHGRLGDGREVTTGHPMEVPINLPPPKTSTSSEGLWQANYVACGGRHTLAIVTWTDM

SEQ ID NO: 141436 - protein, 76 aa, Triticum aestivum
  Clone ID: PAT_TA_35854.pep
DGLLVDLVEMRATAFHFGARWASLHQHPTSVQFGSTVASSPIPPITIIHPTLKQGFLFRTSSLESRHVLLVPSCIS

SEQ ID NO: 141437 - protein, 161 aa, Triticum aestivum
  Clone ID: PAT_TA_35855.pep
TRTPAIAGALLVVMKQVREAGARRRARAAKKRSKEVQAEKLKERAKEKKESIESVKKWRKQRQQGGFSKGKEDGPGLDLEGLEHHKKPRPGGSPGVRSGGLAKRGKQGKNHRSKDSKFGHGGRKGMKKQNTAETTNDFRGFNNQEGRVQETRRGRCFDTVL

SEQ ID NO: 141438 - protein, 85 aa, Triticum aestivum
  unsure (1)..(85): unsure at all Xaa locations
  Clone ID: PAT_TA_35856.pep
GASAVAKGCTCGCSLSRRRCRPASQHSSLALVLLLYRHVVLSFNFPCRSWTMTDHHHTFIRSITPYLLXLFLPHSFAGYGTLAXI

SEQ ID NO: 141439 - protein, 207 aa, Triticum aestivum
  unsure (1)..(207): unsure at all Xaa locations
  Clone ID: PAT_TA_35857.pep
ASQEPSRTGTPIIASSPTSTRTPTPNRSVEFGVGTIDSSKMGMSEEELQLNTRKEIMDLGERLGKTTIAAWASDAVWAAPFVAVLPADXALDCACAPRAAVCLEPLYACDPARFQREEVKIQAWENHQRAKIEAEMKSIEAXLERLPARGDGWLREKTTEATGRAEAKREAAEARRSQEAERTDEQAAQIRKTGHIPSSISCWCWCL

SEQ ID NO: 141440 - protein, 214 aa, Triticum aestivum
  Clone ID: PAT_TA_35858.pep
IQSIVDGEYPANKMSYEDNYFDDPLAVSSENIPNEEAIQFTEQHGSRRKSTSKDGTNHVPTRISEKGAKPTLKRFPGDENAITKPESAKKAKVDFAYSGATGSLSAQRQNLPPDKHINERSSKETGNVGWDTHTELQVQDISPKEGRPVTPGDLQKINQSQNLPIPTHSEGKQEKIMKTSSKKKLDKVQKPLNSMDGSPGNVNFDNTDDSAARK

SEQ ID NO: 141441 - protein, 31 aa, Triticum aestivum
  Clone ID: PAT_TA_35859.pep
SSPGRKHDHHPVPLKQFRTAIPFVQYINLHL

SEQ ID NO: 141442 - protein, 229 aa, Triticum aestivum
  Clone ID: PAT_TA_35860.pep
MNIFKKKVDPKEALRTSKREMSVATRGVEREIGSLQMEEKKLVAEIKNTAKTGNEAATKILARQLVRLRQQIVNLQGTRAQIRGVATHTQAMYAGTSISAGMKGASKAMAAMNKQLEPTKQMKQMREFQKQSSQLDMTLEMMSDAIDETLDKDEAEEETEELTNQVLDEIGVDVASQLSSAPKGRIGASNKKAENNQARNAAPAKNVAPEPNAAEVDDLERRLASLRRI

SEQ ID NO: 141443 - protein, 108 aa, Triticum aestivum
  Clone ID: PAT_TA_35861.pep
MQISMKTLPPRQLSNQPAWRCMPSQPGRASERDEAAADGTSFLVVPSKVRGHVGSALNVFCPTVPGDRLVYSTNFPPPVCHCGDPFGFKRRPEAYWRRIRTFWTRHTL

SEQ ID NO: 141444 - protein, 103 aa, Triticum aestivum
  Clone ID: PAT_TA_35862.pep
MVYFDSWDEFVDRSVQLFRADPITTRYCMKYRHCDGKLVLKVTDDRECLKFKTDQAQDAKKMEKLNNIFFALMTRGPDADISEVSGKEQAEQQQSKKGRGRRQ

SEQ ID NO: 141445 - protein, 79 aa, Triticum aestivum
  Clone ID: PAT_TA_35863.pep
RPSFSTNARRPGPCVDTLPHHAPPLLTPLNACNIRGRGEERGGKSELAVTPPCVKVVHGPLQIWPHYNWRCVMHGKTRN

SEQ ID NO: 141446 - protein, 73 aa, Triticum aestivum
  Clone ID: PAT_TA_35864.pep
DKFAETKQTAIHWQSTSGGQSVGAKLFICADACIAWSAIADEPGLCFFLSLSVRRWLCSGVVTRGCQMMMDAP

SEQ ID NO: 141447 - protein, 126 aa, Triticum aestivum
  Clone ID: PAT_TA_35865.pep
SCPVFGPCGHCEAVLVLWICCGKVAISSLPLLVPFYVDYSIISVIILCAWGGGGCDFLGEGGLDFVQGEGAGGLLVGCLVHVGIAKLFWCCGWAIYGFVGVSGSNRHWPDYVSRCVGIGFSLCGFE

SEQ ID NO: 141448 - protein, 60 aa, Triticum aestivum
  unsure (1)..(60): unsure at all Xaa locations
  Clone ID: PAT_TA_35866.pep
MKEMVGLSXDLLSWXLDDMTSSEDLQEAFDVMGALPDVFSSGYTKCDDFVRAAIQAGRRS

SEQ ID NO: 141449 - protein, 480 aa, Triticum aestivum
  unsure (1)..(480): unsure at all Xaa locations
  Clone ID: PAT_TA_35867.pep
SIRRRHAGASTGSGRRWGTLGWSSSCSNSSRRARDLGLATKARKTKHTPNGCPRGEKGGAAARKSRNKEWDGAXMLRKNEPLXSCIVPLRRQAVPHGQYNRCVDQYWDQLNSQGRADGSRLRLLTYDIVLMLARFATGASFSTDCKGGGKESNSRFLPFMIQMASHLVDGSANQQRHSMAKAISTYLSSSLSTSESPSRVSASPPGARGSPGSPEETVQFMMVNSLLSESYESWTQHRPAFLQRGIYHAYMQHKHGRSALKLSAESSSSAARSDEGSSADPNDDGKRLFAIVQSMLVYTGLVEQLQQFFKKGKSSGTSKSSQKDEASSKWESTMKERLSNMKEMGGLSTDLLSWRDYISWSQTTTAAVAVPWARRCWCTLAWSSNGSIPSKKRQSIMGTTKSTQKDEASSKWESTMKERLSNMKEMVGLSKDLLSWLDDMTSSEDLQEAFDVMGALPDVFSSGYTKCDDFVRAAIQAGRS

SEQ ID NO: 141450 - protein, 57 aa, Triticum aestivum
  Clone ID: PAT_TA_35868.pep
QSASFCFILPMFLNISLFRYFLIYSHITDVYGHILVCRFTHFASYVFCVEISKKTYI

SEQ ID NO: 141451 - protein, 77 aa, Triticum aestivum
  Clone ID: PAT_TA_35869.pep
CTSISAENKPKQSLETHTKTPEQNLCRFSLPHSSGRLFAYVTCRTRCIHRSRRLLRTPRRASFSLMLITISILAATA

SEQ ID NO: 141452 - protein, 201 aa, Triticum aestivum
  unsure (1)..(201): unsure at all Xaa locations
  Clone ID: PAT_TA_35870.pep
EGPSSQTISRVYSASGTPHSLNTQRPYRNSSAMSMSRSSADLANMSSPYFRTSLLRGGSTHSLVGNHLSPPVNISYGYAPPQMYNSGYASPSPHAGSSYISNSGYGSSSGYYLGSSSQHRSSAYLRHXGESGPSLSTMAPQSPQQQQSHSRLRHGGDSDASLNLAGASSAQSFRQSYLRHCGDSDASLSAMASSGQSLPGC

SEQ ID NO: 141453 - protein, 115 aa, Triticum aestivum
  Clone ID: PAT_TA_35871.pep
LRELPKKAGQQLVILSQVLMDDINVGYERLAELQVKKVNGVEVENLKHLCSIVENCTEENLRIDLDDEREIVLKFQNARLATSRILKRHRIPSAMSSDLVDEQASKGETEASCTN

SEQ ID NO: 141454 - protein, 113 aa, Triticum aestivum
  unsure (1)..(113): unsure at all Xaa locations
  Clone ID: PAT_TA_35872.pep
FXFPAXVXIXLXCYXGGFCAVAWASALVEPRGFLGSWGGRSACNFRTRGLPRLGSSSGTGFHQPCRATLSMDQRAKVRLRHHAQTDTFFVGRSYTVSAEAPMLARLSFQRQMR

SEQ ID NO: 141455 - protein, 86 aa, Triticum aestivum
  Clone ID: PAT_TA_35873.pep
SSLARCHPTALAKNKEILSWELKKNRTGKYVSLDSPASILTSLFNGNYMFWLGINKKMRNSLICRKVFFWLNLENPVETLIHVCGF

SEQ ID NO: 141456 - protein, 51 aa, Triticum aestivum
  Clone ID: PAT_TA_35874.pep
CLSADSGLNCLGKHLVKLRYLISECGHSMMDNILCVHDAKLLFRVLPVHKK

SEQ ID NO: 141457 - protein, 118 aa, Triticum aestivum
  unsure (1)..(118): unsure at all Xaa locations
  Clone ID: PAT_TA_35875.pep
MELVGSWRKVMPYMAMVFLQFGYAGLFLLSVASLRQGMSHYVLVVYRNAIAAAAMAPFALWFERKTRRKMTLSLFYKIVVLALLEPVLDQNFFHXGARYTTGSFSSXINNVMPGVTIC

SEQ ID NO: 141458 - protein, 133 aa, Triticum aestivum
  unsure (1)..(133): unsure at all Xaa locations
  Clone ID: PAT_TA_35876.pep
AFSVQVLPQFRDAPLPKIPTKVQLALTNKLSTSSXPRELTIDQIRVMMERTLKWLVPMXINTTCARGFLRFSEWAXSGTERVGRGPGRPDVIETLYHAEKAKTEAYILELVVRLHHLVSQSNRPANVKKAQSM

SEQ ID NO: 141459 - protein, 123 aa, Triticum aestivum
  unsure (1)..(123): unsure at all Xaa locations
  Clone ID: PAT_TA_35877.pep
KRPRTIDKVSYSPRXTPLKLADLHNLTRVNKTDLPTVPINSPPTRASSVLNASYKGFLXMVFHNNETDVHTFHLDGXSILVVWMDYSEWTPNTTGSYNYCDAISRSTRQVFTRWWTAVLVSLD

SEQ ID NO: 141460 - protein, 97 aa, Triticum aestivum
  Clone ID: PAT_TA_35878.pep
PALPPPRPPVPSGEWSGELAAAIRLFFSSRGSRCRCEETKQSPEARTVVKQRGDKAFCSMECRENFMEDEMEGEPSIGHSDPSCPSFDNRRIFQLIQ

SEQ ID NO: 141461 - protein, 263 aa, Triticum aestivum
  Clone ID: PAT_TA_35879.pep
MLLKGMPIDDAALECKYTPELALDYLSDGAFGWCFDLDPCLPASFSDYQRLVPCNEGGDEYESWSEYREFYSTPETDRDYLLYWETIVKDLKWIEEHVLKAFSEWHELHEKASCQAVRIAARFTSIHPRLAYYGFLEYKQSTRFYLKFVKDLDSVFFEIWKLVNLQMSFRDAMEHVYEENPFSLRKRDLERELSRPGSLRLEEQFRRCTEGISKEVPEWIARELISQEVRFKCAVPKTYAQYARKKLKIAEVIGLIPEAKIPT

SEQ ID NO: 141462 - protein, 290 aa, Triticum aestivum
  unsure (1)..(290): unsure at all Xaa locations
  Clone ID: PAT_TA_35880.pep
RVCSPFFRYKRGLLYGFTHTSTASGCIQAQYGICLHVDLCLGGFVLPFAHKLGYPIPPFDFSVKGVTSISTDVHKYGLAPKGTXTVLYRNHEIRKHQFVAVTEWNXGGLYISPTMAGKQAXGGLVARAWAAMMSLGXLNGYLESTGKIMEVSKKIQKGIDDITGLFVIGKPDMTVVAFGSDAVDIFEVNDIMSSKGWHLNALQRPNSLHICVTLQHTAIYEEFLKDLEDSVNTVKANPGPISGGMAPIYGAAGKMPDRGTVKELLVEFMDSSCSTIDWLSLCNMYTYKPQ

SEQ ID NO: 141463 - protein, 117 aa, Triticum aestivum
  Clone ID: PAT_TA_35881.pep
RPRAAVHLLSSISLPSSWNGISPSSFSWQHHTAVASAPTASCRCRTEKPRRVADGRRPSHRRLLLAASHRSLLVATASRRGLLLMWTTPSERRPPGGVAGRRDPATASAGRHGAADD

SEQ ID NO: 141464 - protein, 106 aa, Triticum aestivum
  Clone ID: PAT_TA_35882.pep
KIPNIFWNPENHFPYMNLHLRTILKILVIFRTPYETLNYIRPHHYEYPITTLTLPNIKCVTLRVREHAAKIETPFQSIITSRTWMTIMTLPYSTKIFIGLNHNLVD

SEQ ID NO: 141465 - protein, 210 aa, Triticum aestivum
  unsure (1)..(210): unsure at all Xaa locations
  Clone ID: PAT_TA_35883.pep
TLXITEVAPASTAQKDLADNTTTTVAKETSADAEAEQGSPPPAKSTAPSVTHIALMAGKKVLKIPNTYASFLGLIWALIAFKCGIKMPKIIDDSLFTIQTTAVGLSMFASGTFIARQSRFVPCGYAIASVSMVLKFLIGPVVMLLASLAIGMHGTLLHIAVVQAALPLAVTSFVYAEEYKVHADIMSTGVILGIFISLPVTIVYYILLGL

SEQ ID NO: 141466 - protein, 119 aa, Triticum aestivum
  Clone ID: PAT_TA_35884.pep
YTISRWLPLLTHTIGHLGRLKMSIRARFMSLLGVIARWAALTIDPYASGLCTSHSPHFQKCCILRCQITKRVAHVTKKKKRVMFQLAQSSMQEVSFPNQQDKDVGQDTAPDTDDIPGDQ

SEQ ID NO: 141467 - protein, 194 aa, Triticum aestivum
  Clone ID: PAT_TA_35885.pep
GLLSRRGRNVSSSRPMVGSGRFPYSGTPPISNPCASPPASPSPPSPGVLASPWPAHAPGGCPEAILHFLPRAPLGKLRCLPITLPPIAVHEPAQKQVVPHLPGFRVRIKALQLASSTRTSYLCLVLLKHLGFADLKNLFTMPSVIVRTMVAWQRSLSMSVRPAPSHCICIPVMFGDVGHGLAPLLAARNDVQDR

SEQ ID NO: 141468 - protein, 178 aa, Triticum aestivum
  Clone ID: PAT_TA_35886.pep
NRAVFEVLGYCVCIAKGAAETTKLNMALILLPVCRNTLTALRSTALSTVIPFDDNINFHKVIAVGIAIGAGMHTVVHLTCDFPRLVSCPSDKFQEKLGPFFNYVQPTWGTLFASTPGWTGILLVLIMSFSFTLATTSFRRSVVKLPSPLHHLAGFNSFWYAHHLLVFAYILLVMHSYY

SEQ ID NO: 141469 - protein, 189 aa, Triticum aestivum
  Clone ID: PAT_TA_35887.pep
QLSRPPSTSATTVVTNLPGFDGPLPCYIETGDVGAVEETGAELFYDFAKSERSPGTDPVILWLTGGPRCSGFGGFAFEVGPVKYVRAPYTGVLPRLVQNPLSWTKMASIIFLDSPVCSGFSYARDPKGCDVGDYSSSLQVQRFLNKWFTHHPQYLSNPFYLGGDSYAGKVIPLIATYMSQDLPSHMQIT

SEQ ID NO: 141470 - protein, 173 aa, Triticum aestivum
  unsure (1)..(173): unsure at all Xaa locations
  Clone ID: PAT_TA_35888.pep
HAGNQVPAGERGEVCIRGPNVTAGYKTADPGANEAPCPHGWCRTGDIRVXGRRGAYGSLVGRIKELINRGGVPREGTSVALGEEEVLAVAQKVLVAVPVHKYGEEIHCAVIPGEGEALGDKEVEAFCRKNLAAFKEPKKVYIAADLPKTATGKIQRRIVAQHFFVVPAAAARA

SEQ ID NO: 141471 - protein, 91 aa, Triticum aestivum
  Clone ID: PAT_TA_35889.pep
RPGHSRFMGSHASSEYDTSQYNEDLKKFRKMALGTSSFQSSQLTPSSGEHEQEHQNPSVPSSDGHQQTQEVELGTSTKRDDGDVESQASMR

SEQ ID NO: 141472 - protein, 268 aa, Triticum aestivum
  Clone ID: PAT_TA_35890.pep
EHAFGSDETKQDLAIVPPNTTVYYDVELVSFDKEKESWELKANAEKIEAAAKKKDEGNVWFKMGKYARASKRYGKALDFIEYESSFNEEEKQLSKPLKVSCKLNKAACKLKLKDYKEAKNLCTEVLEIDSTNVKALYRRAQAHMHLVDFDLAEVDIKRALEIDPENRDVKMGYRRLKEKVKEYERRDAKFYGNMINKLSKLEDDEGCGSSQGPSKKPRSLWPLAPFFTTDGSKLWLVLRLLIPVMILVALCVAYYVQSGVHEIDCVNC

SEQ ID NO: 141473 - protein, 150 aa, Triticum aestivum
  Clone ID: PAT_TA_35891.pep
HHKDMVYQPGEKAYLRVTPMKGAHRFGIKGKLAPRYIGPFTILERRGKVAYQLELPPNLSQVHDVFHVSQLRRCFKDPIRAVDHEVLELQQDLSYKEHPVRILDQAERRTRQKAIKFLKVQWSNHSEDEATWEREDRLCEEYPALFPSTS

SEQ ID NO: 141474 - protein, 55 aa, Triticum aestivum
  Clone ID: PAT_TA_35892.pep
IHHEARHPKLPFDPDKINNLHGSTAAAPAAAAVASTSKPKPGIRGSLKKTGDEQK

SEQ ID NO: 141475 - protein, 111 aa, Triticum aestivum
  Clone ID: PAT_TA_35893.pep
MTGKAKPKKHTAKEIAAKIDAATTNRGGGKAGQKDRLGQEKGGHAKMECPLCKVTAPDVKSMQIHHEARHPKLPFDPEKINNLHGSTAAARASPPPPSPSRRPRQPQEDVI

SEQ ID NO: 141476 - protein, 117 aa, Triticum aestivum
  unsure (1)..(117): unsure at all Xaa locations
  Clone ID: PAT_TA_35894.pep
MTGKAKPKKHTAKEIAAKIDAATTKPGRGEGRAGRPDRVGEGRGAASXECPLCKLTARRATSMPLHHPARHPNLPFAPDKIPNLHGSTAAXPAAAAVASTAKPKPGIRGSLKKPGVI

SEQ ID NO: 141477 - protein, 340 aa, Triticum aestivum
  Clone ID: PAT_TA_35895.pep
VRPLGQSAAAGVGGQTTGTRTGAVPCGMPAALSIPADKPELGGTREDAEPGASGRPAPRGGAGRLRPDGRRRPTKRCGATRQSGDAGDSASAASTSAAARRGQQALQALVSRRALVSRGGVAASAAPSASPAPAAGPPAGTPGALGRPDRGGKLYSGLMISRFRNLPSFGTPLSGVAAQAGVRNTMEDLTLNRAVMDTLSSMVQNVDAPQRGQGGFDLASMMQQMMPVVSQVLGGASPRRAGTDVQPPRNDREVSGAAGGRSSQMDLQEACQRIEQHDAPEDIFGAVLETAAQAYGDDESIEVMLEELASDPELADEYMKLLLEQVGERVESESEAKTQS

SEQ ID NO: 141478 - protein, 149 aa, Triticum aestivum
  unsure (1)..(149): unsure at all Xaa locations
  Clone ID: PAT_TA_35896.pep
EIDWENLTNKQLHDKFXQMMSGQVQDVLNRFDEAMEKIDGIEKTFETXLDSKFNELLAHFPQPPPAAPIALLQQQQQRPFRISMDERSVFLLRVAKLLVLLSLLLMLLWLLLLLLLVPRRIMSMRAIMRMRLIKTKATCNRQHLHQQVD

SEQ ID NO: 141479 - protein, 94 aa, Triticum aestivum
  Clone ID: PAT_TA_35897.pep
KSRIMDATNKATGHGGATGPAGNHGGAPAGAGAGGVQQLQATRDDRKTDGGLGRSGGPTGNHGGAPAVGAAAAGEKKGVVENIKEKLPGAGGQQ

SEQ ID NO: 141480 - protein, 204 aa, Triticum aestivum
  unsure (1)..(204): unsure at all Xaa locations
  Clone ID: PAT_TA_35898.pep
RRPALRRPLPAEPPAPSAGLGAPVPVPRRCAPPGFAHAAGLVALHAPCRSRFSGRAFLRPAQAIRRLAVCRSLAPVPGRLAGLGLAVGGGATVRGTPSSYCVRLLRDAGAREVHMRISSPPVVGRCHYGIDTPDGKELISTRLDXEGVREMIGCDSLRASXRLDKLHSIYGDEADELCDACFSRNYPVPMPEKVPAMASADDED

SEQ ID NO: 141481 - protein, 338 aa, Triticum aestivum
  Clone ID: PAT_TA_35899.pep
QAYDYSGYQTQGQQQSYSQQPGYDQQSYGASGYGSAANSTQDGTAPSYGGPGGAGQASPGQQASTPSSGGQPGYPSQPPTSAVASSYPVQGSAPPSGYVAPHTQPGYGTQPPPQGAYGQGGYGQPPQAQKPPSSAPTYGQPPHAQAGYGQYGYSQQGYGAPPPYPGAPTASQPGHRQQQSYGDPYATGSYGQPTAYSTEATAPAASQDQSAAAPAPTTATAAPAPANSGAPQTSPTCLSTSYPPPAQAGYVQYGYSQQGYGAPPPYPGAPTASQPGYGQQQSYGDPYATGSYGQPTAYSTEATAASLDQSAVAPAPTTATAAPAPAPANSGAPQTSPS

SEQ ID NO: 141482 - protein, 121 aa, Triticum aestivum
  Clone ID: PAT_TA_35900.pep
AALPLSRAEASSDSRALESPSKLSCFSTRAWSSCRTSATRASCFSRSVRSKAALLSTLDTASFRVATSFVAPAIPTLFLSFFATKSFSIRYYFHKVLLTFLILELLLGKAELILGPFEALL

SEQ ID NO: 141483 - protein, 156 aa, Triticum aestivum
  unsure (1)..(156): unsure at all Xaa locations
  Clone ID: PAT_TA_35901.pep
FLIDTRMKKXFDTIVPATLLIGYLSKAQFCTLSGHPISKPIWTDLSDWDILDRFGRICRNLFHYYSGSSKKRTLYRLKYILRLSCARTLARKHKSTVRTFMQRLGSAFLEEFFMEEEQVFSLMFTKTTXFSFCGSHTERIWYLDIIRINDLVNPLN

SEQ ID NO: 141484 - protein, 183 aa, Triticum aestivum
  Clone ID: PAT_TA_35902.pep
SQTHNSMAAKIFFNLGVVTRGKCHLPLLESSSLLFSWMHLPRIPNTVINGTLAFFTLFLAVIAFSHFVDQTQSVLHWMPAAYVQGVAGPLVSEIVTKQRKNPKPLQYCTYLSHSKYNTPIYTNLPRPSAALLFLGVSPSPKSSCHAVPDAWCRRSGGGLGAAAARGISQPPLQERPAAQHILT

SEQ ID NO: 141485 - protein, 78 aa, Triticum aestivum
  Clone ID: PAT_TA_35903.pep
SQKIHDMGDMEKSLPSLLEHSLIAWTSWVNRWTPPTSPGRHDAADFLDAACHRSSITQFLQFLSAVSSYIFLSCELIM

SEQ ID NO: 141486 - protein, 196 aa, Triticum aestivum
  unsure (1)..(196): unsure at all Xaa locations
  Clone ID: PAT_TA_35904.pep
MYLYCHALVPPYLLYLIHPYRLLPSVVLLSLRPVMSILVVATKLSHTAVMLFIVKREFEDYGLCCRYFYIHERYHLEDGIRFRIPSKRCMLEFALAVLPMSVEAIVGIRVVDGSWPDHCPGLVVCSTNSVKEGKVVLLDFQNGELPTKSDGVVELARRVGSVDYPXGKLTVSVEASRGRFFARGTGDFGMKVARGK

SEQ ID NO: 141487 - protein, 104 aa, Triticum aestivum
  Clone ID: PAT_TA_35905.pep
ICFKPFGIVSTALHIALCSLPYSSRLEANQYAGALSLFVIISALRAYKQLRLPLAWRGGTKKTAAGRINKKIAAENKKVVTRNQPVPMPLFGPGSLDQPGLKGH

SEQ ID NO: 141488 - protein, 111 aa, Triticum aestivum
  Clone ID: PAT_TA_35906.pep
LLFTAGGKNIRNRSTNIYMAPTNPKEWKEPPAYTRYLLYVETSDLPTKKKRKQHGKLYNSKFPDIIVLRAIFPIDLTHLRPESSPSSRASFPSSYLFGSRGHFQYSQAMAH

SEQ ID NO: 141489 - protein, 146 aa, Triticum aestivum
  Clone ID: PAT_TA_35907.pep
QTGMMHYEEASYFLLRLAILGRPLPALCRFDEDAPRASVLVSSAHSSVGVDKPILLPPSETPAISSHASLVPPTVSPPDRSTAVSCSSSSAQNPPPVKRYSFGAESVWSSYNSKPKGSSFRSSAVPGSMCIWSLFSSLVPCGAGRV

SEQ ID NO: 141490 - protein, 169 aa, Triticum aestivum
  unsure (1)..(169): unsure at all Xaa locations
  Clone ID: PAT_TA_35908.pep
RKTEAIACVSSERKERGQIETSLRSEENFLHLKAENDMQRYKSEIRALEQQISQLKISLDASXTAAPKWGTDDKTRALRLSEGRKNGGNAQVLANVAGAAALDLDFDDIQRDRECVMCLSEEMSVVFLPCAHQVVCAKCNDLHDKQGMKECPSCRTLIQRRVCARTVGC

SEQ ID NO: 141491 - protein, 290 aa, Triticum aestivum
  unsure (1)..(290): unsure at all Xaa locations
  Clone ID: PAT_TA_35909.pep
MEGKEEDVRLGANRYSERQPIGTAAQGGGDDKDYKEPPPAPLFEPGELKSWAFYRAGIAEFIATFLLLYVTVLTVMGVSKSPSKCATVGIQGIAWAFGGMIFALVYCTAGISGGHINPAETFGLFLARKLSLTRAXFYIIMQCLGAICGAGVVKGFQQGLYTGNGGGANVVASGYTKGDGLGAEIIGTFVLVYTVFSATDAKRNARDSHVPILAPLPIGFAVFLVHLATIPXTGTGINPARSLGAAIIYNKDHAWNDHWIFWVGPFVGAALAAVYHQVIIRAIPFNKSRS

SEQ ID NO: 141492 - protein, 289 aa, Triticum aestivum
  unsure (1)..(289): unsure at all Xaa locations
  Clone ID: PAT_TA_35910.pep
MEGKEEDVRLGANRYSERQPIGTAAQGGGDDKDYKEPPPAPLFEPGELKSWSFYRAGIAEFIATFLFLYVTVLTVMGVSKSPSKCATVGVQGIAWSFGGMIFALVYCTAGISGGHINPAVTFGLFLARKLSLTRAIFYIIMQCLGAICGAGVVKGFQQGLYMGNGGGANVVASGYTKGDGLGAEIIGTFVLVYTVFSATDAKRNARDSHVPIVAXPLDRLGFAGAAWFNLGDQSPISGTGLNGGRSPGAPLMYNRLQPWNDHRISRLGPSVGAALAXVYHQGVDQSEFR

SEQ ID NO: 141493 - protein, 130 aa, Triticum aestivum
  Clone ID: PAT_TA_35911.pep
DLELDSKTRASELSVALKTAISAKAEAQKALQELDAVKKTAASKAFSMESRHIKVNYLLLTRIRSSPGAFADLPRSVSDAAAFYRATEGTLTEKVFWSQYAEAGHPVPLSDQLKQLVELHKAAKQALKGF

SEQ ID NO: 141494 - protein, 123 aa, Triticum aestivum
  unsure (1)..(123): unsure at all Xaa locations
  Clone ID: PAT_TA_35912.pep
KLHAEAGKGXFEVALKYVLCTLAADNLIYAREIIKSVARKHGLIATFLPKPDLNDIGSGSHVHLSLWKNDQNVFMGSNEYSHYGMSNVGEQFLAGVYHHLPSILAFTAPHPNRIKSCRLCYQT

SEQ ID NO: 141495 - protein, 521 aa, Triticum aestivum
  Clone ID: PAT_TA_35913.pep
RPPTRPDGYAFPETYYLGSRRARDVVYRVLSAASEDGDLSIQEAIDAVEDIFRRNASDLYKLNVANGSIHQKTIADNRIASSCVEQDVLFVRIVWNDASGQHRCRVVPAGRFYEIARNKGVGLTFASMGMTSFCDGPADGTNLTGVGEIRLMPDMSTLLRLPWSTREEMVIADMQIRPGEAWEYCPRYALRKVTKVLLDEFNVTMKAGFENEFYLRRKLVSEGHERWVPYDNSSYCSTSSFDGASSILQEVYSSLKVANIVVEQLHAEAGKGQFEVALKYVLCTLAADNLIYAREIIKSVARKHGLIATFLPKPDLNDIGSGSHVHLSLWKNDQNVFMGSNEYSHYGMSNVGEQFLAGVYHHLPSILAFTAPHPNSYDRIQPNTWSGAYLCWGKENREAPLRTACPPGVPLDMVSNFEIKSFDGCANPHLGLAAIVAAGIDGLRKGLKLPEPIESNPADYATKLKRLPQDLLESVESLAADKTLHELIGDKLITAIIAVRKAEIDHYSKNPGAFGDLIHRY

SEQ ID NO: 141496 - protein, 210 aa, Triticum aestivum
  Clone ID: PAT_TA_35914.pep
MLPNFNECWWDSIILDILICNWFGIWAGMHTVRYFDGKTYEWVGLSRQPSIMGKVKRSLSQFTPAQWDKDQWQPFMGPLRFIQVLFLCVVFMMVELNTFFLKFCLWIPPRNPLVVYRLILWWLIAIPTIREYNSYLQDSKPVRKVGAFCWLSVAICIVELLICMKFGHGLFHDPMPTWLIIFWRSAGVAFVIFLLAWSWRNHQKFRRKNL

SEQ ID NO: 141497 - protein, 88 aa, Triticum aestivum
  Clone ID: PAT_TA_35915.pep
CVYNNSSATTPVNSVRLVICVHDTPAVAAGGNRGEGRKAPEGDAVTALGADPSETQLMMVRRRRRRKHKSSNSVVIVRFTPATTEGEC

SEQ ID NO: 141498 - protein, 125 aa, Triticum aestivum
  Clone ID: PAT_TA_35916.pep
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLY

SEQ ID NO: 141499 - protein, 214 aa, Triticum aestivum
  Clone ID: PAT_TA_35917.pep
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMGHNGIEYGDMQLIAEAYDVFKSVWKLT

SEQ ID NO: 141500 - protein, 84 aa, Triticum aestivum
  Clone ID: PAT_TA_35918.pep
PEFAQEIMDRQAAWRRVVCLAINNGVSTPGMSASLAYFDSYRRERLPANLVQAQRDYFGAHTYERVDMPGSFHTEWYKIANSKI

SEQ ID NO: 141501 - protein, 172 aa, Triticum aestivum
  unsure (1)..(172): unsure at all Xaa locations
  Clone ID: PAT_TA_35919.pep
QGDYSSGETVDKAQLIEDVRKALYASKICSYXQGMNIIKAKSTEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 141502 - protein, 549 aa, Triticum aestivum
  unsure (1)..(549): unsure at all Xaa locations
  Clone ID: PAT_TA_35920.pep
ESETDTGPSAQTQHLPPSSTHAQRRQIGGVQDGSGPAPGRTRIAPTPLPSHSPSSSRACTQRRDAIPNTSTGLAGRGVMRHNLGLNIAVNGFPISVYNRTTSKVDETVHRAKLAGNLRLXGSYDPASFVNYIQMPRVFIMLVTSAAPVAQTLAALPAHLEQGDCICDGRNGXYDSKERREKRTEQGGLVVLEVGVPGGGEGGRHGPSRMPGGLLEAXYQYIEDILLKAAGHVAAHGPPSRLHHGGGDRATKFGKLVQNGDERXIRESCGGAEGRSPVRGGGGEQGVGAEYGGWERGVESSDSSLMFSAARDDXGEGYLVDKVLDKTGMKGTGKWTVQQAAELSVAAPTIEASLDSRFLSGLKDERVAASKIFQGRLLQRLRTVDKAQAXRGNVRKALYASKICSYAQXGMNIIKAKSTEXGWGLNLGELARXIWKGGCIIRASFLDRIKNAYDRNGELTNHLNNPELAXEIMDRESAWGRVDCHAIDXGASTPGISASLASSDPDRRDWLHPHLLHPEXSTFPGAPTYQGADMPGSLHTQWHEIANAKI

SEQ ID NO: 141503 - protein, 159 aa, Triticum aestivum
  Clone ID: PAT_TA_35921.pep
MGRRFPAAALAAAVRPYARFSPAASKAAKPPTAPLDTPRNAGPGAAAGASSGRAEVRDVAAACGMQEDDRVPLAEVVLDCTKRWFQDTLKEARAGDAAMQVLVGQMYRSGYGVNKNEHKSRIWMEKASRYRSTVWKVCNKRPGYNASDSDSDDVKETGK

SEQ ID NO: 141504 - protein, 171 aa, Triticum aestivum
  Clone ID: PAT_TA_35922.pep
MAQREKSSVAVASLSSSAPTAVPSGERWGAAIGNLGELGANVESLQKLLARKAVFVDDDVFSKASLASEQARSIKILDQRVQSLERELDAAISAAARARTEKRQAEAAQRAAELRAQEVTKELENTARVFQLHMEELRAKQEEIAKRDSDIKVLEAIIRTLSSKDDGGSSE

SEQ ID NO: 141505 - protein, 48 aa, Triticum aestivum
  Clone ID: PAT_TA_35923.pep
LYLHTSQVMIRRRVKSTSKGDEICLHYTLTSMYITCYVHDHLACLLTY

SEQ ID NO: 141506 - protein, 72 aa, Triticum aestivum
  Clone ID: PAT_TA_35924.pep
RGLRFSDTLSYDGTNFDVWVIPMLNPFRVMDPNLERIVDMGFSPPNDPQRLSLEDDKNSYLNAQLLMCFLML

SEQ ID NO: 141507 - protein, 241 aa, Triticum aestivum
  Clone ID: PAT_TA_35925.pep
MQSLPWAIIRSVSRVGSAAPRWWLPALARRDAPPLMESAPSYPNQHLYKIFREKHSKLDLPCLSFCSATTRGMDKAERMKAAEESNPMVETSAIQDVYYQPIIPGSSHRDGTIYKKRLEWESEYCVDVDDRTETQLEPASWDDMTCEMMQIFSLKLAKSPINSGSMQLYGYIAARDEYDLRLNYLFNRSREDPIVVQQGSLIQMTGPKRGIAFHCDVLLEFDMRIKNGENKGDDTQLIDGM

SEQ ID NO: 141508 - protein, 151 aa, Triticum aestivum
  Clone ID: PAT_TA_35926.pep
PTMHADQLLPAVVAAVAMACLLIAGRADGLEEYAPSAAVSLEIEPLSMNQNPGEFLPRPEVMSLPTDLLSRPDVGGDGEGYVPQVEVVPEVVLQPGDPLAEALGGGSYAEEPSTEPVTLMGEQGDIYRTGATPSPAQPPAKPSSPGQKKAG

SEQ ID NO: 141509 - protein, 516 aa, Triticum aestivum
  unsure (1)..(516): unsure at all Xaa locations
  Clone ID: PAT_TA_35927.pep
TGEIAPPRELLPFFSAAQKDPPSPPYAADAASAKRSASGALPSSSSCEKFAAPRSHENKLHYNVLRAEEGGDSELVRQAERNRLAPFPFFDEVIDLEKRWRQRQFELDKIRQELNKTRKEIGKLKTKKQDATQVIQSTEEIKKRLAAKETEVXEAKTTLDAKLVTIGNLVHESVPISSDEANNAIVRTWGEKRLEEKLKNHVDLCIMLDIVSLDKGADVAGGRGFFLKGDGVLLNQALINFGLSFLGKREFTPMQTPFFMRKEIMAKCAQLAQFDEELYKVTGDGEDKYLIATSEQPLCAYHLGDRIYPADLPIRYAGFSTCFRKEAGSHGRDTAGIFRVHQFEKIEQFCATGPNDNVSWEMHEEMIKNAEDFYQAIGLPYQLVSIVSGALNDAAAKKYDLEAWFPASKTFRELVSCSNCTDYQARRLGIGYGQKKNDEQSKQFVHMLNSTLTATERTLCCILENYQREGGVKVPEVLRPFMLGIDFLPFKRPLVDSKQAAADSKPNKSKPKGNAG

SEQ ID NO: 141510 - protein, 272 aa, Triticum aestivum
  Clone ID: PAT_TA_35928.pep
LKDLKLRSCRLVDRHSALKIDTPHAGLENLWFISFRCALIELISVPKLRIFWCWSRKNPPVRCGYVPELYKVELGSRAKASQVPFALSECFSRSATNLSKLYLNFGSQMIWIKPEHPKELTSIFNNLTSLALFNIFSECNLSWTLFPLDGPPALPVSGSPRSQRPGARVSKVGPARSTLAREPSKDLKHLNLKLFIMFGFEDEDKVTNYIRLVMERAVGLKRIELHGRSPCNGCDAIDLESLRRSQADEASRHRIKEQLRHGSSSSVEIVIC

SEQ ID NO: 141511 - protein, 231 aa, Triticum aestivum
  unsure (1)..(231): unsure at all Xaa locations
  Clone ID: PAT_TA_35929.pep
DVILFEGNRTMLFRTTLALLDLYGPALVTTKDAGDAITLLQSLAGSTFDSSQLVLTACMGFQSVKEMGLRELREKHRPEIIAAMEERSKDRKSWKDKKGLATKLYSFKHDPSSVCPQVDSKEGADGLQVNGDSGSTTLXSYLTGSALENELDEGIDLQDQVTWLKVELCKLLEEKRSAELRAEELETALMEMVTQDNRRTLSATVEKLEAEVSEFRKXFEDKQEQEKAINS

SEQ ID NO: 141512 - protein, 276 aa, Triticum aestivum
  Clone ID: PAT_TA_35930.pep
LARMQLAKKNNFSLDQQKPNDEATVDINVATVSEALRRALGYFSAIQAHDGHWPGDFPGPLFTTATMMRVLYVTESLGTTLSSEHRKEICRYLYNRQNIDGGWGLHAEGESSMLSSALNYAALRLLGEGADDGPDMSMPKARKWIHDHGGATMIPILGKVWLSVLGVSEWSGVNPMPPELFLLPSFVPIQPGRLWSHFRMAFIPMSYLYGKKFVGPITKLVLSLREELHIHPYKKINWKQARKLCAKEDAYHPHTWLQECLSDCLYSFGEPFLACW

SEQ ID NO: 141513 - protein, 162 aa, Triticum aestivum
  Clone ID: PAT_TA_35931.pep
PDEAYWRSVKPGLPCPAMSRQNVLAKERGQPPRTPEARPSPIPSLPLSPFFQIMPSWPDVQRQTAARGPGRQSHKGEEEKHSQVAASNGHHEGETRRRRSIRWGAERGGRSAKPRRGKGAAQATAGSRAAGGALPGRVSSAGGRDGMKPSEDVPNLYLRMFR

SEQ ID NO: 141514 - protein, 134 aa, Triticum aestivum
  Clone ID: PAT_TA_35932.pep
IISRRHSIIITTLHIKTLGGGAKNIIFIKRSIPKLGTNINCSKYILKNIIFFKHSIPKLGPFHIISIITLIISSMDSTNSIAIIIFQASAKKIFKIIRSIIIFPIIIITTSNRHNEIIIKCIIFIIFVRHNNNR

SEQ ID NO: 141515 - protein, 288 aa, Triticum aestivum
  unsure (1)..(288): unsure at all Xaa locations
  Clone ID: PAT_TA_35933.pep
GLLTADAARSLVGSVDAFLFDCDGVIWKGDELIQGVPETLELLRKLVCRTGRSGSKSTALITKWRTICAPGPLSSLPXLGKKLVFVTNNSRKSRRQYSKKFKTLGLEVTEEEIFTSSFAAAMFLKLNNFSPEKEVYVVGEDGILDELKLAGFECFGGPEDGKKNIMLEANFYFDHDKSVGAVVVGLDQYFNYYKMQYASLCIRENPGCLFIATNRDPTGHMTSVQEWPGAGTMVAAVIXSVQKEPIVVGKPSSFLMDFLLKSFNLETSRMCMVGDRLDTDILFGQNTG

SEQ ID NO: 141516 - protein, 278 aa, Triticum aestivum
  unsure (1)..(278): unsure at all Xaa locations
  Clone ID: PAT_TA_35934.pep
MAEGLLTADAARSLVGSVDAFLFDCDGVIWKGDELIQGVPETLELLRKLGKKLVFVTNNSRKSRRQYSKKFKTLGLEVPEEEIFTSSFAAAMFLKLNNFSPEKKVYVVGEDGILDELKLAGFECFGGPEDGKEKXMLEANFYFDHDKSNXVGAVVVGLDXTSNYYKMQYASLVYIRXNPGCLFIATNRDPTGHMTSAPEGPGAGTMVAAVFRSERIDLVTAGKPLGGVRVDPVKLFGQNTGCKTLLVLSGETTLPDLQDAANTIHPDLYTISVHAVVQ

SEQ ID NO: 141517 - protein, 56 aa, Triticum aestivum
  Clone ID: PAT_TA_35935.pep
SLLDSKKKKKKKKKKKKKKKKKKKKKQKKKKKKKTKGKKIQQRKKKGKNKKKKRGR

SEQ ID NO: 141518 - protein, 194 aa, Triticum aestivum
  Clone ID: PAT_TA_35936.pep
MYDGEALKPCLWETDQVFSYPDGTIYWVDYHRGLLSCNVLSAGENLELRFIQLPGIEIWTELDDLSYGRVYPEAYRTVGVCKGIVNFVDIDNGFFGSMKKSGFTVTVWTLKMPELEWHQTSMFQVDDLWALANFRESSLPRWVPQFPIVNTHDNHGLYFILQECDSFGEDWIITVDMHNKVLQSYERRIYSILE

SEQ ID NO: 141519 - protein, 169 aa, Triticum aestivum
  Clone ID: PAT_TA_35937.pep
GSTLMDESVVAESPRNMVLNTIRKMKPHVFIHGVTNGSYNAPFFVSRFREALFQFSAHFDMLEANIPRDNEERLLIESTIFSREAINVISCEGMERMERPETYKQWQVRNQRARFKQLPLDQEIMKRAREKVKCYHKNFIIDEDNGWLLQGWKGRILYALSTWKANPQF

SEQ ID NO: 141520 - protein, 249 aa, Triticum aestivum
  Clone ID: PAT_TA_35938.pep
DPRVRLRTLQGVHESRVGSLAWNKSILTAGGMDGKIVNNDVRIRDHAVQTYRGHSQEVCGLKWSGSGRQLASGGNDNLLHIWDVSMASSTQSAGRTQWLHRMEDHSAAVKALAWCPFQSNLLASGGGANDRCIRFWNTHTGACLNSVDTGSQVCALLWNKNDRELLSSHGFTQNQLTLWKYPSMVKMAELNGHTSRVLFMAQSRDGCTVASAAADETLRFWNVFPDAPKSAVKEKTSQSRLFNSYNHLR

SEQ ID NO: 141521 - protein, 89 aa, Triticum aestivum
  Clone ID: PAT_TA_35939.pep
LTTGMSDWSECPELGPIGDLLVSKDFQTKASVLVVQSYGRAAAAAAASTSSEFAVGEAVLPAPEAIMPATSMGHPPRRPRQHSHSDLML

SEQ ID NO: 141522 - protein, 70 aa, Triticum aestivum
  Clone ID: PAT_TA_35940.pep
FFSLYTLSYGFTLFWPCFFAFLCSSNSCEANTQVDRNPVFTNALFPMCIPIIFRCFSMTYPYVFRIMQGK

SEQ ID NO: 141523 - protein, 266 aa, Triticum aestivum
  Clone ID: PAT_TA_35941.pep
MAAETKPSSGTEAAAATAVQFQVDEAYEYRAPKYFDFVLDETEADIRAAERWFEAGASHAPSPFAPRIKESRAEVKIDALCDFADAEDPAPSPNNQATEEAAVNAPNPAGDIDGTSACPDTMSESPPTEEKEESPKSFEFPLSKDLAAKSDVGSSTPKIQRPPPPAEVTTAATTRAKSTVKAEACTPKVQGSSSTRSKTVQPSNLKQSSLALKKKSAIKGARDAVAGNAAAAANDIRQENQAVKRQKLDDGSTRQILNVKSRVLLH

SEQ ID NO: 141524 - protein, 229 aa, Triticum aestivum
  Clone ID: PAT_TA_35942.pep
MTRRSPATTHHRLLLLLLPLLLIGSFLLPLSSAYRPGDIIPMLRSGQYHGSRSVWFDVIGRHCPVFAVNREVLVPIPKPTGFTGADPYKITFQIGHEKFHVPWLYVINRKSSEVPLIDFHLKYTGNDLLGVTAKVVDMPHHFVELHPDIKKNFWDPQNWPKYVLVSYTWEEQSEIDVTAGFYVLFGSGLVLSFILAIYVLQSSQDKLTRFVREAVSDSSLPEGGVAKVE

SEQ ID NO: 141525 - protein, 200 aa, Triticum aestivum
  Clone ID: PAT_TA_35943.pep
MARKRKTDAAPRLDEADRTLYSSFCGAANSLSQLYSQAMAQQKLSFQAGERHALEKLHQWILRKHDEESRLTVADIMSHIQHEIDYGGTDAHVSPRVHQHPMSVNPFTSIQPSAGSYAQATSGHAPRPSLSDQSKNTIFSNALSSPVRRSLQTYHLTQGAGNGGRNTEANSAGQNREANSASSNDTSMDMVSDSAGNGYY

SEQ ID NO: 141526 - protein, 77 aa, Triticum aestivum
  Clone ID: PAT_TA_35944.pep
GIVNVTSLPSIAYLVCASLVRGLELCLLMMLSLFFSRCNTRTASLYLSLIIKHGLTLSGSPSQYAFFSCHNTLLQFI

SEQ ID NO: 141527 - protein, 126 aa, Triticum aestivum
  Clone ID: PAT_TA_35945.pep
TREDEFLILASDGLWDVVSNEVACHVVRSCVRSFAARRPRRPCPASNLAPGRSGARRSGSTSGDEAQNDGGGCADARSESDEESGEEVDEACAEAAILLTKLAIARQSPDNVSVVVVNLRRRRPRF

SEQ ID NO: 141528 - protein, 147 aa, Triticum aestivum
  unsure (1)..(147): unsure at all Xaa locations
  Clone ID: PAT_TA_35946.pep
RLGVFNCAPLSLLRPGCEDARDAAGFRSLLGCALEAPPVCCSAARRLRTRRECTRGYAAPGDDVCAXAAIMSVEGIIKVSVXHYDISYFAPAQXHEEVEMDGRVVDRKGRMTAVTTEVRKKESGALVAIGRQWMTTSRPKGYQGSKL

SEQ ID NO: 141529 - protein, 138 aa, Triticum aestivum
  unsure (1)..(138): unsure at all Xaa locations
  Clone ID: PAT_TA_35947.pep
MFYFAAACMTWELAESGVHFITTVINGADLVPTFSAAAVDDLRSEVTASAWLNDLRHQIEQTRILSTFYRSASALGSRLPSMANAKARVAGAGAILRPVSNGTQVVMRRAHSVAQAAWTRPGLQQSSXXXCIGPKATE

SEQ ID NO: 141530 - protein, 62 aa, Triticum aestivum
  Clone ID: PAT_TA_35948.pep
RSKKNTYHVACKNIASSKVHHERRRKRGCCSWGIPKLRLLLLVESLGVPWASPRLGSRHCIP

SEQ ID NO: 141531 - protein, 482 aa, Triticum aestivum
  Clone ID: PAT_TA_35949.pep
RGPRIQCKGGSNTIPNGIFKPKELKDGTVAWLAACLAAAVADPSSEPRSYQAAPRIPHWREAMEQEFHALLRNKTWTLIPPPPRVNIIDSKWVFKVKKHSDGSIERYKARLVARGFRQRHGLDYEDTFSPVVKPTTIRLLLSIAVSRGWSLRQLDVQNAFLHGFLEEEVYMKQPPGFSDPDRPDYICRLSKALYGLKQAPRAWHARLASALRAHGFVPSTADTSLFLLQKPEVTMYLLVYVDDIILVSSSQYAANALVCSLGADFAVKDLGKLHYFLGVEVTSRATGLVLTQKKYSLELLQRAGMLKCKPTTTPMTSTDKITAVDGELLSPADATEYRSIVGGLQYLTITRSDISYAVNRVCQYLQAPRDTHWAAVKRILRYVQFTLTFGMHIRPTSSRVLSAFSDADWAGSPDDRRSTGGYAVFFVSNLIAWSARKQATVSRSSTEAEYKAVANATAEIIWVQSLLQELGLSQPQPPILWC

SEQ ID NO: 141532 - protein, 187 aa, Triticum aestivum
  Clone ID: PAT_TA_35950.pep
MTIDHYRESTRIYHMSGMRVIDPERRSSSKSVCTSRLSSAAYFADLKVAKLLRWHVDREEKKREDDANDPEIDKKDKMLSHPKDASQWQALNFEYPEFGNDPRNIVLGASTDGVNPFGSQRSTHSTWPVFVWMYNLPPWLCMKRKYIHMSMLIEGPKQPGNDINLYLGLLKEELDTLWKMPTNTWDA

SEQ ID NO: 141533 - protein, 81 aa, Triticum aestivum
  Clone ID: PAT_TA_35951.pep
PSSAHSAPATAMDKIKAEKARQDDAFADLSNMLGNLKDMALDMGTEIDRQNKSLDTFSDDVDELNFRVKGANQRGRRLLGK

SEQ ID NO: 141534 - protein, 219 aa, Triticum aestivum
  Clone ID: PAT_TA_35952.pep
YIKIATQNKYVPDIMSIVEGESYMRDPGRELAKPVGRRAGDKPGLRMKKILHKDGKESTAVVQKLQQEIREVVRDNGISILEKDNAFDEKLLTAFRSAIGKSMDGPAKKPNLSLARKSLLQKGKIRENLTKKLYASSTGRRRSAWHRDREVDFWKHRCSPGINPEKIETLQSVLQLLKKSSDTGTRKESAEEKKAFLSRLYLADASVVPRKGDIKPLSA

SEQ ID NO: 141535 - protein, 345 aa, Triticum aestivum
  Clone ID: PAT_TA_35953.pep
SSTTPAFPASPQHKTLAHAPCRSGPETHSGNLRNAAMVWFQCEDCGENLKKPKLAGHFRSCSAYKLSCIDCGAVFGQDTVQTHTQCISEAEKYGPKGLNKPSSNAQGKPDKPKPNADVDINVGLSTRPPWFCSLCNTTTTSKQTLLGHADGRKHRAKAKAFHASQKQENGAEQTPSDKETGGAPTTASTELNDGKGADSERDADEDVVKRKRTDSTTSEEPDNAKRQNLSNLKTGEATQSENGEAELKTKSKSAAEELVNDANHQDIKKQKIKWKKIITKILEMNSDGAMKLKKLQKLVIREVLECGLLKDKEQLHALLMDKIASSSRFSVDGKNIRLVAKNEES

SEQ ID NO: 141536 - protein, 184 aa, Triticum aestivum
  unsure (1)..(184): unsure at all Xaa locations
  Clone ID: PAT_TA_35954.pep
MAVKDCGGHKGGGCECHRRRLYRKCCGALLALVILALFIILIVYLVLRPHKPRFYLQDLAVLCLNVTPPTSAYLFTTMQATVAARNPNDRVGVYYDEADMYAEYKGVPITVPTRLPVAYQGHRDQSVWSPYLRSMDSVVLPPQLAIALAQDETAGYVLVDVKVDGQVRXRSARWISGHYHLRVN

SEQ ID NO: 141537 - protein, 83 aa, Triticum aestivum
  Clone ID: PAT_TA_35955.pep
CNLPSVDMHQSIRCQIVRGIHCSTQHAEYHHCSTSRRGKEPSAVVRVVLLLEPHGGASVLLFFLSLIKYTFIPEKGGKRQPNM

SEQ ID NO: 141538 - protein, 306 aa, Triticum aestivum
  Clone ID: PAT_TA_35956.pep
MFSSADNLDFIWKSITSAKSRTTSSQVASPPQPAKSPAKVDVTPPKVHQPSVAPPPKVDYAIDLFNMLSMDGTTEKESESSSNDDSAWDGFQSAEPAPNSEKKGTAKPVESKVQSTSGIEDLFKDSPAVAASSAPVASKSNPQTDIMSLFEKSNMVSPFAIHQQQLAFMTQQQALLMAALKSGNAPQMAPGNAPQMVPGNASVLNANGSNAPNGSLPSHSWPNLGYQNPASIPAAAPQNGVAKAGNNNQDFFSGNFGFGSPGMPANGSTTAGANKSASTPTSSTLPSQSGKEYDFSSLTQGMFSKR

SEQ ID NO: 141539 - protein, 220 aa, Triticum aestivum
  Clone ID: PAT_TA_35957.pep
MFNRLFGKPKEQANAGALATLDKLNETLDMLEKKEKVLEKKAGAELERAKEFSKAKNKRAAIQSLKRKKLYEQQIEQLGNFQLRIHDQMIMLEAAKATTETVDALRTGAKAMKAMQKATNIDDVDKTMDEINEQTENMKQIQDALSAPLGASADFDEDELEAELEELEGAELESQLLEPVVTIPIHTTPVPGKAQPTRPAPQKASAEEDELAALQAEMAL

SEQ ID NO: 141540 - protein, 90 aa, Triticum aestivum
  Clone ID: PAT_TA_35958.pep
MDKVLAFSILSASPADIAAGAGAGASWARFSWQGRKLQDDGQARAGQEGKQGGPPSEAEQQPDKGRSPTLRPRFAPEFDGIDCFETIVCH

SEQ ID NO: 141541 - protein, 94 aa, Triticum aestivum
  unsure (1)..(94): unsure at all Xaa locations
  Clone ID: PAT_TA_35959.pep
MDKVLAFSILSASPADIAPGAGKGGSWARLSWRGRKLQEGDRARSRAPREAGRPAAGRQSNSRAKGNRSRXSTLPPRFAPEFDGIDCFETIVCH

SEQ ID NO: 141542 - protein, 114 aa, Triticum aestivum
  unsure (1)..(114): unsure at all Xaa locations
  Clone ID: PAT_TA_35960.pep
ASAQYVLLGAADVFAMVGMQEFFYDQMPVELKSRGLALYLSVLGVGSFISSFLISVIDGATRRGGXRSWFADNLNRGHLDYFYMLLAALSALELLAFLYFSAAYIYKRKPVNVH

SEQ ID NO: 141543 - protein, 73 aa, Triticum aestivum
  Clone ID: PAT_TA_35961.pep
YLWVQSFNQTQRKIGAYRFTSQPFTSRVMSTIIAHDALHPIGYIYIYQNLSNTMCLPKDKCKKEKVKITITLA

SEQ ID NO: 141544 - protein, 190 aa, Triticum aestivum
  unsure (1)..(190): unsure at all Xaa locations
  Clone ID: PAT_TA_35962.pep
FEQRPVLAYFQGAIHKEKXGWKRFVRKLLQLLKDEKDVHFTYGSVRQNGIRRATKGMASSKFCLNIAGDTPSSNRLFDAIVSHCVPVIISDEIELPFEDVLDYSEFCVFVRASDAVRQGSLLRILRGVTRDQWTTMWRRLKEVAHHFEYQYPSKPDDAVQMIWGAVARKMHSLKLHLHKTGRYQRTHSDS

SEQ ID NO: 141545 - protein, 253 aa, Triticum aestivum
  Clone ID: PAT_TA_35963.pep
HLNDELKVDRPLSCLLYLRLSDCRVTTIELNAPKLQTFIFQGRLVPIHLGESSELHNIVIHSYTLTLEQAICSFADAYPLVQRLTLCHTCALPKFPWRLDNTSSFSHLRYLQLLLNIFSEHANDILSIAYFLEAAPFLQEFDLEFRSSCMDVVPGPLRIFPYGQDKYKYLTIFRVFEFRGEKSKVELIVHVVQNAPSLENLTIDPRRQHVLDDSPASEAEEKRLSEIRHIAKSLIGIKLSPKTRLCVGIAVMP

SEQ ID NO: 141546 - protein, 98 aa, Triticum aestivum
  Clone ID: PAT_TA_35964.pep
FVLTLQLIIQRAMAIQGNQKFQLHVARKVNLTRRCCHLPLPSPSKMWLTLPRSSGCMTRFFSCGTYCVSSIGHENMAIKNCSVLMIVLRDYFIHTALN

SEQ ID NO: 141547 - protein, 41 aa, Triticum aestivum
  Clone ID: PAT_TA_35965.pep
CIPFRYRADETSGDEQKKVVEVLMINSQSGPGLLFPKVLIL

SEQ ID NO: 141548 - protein, 188 aa, Triticum aestivum
  Clone ID: PAT_TA_35966.pep
MARAEHPPEDLADGPRSHITMSVPVDARRLAAGCIPVTYRADETSGDEQKKVVEVLMINSQSGPGLLFPKGGWENDETVEQAAAREAIEEAGVRGDIVQFLGFYDFKSKTHQDACCPEGMCRAAVFALHVKEELASWPEQSTRRRTWLTVPEATSQCRYQWMQEALLTGFSEWHDNWSKGGSAGGDPI

SEQ ID NO: 141549 - protein, 227 aa, Triticum aestivum
  Clone ID: PAT_TA_35967.pep
AHLRPPAPRSSLSARALSSGGLRHISSWTHCPVRKTWTRVFRSPSTMHRPLSRSWRMTELPCGVAGASSTMTPPALSLVCLNPFVHPKDLRRRAQGEVLVHQIRRPHYWRSHGIPFAVRSALLQEWIYADDPILPKVHSPTMLPPLSRSWHTTRVTVWCDRGFFHYDPSCPASSVAPILLPLWDSSWIWYIIITYEEEKGFIVSGKVCGGRLGLRPRHLSLAPVPCG

SEQ ID NO: 141550 - protein, 86 aa, Triticum aestivum
  unsure (1)..(86): unsure at all Xaa locations
  Clone ID: PAT_TA_35968.pep
VSNXKHSLGPATTTFXEIEAIKTGXAKNAKXGIXXTNXLINXDXWTCYNILTSGCLNAXPRESRTFWGFQTCXQEXFLXXGMXVLN

SEQ ID NO: 141551 - protein, 404 aa, Triticum aestivum
  Clone ID: PAT_TA_35969.pep
VHSVLPNLAPQSSHLINMESSPWFTLWSTCAAKETFLSVHVTLRDQTRWAKAGHVLASAQLSLPQTKGFVPHVIALSKSPLTSEQVGDGVIISKNHEWQIKINSQLGTIDSWKINNVELMSKGIFPCFWRAPTDNDNGGFYTKSYATTWREAFLDNVSFYSSQFSVKELPDHTVEVSTTYYGLPGHLPKPDDAALSEASESVLFRVHMRCRIYESGDVILDYEVNPKSDLPPLPRVGIVFNAEKSLNHVTWYGRGPFECYPDRKAAAHVGVYESSVEDLHVPYIVPGECGGRADVWWVALKNADGFGLFASTHGESPPMQVSASYYGAAELDRATHQHKLVKGDDIEVHLDHMHMGVGGDDSWTPCVHEEYLLSPAASYRFSLRLRPLSPSSSCHDIYSSRLPN

SEQ ID NO: 141552 - protein, 78 aa, Triticum aestivum
  Clone ID: PAT_TA_35970.pep
LTGGLAPPVIDPRGVKPLVSRAYPAGRLTPPRPKPRRPSHVLLWRSERCMREFLRSWDCLPHICANVKGCHDRGPEEP

SEQ ID NO: 141553 - protein, 232 aa, Triticum aestivum
  Clone ID: PAT_TA_35971.pep
RTRGCPRTVSCSDILSFAARDAAVAAGLPSYEVPAGRRDGTHSRMADLPGNFPVPGHTVPRLTELFASRGLSQEDLVTLSGAHSIGGAHCFMFSNRIYGFSKTGDSQKSRDPAFAQRLRKMCPRPKPDDNPQQAPKVNFDERTGEKLDNAYYQELLARRGLLTSDNTLALDPQTRPLVEQYAKDDALFHQRFGEAMQKVSKLDVIIKKNNGQIRRDCRMVNKAIEVRWMPIH

SEQ ID NO: 141554 - protein, 171 aa, Triticum aestivum
  unsure (1)..(171): unsure at all Xaa locations
  Clone ID: PAT_TA_35972.pep
MDPKLVEVTQLFDRFKAAFKASNFDVCSTLLSQLKVLLTKFPSLPPRVEQTPNDAYISTELESMRLPRERRQTAPHETYIYFMDLVKTVDXAGCSEKGYDYLSINDAKQMFKFSSDKELQQYIAEEHPEWDVKDGRVLFQKAKESQPCKEIPAAPVINQTLGYARELERIV

SEQ ID NO: 141555 - protein, 283 aa, Triticum aestivum
  unsure (1)..(283): unsure at all Xaa locations
  Clone ID: PAT_TA_35973.pep
MDPKLVEVTQLFDRFKAAFKAHANFDVCSTLRLAAXRVLLTKFPSHTPACSRQTPNAVEMRLNACEGEIYXHGSYFDVGEWNEXNDAFERDLVAAQARITVDQQLLAVSSSSHRNAVSPIIGGASLLRLLVHNRNCXECHIELELLPAKALGKADIKHGVELEQSXFMEGAYNRVLSARQTAPHETYIYFMDLHVKTVRNDRAGCSEKGXDYLSIKGATRSXLRLAPHKELEQDMGRGAPXWDFIGCRVLFQEVKESRPCKLIPGAXVINQNFGYARELERIV

SEQ ID NO: 141556 - protein, 236 aa, Triticum aestivum
  Clone ID: PAT_TA_35974.pep
SARGHVCAGEADLPTDDIVIVDCGELPEGSTEGVANFFKDGDMYPDWPIDLDEKPADVLWWINAVDSAKSFGNENFKKHDYKAALRKYRKAMRYLDICWEKEEIDQENSSALRKTKSIILTNSSACKLKLGDVEGALLDADFALRETEGNAKAFFRQGQARMTLKNIDAAVESFQRALELEPNDGGIKRELAAAKKKVTDRRNLERKAFSKMFETSGSSEKSEEVLAATSREKWRR

SEQ ID NO: 141557 - protein, 215 aa, Triticum aestivum
  Clone ID: PAT_TA_35975.pep
SHSWRGRPPKSGLNVLLAILLLAVATPASLAAIDVAQMLADKPQYATFLRLLKETKVADDVSRLKSASVLVVPEKAVKPLLAVPAAKQRTILQHHVLIKYFDPIQLGEMKTNVAKLETMLSNTDKDMGTIDYSKDKDGQMYLRSPGADSVAKLVKVVAARPFTVSIMEISAPLLCPKLLGPGAAGAAAGRPKGKGKGKIKTMSADEGAAAAAPTA

SEQ ID NO: 141558 - protein, 263 aa, Triticum aestivum
  unsure (1)..(263): unsure at all Xaa locations
  Clone ID: PAT_TA_35976.pep
MVGTKEDGSMPQSVAGGASSYNFYGSHVAGDGHVIQPKSQLSQMLLASSPRSCVTTSLGSSMLDFSNSMAPPPPELRSHHHSDNSSECNSTATGSALKKXXFXPRPQAQSTLKVXKEXLXGDRITALHQIVSPFGKTDTASVLQETIGYVRFLLGQIEALSYPYMGHGSNGASIQNGPTRESNPGLFPEYPGQLLNHNNNTGGVQQQAPGQPEQQGAVNEEASKKDLRSRGLCLVPVSCTSHFGGDNAADYWAPAPLGGMILQ

SEQ ID NO: 141559 - protein, 176 aa, Triticum aestivum
  unsure (1)..(176): unsure at all Xaa locations
  Clone ID: PAT_TA_35977.pep
KELXXHVKLENXLVQPREVDPAVEQKWRSLEFERERENELRTVTSXMGRXVVWGDYVLDLEDGAXLEDEXSDDDDRGNDREADNARRLIIFMMRQVAQRHRTQRLQSPSGMPGDAEEGYAVSSGGANGTTPYPFTLEGDDEDDMALAGGEGAGMLRSDRRRRRRRRNRGRLFLDSN

SEQ ID NO: 141560 - protein, 188 aa, Triticum aestivum
  Clone ID: PAT_TA_35978.pep
MTTQEVVRQKLIKRFSEIDAGQSIGIKKMGKLNEKPFRDACAVKLAPKYAGAKSSELYALWQELLDSPNWEPFKSVIVDGNHQEEVIDVDDDKLQGLKLSWGEGPYNAVISALVERKEYNTDGTGDAFDLWNYKEGRKATLGECVDCILDNVKKLKRVHLTYRSRRTMCAATASMHDPVKDLSAASNE

SEQ ID NO: 141561 - protein, 126 aa, Triticum aestivum
  Clone ID: PAT_TA_35979.pep
LNHYRNPVLNGEGNNNTLVYTGREKNCITYNENAFLLSCKSMMYILHKPPKHFENFVKEHFTRLAPHILGACNAYLGGDLVGHAGDSTYISDDGCKSCSTGFKIMLGKLLPKLVAAFSEAGIARGQ

SEQ ID NO: 141562 - protein, 186 aa, Triticum aestivum
  unsure (1)..(186): unsure at all Xaa locations
  Clone ID: PAT_TA_35980.pep
DVLRPGAGHVNPKKXMDPGLVYNLSASDYVPYLCGLNYTDQQVNSIIHPEPAVDCNKITKIAEKDLNYPSITIIVDKADTAVSATRAVTNVGVASSTYEMEVEVPKSVTVEVTPTKLEFKELDEVLNYTVSVKAAAVPEGAIEGQLKWVSSKHIVRSPILILPGDGEEEATSGAEGPSAHVSSLLE

SEQ ID NO: 141563 - protein, 274 aa, Triticum aestivum
  unsure (1)..(274): unsure at all Xaa locations
  Clone ID: PAT_TA_35981.pep
MSPSSDEIRIQPYKAFFQIGHPIYPSKMVRFRXGYCKLSRPSESFITDDDDNQAVIADEIYRSTLAAPEFLMLQENKLQTFKLPRPALCIGGVVKIELLGRVQKQATDDRYYICVCHAQVVGRSLSPVFMVDINDSAGYSILKHLPEAKNLSVEEVMQDSASDSQEWKDALASYRETSHLATALMNVLHEGAAHPAQDQQGDAPHFPHGAALLQEIQAMQGDANLMQQLQVDAQLLYLLQDGVLQLQDDEDGLQAMDEDDDADGGGVSDNDPFA

SEQ ID NO: 141564 - protein, 143 aa, Triticum aestivum
  Clone ID: PAT_TA_35982.pep
PLCPQECCVWLQRLQLGGRLLHVGCIIMVYMGDFFGRNFMRPVWLISRVFLHRKGVGLDSPATFVDVRRCAPCPGVLGFPPVPSSRDRPTLPCHPRPLLSPLLRPVLIPGRAQCYGVAGPPDPSHGGPRAISPFPKVRGCGLH

SEQ ID NO: 141565 - protein, 136 aa, Triticum aestivum
  unsure (1)..(136): unsure at all Xaa locations
  Clone ID: PAT_TA_35983.pep
TAAGSSLYIGRLTPSSSQSPGRLIRVSGSDSQLYLSYTTSSTITMITTTGFKPYPGLSPSLGGRPKSRGRGGLGNDHMSNPALLAGDSKVYTSNIKAQDDXEPVMSTSILRQENSRLQLYEGNNXRDSPXGSGXPP

SEQ ID NO: 141566 - protein, 51 aa, Triticum aestivum
  Clone ID: PAT_TA_35984.pep
MPTRDAPSAVPGYGGRNRRMNYSGPLVPPGGNMDEMLKEHERQIQAAVLKA

SEQ ID NO: 141567 - protein, 115 aa, Triticum aestivum
  unsure (1)..(115): unsure at all Xaa locations
  Clone ID: PAT_TA_35985.pep
ARGWLWWTRFLFSRHAHVLRVTVGCXVNILMLPLSETMPTLCSWDHPSSGVIFYVHLSSRVVKMVYQRTADEHXCRSVAVRISPVMTIWPPIFPALNIGHDQEGIVRAVRSLDRR

SEQ ID NO: 141568 - protein, 59 aa, Triticum aestivum
  Clone ID: PAT_TA_35986.pep
NCQYIQYTDLHGCNVSCCRILTMSKCYVRVTISTLNFGPLGVDGNPQPWLLLPAIWDWR

SEQ ID NO: 141569 - protein, 225 aa, Triticum aestivum
  Clone ID: PAT_TA_35987.pep
MVQCLDGVKHLLAVLFKCCDLELKQPRGLEDPQVLARETVFSVSEVEALYELFKKISSAVIDDGLINKEEFQLALFKTSKKESLFADRVFDLFDTKHNGILGFEEFARALSVFHPNASVEEKIDFSFQLYDLKQQGFIERQEVKQMVVATLAESGMNLSDEIIENIIDKTFEEADTKHDGKIDREEWHNLVLRHPSLLKNMTLQYLKDITTTFPSFVFHSQVDDT

SEQ ID NO: 141570 - protein, 128 aa, Triticum aestivum
  unsure (1)..(128): unsure at all Xaa locations
  Clone ID: PAT_TA_35988.pep
XLLCLLRQHKCELFHALFSSLLSIAPVYLTMSVRSITFLVYQPFQLEGVMAVSVGVKTRSSEKIVLPVDADRTTVVLAQEPAPPHITHTHADCTPTQLDREPATPLLTPTPADRHPVPVSAQQSAFAV

SEQ ID NO: 141571 - protein, 150 aa, Triticum aestivum
  Clone ID: PAT_TA_35989.pep
VDQAELLLNNMLTNENNWTLPEPIPEAIPEPIEPTPEPIPKPTPKKRGVLFLSPEDMQEAKKSMKEKGIKAEDVKNLPPIEEIHGLNIPPIEETHCLDNPTQVVKVNSLYRYDKVEIPSTKFHSPCLDEFDDFMARQESFNACVGRELKN

SEQ ID NO: 141572 - protein, 248 aa, Triticum aestivum
  unsure (1)..(248): unsure at all Xaa locations
  Clone ID: PAT_TA_35990.pep
EAGQAPQRGPRPRARPPAAPPPPAAPGAAAPAPPAAATGGAPSPRATWRASLLRVGRASGPRAPAGAPGLRRPVLCQPRCSGQNQRWLPLLLLHCLLAAASSVRAVPHAAVRPPLPGATVAVFLAKAAAMALAQLQGLSVPAFRVGYPILTDKLDALYEKVKPKGLTMTVLLAKAAAMALAQHPVVNASCRXGRAKQLQPNEYSSGTFTRSCLGMFGLDACDAVLPPGQGAIMAVAAPEPTGKTASTE

SEQ ID NO: 141573 - protein, 120 aa, Triticum aestivum
  unsure (1)..(120): unsure at all Xaa locations
  Clone ID: PAT_TA_35991.pep
PPEPWPVSMPRATACLTAIIASSLRCPGRVSRVAKPHHSTPTAEYHRSSPTDDEFHASIKPLGSSPNCMSLAFSQLNRLRLSGSLHRSPSIKLHLQHDSMVDDQSTPRPHQLQAXVCTPP

SEQ ID NO: 141574 - protein, 306 aa, Triticum aestivum
  Clone ID: PAT_TA_35992.pep
MEAAASNPSSKRIALVTGGNKGVGLETCRQLASKGLKVVLTARNEARGLEAVEGVRRSGADVVFHQLDVTDPDSVARLADFVRDQFGKLDILINNAGISGAERVPRRSASGSGRVESMDVDQRVQWMKENSKETYEEAKECMRTNYYGAKLVTGALLPLLQLSSSGRIVNVSSGFSLLRNFNSEKLKNEFNDVDNLTEKRLEELLDSFLEDFKANLIEAHGWPTGGSSAYKVAKAALNAYTRILAKKYPRMRINCLTPGYVKSDMSMHMGVLTPEEGASNPVKVALLPDDGPTGAYFDRDGVASFV

SEQ ID NO: 141575 - protein, 140 aa, Triticum aestivum
  Clone ID: PAT_TA_35993.pep
LPPHGRTEPLPPKNLKPSSRAKKLPLSDMQTACPILCGDYVCLLSKWDYRDDEAWIVTVDMWKKAVRGLVRVKDGISMRLNPAYISFVMKNYRKGESDGRSSLVKDTPFHGKRCLQFPAEEDTEGFDNGTKRTIWLSRPP

SEQ ID NO: 141576 - protein, 110 aa, Triticum aestivum
  Clone ID: PAT_TA_35994.pep
VHGYMHIPNHVTKNVSCPFKYSRQLWLIWLLRKPNRKQTVATETGPYLRIKPYKPKYKNRINQKPYEPNRIKPKKPNAQADQARPGGLCPAWWPPAPPLRSINTSLLQKP

SEQ ID NO: 141577 - protein, 219 aa, Triticum aestivum
  unsure (1)..(219): unsure at all Xaa locations
  Clone ID: PAT_TA_35995.pep
STASSSVSSTPAEDPVKAEIESSPESSALSEGITEEASTDTSLKGNDDVEEKAQDXXRTKESGVEGLKSVLNFFKSRIPEFKVQVINVEVPEEAELVADSSDELVQDDVKSTSESSLEEPSTEEFQEEDVSDGDSDSNDESKGPEVKLFISGVVHNKEEAGAKSYVRVPAEINNLERDSFELYIPGKGSDRDLSETKAAKQKVADMAAKLASELMPSDV

SEQ ID NO: 141578 - protein, 123 aa, Triticum aestivum
  unsure (1)..(123): unsure at all Xaa locations
  Clone ID: PAT_TA_35996.pep
IEVKDRMKDIIISXGGENISTLEVEKVVYMHPAVLEASVVARADERWGESPCAFVTLKEGAGGSDEVALANDIMRFCRERMPGYWVPKSVVFGPLPKTATGKIKKHELRAKAKELGPVKKSRM

SEQ ID NO: 141579 - protein, 129 aa, Triticum aestivum
  Clone ID: PAT_TA_35997.pep
KKKFRELSQSRPVKAVQGRFYTPSNKFIWKTAITFVLLGVLTLVFPTEEGPTLQVLISCAANIYFLYQRLKSGWKSFFYGFGSFFASWFLATFLMVSVIPPILPGPRNLEVSTACVAYAFLFVSSTFLK

SEQ ID NO: 141580 - protein, 107 aa, Triticum aestivum
  Clone ID: PAT_TA_35998.pep
GRSSRSSKASVTVQSRKISKVGDSVFIEEMPDILREPSSPGIVKTCSPNGKRVSPPHNALSISPNRKGGRKLILKSIPSFPSLVGDTSGGSAICSSDSTTALALGPS

SEQ ID NO: 141581 - protein, 107 aa, Triticum aestivum
  Clone ID: PAT_TA_35999.pep
LLTAHWRADPCADFVRQGHPPRQNPLVETSSPVWKPWFPDLQRQSSSFLEAREGQILPLGYPPSRRRSFPRLELVAMGPCFRPHYSPLYLPLRAPGKVLVRASFPVP

SEQ ID NO: 141582 - protein, 65 aa, Triticum aestivum
  Clone ID: PAT_TA_36000.pep
SPELQCISSAHLTHHYISHLRRSCLLLLGALVAVGGPVALDGVEHLLSDVRAVLVVRHHRLPPHP

SEQ ID NO: 141583 - protein, 84 aa, Triticum aestivum
  Clone ID: PAT_TA_36001.pep
RKKPKEGMERITGWWAKAVRVSFFLSVLFSQLGGVIAGFALNYWLQIQEKCKFGGFLEIIPLALALGFWLLFHGFFGWISISQN

SEQ ID NO: 141584 - protein, 181 aa, Triticum aestivum
  Clone ID: PAT_TA_36002.pep
GPRGQEKKEIIDNDLGRYRLYSSMDHRAAKSSSSFFNSSQLFLKAATDSSTSCSRSIRSFLKSPISSSTTAFSVIPKALLCSCSIFLAGGLLLLLGDHLEDLRIVTHELLDEAGRLVNRGIADLEQLHQAVDQLLLLSDASENVIVAGQRLQECQLIAMADAASALVRALACPWRARSRAP

SEQ ID NO: 141585 - protein, 99 aa, Triticum aestivum
  Clone ID: PAT_TA_36003.pep
LQKCTPLSTMTPTPHLPPKKWDALKPIRVRKMIKNHRYACQQIGKGSEARSWPCTLLGSSSMAINSKLLASYYASLVPQPAPPLFHRPVLPRRRLRRRR

SEQ ID NO: 141586 - protein, 119 aa, Triticum aestivum
  Clone ID: PAT_TA_36004.pep
CDVEVLAIYTQPWTLCSWQAHVICFVPHRHSSVLLRCGSFLKAHRYMAQSGSTMPVLFRFMLVFTLSFFWSGVLHLFSVVCTSLLCCIHRYFQINKSKTIREHAGPRIWRVYACICTVL

SEQ ID NO: 141587 - protein, 298 aa, Triticum aestivum
  Clone ID: PAT_TA_36005.pep
KNIEPVEAQDGITPDNVPAEEINDTEAMETGEIPHESTDDSLTASAALPDIQQVPEQEAVEDKACTDTTENQGEPQQSIVSTSAELTPTEEETAVVKHTQDTHVQNASSEPGTDPNLLVQSAHQSELAEDSKGQLVKAEETGQSNGATLEEPTAEDNAANEISPLADSKQEHGVESMEQNKCIDATEGEEASHLSQDPGLEEPVSERDTTTVEPTSDIQQVNDMDEAEEMAATEPINGEEISSQKTDVATLEDPSPTDNETAPEQNPVELDEENLGNEISNAILADENIKEEVPARAA

SEQ ID NO: 141588 - protein, 182 aa, Triticum aestivum
  Clone ID: PAT_TA_36006.pep
VHSDCCNASCELGSVTCPWSWAGAPRKYKCARCGTMKTPVHCYKLTAKVEHATGTMDLMIFCYVADELVSVSAQELVDNIDQDDEWYALPDEIEDLLGSTHTFQVFDKYMNRSFPVKSIMDDASVPPPAASASQCTENADPGRSWTMLASQPLLQPLVNARRRKLTLREARSLTSGCEATTT

SEQ ID NO: 141589 - protein, 104 aa, Triticum aestivum
  Clone ID: PAT_TA_36007.pep
PHTRTPLVWPAGWAHQPALRRTNHWLGVTGAQVRRPKLFDMIIPFRQDGGGAHRRGQQRQAKRLYSRVHDAFVGAFCQRTSHAAPSFSEFAQCMCLGFVLIDGP

SEQ ID NO: 141590 - protein, 222 aa, Triticum aestivum
  Clone ID: PAT_TA_36008.pep
MEASLTAAAAATSSFPPQIRRRIIKFNPLVLPRRPQFGDSKIWTANFRGHLAAASASTPPPPGGGLYSAATYELTPDNVDRVLDDVRPYLISDGGDVAVVSVEDGVVSLRLEGACSSCPSSTTTMNMGIERVLKEKFGDAIKDIRQVFDGDQQPEETTPEAVNRHLDILRPAIANYGGSVEVLAVDGEDCLVKYDGPESIGSGVKAAIKEKFPDITNVVFTQ

SEQ ID NO: 141591 - protein, 167 aa, Triticum aestivum
  Clone ID: PAT_TA_36009.pep
GRHLRITPHHDFRHGSCSSHGCALATCPPNMCKGKVMDAMLQELSAAAAAGTRRPSRVVYLGDGRGDYCPTLKLAERDYMMPRKGYPVWDLIAGDRRAVRADVRGWADFKDLETVLLDIIHECAAAAMVEQDGGDQVVVGMVVPECRALSAPKMAMAVLPKAIHAPN

SEQ ID NO: 141592 - protein, 175 aa, Triticum aestivum
  Clone ID: PAT_TA_36010.pep
RAREDDRSRRGREGQGRGAEGLAGGAPRGPGRVAVPAGRLPGRHCGGRKEAFRLLQPLSLPIARPARSVKRRWWCFSPPCLAAARGGGGHVQRWCCDPYAEAVGVRRRLGQLLLWWPGFGLRCVVSPRLFTYVRSSLCCAVCVPQTLPSSRHAYHYQMREWLQGKLVVRLCQQPA

SEQ ID NO: 141593 - protein, 123 aa, Triticum aestivum
  Clone ID: PAT_TA_36011.pep
ICRRQHAPASGVTASCIDGNPYVEHHDEIVIVVAVSLCRRVRNCYLLESHVGIIIRIQAQPVRKADPNGGEGVYRNGRTAVDVVQNDGGIRSEICKPIFIGTDPDLYIRRWGSGEITGWKWNN

SEQ ID NO: 141594 - protein, 146 aa, Triticum aestivum
  unsure (1)..(146): unsure at all Xaa locations
  Clone ID: PAT_TA_36012.pep
GYSFHLACRQWXTIXKGVHKHIFNFDKDIMSLDENERVTSXGSLNVHHCDDTNMVISFTRGPFLFVFNFNPEVPYQLYRVGVDEAGEYQLILNTDETKYGGRGELKSSQYMKKTSDRRADGCRNSLELALASRSAQVYKLVRILRI

SEQ ID NO: 141595 - protein, 90 aa, Triticum aestivum
  Clone ID: PAT_TA_36013.pep
EKDQLYWRWNISVPEPLLTIVSAHRSMFLPSVTYTVIVVPVLFCSLLMYNRILDGSLLYMCKIGHTWRQRVQNTSHSCLSLLLSQLREHL

SEQ ID NO: 141596 - protein, 101 aa, Triticum aestivum
  unsure (1)..(101): unsure at all Xaa locations
  Clone ID: PAT_TA_36014.pep
LXQCNFHXKXCSCXTXTSXNXSXEIFDXMXQXCXLFLXNFXVFFXLNANARTPPGASFLWGEDPGRVLSSDCFTRWCGRSIRLSAQVRMPAIRNGLVSIGK

SEQ ID NO: 141597 - protein, 233 aa, Triticum aestivum
  Clone ID: PAT_TA_36015.pep
GASVVPLRPTPHPPPPRASVKLAWTHDRFEDSMVAAGLPGIETGTKLYVSNLHYGVTKEDLQELFSEMGHLKNCIVHYDNNRHPTGSAEVIFTRRSEAVQALKRYNNVRLDGKEMKIEMIGANLGLAAAPAPRVNVVSGARGRGQREVVMSHPNGFGRGATDSSSFLPGWKRNNGFAQRGGSVRGRGRGRGRGRSTFGRGRGRGVYVRKGLVKSADQLDKELDTYHSGAMNVD

SEQ ID NO: 141598 - protein, 218 aa, Triticum aestivum
  unsure (1)..(218): unsure at all Xaa locations
  Clone ID: PAT_TA_36016.pep
FVNTAGPDGHRQLALHCEVDMSMFFICRFEGYQDTLYVHANRQFFRNCEVLGTIDFIFGNSAAVFQNCLMTVRKPMESQGNMVTAHGRTDPNMPTGIVLQGCKIVPEDALFPVRQTVPSYLGRPWKEYSRTVIMESTIGDLIKPEGWSEWMGDLGLKTLXYAEYANTGPGAGTSKRVTWPGYRVIGQAEATQFTAGVFIDGMSWLKNTGTPNVMGFIK

SEQ ID NO: 141599 - protein, 113 aa, Triticum aestivum
  Clone ID: PAT_TA_36017.pep
MVTSTKKTKKSGDNINNKLQLVMKSGKYTLGYKTVLRTLRNSKAKLVILANNCPPLRKSEIEYYAMLAKITVHHYHGNNVDLGTACGKYFRVCCLSIIDPGDSDIINATPAGQ

SEQ ID NO: 141600 - protein, 113 aa, Triticum aestivum; identical to SEQ ID NO: 141599
  Clone ID: PAT_TA_36018.pep

SEQ ID NO: 141601 - protein, 170 aa, Triticum aestivum
  Clone ID: PAT_TA_36019.pep
MTAGFRTQYFCNNAISLSCSRSRARAYCPAGRRLPGAVVAMSSAAPTPGPVQKSEEEWEAVLTPEQFRILRRKGTEYPGTGEYDKFFSEGIYGCAGCGTPLYKSSTKFNSGCGWPAFYEGFPGAIKRTADPDGRRIEITCAACEGHLGHVFKGEGFNTPTDERHCVNSIS

SEQ ID NO: 141602 - protein, 323 aa, Triticum aestivum
  Clone ID: PAT_TA_36020.pep
MILLQSPSRFLLQILKDRVVSGDKGVDIDCHTVEFDDVRYHIQFSMRNPKVMVLSVALPLAPPEAILHDGLPLGAIDAIKAAYGAVVQILDPPKDCFDLTMKINLTKLPTDEEQRNVVLTQIASVREVVLGAPLKLLLRHLASKTVAPNVDKLVALVHRPNESFFLAPQADKVTVVYPMRFQDSIDIVLATSFLQEFVEARRTAALNNAPSCMWSPVPPLELKGVNADALDANAGFVTFVVFPRHVEGRKLDKTVWSLLTFHAYVSYHVKCSEGFMHTRMRRRVESLIQALDRAKSDAEKLKKLVHGGSFRRLSMKHEGNSNR

SEQ ID NO: 141603 - protein, 145 aa, Triticum aestivum
  Clone ID: PAT_TA_36021.pep
PVVCKYDAAVLHNKVYKHMKPTTHVQSPNSRHIIIWVCCEENGSPRTSIHVAYGVYDLSINVDANKKKLYHDTGNQLKCKMEKQKKKDFRGNVYRISKDSKPYLVQYITHKRSTIRRFLLCINMANLGSKKRVDSIDRYNTTATQ

SEQ ID NO: 141604 - protein, 295 aa, Triticum aestivum
  unsure (1)..(295): unsure at all Xaa locations
  Clone ID: PAT_TA_36022.pep
QGNMLTGAIPSNISHCSSLRKMVIADNKGLQGXIPSEIGNMQSLRLVHLYNNSLTGTIPSSLGNLSQVTILSLAANHLEGSIPETFGNNPRLEFLQLAMNNLAGLLPLSLYNQSSLYRFYVTDNNLHGRLPADLGRSLPSIQQFGFGDNQFTGVVPPSLTNISRLQLFDVGNNGFSGVVPSELGRLQYLRWFCLDVNKFEANNEREWQFLTSLTNCSRLRLMYIEQNRFSGQLPTSISNLSTNIQELDILNNNISGTIPSDIGNLIGLEVLILAGNLLTGAIPETIGKLIQLKRL

SEQ ID NO: 141605 - protein, 53 aa, Triticum aestivum
  Clone ID: PAT_TA_36023.pep
NRIYRKELARSFLLLTAPARSVLSAQGIHFYFLLFQGVSFLVMGLDLIGEQVE

SEQ ID NO: 141606 - protein, 76 aa, Triticum aestivum
  Clone ID: PAT_TA_36024.pep
YSYEKTTEVDGKAPFARLMLQGNYLCGALPRELRQMKEGGVMVSLADNCLLKCPHKFFFCQGPPQKNRDTCPKCEP

SEQ ID NO: 141607 - protein, 152 aa, Triticum aestivum
  unsure (1)..(152): unsure at all Xaa locations
  Clone ID: PAT_TA_36025.pep
LPYMGQGNGDPLGCGMSDGGMGDDQGAMHPLDQAFCRPMGSXHSSSSSTSSATPPLRLGLSGKICRAWFRWTWGRARSSPPPPTATXDGPHENGALTSSPGKKLDPTGSLDATAVHREEKQSLRVSQRSLPFDRPWKHSEIQPNSVGPLAVS

SEQ ID NO: 141608 - protein, 65 aa, Triticum aestivum
  Clone ID: PAT_TA_36026.pep
RRDERRAAGSSVATVMALLTRTDRGGADGMGRLGAALFKGYPGRCPARVRPEVGSFFLLFRSEEK

SEQ ID NO: 141609 - protein, 88 aa, Triticum aestivum
  Clone ID: PAT_TA_36027.pep
PTRPRHVYGCTEDNLFTAYIGMMGRCYPRPELRVRQPEVPLQVMVHRSAPGQTCGVRSEVSSLSPAPALGWNKTSDAIFLLTSYYSDG

SEQ ID NO: 141610 - protein, 499 aa, Triticum aestivum
  unsure (1)..(499): unsure at all Xaa locations
  Clone ID: PAT_TA_36028.pep
MYRAAGSHFRSLKNHGASRFASTSVVKQSSGGLFSWLLGGGSSQLPPLDVPLPGITIPPPLPDFVEQSKTKITTLPSGIKIASETSPGAAASVGLYIDCGSIYETPASSGASHLLERMAFRSTTNRSHLRLVREVEAIGGNVSASASREQMSYTYDALKSYAPEMVEVLVDSVRNPAFLEWEVKEQLQKIKSEISEVSSNPQGLLLEALHSAGYSGALAKPLMATESAINRLDISTLEEFIHENYTAPRMVLAASGLEHDELVSIAEPMLSDLPGVKRHEEPKSVYVGGDYRCQADAPKTHIALAFDLVIGCRQQYTPXLGLCLIHSCTXGGSFSVGGPVGSRGTPLYLRVLNKYDQNESFSAFNSIYNDSGLFXIHAATSPDFASTAVDLAAGELLEVATPGKVTQEQLDRAKEATKAAVLMNLESRIVASEDIGRQVLTYGQRKPVEYFVRAVEATTLYDISTVAQKIISSPLTLASWGDVIHVPSYESVSRKFLSK

SEQ ID NO: 141611 - protein, 95 aa, Triticum aestivum
  Clone ID: PAT_TA_36029.pep
LTKPARLTWSKVNGLAHEKPVNGLFANSPFHGPLTHGPLGPKGNRPNNVMWAVEYNTSPFHFWPMYGPRRLSAHMRPSYLSALYRPTVTLAHNEQ

SEQ ID NO: 141612 - protein, 149 aa, Triticum aestivum
  Clone ID: PAT_TA_36030.pep
VHDLNGTNTTANSMMDIHSLIMSLNFTQIEIKTANFANSWGDGVLVMVSGLVQTKEYSNQRKFIQMFFLAPQEKGYFVLNDYFHFVDQEQVQPAQVRAQEAFETNMASNTVQTSAEYIHEESQTMQAVPVTSEENDAVDCYTYSEPPQQ

SEQ ID NO: 141613 - protein, 228 aa, Triticum aestivum
  unsure (1)..(228): unsure at all Xaa locations
  Clone ID: PAT_TA_36031.pep
SCSFPSKKETKQEEPAHPPPVPPHVGEPVREPVNEAYASILRTAHAPPPFPIAQSVPVSKPHPTTEANQATLVTSSVAADKPKSDFYTEGHDEEESKSVYVGNVPQNVTXADLENEFKKFGQLIPDGVAIRSRKETGGYYAFVEFEELSGVHNALRASPLEINGRQIYVEERKPNSGIRGGRRGGGRGRFGGSGRGYARGDEYSGSRGKSNGYQRVPHHERGILGARN

SEQ ID NO: 141614 - protein, 141 aa, Triticum aestivum
  Clone ID: PAT_TA_36032.pep
VDQPLASETNDYTNSWPGNTFQPDVGLGSIGFSSSSHDYQSSAAKHSVPLSVDNHVPAMGTGALNSSYSHHMAGSGNSTSVAGDTQPIMSDAFYIDPDDKFMGSSFDGLPFDFIGINSPIPDLDELDELLDDNDLMQYLGT

SEQ ID NO: 141615 - protein, 151 aa, Triticum aestivum
  Clone ID: PAT_TA_36033.pep
EDDLFISSVASCSNLWALIMDAGTGFTSQVYELSPYFLHKEWIMEQWEKNFYITALAGANNGSSLVVMSRGTQYAQQSYKVGDSFPFKWINKKWKEGFYVTAMATAGSRWAVVVSRNAGFVDQVVELDFLYPSEGVHRRWDNGYRITATAA

SEQ ID NO: 141616 - protein, 90 aa, Triticum aestivum
  Clone ID: PAT_TA_36034.pep
MKRFCPGLIRSNGKGFTFGEPPWRSAKLHISDGAASSSGEEVIRHSFLRWLLSWCRGQVTGVGVKLRDVLLSFQFCHVGPYVTSILFFMI

SEQ ID NO: 141617 - protein, 136 aa, Triticum aestivum
  Clone ID: PAT_TA_36035.pep
ALKLLLSLEKEGVKPGVKTNLVLLDWLSTLQLVQEAEQLVQKIRKAGEEPLEIHVYLADMYAKSRQEEKARKSLKILEEKKRLLKADQFERIIRGLQVGGFSEDASRYFKMMRSRGFVPSATVEAGVRGVGRPAGR

SEQ ID NO: 141618 - protein, 64 aa, Triticum aestivum
  Clone ID: PAT_TA_36036.pep
VGDGDEECERFVVRVEALRHPSLAALLEMAAQEFGYKQEGILRVPCAVNQFRQALTTAAVSKNY

SEQ ID NO: 141619 - protein, 251 aa, Triticum aestivum
  Clone ID: PAT_TA_36037.pep
MMVIGTMVDRWLRSAVQEMKENNLTEVLCPYQRCKGIVWLDPYDDGRVEAHLLMTDFMDGYTWWIIEARHGGGEGAGHGGGEGDGHGGGENDMDSTQQSSSVLSSIVRDPHVQALLRKETSTERAASREEAKLEQLVVDSNTPLYDGCNPDVTRLSFTLQLVKTKAKNKWTDTSLNEHLKYLKDVFPPGNLCPTSVDEAKKIVCPLDLPHVRYHACINDCIIYWKEHAEKTSCPVCNASQNKKAGKKSPQK

SEQ ID NO: 141620 - protein, 96 aa, Triticum aestivum
  Clone ID: PAT_TA_36038.pep
MRELIRRLSFSDRVSEGSGGVPRGCVPVLVVGDGDRDEECERFVVRVETLRHPSLTVLLEMAAQEFGYKQEGILRVPCAIHQFRQALTTAAVSKGY

SEQ ID NO: 141621 - protein, 746 aa, Triticum aestivum
  Clone ID: PAT_TA_36039.pep
MKEDEMNMYRVQGTLREWVTRYEVRRFIAKKFKEFLLTYVNPKNEQGEFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGGVVTRRSGVFPQLQQVKYDCSKCGTVLGPFFQNSYTEVRVGSCPECQSKGPFTVNVEQTIYRNYQKLTLQESPGIVPAGRLPRYKEVILLNDLIDCARPGEEIEVTGIYTNNFDLSLNTKNGFPVFATVVEANYVSKKQDLFSAYKLTDEDKAEIEKLSKDPRISERIVKSIAPSIYGHEDIKTAIALAMFGGQEKNVKGKHRLRGDINCLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGGNLEDRVVADEEDDPLTVARNADPDILSQDMLKKYITYAKLNVFPKIHDADLDKISHVYAELRRESSHGQGVPIAVRHIESIIRMSEAHAKMHLRSYVSQEDVDMAIRVLLDSFISTQKFGVQKALQKNFRKYMTYKKDYNELLLLLLRTLVKEALHFEEIVSGSTTRLTHVEVKVDDLKNKAQEYEIYDLRPFFSSSHFSDNSFVLDEGRGIIRHPVAA

SEQ ID NO: 141622 - protein, 259 aa, Triticum aestivum
  unsure (1)..(259): unsure at all Xaa locations
  Clone ID: PAT_TA_36040.pep
NACGVNKLVEPRCTVVLAATNHCLDVFGFCXVYIINIRDAEAXRIWKAMYETPAXWLRMIXSWNDPWFVADLTVFHFXLMSTKQTTYENFRYRYDRRANPYNVGVVNNFLEIFCTSVPASKNNFRAWIPGEQGLLQSRPPTWGFMSPNMGQTCXEDLELGRKPAAWDEPRSGADIRDLGVGGMLDEKEGRITHASPDLSREALPVELMEGRAVMHSRRSSWGHRSGTSESMDSIAVQMGGGETNWGSVSSGHGTTSGTH

SEQ ID NO: 141623 - protein, 122 aa, Triticum aestivum
  Clone ID: PAT_TA_36041.pep
YNSARKHIERILLAGMLTGRPEKEMPLSAGDLLQDLSQLHERARQVMQGIAQALWPSSFLPNGMGELVDMLQGARRRFQLWKMLACQQGAREAWAMVKTRYTKLDPNHMAEVGPTGPDGQEI

SEQ ID NO: 141624 - protein, 236 aa, Triticum aestivum
  Clone ID: PAT_TA_36042.pep
VEQVLAIEESFKHRVTNVVFMGMGEPMLNLTAVLEAHQCLNKELKIGQRMMTISTVGVPNTISKLASHKLQSTLAVSLHAPNQRLRETIVPSAKAYPLEALMDDCKNYFLETGRRVSFEYTLLAGINDEKAHAEELAALLHACGGGYHVNLIPYNPVEGSEYKRPYRKAIQAFVDALESRKITVSVRQTRGLDANAACGQLRNEFQKNPLLESSPPSEPNQLLESSTPSEPSLVPA

SEQ ID NO: 141625 - protein, 115 aa, Triticum aestivum
  unsure (1)..(115): unsure at all Xaa locations
  Clone ID: PAT_TA_36043.pep
TIWQVPQYVVVGAAEVFTLLGQMEFFYDPSPDAMRSVCSGLSSAAFALGTRATSAPAGEVVPGYVPGGRPGWIPDDINDGHLDYFFWLLAMLCTGNFGAYLLVARWXYTYKKTAD

SEQ ID NO: 141626 - protein, 172 aa, Triticum aestivum
  unsure (1)..(172): unsure at all Xaa locations
  Clone ID: PAT_TA_36044.pep
HPAKTIMTTTRPFELLHMDLFGPNHYSTVTNDASLYGFVIVDDYSRYTWVHIVTYKHEVQEVFKRFSSRASTNFGVKIKHIRSDNGTEFKNSGLDDYLNELDITHELSGPCTPQQNGVVERKNRTPVEMAHTMLDEXKTPRRFWIDAIDTACHIINRVYIHKFFKKTASELL

SEQ ID NO: 141627 - protein, 389 aa, Triticum aestivum
  Clone ID: PAT_TA_36045.pep
LCVTPCTVSPIQDENVSPIITAGVSINFRDVHGWTALHWAAFCGRERTVVALIALGAAPGALTDPRPDFPSGRTPADLASFNGHKGISGFLAEFSLTSHLQTLNLKEAMGSNASEISGLPGIGDVTGRIASPSAGQGLQAGSMGDSLGAVRNAAQAAARIYQVFRVQSFQRKQAVQYEDDNGVISDERAMSLLSYKPSKPGQFDPMHAAATRIQNKFRGWKGRKEFLLIRQRIVKIQAHVRGHQVRKHYRKIIWSVGIVEKVILRWRRRGAGLRGFRSTEVATDSSTSSSSVDVIPVKPAEDDYNFLQEGRKQTEERLQRALARVKSMVQVPRSPGPSIKRIMTVVTKMQESQPVEESMLEESTEMDEGFLMSEFKELWDDDMPLPGYF

SEQ ID NO: 141628 - protein, 160 aa, Triticum aestivum
  unsure (1)..(160): unsure at all Xaa locations
  Clone ID: PAT_TA_36046.pep
EIIALWGGVVITAFDCFIFLFLENYGVRKLEAFFGVLIATMAISFAIMFGETKPSGKELLIGLVVPKLSSKTIKQAVGIVGCIIMPHNVFLHSALVHAGKLDTEKGSPXPVPKTGLTLDRHTLLISSNFQGKVLNKWFNMILAITWAFERNHSIAPSSHH

SEQ ID NO: 141629 - protein, 132 aa, Triticum aestivum
  Clone ID: PAT_TA_36047.pep
SLIEKYDITLYESENFDILEYCYENYAHNVYVKEFIERMTVASKENNDTHESLDNCDPDDLIEISLDEHDAFYSCGHDANIFEDEFAIIPYVKHEIIAIAPILDSSFDEKHDCNDFTINSLDVNCANNMQNL

SEQ ID NO: 141630 - protein, 125 aa, Triticum aestivum
  Clone ID: PAT_TA_36048.pep
QNRHLNTQHTAGRVKRTANVCRSVFLNPPHNMQCTWKYHMIQRTTCTRLRTNADDREKTHCVPRAIVDLVVFSGPLSEQESRAWVLESVILRRSFHNPEDKNCPRCSMYGHSDTVFSQCICNIRG

SEQ ID NO: 141631 - protein, 177 aa, Triticum aestivum
  unsure (1)..(177): unsure at all Xaa locations
  Clone ID: PAT_TA_36049.pep
MTKNLPSKDEIIDLASIVVPPIDHLEQYLLDHENDMFMNERKELDEIFFNQMPVLKHNLPVEILGDTPPPKGDPVFELKQLPDTLKYAYLDEKKIYPVIISANLSDHXRRLLRTLKKHRVAIGYTLDNLKGISPTLCXHKISLEHDAKPVVDHQRRLNPKMKEVVRNEILKLLLMIA

SEQ ID NO: 141632 - protein, 92 aa, Triticum aestivum
  unsure (1)..(92): unsure at all Xaa locations
  Clone ID: PAT_TA_36050.pep
DDNLAMVVADDDLAMVVADDDPAMVVADDDLAIVVPDADLAXLVPNDDLAMVVAPAIPQLGDRTMPIVVEEYIRVGICHSERIRLMKEKKEE

SEQ ID NO: 141633 - protein, 78 aa, Triticum aestivum
  Clone ID: PAT_TA_36051.pep
IFLTVWFMLGVDETGSKACRVGEPGRGCNQAPHFIRTTESTGSRSTLKLPKSSKFSVPNFSIGSLKAHIVLEIMPVGK

SEQ ID NO: 141634 - protein, 124 aa, Triticum aestivum
  unsure (1)..(124): unsure at all Xaa locations
  Clone ID: PAT_TA_36052.pep
MYSIWLDSKLHFNADSMLIIKYFLWRKKAEYAISAHYDRTCVWEEVLQNKRLNKYNHTAIDGQFYFYQSEGLXKFNASGQDPVLPSFVPHGXSCLWFNEVNRFTSRNKSSXTYTCLKLMRMNAG

SEQ ID NO: 141635 - protein, 129 aa, Triticum aestivum
  Clone ID: PAT_TA_36053.pep
QLQLPRRCREAAVMLQFPWLHSVVSCAPRGAAGPTTTCRWLRCYEAGLMISQLYFLDCSDLHRHAVLPRSSDVHANLRPLELQDWHGTHCCCRDGNKRGSDAWASAFFLVPSSLVPGYQLCLSVSLLLS

SEQ ID NO: 141636 - protein, 127 aa, Triticum aestivum
  Clone ID: PAT_TA_36054.pep
GGQALRRGGEMTVLQGERRQHCGSIAVPGGGAEGCGNAARGHRAAPATAEVHTTEVPRGCGDASISVATLGAELRSKGGRRCYESMTTRRWLRCYEAGPVISQLYFLDCSDLHRQAVLPRSSDVRLM

SEQ ID NO: 141637 - protein, 186 aa, Triticum aestivum
  Clone ID: PAT_TA_36055.pep
VPTWIVDPLDGTTNFVHGFPFVCVSIGLTIGKIPTVGVVYNPIMNELFTAVRGKGAFLNGSPIKTSPQNELVKALMVTEVGTKRDKSTLDDTTNRINKLLFKIRSIRMCGSLALNMCGVACGRLDLCYEIGFGGPWDVAAGALILKEAGGFVFDPSGDAFDLMAQRMAGSNGHLKDQFIKALVDAS

SEQ ID NO: 141638 - protein, 224 aa, Triticum aestivum
  unsure (1)..(224): unsure at all Xaa locations
  Clone ID: PAT_TA_36056.pep
QEVHDSPYSIHPGNTKMYSDLKEHFWWTGMKKDIAEYVAVCDVCQRVKVEHQKPAGLLQPMSIPEWKWDKLGMDFITGLPRAKAGYESIWVVADXRLTKVAHFIPVKTTYTSAKLAKIYMTRIVCLHGVPRTIVSDIGTQFTSKFWNQLHQTLGTRLEFSTAFHPQTDGXTEGVNQILEDMLRACALDYGSSRDDNLLYAEFSYKNSYQASLKMTPFEPLYGRR

SEQ ID NO: 141639 - protein, 70 aa, Triticum aestivum
  Clone ID: PAT_TA_36057.pep
MVNAIKGLFISCDIPMAQFIVNMNASMPASEKFIVHILDPTHMFIQPNMGDYIKSKMAEFRDQNSYEKPT

SEQ ID NO: 141640 - protein, 70 aa, Triticum aestivum; identical to SEQ ID NO: 141639
  Clone ID: PAT_TA_36058.pep

SEQ ID NO: 141641 - protein, 108 aa, Triticum aestivum
  Clone ID: PAT_TA_36059.pep
IFYCSAHDQDSIANSTWLVARSEAGQRRHLIFTSFGINLLLPRSTGLISGVRIILTFFFLSHNGHPDVSVAADVGRVAAMVRAGPPPLVDVARVPQGGVQVHGLLVPN

SEQ ID NO: 141642 - protein, 376 aa, Triticum aestivum
  Clone ID: PAT_TA_36060.pep
ARVRGRVGLPPWVLQEVHADPDIVYTRRSGRRNPEYISLSGDTLPVLKGRTPVQVYSDYMRSFRDRFAGYLGTVIAEVQVGLGPCGELRYPSYPEANGTWSFPGIGEFQCYDKYMRASLQAAAVAAGHENWGTSGPHDAGEYKQFPEETGFFRRDGTWSTEYGHFFLKWYSGMLLEHGDRVLAAAEAIFGGTGVTLSAKVAGIHWHYRTRSHAAELTAGYYNTRHHDGYEPIAQMLARHGTVLNFTCMEMKDEQQPGHAGCSPELLVQQVRAAARAARVELAGENALVRVDEQAFAQVAATAEAAGLSAFTYLRMNRNLFDGDNWRRFVAFVKTMADGGARTALPRCEGGHSDLYVGFVDAAKEQRAPESEAAAAL

SEQ ID NO: 141643 - protein, 134 aa, Triticum aestivum
  unsure (1)..(134): unsure at all Xaa locations
  Clone ID: PAT_TA_36061.pep
YENPRLSKDXRVIPTKEMHFFKTIASFHLYMLIKYKLPLEILHVVNLLLCGLLSQLYDDLNRKYKFVMHLVDVYGPFALFKGCFDDINLERLRLTMTKTSPEDDMFNFDPKTGSTGTTXFYKIHIPGVLKYVLK

SEQ ID NO: 141644 - protein, 69 aa, Triticum aestivum
  Clone ID: PAT_TA_36062.pep
QVQTPDAAMVSGCKYRRDGRRACLFPLRPLLLPAGLPLLCLPPELFSSLPLHACLPSLHHVLAGCSSPS

SEQ ID NO: 141645 - protein, 144 aa, Triticum aestivum
  Clone ID: PAT_TA_36063.pep
HAHSLIPFLFLFLSSGQQHNYTSNANARRYYNHALRSQAWILSVAEDGHVGVERRQLVVLVGISIAVAVDLAGTRNGDRRPGRPGRAEPAPRHGDARRHGNPALAGRVGAREGRGAGPAACRMPGGEQRAREHHGGEPSATRAP

SEQ ID NO: 141646 - protein, 78 aa, Triticum aestivum; identical to SEQ ID NO: 106966
  Clone ID: PAT_TA_36064.pep

SEQ ID NO: 141647 - protein, 184 aa, Triticum aestivum
  Clone ID: PAT_TA_36065.pep
VERTPLGSMSMDGKTPDLLPLSAAKKKVLDDVHVALACVYALHNALAIVFSTAVGYIAVDYFDVSCSQLSSILPCVELTDAESAWLAALSIGILCCAPTQAAAAALALLLPCRRRRARRVLAYLALAVTFLFHCMYAGAVWIFLAADPGYIFGKIFFTVVICLILVCDLTCLSDLLRGDGWGKQ

SEQ ID NO: 141648 - protein, 97 aa, Triticum aestivum
  unsure (1)..(97): unsure at all Xaa locations
  Clone ID: PAT_TA_36066.pep
MDSDNDNIGDNESEVVENYLPYVCFLGFHPYKEVIFXDLLSLKRAVAYHLNTSIVQDLGNIWPNDYDAGHAGGIDKSFLYTPCLIADFPENRLEAHV

SEQ ID NO: 141649 - protein, 156 aa, Triticum aestivum
  Clone ID: PAT_TA_36067.pep
MEVDRAPTAAAAGGSSSGAMAVDAAGGVEKPRFDALMPSEMSGGRPQYRKVQVPPHRFAPLKKAWLEIYTPVYEHMKVDIRMNLKAKRVELKTRHDTPDVSNLQKCADFVHAFMLGFDIADAVALLRLDDLYVDSFVIKDVKTLRGEHLSRAIGSP

SEQ ID NO: 141650 - protein, 225 aa, Triticum aestivum
  Clone ID: PAT_TA_36068.pep
MEVDRAPAAAAGGGSSSGAMAVDAAGGVEKPRFDALMPSEMSGGRPQYRKVQVPPHRFAPLKKAWLEIYTPVYEHMKVDIRMNLKAKRVELKTRHDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 141651 - protein, 259 aa, Triticum aestivum
  Clone ID: PAT_TA_36069.pep
MADGTGSGRSRLSALHHDILHHIITYLPVTEAAGAAGLARDWRHLWRSYPLVLKDARIPEAARDAVVPRVLHDHPGNFRAVILPDCRLASLDRELPAWPRLLVDKRTEKLLLAYRWVMDQPNPARLLPADILRCDSLQELTLDFWTFPSGTEVLLPRLRTLTMVRIGTSDQDLESLIAASPVLQSLRLIVNSPKHVRLRSKSLMCALVGLSTVEELTVVDTPLLARFCWSGPGKGGRIRIVCAPNLRALGYLDTRVLKL

SEQ ID NO: 141652 - protein, 362 aa, Triticum aestivum
  unsure (1)..(362): unsure at all Xaa locations
  Clone ID: PAT_TA_36070.pep
RNRIKERLDKMHKEKLLDFCDILDVQTKHTLKKVNLLQHMIVMIXAVNSVVTVFCCTQEEVSAKLLEFLESPCITRDVVISDVKKGKKRRRRSKGTSQATAEGASGEKKKRKSRKQKVEAENENDDEDDAGPAGSEDSSMGESDEDSEVKEETKSDEEPEATPVKKKSTDGKQGKKEAGSKAKEKDASVKKTPTKSVKSVSKPNVKLESKKAAKKTPKNSTKESSTPVEKAKKKVAKPKKDDGKESQNNSKARKKQGAKASGENKGKGKVAPTTKQLHGVVSNILKEVDFNTATLADILRKLGDHFDMDLMDRKSEVKRIIEEVINSMSDDEGEEENEEEDAEENGKKEEDSKEDPDEEEEK

SEQ ID NO: 141653 - protein, 68 aa, Triticum aestivum
  Clone ID: PAT_TA_36071.pep
MVVAVLALLVVATVVAPAQAVDCRTASTRFNGICILDSSCANMCITEGFLAGGECEGLHRRCMCKTPC

SEQ ID NO: 141654 - protein, 209 aa, Triticum aestivum
  unsure (1)..(209): unsure at all Xaa locations
  Clone ID: PAT_TA_36072.pep
MAAQNGSGGAAVVLNVYDLTPINDYLYWFGRGIFHSGIEVHGXEYAFGAHDLSTSGVFEVEPKRCPGYVYRRSVWMGTTEMSRAEFRSFVQTLAGKYDGNTYHLISKNCNHFTDDVCKNITKKPAPXGWVNRLARVGYFFNRLLPKSIQVSTVTHAATHPAFSDDDVDSSGSSLNGDSDMDDLDQHLLPAAGTDLQSIVVSPKPSKDLV

SEQ ID NO: 141655 - protein, 225 aa, Triticum aestivum
  Clone ID: PAT_TA_36073.pep
MQFTISAAALMAFAAQALAQVADFDPVLTPSNWEQVQTGETLEITWQAKPKYSGEKISISLIGGATQNTQVPIKTIATGVDNDAASYSWKIDSSVGTNNVYGLVLKLESNPEVFQYSFPFKIEGGKEKPSEAEEKPSKTEEKNDYELPTEAPKPTKEAYPVPHTTVVAVHETVTVPCNTTTVGGSPTTFVPVVKTHYPVPPPAHQAPPANTNGTAPPPLPFTLTL

SEQ ID NO: 141656 - protein, 198 aa, Triticum aestivum
  Clone ID: PAT_TA_36074.pep
MTATGTSVSLLKFVGTVSLGLLTGVSYSISSLALPALLRLPSSASASHGLSTLSAALKTPVLALTSLASAPFLISFFLAPRSSRHPYLLYTAILATLSSVAPILIPTPTPAPRRTASSAPRKSSRAKMEASYEVLGDAHSEPASDEDIEDINGEEVRAEVEGLTRSYLARTAISALGFAMAVVGIWGDGAPQSVVYVS

SEQ ID NO: 141657 - protein, 325 aa, Triticum aestivum
  Clone ID: PAT_TA_36075.pep
MGSISTKGKSFPPGIHVPSLTWFKNDAEQEVDWDQQSRHIEFLVNSGLDGIVIAGTNGEAVTLSAAEKSRLVRTTREIATSCGRPDITITMGTSSQTTRDAINETKLAKEAGADFVLVLTPSYFHFAMTQDAIVAFFEELADASPVPVVIYNFPGVVAGLDVNSEMLERLAKHPNIVGVKLTCGGIAKVARVAAQYKPEEFTALAGQSDWLVPALSVGATGAVTGVANLYPKTCLQIFDLYMAGKTKEAEAAQLELAKMEWGFAKGGINGTKWIVAKLLGYPADSCHCRKPYPQYVDESKQEWIHSVVEPLSAVEKSLGKRGAGI

SEQ ID NO: 141658 - protein, 79 aa, Triticum aestivum
  Clone ID: PAT_TA_36076.pep
MAKCLAVALLLLVVLAYCNGRELNQKDGALAATRGAGAGAGVGESKILGLPDLPVVGTTTGTSTINGPLVVIPGIPAHP

SEQ ID NO: 141659 - protein, 207 aa, Triticum aestivum
  Clone ID: PAT_TA_36077.pep
MATNITWHPSLSRKEREETRGQRGLTIWLTGLSASGKSTVATALEQHLLHLGVAAYRLDGDNVRFGLNKDLGFSEADRNENIRRISEVAKLFADSSTIAITSFISPYRADRQVARQLHEQATQGGDAPIPFVEVYVDVPLEVAEQRDPKGLYKKARAGEIKDFTGISAPYEEPEKAEITIKTHENSVEECVAQIVEWLNEKGYLNKK

SEQ ID NO: 141660 - protein, 134 aa, Triticum aestivum
  Clone ID: PAT_TA_36078.pep
RLQSGSSSVTITTAVFREQNTLFTSTPQLSTQFNNKTPSSRSLLLQASDLILLLLLNNQHVCFPAFATCSDQMRSLLGGGRRSAKRRAPPRLLPWLTPSHSPAATCGASSWRPWRERSRRRGGGVCRAGSPRRA

SEQ ID NO: 141661 - protein, 57 aa, Triticum aestivum
  Clone ID: PAT_TA_36079.pep
TGIQRKDKHILDSIFYFLYYFCYCFRSKVKARALSMNGSTVKSTSCYQIKIRPVSDT

SEQ ID NO: 141662 - protein, 189 aa, Triticum aestivum
  unsure (1)..(189): unsure at all Xaa locations
  Clone ID: PAT_TA_36080.pep
APRGAEIHPYQNKLXKHGASSAGFRPYSCPYAGSAXPLQGPLPMLVSHLINDHTVDLHERCTANHPXVNPSPYEGENATRILTVLKCFGQHFSRHFQASLLGMSPVYMAFLRFMGEESEARGFCYSLEVGGNGRKLTWQGTPRSIRDGHKKVRDSFDGLIIHRNMALFFSSGTRQELKLRVTGRIWKEQ

SEQ ID NO: 141663 - protein, 138 aa, Triticum aestivum
  Clone ID: PAT_TA_36081.pep
GVRRAGRIRCFPGRRRLLPGHLFPASSLPEFITAFERPAGGGGCPDRQIRCFPGRQRPRSPPPWWPQAPRPVSCTFLDPEANLVEVESMVMLPRFLLPGAPRSNNSSLEARRWFLISSPPSPCRLGSKHMKTHEQDAL

SEQ ID NO: 141664 - protein, 94 aa, Triticum aestivum
  Clone ID: PAT_TA_36082.pep
RRRRRRRQGRTRRRRGAGAGDLSPPLKTGRCAILLPRPTLPKSAADLRPSSSIPGASSAAAPTYSGGPPQRFYAGQLHRLTAAARPRLGQHRED

SEQ ID NO: 141665 - protein, 174 aa, Triticum aestivum
  Clone ID: PAT_TA_36083.pep
AALRRRFHKDALARIYSASIMYGYFLKSVAVRHRLDLTFARSEECLQPIQLLNAQLATTRKKEQQEAFDGSVETVPSSKPRSVVDPHDLKSYMMGFDPKTLELCAKLRTNEACNLIEKHSWALFGEKMGSTEIDEAVILDPASLKRLLLEAIAFGSFLWDSEDYVDEIYKLQDS

SEQ ID NO: 141666 - protein, 148 aa, Triticum aestivum
  Clone ID: PAT_TA_36084.pep
SGIPGSVEHDLCPIQATHHSDRISTQDWDDNYKTQSVSADVLSFMLSYMTEDSDLCPSCTFLLEYHTSTQYWDDEYTTESVASDVLGMIRALMTAEENRAPVISGLVPSFIRIPFSSEDLSIAILYKAFSYVLPLEDVLENPACLLWR

SEQ ID NO: 141667 - protein, 176 aa, Triticum aestivum
  unsure (1)..(176): unsure at all Xaa locations
  Clone ID: PAT_TA_36085.pep
RHQNPSRPRRRASRPEKNPAAKNPAEERSARPRSGCPAGSKPLAEKRLPAGKTAAGKEGGGKKAKKKGXKSVDTYKTDTPKVLNQVHPDIGISSKAMSLMNSSINDIFEKLPREAAKLARHHKEPTITSRSTQTSVPLVPPAALATHPASEGTTSVTKSTSSCASRFFAAWLSLCS

SEQ ID NO: 141668 - protein, 130 aa, Triticum aestivum
  Clone ID: PAT_TA_36086.pep
AGRVRPTSRRHHRSSSVSISVSSKPSTMSGRGKGGKGLGKGGAKRHRKVLRDNIQGITKPAIRRLARRGGVKRISGLIYEETRGVLKIFLENVIRDAVTYTEHAHRKTVTAMDVVYALKRQGRTLYGFGG

SEQ ID NO: 141669 - protein, 120 aa, Triticum aestivum
  Clone ID: PAT_TA_36087.pep
GEAPPPPPPPPLPYPDTFEQPPPPPQYPPSPESSPPPLPPSMPPPIPPPPPPPPSTDAFMPVPALPMGGMPYFPPFPPPVNYPMINMPPPFPGAPNPPHPGFLGFGGPFYGPPFPSAPHQ

SEQ ID NO: 141670 - protein, 218 aa, Triticum aestivum
  Clone ID: PAT_TA_36088.pep
AHESGTRPKPEHRSTTSRPGQLPTSRKGKPREMNARDLLFSGVDIVKQQASAVASTVSLAKPYLPAKLTEMNTGNIVAGLGYVKNHTGAAVASTVSLAKPYLPARLTGMNTGDIVAGLGYVKNHTGAAMVSTVSLAKPYLPAKLSTRDGAVGTAAMVIGGRRGRLLPLARCGRPRRSRRNDEVARPLAPRRLPPHSCREASKRAPSISPLCLVSVYCV

SEQ ID NO: 141671 - protein, 207 aa, Triticum aestivum
  unsure (1)..(207): unsure at all Xaa locations
  Clone ID: PAT_TA_36089.pep
MLHAHAASGKPVSRCMSQAKLVVATVLALELLLVATAVADGPVALSGCPEACGNVSVPYPFGFRQGCFRKGFNLTCEETRRPSKLLLGDGVEVXPISLADGTVHVQTKVVAFRPLSTNSVVGARRFIDYNYSWYGGLPXGAQLAVSTEHNVFVAIGWNFIGYFIVVSDGGREYVSTCSTLCNGKTRDALCTDVGCCWRMGSSCGAEK

SEQ ID NO: 141672 - protein, 126 aa, Triticum aestivum
  Clone ID: PAT_TA_36090.pep
LQRPYIYTIISTKWSWGLFIHLINKSLVSDIIHSSSLPPLLLITQPPCLCAIEPISFMANHPSISWPDRARVEVECRAGRGPPSSGDALHEREPHVLRRLPGAAGVRDEEHLSELKGRTRGARLCR

SEQ ID NO: 141673 - protein, 173 aa, Triticum aestivum
  Clone ID: PAT_TA_36091.pep
FEAKKIWYEHRLIDDMVAQMIKSSGGYIMALKNYDGDVQSDIVAQGFGSLGLMTSVLITPDGKTFESEAAHGTVTRHYREHQKGNETSTNPIASIFAWTRGLIQRGKLDDTPDVVAFAEGLEQACIDTVDIDGIMTKDLALATGKSERKDYATTNEYLDAVERRLKKTLKEKL

SEQ ID NO: 141674 - protein, 204 aa, Triticum aestivum
  Clone ID: PAT_TA_36092.pep
MPISPILTFKAGQCEVDTSSKPYKVKPQSEPGYIYLYSEDDLVHFCWRKRTEPLDNPELDLIMVPTDGSFTPYESTTSSEPTSKTDGRIFVLKFSSSSQRHIFWLQSKPQSENGDAAYYSPRDRKIGDIVNRLLQGEEVEVAEEMATVRNDDQDDDEDEAMEDADNQRPREQRGSGGAGPDATGGDVREEGEGSREGGADGARA

SEQ ID NO: 141675 - protein, 126 aa, Triticum aestivum
  Clone ID: PAT_TA_36093.pep
VPRIERKSTCIGWERSLATEKRERSSVAGDRLFCSSQISLAESGRSRGRGSRRWSARRRSPADREGLDLEIWRYGDQAGEITSDYLHATGNALKPPETLFKQERYHSTTTARWVLSSSTIWRRTSP

SEQ ID NO: 141676 - protein, 64 aa, Triticum aestivum
  Clone ID: PAT_TA_36094.pep
HATMDDQDDEAELTVLLHVFGWPVPHVLSDLGYLASKLVAGRLNTKARHAHMPQSDRCLLSSHK

SEQ ID NO: 141677 - protein, 446 aa, Triticum aestivum
  unsure (1)..(446): unsure at all Xaa locations
  Clone ID: PAT_TA_36095.pep
MAVNKAHIPIRDLETHAVLPGIEINDCGHKIGLNGVDNGALRFRSVRIPRDNLLNRFGDVARDGKYTSSLPTINRRFAATLGELVGGRVGLAYSSVGVLKVAVTIAVRYALLRQQFGPPKEPEISVLDYQSHQHKLMPMLASAYAFHFARAYLVDMYSEMKKTNDEDVTADVHVLSSGLKSYITSYTAKSISICRESCGGHGYAAVNRFGGLRNDHDIFQTFEGDNTVLLQQVAGDLLKQYQQKFKGGTLSVTWNYLRDSMNTYLSQPNPVTARWEGEDHLRDPKFQLDAFRYRTSRLLHSVAARLQKHMKTLGGFGAWNRCLNHLLTLAESHIESVILARFIEAVKSCPDEKTREVLKXLVCDLYALERIWKDIGTYRNVDYVAPNKAKAIHKLVDYLSYQVRLVARELVDAFDVPDQIIRAPIGMQSEAYAQYTQGVGFYRQPT

SEQ ID NO: 141678 - protein, 84 aa, Triticum aestivum
  Clone ID: PAT_TA_36096.pep
MSKPVKIGPWGGNSGSERDVQPKPTGMVSVTVSSGAIIDAIAFTYVGTDNAEHSSGIKWGGTGGTEDTVGKLFVFKNSLSCTIW

SEQ ID NO: 141679 - protein, 160 aa, Triticum aestivum
  Clone ID: PAT_TA_36097.pep
MIACVPLVRRQVRPPPPCRRCRGRGRGGGGRGRTGGGTRLSRPWGSRPSSAGAPPAPAARARGTPPASPSRGPRCRRLGPPASPAPRRRHLLRPAPPPCPARPRPPPPTPPPAPTAARPPSSSSFASSGYPPASSTPHHSLAPPLTDKPRRTPLLLHDPP

SEQ ID NO: 141680 - protein, 162 aa, Triticum aestivum
  Clone ID: PAT_TA_36098.pep
PGDPHRSLLGPDARRLAAALRGASRAVAWRSSHHAERVVGVRCRCSAAVREAPCIWSRPGAPEGAAGVEIWSCRRKQWFRGWPGRGLSAARRSARSRNRRGASQTPSRLAAASSLVSGHGRLASAVGKGVGRWPGVLHVVHRCDVEAGLSAASRYVAWIGGY

SEQ ID NO: 141681 - protein, 143 aa, Triticum aestivum
  unsure (1)..(143): unsure at all Xaa locations
  Clone ID: PAT_TA_36099.pep
RPGRPPEPPPXPGRRGRPEPEPEPPPXPGRLGKPPDPEPPPRPGRLGRPEPEPPPRPGRLGRPEPEPESPPRPGRLGRPPEPPPRLGRLGRPEPEPEPPPRPGRLGRPEPEPPPRPGSPPPRPVRGAMGPATAKGTRATRIDV

SEQ ID NO: 141682 - protein, 137 aa, Triticum aestivum
  Clone ID: PAT_TA_36100.pep
PAGFTRATPPGVFTEARLERDRERSDRKATTAKIQSFASEFLRQRPERRTAPSLRCSACMLRPPATATAVVVTLLLPQIYPPPRSSCPSGDGNGDGSTVNFHLLPPRGCLGAVLGVSRGAHGCCLSLQCSEPLTFSK

SEQ ID NO: 141683 - protein, 102 aa, Triticum aestivum
  Clone ID: PAT_TA_36101.pep
HIIGNTIHHPLTPIHSKVQGPRSAQQQKNSSKIASARQKGPTSTQVHNNIDWTRSTNIMSLVHIHYPITQAPMLCPSAGFATWWCYCIRAVPASPCPNGTCI

SEQ ID NO: 141684 - protein, 205 aa, Triticum aestivum
  Clone ID: PAT_TA_36102.pep
MAARSGIVVVAAALLALVAVSQAQAPGPSATPAGPPNVTAILVKGGQYTTFMRLMKETQQDTQLNSQLNNSFNGNGYTVFAPTDNAFNNLKPGTLNSLTQQQQVSLVQAHILPQYYTMESFQTASNPVRTQASGEKEPITVNIVATNNQVNVTTGLVEVAVNNALSAVKPLAVYSVDKVLLPEALFGAKAPAPAPTAAKGGKTRR

SEQ ID NO: 141685 - protein, 201 aa, Triticum aestivum
  unsure (1)..(201): unsure at all Xaa locations
  Clone ID: PAT_TA_36103.pep
DAWAAPWSSCYPHLLPYAXDTLDGDAFVDSPTGSPSPWNSHSLDQITDADVSRMRKKXWGSAQMPFGGANASQQPRKDVPKGFKKLLKFGRKNRGDGLVNDWVSASTASECDDDMEDGRDLAIGSSDDFRKSRMGYLSSYDGFVENEVLTEQEQSLRSSIPNPPANFRLREDQLTGSSIKAPRSFFSLSTFRSKGGDARLR

SEQ ID NO: 141686 - protein, 289 aa, Triticum aestivum
  Clone ID: PAT_TA_36104.pep
CGCPTLRSAKSPRLQFVIINGVIGIVSSLPHDHVYVFGETPENIRQFHQGSGEDGSHELQSECGRHGHILALYTHTRGDFLVVGDLMKSISLLVYKHEESAIEELARAYNANWMTAVEMIDDDIYVGAENSYNLFTVRKNSDAATDEERGRLEVVGEYHLGEFVNRFRHGSLVMRLPDSEMGQIPTVIFGTINGVIGIIASLPHDHYVFLEKLQTTLVKFIKGVGSLSHEQWRSFHNDKKTSEARNFLDGDLIESFLDLNRSKMEEVAKAMAVPVEELSKRVEELMRLH

SEQ ID NO: 141687 - protein, 166 aa, Triticum aestivum
  Clone ID: PAT_TA_36105.pep
ICLIPEVPFTLDGPNGVLRHLEHLIETKGFALMCVAEGAGQEYLQKSNATDASGNMVLSDIGVHLQQKIKSHFREINVHSDVKYIDPTYMLRAVRANASDAILCTVLGQNAVHGAFAGFSGITTGICNTHNVYLPIPEVIKTPRLVDPNSRMWHRCLTSTGQPDFC

SEQ ID NO: 141688 - protein, 128 aa, Triticum aestivum
  Clone ID: PAT_TA_36106.pep
AGVACLSDPLHLPAPLLPVHHLPAASFPIRPRRHCRLVQSSEFVVSGEIRIIQGEGRHAPPAEGYCQAAAHQAPAGPPAQAAGRVATCVCRLLAERRAQLPPILFGCALLLPAAAPRCCCLASIIIVG

SEQ ID NO: 141689 - protein, 91 aa, Triticum aestivum
  Clone ID: PAT_TA_36107.pep
LSPVPHMRNYTWALCFVALVAMATTFVSGHATRSYIGTTDMCAAGADDHCSPPERATGNILCKACCAAQGYDKDKSSCCQGSSSSCCCVKD

SEQ ID NO: 141690 - protein, 249 aa, Triticum aestivum
  unsure (1)..(249): unsure at all Xaa locations
  Clone ID: PAT_TA_36108.pep
RPLRLVVEKWDDHSKDEFCSEQVKILFYAIYTTVNQLGVVASAIQNRDVRKHLIELWLQLLRSMMSEAEWRMRKYVPTVEQYMSNAVVSFTLGPIVLTSLYFVGPKLSGCVIQDQEYXELFRLTSTIGRLLNDIQGLERESREGNLDCVSLLILHSGGSMSIETAKETIQKAIASCRKDLLKLVLRENTVVPRPCKELFWKMCKIVHLFYSQTDGFSSPNEMVSAVNAVINEPLKLQINNRPLPMQSVN

SEQ ID NO: 141691 - protein, 177 aa, Triticum aestivum
  unsure (1)..(177): unsure at all Xaa locations
  Clone ID: PAT_TA_36109.pep
RTPTPPTGGCLVAPGGSGPPAWGASRGLGRRARARMXQHSMHSSMQSSPFPPTARRVRPRALTITSFIAAAAASSAEVGVPHGFAPPAAVNRSLPSDGEGVSRPPVDRPYAWGWEGFGPFPWVPVDGEPHWWSTFNPMQNHTHGGFTRRPAPGERIPQSHPDSVYQPVPPLRMPPFL

SEQ ID NO: 141692 - protein, 291 aa, Triticum aestivum
  Clone ID: PAT_TA_36110.pep
TGSTGVLEALQGSSITLDRPADDGYNWRKYGQKAVKGGKYPRSYYKCTLNCPVRKNVEHSADGRIIKIIYRGQHCHEPPSKRFKDCGDLLNELNDFNDAKEPSTKSQLGCQGYYGKPITPNGMMTDVLLPTKEEGDEQLSSLSDIREGDGEITTVDGDDGDADANERNAPGQKIIVSTTSDADLLDDGYRWRKYGQKVVRGNPHPRSYYKCTYHGRDGKKHIERSSEEPHAVITTYEGKHTHDVPESRNRSQGTGQHHCKEQTYSEQPAASFCSSSEKRKYGTAILNDLAF

SEQ ID NO: 141693 - protein, 100 aa, Triticum aestivum
  Clone ID: PAT_TA_36111.pep
MGRSAIAKSTGLLREVKNRQSSNLTSRVQPTKARSAETALWVPHPRTGIYYPRGFEWVMEDVPSSAATFQQTYWLRSGDAETASSPTSTDGTAAFDNPFL

SEQ ID NO: 141694 - protein, 113 aa, Triticum aestivum
  Clone ID: PAT_TA_36112.pep
PTSYVQVLPADTFLPTYRPKIKKVYLCFKHHPWNGMEGRIHPSMESMERGSQSSVMPAQEHDDAALDDVEPGPVLLEAPAQASSTPPAPHKLHLCFNTHTHSYLSLWRGDSWK

SEQ ID NO: 141695 - protein, 85 aa, Triticum aestivum
  Clone ID: PAT_TA_36113.pep
RGCFGEPCHGIGCSKWAIFGKQNWRCGMNRKPGYGAQLRANLEPTKGVGRLRQQDPQAAAKRLTTEALARKSKDDISCIVIRFRC

SEQ ID NO: 141696 - protein, 119 aa, Triticum aestivum
  Clone ID: PAT_TA_36114.pep
MARRPLVLLALLAMTLAVASAVLGDHSERLGEWGPIPNLKDAHIQELGGWAVQHASLASNGLRFRRVTRGEQQVVSGMNYRLFVDAEDDSGKNASYLAEVYEQSWTKTRQLKSFKPAAN

SEQ ID NO: 141697 - protein, 104 aa, Triticum aestivum
  Clone ID: PAT_TA_36115.pep
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLDDDDN

SEQ ID NO: 141698 - protein, 75 aa, Triticum aestivum
  Clone ID: PAT_TA_36116.pep
GVHVRGARRPPAPCRDCGGACSYRCSKSSRPNLCNRACNTCCRRCNCVPPGTAGNEDVCPCYAHMTTHDGRHKCP

SEQ ID NO: 141699 - protein, 68 aa, Triticum aestivum
  unsure (1)..(68): unsure at all Xaa locations
  Clone ID: PAT_TA_36117.pep
SSVKGSSWSTPVGTRKMVNYAXAGRSQRKLWWRLEAILTCKSFVXLGYRGERLIEPSSSWFPPKFPSG

SEQ ID NO: 141700 - protein, 91 aa, Triticum aestivum
  Clone ID: PAT_TA_36118.pep
KIARARKTTKYMTKYERARILGTRALQISMNAPVMVELEGETDPLEIAMKELRARKIPFTIRRYLPDGSYEDWSVDELIVEDSWKRQVGGE

SEQ ID NO: 141701 - protein, 71 aa, Triticum aestivum
  Clone ID: PAT_TA_36119.pep
HGTVARTIDANVSEAEGIYSALEKLGIDWEEVGKQLEHEGVSSFKGSFDSLLTSLEEKGQCPQRPPPTCRR

SEQ ID NO: 141702 - protein, 154 aa, Triticum aestivum
  unsure (1)..(154): unsure at all Xaa locations
  Clone ID: PAT_TA_36120.pep
MADVDVDPEVAAAGPKKRTFRKFSYRGVDLDALLDMSTEDLVQLFPARPRRRFSRGLKRKPMALVKKLRKAKSEASAGEKPEQVRTHLRNMIIMPEMIGSVVGIYNGKCFNQVEIKPEMIGHYLAELSLSYKPVKHGRPGIGATHXSSRFIPLK

SEQ ID NO: 141703 - protein, 184 aa, Triticum aestivum
  Clone ID: PAT_TA_36121.pep
QSKWYRLASLHLLTTVDFVCYYHILSLVPNCFLRPREAQKAADEAKARFGHIDGDHLTLLNVYHAYKQNNEDPQWCYENFINSRALKSADNVRQQLVRIMTRFNLKMCSTDFNSREYYVNIRKAMLAGYFMQVAHLERTGHYLTVKDNQGVHLHPSNCMDHKPEWVIYNEYVLTTRNFIRTVTD

SEQ ID NO: 141704 - protein, 203 aa, Triticum aestivum
  Clone ID: PAT_TA_36122.pep
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPLRSVPEGGVICNVEHHVGDRGVFARGIRVTIAIVHQATQPPTNGHPSRESKSPSGWPKEKIVPKASLPVAHELVGLLGGVAKNLEKAQMASRAWVNRPTH

SEQ ID NO: 141705 - protein, 153 aa, Triticum aestivum
  unsure (1)..(153): unsure at all Xaa locations
  Clone ID: PAT_TA_36123.pep
MARTKQTARKSTGGKAPRKQLATKAARKSAPTTGGVKKPHRYRPGTVALREIRKYQKSTELLIRKLPFQRLVREIAQDFKTDLRFQXHAVLALQEAREAYLVGLFEDTNXCAIHASAEHNGQDIQVAGRTGGGRLTNEEGQAPLPTGQSWAAY

SEQ ID NO: 141706 - protein, 72 aa, Triticum aestivum
  Clone ID: PAT_TA_36124.pep
ASIFSAGASSIRALVGFAHCPRFPTAAPRGSPGRVSVPVWLIIRKDQLSIIGLVSLYLTNYLILRRLIKQRF

SEQ ID NO: 141707 - protein, 69 aa, Triticum aestivum
  Clone ID: PAT_TA_36125.pep
QLTCLLGQLSKEVGWNYADTIRELEEKRKEKAKVSYDRRKQLAKLRVKAEKAAEEKLGTQLEILAPIKY

SEQ ID NO: 141708 - protein, 104 aa, Triticum aestivum
  Clone ID: PAT_TA_36126.pep
RGCFGEPCHGIGCSKWANSVDVTSLRDPQEDAVRVKNPEWLVVIGVCTHLGCIPLPNSGDFGGWFCPCHGSHYDISGRIRKGPAPYNLEVPTYSFLEDNKMLIG

SEQ ID NO: 141709 - protein, 152 aa, Triticum aestivum
  unsure (1)..(152): unsure at all Xaa locations
  Clone ID: PAT_TA_36127.pep
MAGTVPKLAAPRPAAAGPLPSQSLRAAALAFAPSARRFRVSLAGRARSPVIAMASAKEGNGAVTKRTTLHDLYEQTRVKSPWYDXTFCRPVTDFAAPXIANGGRGGTSNPTIFPESHLFIQTPLTGQSREAIFTWEGMRRSGLPGNPAIKGT

SEQ ID NO: 141710 - protein, 68 aa, Triticum aestivum
  unsure (1)..(68): unsure at all Xaa locations
  Clone ID: PAT_TA_36128.pep
SSVKGSSWSTPVGTRKMVNYAXAGRSQRKLWWRLEAILTCKSFVXLGYKGERLIEPSSSWFPPKFPSG

SEQ ID NO: 141711 - protein, 90 aa, Triticum aestivum
  unsure (1)..(90): unsure at all Xaa locations
  Clone ID: PAT_TA_36129.pep
VGWCGCFGEPCHGIGSYLANFNDHLTGHLDDRRISGLSGIRVRAFFRWWSITGIRADGDELVFEVGSVSAXKFPARHFNASLECPAKADS

SEQ ID NO: 141712 - protein, 147 aa, Triticum aestivum
  Clone ID: PAT_TA_36130.pep
KTRGMGAGRKLKTHRRNQRWADKAYKKSHLGNEWKKPFAGSSHAKGIVLEKIGIEAKQPNSAIRKCARVQLVKNGKKIAAFVPNDGCLNFIEENDEVLIAGFGRKGHAVGDIPGCQVQGLSKDFGGGAFCFFFSRGKKGGKPPGLFK

SEQ ID NO: 141713 - protein, 163 aa, Triticum aestivum
  unsure (1)..(163): unsure at all Xaa locations
  Clone ID: PAT_TA_36131.pep
MRLASWMSLGMMVTRLAWMAQRLESELFQSGISLMARAPPEGGLLRLPPKLRRKGPKPIPGNSKASXGLSVQVQVVRIFTDMSISPSLSPRQCPDRYAFRAGRNLPDKEFRYLRTVIVTAAVHRGFGRRLPCHQFTNFLDLPALGRRQPPYMVLRLCGDLCFW

SEQ ID NO: 141714 - protein, 145 aa, Triticum aestivum
  Clone ID: PAT_TA_36132.pep
MANPRVFFDMTVGGAPAGRIVMELYKDAVPRTVENFRALCTGEKGVGKSGKPLHYKGSAFHRVIPDEKFVHKHTKPGILSMANAGPNTNGSQFFICTVPCNWLDGKHVVFGEVVEGMDVVKNIEKVGSRSGTCSKQVVIADCGQL

SEQ ID NO: 141715 - protein, 147 aa, Triticum aestivum
  unsure (1)..(147): unsure at all Xaa locations
  Clone ID: PAT_TA_36133.pep
MVAFRFHQYQVVGRALPTPGDEQPKIYRMKLWATNEVRAKSNSGYFLRKLKKVKKEQRQMLRHQRDLLRKNPTTIQELWHLSCVTKSKTRYHNMLQGYPYTTLNGXAVEQXFTEMAXRQRVXXPASVIKTATSTQSRETTQAFTTPS

SEQ ID NO: 141716 - protein, 77 aa, Triticum aestivum
  Clone ID: PAT_TA_36134.pep
LMYQCDVACLIDDWLSLTRKKNKKTLSIYLRRILIPFIRQPLLLLVFACLLACLLVALSSVGKSTTKMCGAGTLLDH

SEQ ID NO: 141717 - protein, 136 aa, Triticum aestivum
  Clone ID: PAT_TA_36135.pep
MARTKQTARKSTGGKAPRKQLATKAARKPAPATGGVKKPHRFRPGTVALREIRKYQKSTVLLIRKLPFQRLVREIAQDFKTDLRFQSSAVSALQEAAEAYLVGLFEDTNLCAIHAKRVTIMPKDIQLAPRIRGERA

SEQ ID NO: 141718 - protein, 134 aa, Triticum aestivum
  Clone ID: PAT_TA_36136.pep
MAKPSQSRLLLVFPVAAVLASAFLLPLARSDASGPTPTATAYDELRLRGFPRGLLPANVRGYTLDAGSGDFAVNLDSSCRIVLPAGSYLANFNDHLTGHLDDRRISGLSGIRVRAFFRWWSIAGIRADGDELVF

SEQ ID NO: 141719 - protein, 175 aa, Triticum aestivum
  unsure (1)..(175): unsure at all Xaa locations
  Clone ID: PAT_TA_36137.pep
EREREREREREREREREREREREREREREREREREREREMGAGRKLKTHRRNQRWADXAYKKSHLGNEWKKPFAGSSHAKGIVLENIGIEAKQPNFPIRKCARVQLVKNGKKIAAFVPNDGCLNFIEENDEVLIAGFGRKGHAVGDIPGVRFKVVKVSGVFLLALFKKKKEKPRF

SEQ ID NO: 141720 - protein, 137 aa, Triticum aestivum
  unsure (1)..(137): unsure at all Xaa locations
  Clone ID: PAT_TA_36138.pep
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATXASGGVMPNIHQHLLPKKASSSKASTVDDDDNRP

SEQ ID NO: 141721 - protein, 117 aa, Triticum aestivum
  unsure (1)..(117): unsure at all Xaa locations
  Clone ID: PAT_TA_36139.pep
RGRYPLWITSFLYDTLPLRGVVGWRPDDQRSRLFSLLGQMKMEVEVLLLAGFADEFGEGAGWWGPPMAAVVVLQASCSWRCLGSSLLNDAARCLPNLLIVPEFSWRXSXSRFVLVTR

SEQ ID NO: 141722 - protein, 186 aa, Triticum aestivum
  unsure (1)..(186): unsure at all Xaa locations
  Clone ID: PAT_TA_36140.pep
MGKTRGMGAGRKLKTHRRNQRWADKAYKKSILGNEWKKPLAGSSHAKGNVLRKXIASEAKAXNSAIXKCARVPLXVKNGKKLPLLCPNDGAFNYIPGNDEVLIAGSXPXRHAVGNPRVXFKXVKAPGFPGPKEKTELKPPKQVCLEGTHVRTTNVSNLKIELKRASFSKYLPEKKGAGHFPKPQGV

SEQ ID NO: 141723 - protein, 178 aa, Triticum aestivum
  unsure (1)..(178): unsure at all Xaa locations
  Clone ID: PAT_TA_36141.pep
EMLFPVTSPIPNVPNWSIEGLISHAKILEKKPIEQRHLQRRKALIKSKADTAFKQKEYKIATKIYDLAIAHGESATLYANRSVCKLLIGDGEGALSDALMCXMLRPDWAKACYRQAAAHMLLKEYEQARDALLDAHNLDPGNAEIEGELQKARELMKNPPGECEQCTDSGDATCASFH

SEQ ID NO: 141724 - protein, 213 aa, Triticum aestivum
  Clone ID: PAT_TA_36142.pep
WTATAILQEVTAILHVLLSRSTLVHLLKNVQGLTKKGMQKEMQYPAVLQWRASAQKKTNIMAEKITPVYTPLLAVQIIANATSWELMYRSSEGFLPLVAQVALLVCLVSPPLVPAVGLELAPSSHTTCLTTRWDGNASSILVVEHACIISNESTGIFHQRKARRRAAPRYVHKSLMILLPHIHFSRIFMWVLLFRPSITASDDLSEVHGHGVE

SEQ ID NO: 141725 - protein, 122 aa, Triticum aestivum
  unsure (1)..(122): unsure at all Xaa locations
  Clone ID: PAT_TA_36143.pep
MAATIQSVKARQIFDSRGNPTVEVDVCCSDGTFARAAVPSGASTGCXYKLWELRDGGSDYLGQGCXSKAVNNVNSIIAPALXVGKDPTAQTDSDNFKGQQLDGTKNEWGLVQAKLGAMQPAV

SEQ ID NO: 141726 - protein, 108 aa, Triticum aestivum
  Clone ID: PAT_TA_36144.pep
MNRKPGYGAQLRANLGPTKGVDLPLKVFRDAGIHGHAFLTAGNLAKLSEGQYKNFSLDEFRRSFRSTAGVGIILPTKLFRVEVNYCYILKQSQHDSGKTGIQFSFSSP

SEQ ID NO: 141727 - protein, 86 aa, Triticum aestivum
  Clone ID: PAT_TA_36145.pep
MHPEIAMEKYMNLLSEFLPGWMGDTTPSTEKQKVDVDSEGALLTMTTHTSDPQINQGNEGSTSIDEGPLTVPPNPEKGQSSDVPTE

SEQ ID NO: 141728 - protein, 61 aa, Triticum aestivum
  Clone ID: PAT_TA_36146.pep
TYCAMKQVQSIHAHRYVLCSKNLLVFFVQNPSYLHISTTQLNFFRFVSTNITTTIVASGPS

SEQ ID NO: 141729 - protein, 75 aa, Triticum aestivum
  Clone ID: PAT_TA_36147.pep
WKSFFSSGSVAMYMVLYSINYLVFDLKSLSGPVSATLYLGYSLFMVIAIMLATGTVGFISSFCFVHYLFSSVKAD

SEQ ID NO: 141730 - protein, 84 aa, Triticum aestivum
  unsure (1)..(84): unsure at all Xaa locations
  Clone ID: PAT_TA_36148.pep
VFTGQALHSSLNSNSYTGYKRAFFVFRVESSIYSLFKKEIKGSLFCFSFLPINSFTAGLPCRRYPNSRIRTTGSKXILGGRAKN

SEQ ID NO: 141731 - protein, 195 aa, Triticum aestivum
  Clone ID: PAT_TA_36149.pep
MASRAIIRRRKYLLDHVNTPILSSSSSSFRHGTFGFKPEPRIAQPFLEQSLGDSKSEKEKEQYSVDLTKGGLLGPDNGLLRRPAHVISHYGYGIGRNEFTLPFGARGLLQSVRKASTATAGQPKLDIEEQGDENQNKRKKEASPEECDQAVEGLSTAKAKAKAKQVQDSLKADQSIVKKFWARLLGIGPALRAVA

SEQ ID NO: 141732 - protein, 208 aa, Triticum aestivum
  Clone ID: PAT_TA_36150.pep
PTRPEDLALKEMTEPTAREEEELIEAKQHDKEQLCNISRALAVLASASSVSKERQEFLNLVNKEIKLYNSMLEREDTEGAEEAKKAYMAAREESDDTTEVASEEKVSSALIDKVDAMLQELEKEIDDVDAQIGNRWQLLDRDHDGKVTPEEVAAAAAYLKDTIGKEGVQELISKLSKDKEGKIRVEDIVKLASQAEENNEDDEEEARH

SEQ ID NO: 141733 - protein, 96 aa, Triticum aestivum
  Clone ID: PAT_TA_36151.pep
VSIHALYRTAENLQGKTDATEGSYCCSASLRVPTLSLTIRAVGYSIRPSLTRNAYCFFVCTYDIFHPFASVPRPPGQVSCPVIRVCVWCFCLLVLI

SEQ ID NO: 141734 - protein, 70 aa, Triticum aestivum
  Clone ID: PAT_TA_36152.pep
MVSGSGVSARRVVVDARHHMLGRLASIVAKELLNGQRVVVVRCEEMCISGGLVRQKMKYLRFLRKRMELP

SEQ ID NO: 141735 - protein, 121 aa, Triticum aestivum
  Clone ID: PAT_TA_36153.pep
MGKTRGMGAGRKLKTHRRNQRWADKAYKKSHLGNEWKKPFAGSSHAKGIVLEKIGIEAKQPNSAIRKCARVQLVKNGKKIAGFGRKGHAVGDIPGVRFKVVKVSGVSLLALFKEKKEKPRS

SEQ ID NO: 141736 - protein, 146 aa, Triticum aestivum
  Clone ID: PAT_TA_36154.pep
ESNNATSARERSTHPSESQDRDELVGGQEGGVAGGGDEHGGRGGAQGPGGDCAAGTTRSARSTTAPSRRPYPPPPSTPGAAARRPSAGLRGPGDPRRRSCTRRTTSSAGDPTELIVIAKLISTNKHIRVLLLHFYSFPSWLSVNGV

SEQ ID NO: 141737 - protein, 123 aa, Triticum aestivum
  Clone ID: PAT_TA_36155.pep
MKTSLLHKLAMQEFMILPTGATSFKEAMKMGVEVYHNLKSVIKKKYGQDATNVGDEGGFAPNIQENKEGLELLKTAIEKAGYTGKVVIGMDVAASEFYKNKCRVVIMSRMQIPSSMAPPVHGT

SEQ ID NO: 141738 - protein, 120 aa, Triticum aestivum
  unsure (1)..(120): unsure at all Xaa locations
  Clone ID: PAT_TA_36156.pep
YHNAMLRIALDXLQRRRPDARIIYADYYTPYIQFARTPHLYGYKRGALRACCGGGGPYNYNMSSSCGLPGATVCDDPDAHVSWDGIHLTEAPYRFIANTWLKGPYAYPPLASVVRDDMVY

SEQ ID NO: 141739 - protein, 64 aa, Triticum aestivum
  Clone ID: PAT_TA_36157.pep
KVRGVAMNPVEHPHGGGNHQHIGDACTVRRDAPPGQKVGLIAARRTGRLRGQAAATASKADKAT

SEQ ID NO: 141740 - protein, 136 aa, Triticum aestivum
  Clone ID: PAT_TA_36158.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGPFEDTNLCAIHAKRVTIMPKDIQLARRIRGERA

SEQ ID NO: 141741 - protein, 192 aa, Triticum aestivum
  unsure (1)..(192): unsure at all Xaa locations
  Clone ID: PAT_TA_36159.pep
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVXPVPAFNVINGGSHAGNKLAMPEFMILSTGAASFKEAMEKWG

SEQ ID NO: 141742 - protein, 75 aa, Triticum aestivum
  Clone ID: PAT_TA_36160.pep
STPAPGVLSMANAGPNTNGSQFFICTVATPWLDGKHVVFGQVVEGMDVVKAIEKVGTRNGSTSKVVKVADCGQLS

SEQ ID NO: 141743 - protein, 305 aa, Triticum aestivum
  Clone ID: PAT_TA_36161.pep
WLGLIVVQDWMKFSSYKERLLGLSLGLLSTRHHDLSYNLTWRSLTDPSRLASTSIRRQLGHNLLSALKYTYKIDERDSHIRPTKGYAFLSSSQVGGLWDNKGLKFFRQEFDVRAAVPFGFWNAALNVGVGAGVVLPLARGFMNSSTPVTDRFNLGGHNSPVCSLGGISSLLGFRTRGVGPTEPRRLVPGESEDGSPAVPGRDYLGGDLAVSAFADLSFDLPLKVLRDAGIHGHAFLTAGNLAKLSEGQYKNFSLDEFRRSFRSTAGVGIILPTKLFRVEVNYCYILKQSQHDSGKTGIQFSFSSP

SEQ ID NO: 141744 - protein, 136 aa, Triticum aestivum
  Clone ID: PAT_TA_36162.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFGDTNLCAIHAKRVTIMPKDIQLARRIRGERA

SEQ ID NO: 141745 - protein, 144 aa, Triticum aestivum
  unsure (1)..(144): unsure at all Xaa locations
  Clone ID: PAT_TA_36163.pep
MGKTRGMGAGRKLKTHRRNQRWADKAYKKSHLGNEWKKPFAGSSHAKGXIVLEKIGIEAKQPNSAIRKCARVQLVKNGKKIAAFXXPNDGCXNYIEENDEVLIAGFGRKGHAVGDIPGVXFXVVKVSRVSLLALFXEKKEKPRS

SEQ ID NO: 141746 - protein, 59 aa, Triticum aestivum
  Clone ID: PAT_TA_36164.pep
SYEEGISSDLSNALISPMQEILDDDRYVHSAGTSELCPISGLGGLVSGPSSMLALPSFP

SEQ ID NO: 141747 - protein, 136 aa, Triticum aestivum; identical to SEQ ID NO: 106789
  Clone ID: PAT_TA_36165.pep

SEQ ID NO: 141748 - protein, 197 aa, Triticum aestivum
  Clone ID: PAT_TA_36166.pep
GTRLSETSMAFGRSLVTDSNGNYKGPLTLSLKQGSLLVMRGNSADMARHVVCPSSNRRVSITFVRVRPSTPVDLSPLPSPTKAMTLWQPPPTAATAGMQKPPHGSNGAIIGYCPAPQAMLAPAWGMAVRAAPVMMVAAPARPMVMAPSSNINKRMGRGGTGVFLPWTVGPKRYNKHLPPRIQKRRFSAMMSPIESQG

SEQ ID NO: 141749 - protein, 89 aa, Triticum aestivum
  Clone ID: PAT_TA_36167.pep
CFHWGQPSSSPATPPSPTRRAPFSCQAKTKTKWSWKSKSAKECVTTHLPNQLCSNLRGLQWLCAPTPPRLPRPLHRRPRAQVHGRRRRR

SEQ ID NO: 141750 - protein, 178 aa, Triticum aestivum
  unsure (1)..(178): unsure at all Xaa locations
  Clone ID: PAT_TA_36168.pep
MALQAATSFLPSALSARKEGAAKDSAFFGVRLADGLKFDTTSLGLRTKRVNTSSVAIRAQAAAVSAPTATPASPSGKKTVRTXGNAVITGASSGLGLATAKALAESGKWXHVIMACRDYLKTARAGQXRSGMPKGNYTIVHXWTLASLDSVRQFVKNVRQLDMPIDVVVCNAAVYQPT

SEQ ID NO: 141751 - protein, 105 aa, Triticum aestivum
  Clone ID: PAT_TA_36169.pep
PRRRFKRGLKRKPMALVKKLRKAKKDAPAGEKPEPVRTHLRNMIIVPEMIGSLIGVYNGKTFNQVEIKPEMIGHYLAEFSISYKPVKHGRPGIGATHSSRFIPLK

SEQ ID NO: 141752 - protein, 210 aa, Triticum aestivum
  Clone ID: PAT_TA_36170.pep
MAEANSYEEQRRRQVEENKRKLEELRLHHLSAAVREAAVKPRLKRKAPKPRDAADDAPPRRSGRIATLPEQPDYRDNVKLGTRKPWQQKEVKPDHAYAIAKAEELQDELGSDYPTFVKPMPQSLTSLHIPAQFSMEHLPDHGMRMVLVDEEEEEFKVRYRPHSSSLVAGWSEFAVDNELVEGDCLVFQLIKRALFKVYIFRASSYYENDH

SEQ ID NO: 141753 - protein, 60 aa, Triticum aestivum
  Clone ID: PAT_TA_36171.pep
WQQEGNIRQYTLEHNTAILARTRDLPTTMQDQTHANETKLTSLHQSPEQTHYIDHDTNKH

SEQ ID NO: 141754 - protein, 98 aa, Triticum aestivum
  Clone ID: PAT_TA_36172.pep
MLSLGAALLVADDVGAILLPSQDKDQVAMAAPRPWKCCDVTICTRSIPPTCSCQDVVDNCAPTCEDCNGYVHPPRRVCLDRYTGDPGPRCTGAGTGGN

SEQ ID NO: 141755 - protein, 205 aa, Triticum aestivum
  Clone ID: PAT_TA_36173.pep
AYPGAFPVDPTPPETSMAFGRSLVTDSNGNYKGPLTLSLKQGSLLVMRGNSADMARHVVCPSSNRRVSITFVRVRPSTPVDLSPLPSPTKAMTLWQPPPTAATAGMQKPPHGSNGAIIGYCPAPQAMLAPAWGMAVRAAPVMMVAAPARPMVMAPSSNINKRMGRGGTGVFLPWTVGPKRYNKHLPPRIQKRRFSAMMSPIESQG

SEQ ID NO: 141756 - protein, 167 aa, Triticum aestivum
  unsure (1)..(167): unsure at all Xaa locations
  Clone ID: PAT_TA_36174.pep
MVAFRFHQYQVVGRALPTPGDEHPKIYRMKLWATNEVRAKSKFWYFLRKLKKVKKSNGQVLAINEIFERNPTTIKNYGIWLRYQSRTGYHNMYKEYRDTTLNGAVEQMYNEMASRHRVRSPCIQXIKTATVHFKLCKRDNTKQXHNSEXKXPLVYRKVRPPTRTETQ

SEQ ID NO: 141757 - protein, 126 aa, Triticum aestivum
  Clone ID: PAT_TA_36175.pep
VNSVALYHNAMLRIALDQLQRRRPDARIIYADYYTPYIQFARTPHLYGYKRGALRACCGGGGPYNYNMSSSCGLPGATVCDDPDAHVSWDGIHLTEAPYRFIANTWLKGPYAHPPLASVVRDDMVY

SEQ ID NO: 141758 - protein, 174 aa, Triticum aestivum
  Clone ID: PAT_TA_36176.pep
EVVLPLARGFMNSSTPVTDRFNLGGHNSPVCSLGGISSLLGFRTRGVGPTEPRRLVPGESEDGSPAVPGRDYLGGDLAVSAFADLSFDLPLKVFRDAGIHGHAFLTAGNLAKLSEGQYKNFSLDEFRRSFRSTAGVGIILPTKLFRVEVNYCYILKQSQHDSGKTGIQFSFSSP

SEQ ID NO: 141759 - protein, 181 aa, Triticum aestivum
  Clone ID: PAT_TA_36177.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSYDRRKQLAKLRVKAEKAAEEKLGTQLEILAPIKY

SEQ ID NO: 141760 - protein, 166 aa, Triticum aestivum
  Clone ID: PAT_TA_36178.pep
MARTKHPAVRKTKALPKKQLGTRPSAGTPRRQETDGAGTSATPRRAGRAAAPGAAEGATGQPKQRKPHRFRPGTVALREIRKYQKSVDFLIPFAPFVRLIKEVTDFFCPEISRWTPQALVAIQEAAEYHLVDVFERANHCAIHAKRVTVMQKDIQLARRIGGRRLW

SEQ ID NO: 141761 - protein, 188 aa, Triticum aestivum
  Clone ID: PAT_TA_36179.pep
AGTPLRPNQYIEIYLFSLIDEDVKSVDPGYFERHWGVMRYDGQPKYAMDPTGQGRNTALVGARGVQYLPRVWCVLNANAANMSKLADSVCYACTNADCTSLSLGSTCNGVDAAGNASYAFNAYFQVQDQDEVACGFDGLAVSTRQDPSTGTCNFTIQLETTSAAAGRPTVLLTTALLALVLAAMVTML

SEQ ID NO: 141762 - protein, 74 aa, Triticum aestivum
  Clone ID: PAT_TA_36180.pep
RRIRVRFRRGSLRNGYHIQGRQQARKLPKTFNQVEIKPEMIGHYLAEFSISYKPVKHGRPGIGATHSSRFIPLK

SEQ ID NO: 141763 - protein, 110 aa, Triticum aestivum
  Clone ID: PAT_TA_36181.pep
LDARPWPPAPAPGATTTAPHAQGHAHPGRGRPAPARPCPQPPAIEPAGPPRRPPPATQPRPHSAAPSSRPHKPSARNFTGQRPVHKDQQPHPAAMGPEQGQPMHLDGRQP

SEQ ID NO: 141764 - protein, 422 aa, Triticum aestivum
  Clone ID: PAT_TA_36182.pep
SDEARPAAAPLRPASLRTAALAFAPSPRRATVSVAGRARSPIIAMASAKEGNGAPTKKTALHDLYELQGLSPWYDNLCRPVTDLLPLIASGVRGVTSNPTIFQKAISSSSAYDDQFKQLISGGKDAESAYWELVIKDIQDACKLFEPIYNETDGADGYVSVEVSPRLANDTQGTVEAAKWLHKVVNRPNVYIKIPATAECVPSIQEVIANGISVNVTLIFSIARYEAVIDAYLDGLEASGLSDLSRVTSVASFFVSRVDSLIDKMLEKIGTPEALALRGKAAVAQAKLANQLYQKKFSGPRWEALAKKGAKKQRLLWASTGVKNPAYPDTLYVDSLIGPDTVNTMPDQALQAFIDHGTVSRTVDANVSEAEGVYSALEKLGIDWDAVGKQLELEGVDSFKKSFDSLLVSLQEKGNSLKTASV

SEQ ID NO: 141765 - protein, 124 aa, Triticum aestivum
  unsure (1)..(124): unsure at all Xaa locations
  Clone ID: PAT_TA_36183.pep
VQSKSLNEDPLEGKCGSVTVRMVPAPRGSGIVAARVPKKVLQFAGIDDVFTSSRGSTKTLGNFVKATFDCLMKTYGFLTPDFWRETTFTKAPYQEFTDILXAKPTKALMLDAPAREDRSLGCLP

SEQ ID NO: 141766 - protein, 96 aa, Triticum aestivum
  unsure (1)..(96): unsure at all Xaa locations
  Clone ID: PAT_TA_36184.pep
MVSGSGVCAKRIVVDARHHMLGRLSSIIAKELLNGQKVVVXVRCEEICMSGRAXVRQKMKYLRFLPQAXMNTKPFPRAIHFRAPAKILWRTIRGMI

SEQ ID NO: 141767 - protein, 143 aa, Triticum aestivum
  Clone ID: PAT_TA_36185.pep
MGKTRGMGAGRKLKTHRRNQRWADKAYKKSHLGNEWKKPFAGSSHAKGIVLEKIGIEAKQPNSAIRKCARVQLVKNGKKIAAFVPNDGCLNFIEENDEVLIAGFGRKGACRGRHPPVSRFKVVKVSGVSLLALFKEKKEKPRS

SEQ ID NO: 141768 - protein, 216 aa, Triticum aestivum
  unsure (1)..(216): unsure at all Xaa locations
  Clone ID: PAT_TA_36186.pep
MGQRLLLLVTTCLWALSCAVPHDASSPDGLLRINLNKKSLTYESLAAAKAARQQGALRLKSSDSDSDIVPLVDYLNTQYYGVIGLGTPPQNFTVIFDTGSSNLWVPSSKCYFSIACYLHPKYKSSKSSTYKADGEICKITYGSGAISGFFSNDNVLVGDLVVKNQKFIETTRETSVSFIVGKFDGILGLVPXISVGKASSWLTCKTKLXADDYPFG

SEQ ID NO: 141769 - protein, 173 aa, Triticum aestivum
  unsure (1)..(173): unsure at all Xaa locations
  Clone ID: PAT_TA_36187.pep
MAKPSQSRPLFVFPVAAVLAAAFLLPLARSDASGPTPTATAYDELRLRGFPRGLLPANVRGYTLDAGSGDFAVDLDSSCRIVLPAGSYLANFNDHLTGHLDDRRISGLSGIRVRAFFRWWSITGIRADGDELVFEVGSVSAKFPARXHFNASLECPAKADSVSTITRNSWRAS

SEQ ID NO: 141770 - protein, 149 aa, Triticum aestivum
  unsure (1)..(149): unsure at all Xaa locations
  Clone ID: PAT_TA_36188.pep
MADVDVEPEVAAGAPKKRTFRKYSYRGVDLDALLDMSTDDLVQLFPARARRRFQRGLKRKPMALIKKLRKAKKDAPAGEKPEPVKTHLRNMIIVPXEMIGSIVGVYNGKTFNQVEIKPEMIGXLADSISISRSKHGRPGIGATTLAVIK

SEQ ID NO: 141771 - protein, 139 aa, Triticum aestivum
  unsure (1)..(139): unsure at all Xaa locations
  Clone ID: PAT_TA_36189.pep
MALQAATSFLPSALSARKEGAAKDSAFFGARLADGLKFDTTSLGLRTKRVNTSSVAIRAQAAAVSAPTATPASPSGKKTVRTGNAIITGASSXGLGLATAKALAESGKWHVIMACRDYLKXXRAQPRRAAMPKGNYTSY

SEQ ID NO: 141772 - protein, 155 aa, Triticum aestivum
  Clone ID: PAT_TA_36190.pep
SPTQRMARRRTYWTPPTPPRPIHTHTHAPRPHTPTRTHAHTPRRRANQAGQTEKGHLISSHATGTDLAEEVAEGGGGEGGRGEGHGGRGVGGGRRGRGLGGGRGGDERGGHGGDGDELHPETGHWRLDLVPGAGRGGRRGSRCCLFGCEISLGGS

SEQ ID NO: 141773 - protein, 136 aa, Triticum aestivum; identical to SEQ ID NO: 106789
  Clone ID: PAT_TA_36191.pep

SEQ ID NO: 141774 - protein, 66 aa, Triticum aestivum
  Clone ID: PAT_TA_36192.pep
PRRRRFSVRFLPPPVKIQESEHSLLSDHFHHRQSQVRASMSTYRRQQVPLKHRAVVPDVDVEWGTS

SEQ ID NO: 141775 - protein, 136 aa, Triticum aestivum; identical to SEQ ID NO: 106789
  Clone ID: PAT_TA_36193.pep

SEQ ID NO: 141776 - protein, 381 aa, Triticum aestivum
  Clone ID: PAT_TA_36194.pep
MAAPFLYTRSSGNGTSQDAAMRAAFDGDLRRLRGTVKSLDDPRVIFSFDMGYGLGVLHIAAAGGHLEVCKYLVEELGGDVNAPAPGVVDFAGVTPFMLSAQSGDVSTVKYLLDHGGDLIKADAKGRTVLHHAAGIGSCKVTEFLLSKGVPVDIYCGRGTPLHQAATNEHDKTVKILLEHHADPNTTVIGLGTALMGALLYRSLKCMKLLIKAGADVNCKGCAMTPLVFATGRGGYTNYIQFLLKAGADPNIPDDLGRLPIEFAAVRDCKEEVEMLFPLTNPIPNVRNWSIEGVISYAKIQDKKPMEQKHVEKRKAFLKLQANTAFKQKEYKLASQLYGLAIDHAESAALYANRSVCKLLMGDGESALSDALRCRMLRPDWA

SEQ ID NO: 141777 - protein, 271 aa, Triticum aestivum
  Clone ID: PAT_TA_36195.pep
MSLLSKLRLVTVDVTGTLLAYKGRLGDYYCMAAKAAGKPCPDYDRMHEGFKLAYTEMARKYPCFGFAAKMPTIEWWRICVKDSFVKAGYDYDDETFEKVFKRIYSAFGSSAPYSVFPDAQPFMRGLREKGITVGIVSNAEYRYKEVILPALGLNQGSEWDFGVFSGIVGVEKPDPTIYKIALEMAGNVAPEEALHIGDSYRKDYVPARSIGMHALLLDRFKTAEAESWRKSGAPVLPDLEAAQAWLTKNPTEEPAEEPLGAALLRRMAEKL

SEQ ID NO: 141778 - protein, 148 aa, Triticum aestivum
  unsure (1)..(148): unsure at all Xaa locations
  Clone ID: PAT_TA_36196.pep
MVAFRFHQYQVVGRALPTPGDEQPKIYRMKLWATNEVRAKSKFWYFLRKLKKVKKSNGQMLAINEIFEKNPTTIKNYGIWAAXYKSKTGYHNMYKEYRDXVNFKLCKRDNTKQFHNSKIKFPLVYQKVRPPTRKLKTTYKATRPNLFM

SEQ ID NO: 141779 - protein, 365 aa, Triticum aestivum
  unsure (1)..(365): unsure at all Xaa locations
  Clone ID: PAT_TA_36197.pep
LPESYPICSDHDECIVRPERIKIQKGFMAKESVKGHMVNVVKGLKIYEDVFTTMELMKVADFINEIRQAGRNGELSGETFIFFNKQIKGNKREIIQLGVPLFQHTTEETNCHIEPIPVVLQAVIDHLVLWALXIQESRKPNSVIINFFDEDEHSQPYFKPPHLDNPISTLLLSETSMAFGRSLVTDSNGNYKGPLTLSLKQGSLLVMRGNSADMARHVVCPSSNRRVSITFVRVRPSTPVDLSPLPSPTKAMTLWQPPPTAATAGMQKPPHGSNGAIIGYCPAPQAMLAPAWGMAVRAAPVMMVAAPARPMVMAPSSNINKRMGRGGTGVFLPWTVGPKRYNKHLPPRIQKRRFSAMMSPIESQG

SEQ ID NO: 141780 - protein, 92 aa, Triticum aestivum
  Clone ID: PAT_TA_36198.pep
MAGQARAFMCVALVVLLLLVETTAPSGQAHAVDCGSACSYRCSKSSRPNLCNRACNTCCRRCDCVPPGTAGNEDVCPCYAHMTTHDGRHKCP

SEQ ID NO: 141781 - protein, 341 aa, Triticum aestivum
  Clone ID: PAT_TA_36199.pep
MMSAQSGDVPTVKYFLDHGGDLMKADDKGRTILHHAVSAGCCKVTEFLLSKGVPVDIDCGRGPPLFMAATNEQDKTLKILLDHHANPNIIISGATTPLLSALIYRSLKCMKLLIKAGADVNCKASTMTLLVFATMQGGYTNFIKFLLKAGADPNIPDDLGRLPIELAALRDCKEEVEMLLPLTTPIPTVPNWSIEGVISHVKNEDKKPMEQRHRERRQRLLKSQADTAFKLKEYKMASECYGLAIDHGESATLYANRSVCKLLLGDGEGSLSDALRCRMLRPDWAKACYRQAAAHMLLKEYKQACDALLDAQNLDPGNAEIERELRKARELMKNPPAEGEQ

SEQ ID NO: 141782 - protein, 189 aa, Triticum aestivum
  unsure (1)..(189): unsure at all Xaa locations
  Clone ID: PAT_TA_36200.pep
MKKWGAPNKTAFLSFSYKACRIFAAKVCSAQVHMAGNLGAETLRGLYPVESISKAEKVFNQDFYFKRTMKYVGEPMIHLESITSSPVRAAIKVQASVIICFTSSGXEKREIIAKYRPTMPXPHLKTNQLKWSFTSASEARQSLIVRVLFPMLADPHHPAESTSTRNESVLKVALDHGKASGVIKSHGLP

SEQ ID NO: 141783 - protein, 146 aa, Triticum aestivum
  Clone ID: PAT_TA_36201.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSAAAEKEAKSPKKKAATKSPKKKAAAAKE

SEQ ID NO: 141784 - protein, 115 aa, Triticum aestivum
  Clone ID: PAT_TA_36202.pep
MKRCSTPSILLMLSLAAALLIAGHPSVADDVGTILLPSQDKDQEVVMAAPRPWKCCDVTVCTRSIPPTCSCQDVVDNCAPTCEDCNGYVHPPRRVCLDRYTGDPGPKCTGARRRR

SEQ ID NO: 141785 - protein, 181 aa, Triticum aestivum
  unsure (1)..(181): unsure at all Xaa locations
  Clone ID: PAT_TA_36203.pep
MVAFRFHQYQVVGRALPTPGDEHPKIYRMKLWATNEVRAKSKFWYFLRKLKKVKKSNGQVLXAINEIFERNPTTIKNYGIWXLRYQSRTGYHNMYKEYRDTTLNGAVEQMYNEMASRHRVRSPCIQIIKTATVHFKLCKRDNTKQFHNSEIKFPLVHRKVRXPPTRKLRTTFKASRPNLFM

SEQ ID NO: 141786 - protein, 167 aa, Triticum aestivum
  Clone ID: PAT_TA_36204.pep
MDGALPTPGDEQPKIYRMKLWATNEVRAKSKFWYFLRKLKKVKKSNGQMLAINEIFEKNPTTIKNYGIWLRYQSRTGYHNMYKEYRDTTLNGAVEQMYTEMASRHRVRSPCIQIIKTATVNFKLCKRDNTKQFHNSKIKFPLVYQKVRPPTRKLKTTYKATRPNLFM

SEQ ID NO: 141787 - protein, 142 aa, Triticum aestivum
  Clone ID: PAT_TA_36205.pep
MGKTRGMGAGRKLKTHRRNQRWADKAYKKSHLGNEWKKPFAGSSHAKGIVLEKIGIEAKQPNSAIRKCARVQLVKNGKKIAAFVPNDGCLNFIEENDEVLIAGFGRKGHAVGDIPGVRFKVVKVSGVSLLALFKEKKEKPRS

SEQ ID NO: 141788 - protein, 126 aa, Triticum aestivum
  Clone ID: PAT_TA_36206.pep
STGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 141789 - protein, 91 aa, Triticum aestivum
  Clone ID: PAT_TA_36207.pep
GWRRCFGEPVRTNQIPREIPAQKYPSWLLVLGAGTLPFGTLFIELFFIMSSIWMGRVYYVFGFLFIVMLLLVIVCAEVSLVLTYMHLCVED

SEQ ID NO: 141790 - protein, 174 aa, Triticum aestivum
  unsure (1)..(174): unsure at all Xaa locations
  Clone ID: PAT_TA_36208.pep
MVAHRFHQYQVVGRALPTPGDEQPKIYRMKLWATNEVRAKSKFWYFLRKLKKVKKANGQMLAINEIFEKNPTTIKNYGIWXLRYQSRTGYHNMYKEYRDTTLNGGVEQMYTEMASRHRVRAPCIQXIKTATVDFKLCKRDNTKXFHNSQIKFPLVYRRCATTRNSRHLQTSQLS

SEQ ID NO: 141791 - protein, 137 aa, Triticum aestivum
  unsure (1)..(137): unsure at all Xaa locations
  Clone ID: PAT_TA_36209.pep
MARTKQTARKSTGGKAPRKQLATKAARKSAPATGGVKKPHRFRPGTXVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 141792 - protein, 152 aa, Triticum aestivum
  Clone ID: PAT_TA_36210.pep
FQTTAPKSCFMRPPGGILAPGETIIATVFKFVEHPENNEKPLDQKCKVKFKIVSLKVKGPVEYVPELFDEQKDQVAVEQILRVIFLDAERPSAQLDRLKRQLAEAEAALEARKKPPEDTSPPIVGEGLVIDEWKERRERYLARQQVEEVDSV

SEQ ID NO: 141793 - protein, 197 aa, Triticum aestivum
  unsure (1)..(197): unsure at all Xaa locations
  Clone ID: PAT_TA_36211.pep
MKTFLIFVLLAMAMNIATAARQLNPSNKELQSPQQSFSHQQQPFPQQPYPQQPYPSQQPYPSQQPFPTPQPQFPQQSQQPFPQPQQPIPLQPQQPFPQQPQQPQQPFPQPQQPFPWQPQQPFPQTQQSFPLQPQQPFPQQPQQPFSQPQLQFPQQPEQIIPQQPQQPFLLESQQPFPQQPQQPFSQPQQLIPMQXXQ

SEQ ID NO: 141794 - protein, 288 aa, Triticum aestivum
  Clone ID: PAT_TA_36212.pep
RPRRPLKKLGIDDLVHFDFMDPPAPETLMRALEVLNYLGALDDEGNLTSLGEMMSEFPLDPQMSKMLVISPRYNCSNEILSISAMLSVPNCFLRPREAQKAADEAKARFGHIDGDHLTLLNVYHAYKQNNEDPTWCYENFVNARAMKSADNVRQQLVRIMTRFNLKMCSTDFNSREYYVNIRKAMLSGYFMQVAHLERTGHYLTVKDNQVVHLHPSNCMDHKPEWVIYNEYVLTTRNFIRTVTDIRGEWLIDIAPQYYDLTNFPSCEAKRVLERLHNKRERESAASRN

SEQ ID NO: 141795 - protein, 181 aa, Triticum aestivum
  Clone ID: PAT_TA_36213.pep
RGQYGEIILELLIAQTQPQKVCSQIGLCLFDGTHSVSNGIESVVGKENVGSDVMCTACEMAVVWIENQLRENKTKELILQYANQLCERLPSPNGESTVSCHEMSKMPNLAFTIANKTFVLTPEQYVVKLEQSGQTVCISGFMAFDIPPPRGPLWILGDVFMGTYHTVFDFGKDRIGFAESA

SEQ ID NO: 141796 - protein, 136 aa, Triticum aestivum; identical to SEQ ID NO: 106789
  Clone ID: PAT_TA_36214.pep

SEQ ID NO: 141797 - protein, 139 aa, Triticum aestivum
  Clone ID: PAT_TA_36215.pep
LFARRYFLRKLKKVKKANGQMLAINEIFEKNPTTIKNYGIWLRYQSRTGYHNMYKEYRDTTLNGGVEQMYTEMASRHRVRAPCIQIIKTATVDFKLCKRDNTKQFHNSKIKFPLVYQKVRPPTRKLKTTYKATRPNLFM

SEQ ID NO: 141798 - protein, 123 aa, Triticum aestivum
  Clone ID: PAT_TA_36216.pep
MARAPVLLLLALLAAALAAATPAAALGGRGARVGGWGPIPDVRDAHIQELGGWAVEQHARLASDGLRFRRVTRGEQQVVSGMNYRLFVDAADGSGRSAPYLAEVYEQSWTKTRQLTSFKPAAN

SEQ ID NO: 141799 - protein, 225 aa, Triticum aestivum
  unsure (1)..(225): unsure at all Xaa locations
  Clone ID: PAT_TA_36217.pep
CFLPGIAFLILTTLNFLLWGSQSTGAIPFSLFVVLILLWFCISVPLTLVGGFLGAKAPHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSXGPVSATLYLGYSLFMVIAIMLATGTVGFISSFCFVHYLFSSVKAD

SEQ ID NO: 141800 - protein, 200 aa, Triticum aestivum
  Clone ID: PAT_TA_36218.pep
PFKKKLQGCFLRHKTKNRCYRARRWWCAQDNSYHQRGGGQRALLKSWCATRRHTKLLEDKDDGSPPRPSNTPSFTLWRVLVEWLASGIMPRTSYWTRQKMCAVGMRVEKLYQRDPANNDRLIVVYPVKMHKIQECEKRTEQISKPNRFLCRKMLLHPHIIATLRFSPGNDELGRSRVARTQAKQHLFKLIFSEPQYILQT

SEQ ID NO: 141801 - protein, 213 aa, Triticum aestivum
  Clone ID: PAT_TA_36219.pep
RLPDLLIVLNFRGGALSQGLLASTWLGRINLAIKKTWWCYLIVRTGLYFDDRSQFMSQLANDTLNKLRVLNGVKFEYSYWNIHTHGFAGQQNTQVDALAMDILLESRPKDDQGNAFVELMQMKPEAITKECLKFLTENDHLLFIDEMESTAEWDSIKKHLLCESTRAYIVVLTRSKNVATYCVDHKEYQLLNLRDLMIKICTYHTTMCNYNNN

SEQ ID NO: 141802 - protein, 93 aa, Triticum aestivum
  Clone ID: PAT_TA_36220.pep
HASDDRTKRMVIPDALKVLRLQPGHRYCLLGQLSKEVGWNYADTIRELEEKRKEKAKVSYDRRKQLAKLRVKAEKAAEEKLGTQLEILAPIKY

SEQ ID NO: 141803 - protein, 377 aa, Triticum aestivum
  Clone ID: PAT_TA_36221.pep
MAAPFVYTRSSGGGTSQDAAMRAAFDGDLRRLRGTVKSLDDPRVIFSFDMGGGIGVLHIAAVGGHLEVCKYLVEELGGDVNAPAPGVGDFAGVTPFMSSAQSGDVSTVKYLLDHGGDLTKSDAKGRTVLHHAACIGSCTVTEFLLSKGVPVDIDCGRGTPLHQAATNEQDKTVKILLEHHADPNATGGADVNRGSSLPMTPLVFTTGWGGYTNFVKFLLKAGADPNIPDAYGNLPIELAAKRDCMEEVEMLFPLTSPIPTIPNWSIDGIISHAKFETYGVAIDVAPSATLYANRSLCKLLLDDGEGALSDALRCRMLRPNWVKACYRQAAAHMLLKEYKQACDALLDAQKLDPGNTEVERELRKARELMKAHGEADK

SEQ ID NO: 141804 - protein, 160 aa, Triticum aestivum
  Clone ID: PAT_TA_36222.pep
PGPTQTELFSPRPKPQPRRRPTPVPSPPPPPPPRRREDAHASATTAAMVLSHRRFLLPPRPLCHRRRRTTAGPCSSWSGGVQIRHCHSVVVLHNHAAAPRPRPSSPVWGQGRRSLSRSIWRGWMRSKVRCTTVMMGIHSCCHDSSRRPPRHSHRSGSWGR

SEQ ID NO: 141805 - protein, 319 aa, Triticum aestivum
  unsure (1)..(319): unsure at all Xaa locations
  Clone ID: PAT_TA_36223.pep
MVGRMERQTVSTSSASCSPSAASSSSSSSCGGRKRPDILNMIRSAACLNSSSTDTGKGRSKQSSTKVTHGFHLVEGKSGHDMEDYHVAEYKCDKNHELGLFAIFDGHLGDRVPSYLRANLFSNILKEPLFWTDPQEAIKNAYGSTNKYILENAKQLGPGGSTAVTAIVVDGKDMWIANVGDSRAVLCERXAANQITVDHEPHISNERQRIEQQGGFVTTFPGDVPRVNGQLAVARAFGDHSLKTHLSSEPDIRHVPINSSIEFVILASDGLWKVMKNQEAVDLVKSTKDPQAAAKRLTTEALARKSKDDISCIVIRFRC

SEQ ID NO: 141806 - protein, 152 aa, Triticum aestivum
  Clone ID: PAT_TA_36224.pep
RGLAAGLNGVGSAAMIDGAEFDGAKAYKDSKVCNMLTMQEFHRRYHEETGVTFASLYPGCIATTGLFREHIPLFRLLFPPFQKYITKGYVSEEEAGKRLAQVVSEPSLTKSGVYWSWNKNSASFENQLSEEASDTEKARKVWELSEKLVGLA

SEQ ID NO: 141807 - protein, 361 aa, Triticum aestivum
  unsure (1)..(361): unsure at all Xaa locations
  Clone ID: PAT_TA_36225.pep
ALVIAFLAGIVFVILLXTVRRDLTRYEELDSEAQAQMNEELSGWKLVVSDVFRAPSNPMLLCMMVGDGVQILGMAVVTILFAALGFMSPASRGTLITGMLFFYLVLGILAGYASVRVWKTIRCGDHSGWVGVSWRTACFFPGIAFLILTTLNFLLWGSQSTGAILFSLFVVLILLWFCISVPLTLVGGFLGAKAPHIEYPVRTNQIPREIPAQKYPSWLLVLGAGTLPFGTLFIELFFIMSSIWMGRVYYVFGFLFIVMLLLVIVCAEVSLVLTYMHLCVEDWKWWWKSFFSSGSVAIYIFLYSINYLVFDLKSLSGPVSATLYLGYSLFMVIAIMLATGTVGFISSFCFVHYLFSSVKAD

SEQ ID NO: 141808 - protein, 136 aa, Triticum aestivum
  Clone ID: PAT_TA_36226.pep
MARTKQTARKSTGGKAPRKQLATKAARKSAPATGGVKKPHRFRPGTVALREIRKYQKSTELLIRKLPFQRLVREIAQDFKTDLRLQSSAVSALQEAAEAYLVGLFEDTNLCAIHAKRVTIMPKDIQLARRIRGERA

SEQ ID NO: 141809 - protein, 211 aa, Triticum aestivum
  Clone ID: PAT_TA_36227.pep
MDRVRGSALLLGVLLAGSLFALCAAKEEAKKLGTVIGIDLGTTYSCVGVYKNGHVEIIANDQGNRITPSWVGFTDGERLIGEAAKNQAAVNPERTVFDVKRLIGRKFEDKEVQRDMKLVPYKIVNKEGKPYIQVKIKDGETKVFSPEEISAMILGKMKETAEAYLGKKINDAVVTVPAYFNDAQRQATKDAGVIAGLNVARIINEPTAAAI

SEQ ID NO: 141810 - protein, 193 aa, Triticum aestivum
  unsure (1)..(193): unsure at all Xaa locations
  Clone ID: PAT_TA_36228.pep
MASVGVAPSGHKNSSGTSMGAEKLPDQMNDLKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHYNKMNQRMPLIYVKLYTYQKFRXLAYIHGSHGS

SEQ ID NO: 141811 - protein, 171 aa, Triticum aestivum
  Clone ID: PAT_TA_36229.pep
APDRTQQEREYALRSFKSGATPILVATDVAARGLDIPDVAHVINFDLPNDIDDYVHRIGRTGRAGKSGLATAFFNEGNMSLARPLCELMQEANQEVPQWLERYSARSSFGGGGGGRNRRSGGGGGARFGGRDFRRDTRGGGGGGGGGYGGGGGGGYGGGGGYGGGASSSWD

SEQ ID NO: 141812 - protein, 158 aa, Triticum aestivum
  Clone ID: PAT_TA_36230.pep
MAKPSQSRLLLVFPVAAVLAAAFLLPLARSDASGPNPTAYDELRLRGFPRGLLPANVRGYTLDAGSGDFAVDLDSSCRIVLPAGSYLANFNDHLTGHLDDRRISGLSGIRVRAFFRWWSITGIRADGDELVFEVGSVSAKFPARHFNASLECPAKADS

SEQ ID NO: 141813 - protein, 266 aa, Triticum aestivum
  unsure (1)..(266): unsure at all Xaa locations
  Clone ID: PAT_TA_36231.pep
MQLYHHPYSLDSQKVRIALEEKGIDYTSYHVNPLTGKNMNVTFFRMNPSAKLPVFQNGAHVIFRAIDIIQYIDRLAVHLSGEIQPVNTEVLQWMQKVDGWNPKMFTLTHTPLKCRAFVSKFIRRVLIARMAEAPDLASMYHVKLRDGYETEDRLKDPETMRQSEEELSKLLDDVEAQLNKTKYLAGDEFSPADSMFIPILARIXLLDLHEEXYISSRPRVLEYHTLVKQRPSYKVVIGKYFNGWKKYHTLFRTSFFLCVRTLFRKY

SEQ ID NO: 141814 - protein, 274 aa, Triticum aestivum
  unsure (1)..(274): unsure at all Xaa locations
  Clone ID: PAT_TA_36232.pep
PRAEEFGRVRXKSLDVGANLFIGNLDPEVDEKLLYDTFSAFGVIVTNPKIMRDPETGNSRGFGFVSYDSFESSDQAIEAMNNQHLCNRPITVSYAYKKDTKGERHGTPAERLLAANNPGSQKHRPHTMFATAPPTQGLQNGGVGAPVPRPFANGNVPGQMQHVRPPPPPVGQYPPMQMHGQPAWPGPPQNMQQVPPPMQQQLQYRLPGMPPPPQNMMPPPQNMMPPPHHMARPPPPPPNMQAPPMWRPPPPPQQGGGMPPPPMSMPPPPPPPSG

SEQ ID NO: 141815 - protein, 193 aa, Triticum aestivum
  Clone ID: PAT_TA_36233.pep
NTIVRKSDGKLVGYNTDYIGAISAIEDGLGSKDAAMSPLSGRLIVVVGAGGAAKAIAYGAKKKGARVVVANRTYEKAVTLANAVGGQALRLADLENFRPEEGTILANATSLGMYPNVDGTPVPKKALRFYDVVFDAVYAPKVTRLLREAKEHGVKVVSGVKMFVRQAMGQFEHFTGGIEAPESLMREIAAQYT

SEQ ID NO: 141816 - protein, 136 aa, Triticum aestivum; identical to SEQ ID NO: 116005
  Clone ID: PAT_TA_36234.pep

SEQ ID NO: 141817 - protein, 498 aa, Triticum aestivum
  Clone ID: PAT_TA_36235.pep
MGQRLLLLVTTCLWALSCAVPHHASSLDGLLRINLNKRSLTYESLAAAKAARQHGALRLKSSDLDSDIVPLVDYLNTQYYGVIGLGTPPQNFTVIFDTGSSNLWVPSSKCYFSIACYLHAKYKSSKSSTYKADGETCKITYGSGAISGFFSNDNVLVGDLVVKNQKFIETTRETSVSFIVGKFDGILGLGYPDISVGEAPPVWLSMQEQKLLADDVFSFWLNRDSDALSGGELVFGGMDPDHYKENHTYVPVSRKGYWQFNMGDLLIDGHSTGFCAKGCAAIVDSGTSLLAGPTAIVAQVNHAIGAEGIISMECKEVVSQYGEMILELLIAQTQPQKVCSQIGLCLFDGTHSVSNGIESVVGKENVGSDVMCTACEMAVVWIENQLRENKTKELILQYANQLCERLPSPNGESTVSCHEMSKMPNLAFTIANKTFVLTPEQYVVKLEQSGQTVCISGFMAFDIPPPRGPLWILGDVFMGAYHTVFDFGKDRIGFAESA

SEQ ID NO: 141818 - protein, 279 aa, Triticum aestivum
  unsure (1)..(279): unsure at all Xaa locations
  Clone ID: PAT_TA_36236.pep
MADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVGDSNGHVGLGVKCAKEVATAIRGAIILAKLSIVPVRRGYWGNKIGLPHTXVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILVKPTKALMLDAPAEKIEA

SEQ ID NO: 141819 - protein, 136 aa, Triticum aestivum; identical to SEQ ID NO: 106789
  Clone ID: PAT_TA_36237.pep

SEQ ID NO: 141820 - protein, 136 aa, Triticum aestivum; identical to SEQ ID NO: 106789
  Clone ID: PAT_TA_36238.pep

SEQ ID NO: 141821 - protein, 177 aa, Triticum aestivum
  unsure (1)..(177): unsure at all Xaa locations
  Clone ID: PAT_TA_36239.pep
RSFPFLAAAAPYPLEANPTMADVDVDTEVAAGAQPKKRTFRKFSYRGVDLDALLDMSTDDLVQMFPARARRRFKRGLKEEAHGRSVKKLRXAKKDAPCWVKKPEPVRXHISRNMIIVPXEMIGNLIGVYNGQDFNQVEIKPEMIGHYLAEFSISYKPMKHGRPGIXGATHSSRSSLP

SEQ ID NO: 141822 - protein, 535 aa, Triticum aestivum
  Clone ID: PAT_TA_36240.pep
GQGQGGRLGSRLCARRQGRGHARARHHGRTNCGQGRRNEGRRRAWRAGPWASYGPQGAEELRLSRAHARLHWRLRCGQGSPSQGRRRAWRAGHRGRDGGGHGYRRRVRQTGGSKGEGGHAHHGRDDGGVREAGRREGQGRHGEHRRDGRGVRQDGRRERRERRRWRPGKTTAEYTQQAAVKGKDVTVSTGGTAAEYAKTAAEKAKDTALAAGKTTADYTQQAAVKTKDVTLSTAAQAAQKAKEVTAVTAQKVAEYTKEMAEQGNATAAQAEEKAKEAAARAADKAEEPSFDTDTQATDKAKSTAAGAADKTRDTAEQTMDKAKDVTGDTGNRTGSMAAQVKDTTGAMAQKATDTAAYIKDSVTGAAGGTADKARDTTEQTMGRAKDATGDTGNRTGSMAAQVKDATGAMVQKAGDTAAYIKDSVTGAAGGAVDKTRDATSQVAQKAGEATNRAVETGKSATGGGTTKAKGEGTEDTKIVEDVLEVVGATVEAVGATVTGLAQHTKGIVAGEEELIPVEGEAGKVAGAGEGRVKSE

SEQ ID NO: 141823 - protein, 191 aa, Triticum aestivum
  Clone ID: PAT_TA_36241.pep
MSKRAGPPKHQNTYAWKPNLGRKINETEPGGRFRPLSEITGVCQRCRDQIDWKRKYGKYKPIVEPAKCQKCSKRNVRQAYHNVCTGCSKELGICAKCCTSVKQLVGRDAEEANSERKELEEAIRYARERERRTLLRLMNKNKDESGPSVPKIADRDREGDLFPVASLDEYAEQAVQKDESDEEDARDFVKD

SEQ ID NO: 141824 - protein, 371 aa, Triticum aestivum
  unsure (1)..(371): unsure at all Xaa locations
  Clone ID: PAT_TA_36242.pep
MERTPSSWCILLCLAAASAAAAAPLPQYYNAIFSFGDSFSDTGNFVIINSGKLPNMPKFPPPYARCSNGRLVIDFLAEALGVPLLPPSANKGTNFSQGANFAVMGATALELKYFRDNNVWSIPPFNTSMKCQLEWFQEVKETVCSSPQECKEFFGKALFVFGEFGGNDYSFAWKAEWSLDKVKTEMVPKVVESMIDGVEAVLDEGARHVVVPGNLPAGCIPITLTMYASEDRSDYDPRTGCLKKFNSVALYHNAMLRIALDQLQRRRPDARIIYADYYTPYIQFARTPHLYGYKRGALRACCGGGGPYNYNMSSSCGLPGATVCDDPDAHVSWDGIHLTEAPYRFIANTWXLKGPYAYPPLASVVRDDMVY

SEQ ID NO: 141825 - protein, 267 aa, Triticum aestivum
  Clone ID: PAT_TA_36243.pep
MSLLSKLRLVTVDVTGTLLAYKGRLGDYYCMAAKSAGKPCPDYDRMHEGFKLAYTEMARKYPCFGFAAKMPTIEWWRICVKDSFVKAGYDYDDETFDKVFKRIYSAFGSSAPYSVFPDAQPFMRGLREKGITVGIVSNAEYRYKEVILPALGLNQGSEWDFGVFSGIVGVEKPDPKIYKIALEMAGNVAPEEALHIGDSYRKDYVPARSIGMHALLLDRFKTADAESWRKSGAPVLPDLEAAQAWLTKNPTEEPLGAALLRRMAEKL

SEQ ID NO: 141826 - protein, 441 aa, Triticum aestivum
  Clone ID: PAT_TA_36244.pep
LKSYVLPNPERCNVPASTMLVSNDSIVVVDINVPAAHVALHQWQPNTPDGQGTPFLFHHGRNAASSTSGAFMRMFKGSTSSGEDYEFPRAIGFAASAIRSSAIVAVTCDKDIITGGHADCSVKLISPDGARTIESASGHLAPVTCLALSPDSNYLVTGSRDTTVILWRIHQAGFIHKKNPPEPPPATPRTPRSPLPTSPSSMSNLLETRKCRIEGPMHVLRGHLGEVISCAVGPDLGLVVSSSNMSGVVLHSLRTGRLIRKIHVAEAHAVSLSSQGIILVWSESKKRLSSFTVNGVPIATSVLSPFSGGVSCIEISMDGYFALIGTCSSSNYKCEDNTEVADREPNKSSRKVDISEQTEIRQSVNVPSICFVDLHKLKVFHTLELGKGQDITAIALNEENTNLLVSTADKGLMVFTDPALSLKVVDQMLRLGWEGDGLLQS

SEQ ID NO: 141827 - protein, 138 aa, Triticum aestivum
  unsure (1)..(138): unsure at all Xaa locations
  Clone ID: PAT_TA_36245.pep
MASGAVRPKLAYIVCYVDDVVKAAAFYADAFGYSVRRVDDSHKWAELDTGSTTIAFTPRHQRETDALTGEVQLPKSPRERGPVEICFDYDDVDAAYRRAVENGGXPVSAPEQKNWGQKVGYVRDFDGITVRLGSHVRE

SEQ ID NO: 141828 - protein, 319 aa, Triticum aestivum
  Clone ID: PAT_TA_36246.pep
MVGRMERQTVSTSSASCSPSGASSSSSSSCGGRKRPDILNMIRSAACLNSSSTDTGKGRSKQSSTKVTHGFHLVEGKSGHDMEDYHVAEYKCDKNHELGLFAIFDGHLGDRVPSYLRANLFSNILKEPLFWTDPQEAIKNAYGSTNKYILENAKQLGPGGSTAVTAIVVDGKDMWIANVGDSRAVLCERGAANQITVDHEPHISNERQRIEQQGGFVTTFPGDVPRVNGQLAVARAFGDHSLKTHLSSEPDIRHVPINSSIEFVILASDGLWKVMKNQEAVDLVKSTKDPQAAAKRLTTEALARKSKDDISCIVIRFRC

SEQ ID NO: 141829 - protein, 448 aa, Triticum aestivum
  unsure (1)..(448): unsure at all Xaa locations
  Clone ID: PAT_TA_36247.pep
LLQDTAKEMAKEVQTSRSGXTKQTAEDLDEFLNKVRKVERVCNDEILNFAKLFNDELTLDNMSRPRFVNMCKYMGIRPFGTDHYFXFMLRKKLRDIKNDDKVIQAEGVESLSEEELRQACRERGHLGLLSTEEMRQQLRDWLDLSLNHAMPSSLLILSRAFIVSGRMKPEEAVVATLSSLPDEVVDTVGTVLPSEDSVSERRKKLEFLEMQEELIKEEEKKKEKEEKAKQKKEEKAKLKEPEADEQDLALNEMTEPTAREEEELREGKQRDKEQLCNISRALAVLASASSVRKERQEFLSLVNQEIGLYNSMIEKEGTDGEEAKRAYMAAREEADDADEVAAEEKVSSALIEKVDAMLQGLEKEIDDVDAQIGNRWQLLDRDHDGKVTPEEVAAAAAYLKDTIGKEGVQEFISNLSKDKEGKILVEDIVKLASQTDENNEDQEEESRQ

SEQ ID NO: 141830 - protein, 92 aa, Triticum aestivum
  Clone ID: PAT_TA_36248.pep
MAGKARVFMCVALVVLLLLVETTAPSGQAHAVDCGSACSYRCSKSSRPNLCNRACNTCCRRCDCVPPGTAGNEDVCPCYAHMTTHDGRHKCP

SEQ ID NO: 141831 - protein, 153 aa, Triticum aestivum
  Clone ID: PAT_TA_36249.pep
MANSNLPRRIIKETQRLLSEPAPGISASPSEENMRYFNVMILGPTQSPYEGGVFKLELFLPEEYPMAPPKVRFLTKIYHPNIDKLGRICLDILKDKWSPALQIRTVLLSIQALLSAPNPDDPLADNVAKHWKANETEAVETAKEWTRVYANDA

SEQ ID NO: 141832 - protein, 211 aa, Triticum aestivum
  unsure (1)..(211): unsure at all Xaa locations
  Clone ID: PAT_TA_36250.pep
RNSARGDVELAELTPTTAALKNPCAKIVYDXEYNHERCPPXLTPGKRAFAYFVLSGGRFVYASLLRLLVLKFVLSMSASKDVLALASLEVDLSSIEPGTTVTVKWXRGKPVFIRRRTEDDVKLANSVDVTSLRDPQEDAVRVKNPEWLVVIGVCTHLGCIPLPNSGDFGGWFCPCHGSHYDISGRIRKGPAPYNLEVPTYSFLEDNKMLIG

SEQ ID NO: 141833 - protein, 136 aa, Triticum aestivum
  Clone ID: PAT_TA_36251.pep
MARTKQTARKSTGGKAPRKQLATKAARKSAPTTGGVKKPHRYRPGTVALREIRKYQKGTELLIRKLPFQRLVREIAQDFKTDLRFQSHAVLALQEAAEAYLVGLFEDTNLCAIHAKRVTIMPKDIQLARRIRGERA

SEQ ID NO: 141834 - protein, 458 aa, Triticum aestivum
  Clone ID: PAT_TA_36252.pep
MASRAIIRRRKYLLDHVNTPILSSSSPSFRHGTYGFKPEPRIAQPFLEQSLGDSKSEKEKEQYSVDLTKGGLLGPDNGLLRRPAHVISHYGYGIGRNEFTLPFGARGLLQSVRKASTATAGQPKLDIEEQGDENQNKRKKEASPEECDQAVEGLSTAKAKAKAKQVQDSLKADQSIVKKFWARLLGIGPALRAVASMSRADWAAKLKHGKDEFISTLQHYWLGTKLLWADVRISSRLLVKLAGGKSLSRRERQQLTRTTADIFRLVPVAVFIVVPFMEFLLPVFLKLFPNMLPSTFQDKMKEEEALKRKLKARMEYAKFLQEPAKEMAKEVKASYSGETKQTAGDLDEFLNKDVTNVGDEGGFAPNIQENKDGLELLKTAIEKAGYTGKVVIGMDVAASEFYNDKDKTYDLNFKEENNDGSQKISGDSLKNVYKSFVSEYPIVSIEDPFDQDDWGALC

SEQ ID NO: 141835 - protein, 144 aa, Triticum aestivum
  Clone ID: PAT_TA_36253.pep
RHEGHSQALSLIRVQHLSSSPLERSHSRISSSSERPPPASSSQHQEPPSQVANGRSQDEARRRRRHGRRARGLRGRRRGPGPGARLRRRGRRAPRRGLIRRRRLRIPLLLNPSSTLRSVACDPSWSCPSWFIVLGVCACVRAGV

SEQ ID NO: 141836 - protein, 146 aa, Triticum aestivum
  Clone ID: PAT_TA_36254.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSAAAEKEAKSPKKKAATKSPKKKAAATKE

SEQ ID NO: 141837 - protein, 166 aa, Triticum aestivum
  Clone ID: PAT_TA_36255.pep
MAAVATTTALHGSQAAGALAVAAQRLLVLLALAMEAVNNGADIFTEDQQEIIKQFGRIKSETVPENKDAGSDDDDDDDEDEDDETGDADDDDADAGEDFSGEEGEDDDEDEDPEANGDDAGAGSDDDDGDDDDDDGEDGEDDDDDDEDDDEEDEEDEDQPPAKKKK

SEQ ID NO: 141838 - protein, 250 aa, Triticum aestivum
  Clone ID: PAT_TA_36256.pep
TPDRILDLTKKGICMLNECSMLIMDEADKLLAPEFQPSVEQLIRYLPASRQLLLFSATFPVTVKDFKQKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTAETYLHRVGRSGRFGHLGLAVNLITYEDRFNMYRIEQELGTEIKTIPPQIDLAEYCQ

SEQ ID NO: 141839 - protein, 274 aa, Triticum aestivum
  Clone ID: PAT_TA_36257.pep
MTTRIAPGVGANLLGQHSAERNQDATTYVGNLDPQVSEELLWELFVQAGPVVNVYVPKDRVTNLHQGYGFVEFRSEEDADYAIKILNMLKLYGKPIRVNKASQDKKSLDVGANLFIGNLDPEVDEKLLYDTFSAFGVIVTNPKIMRDPETGNSRGFGFVSYDSFESSDQAIEAMNNQHLCNRPITVSYAYKKDTKGERHGTPAERLLAANNPGSQPASLVACLCASLKYAGTVTTASLIFLPRYASAVSFIFPRIIALISSGLKTLVSPSLILT

SEQ ID NO: 141840 - protein, 406 aa, Triticum aestivum
  Clone ID: PAT_TA_36258.pep
MASVGVAPSGHKNSSGTSMGAEKLPDQMNDLKIRDDKEVEATIINGKGTETGHIIVTTTGGKNGQPKQTVSYMADRIVGQGSFGIVFQAKCLETGDTVAIKKVLHDKRYKNRELQTMRLLDHPNVRALKHCFFSTTEKDELYLNLVLEYVPETVHRVVKHYNKMNQRMPLIYVKLYTYQICRALAYIHGSIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAVEALVHPFFDELRDPGTRLPNGRFLPPLFNFKPNELKGIPADVAAKLIPEHARKQSPHA

SEQ ID NO: 141841 - protein, 279 aa, Triticum aestivum
  unsure (1)..(279): unsure at all Xaa locations
  Clone ID: PAT_TA_36259.pep
MADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLXQFAGIDDVFTSSRGSTKTLGNFVKATFDCLMKTYGFLTPDFWRETTFTKAPYQEFTDILAKPTKALMLDAPAEKIEA

SEQ ID NO: 141842 - protein, 158 aa, Triticum aestivum
  unsure (1)..(158): unsure at all Xaa locations
  Clone ID: PAT_TA_36260.pep
MRRCSIPSILLMLSLGAALLIAGHPSVADEASAILLPSQDKGLADQVVMATPRPWKCCDVTVCTRSIPPTCSCQDVVDNCAPTCEDCNXMLHPPRRVCLDRYXGDPGPRCTDARAPAVTELYVLLYAHRLDLPGMRTYAVDVCYYMNGIIMLCVVLHA

SEQ ID NO: 141843 - protein, 309 aa, Triticum aestivum
  Clone ID: PAT_TA_36261.pep
KSFNGDLQPQTYPEILRSNLANTVLTLKKLGIDDLVHFDFMDPPAPETLMRALEVLNYLGALDDEGNLTSLGEMMSEFPLDPQMSKMLVISPRYNCSNEILSISAMLSVPNCFLRARDAQKAADEAKARFGHIDGDHLTLLNVYHAYKQNNEDPTWCYENFVNARAMKSADNVRQQLVRIMTRFNLKMCSTDFNSREYYVNIRKAMLSGYFMQVAHLERTGHYLTVKDNQVVHLHPSNCMDHKPEWVIYNEYVLTTRNFIRTVTDIRGEWLIDIAPQYYDLTNFPSCEAKRVLERLHNKRERERAASRN

SEQ ID NO: 141844 - protein, 136 aa, Triticum aestivum; identical to SEQ ID NO: 106789
  Clone ID: PAT_TA_36262.pep

SEQ ID NO: 141845 - protein, 484 aa, Triticum aestivum
  Clone ID: PAT_TA_36263.pep
SVKLFPNMLPSTFQDKMKEEEALKRKLKARMEYAKFLQDTAKEMAKEVQTSRSGETKQTAEDLDEFLNKVRKGERVSNDEILSFAKLFNDELTLDNMSRARLVNMCKYMGIRPFGTDHYLRFMLRKKLRDIKNDDKMIQAEGVDSLSEEELRQACRDRGHLGLRSTEEMRQQLRDWLDLSLNHAVPSSLLILSRAFTLAGRMKPEDAVVATLSSLPDEVVDTIGTVLPSEDSVSERRRKLEFLEMQEELIKEEEKKKEKEEKAKQKKEEKANLTEQEAAEEDLALKEMTEPTAREEEELIEAKQHDKEQLCNISRALAVLASASSVSKERQEFLSLVNKEIKLYNSMLEREDTEGAEEAKKAYMAAREESDDTTEVASEEKVSSALIDKVDAMLQELEKEIDDVDAQIGNRWQLLDRDHDGKVTPEEVAAAAAYLKDTIGKEGVQELISKLSKDKEGKIRVEDIVKLASQSEENNEDDEEEARH

SEQ ID NO: 141846 - protein, 192 aa, Triticum aestivum
  Clone ID: PAT_TA_36264.pep
MSKRAGPPKHQNTYAWKPNLGRKINETEPGGRFRPLSEITGVCQRCRDQIDWKRKYGKYKPIVEPAKCQKCSKRNVRQAYHNVCTGCSKELGICAKCCTSVKQLVGRDAEEANSERKELEEAIRYARERERRTLLRLMNKNKDEESGTSVPKIADRDREGDLFPVASLDEYAEQAVQKDESDEEDARDFVKD

SEQ ID NO: 141847 - protein, 332 aa, Triticum aestivum
  Clone ID: PAT_TA_36265.pep
MTKLIPRNTVIPTKKSMDDAGLEKTQIHEIVLVGGSTRIPKVQQLLRDYFDGKEPNKGVNPDEAVAFGAAVQGSILSGEGGDETKDILLLDVAPLTLGIETVGGVMTKLIPRNTVIPTKKSQVFTTYQDQQTTVSIQVFEGERSMTKDCRLLGKFDLSGIPPAPRGTPQIEVTFEVDANGILNVKAEDKGTGKSEKITITNEKGRLSQEEIDRMVKEAEEFAEEDKKVKERIDARNQLETYVYNMKNTVGDKDKLADKLESEEKEKVEEALKEALEWLDENQTAEKEDYEEKLKEVEAVCNPIVSAVYQRSGGAPGGEGADGGVDDEDHDEL

SEQ ID NO: 141848 - protein, 153 aa, Triticum aestivum; identical to SEQ ID NO: 141831
  Clone ID: PAT_TA_36266.pep

SEQ ID NO: 141849 - protein, 95 aa, Triticum aestivum
  Clone ID: PAT_TA_36267.pep
MKTFLIFVLLAMAMKIATAARELNPSNKELQSPQQSFSHQQQPFPQQPYPQQPYPSQQPYPSQQPFPTPQQQFPQQSQQPFTQPQQPTPLQPQQV

SEQ ID NO: 141850 - protein, 376 aa, Triticum aestivum
  unsure (1)..(376): unsure at all Xaa locations
  Clone ID: PAT_TA_36268.pep
MATMNPFDLLGDDEGDDPTQLLAKAAALAQKAEAKKAAAPPAAXRGGAKTVANLPTKPPPPGQAGNDSRGGGPPSRGGYGRGERGSGRGGRGGYGQNRDYGSEDTNGYRGGYGARTGGEEGAQDRERAPRQPYQGGGRRGGYREGEFGDDSERPPRRNYERHSGTGRGYEIKREGAGRGNWGTTSDEFVARETEALKQDEKAPAPEKQGAPEDAPQADENKPTKDGATVVEEEKEEDNEMTLDEFEKVMEEKRKALAALKKSEERKVEIDKDLQAMQLLSTKKGNDEVFIKLGADKEALKKKENAEREERAKKSVSINEFLKPAEGERFYGGRGRGGRGRGDRGGFRGGFGGGGYHGPPPAPAIQDQNQFPTLGGK

SEQ ID NO: 141851 - protein, 319 aa, Triticum aestivum
  unsure (1)..(319): unsure at all Xaa locations
  Clone ID: PAT_TA_36269.pep
MVGRMERQTVSTSSASCSPSAASSSSSSCGGRKRPDILNMIRSAACLNSSSTDTGKGRSKQSSTKVTHGFHLVEGKSGHDMEDYHVAEYKCDKNHELGLFAIFDGHLGDRVPSYLRANLFSNILKEPLFWTDPQEAIKNAYGSTNKYILENAKQLGPGGSTAVTAIVVDGKDMWIANVGDSRAVLCERGAANQITVDHEPHISNERQRIEQQGGFVTTFPGDVPRVNGQLAVARAFGDHSLKTHLSSEPDIRHVPINSSIEFVILASDGLWKVMKEPRKLWTSVKSTKDPQAAAKRLTTEALXRKSKDDISCIVIRFRC

SEQ ID NO: 141852 - protein, 92 aa, Triticum aestivum
  Clone ID: PAT_TA_36270.pep
MSSSAAKKGVSMVVATSMAAVEALKDQAGLCRWDYALRSLYHRAVVTGRRAVPASLSSSSSSQAAVGRAARPRRSEEEKLHKAYHIVCWGPN

SEQ ID NO: 141853 - protein, 388 aa, Triticum aestivum
  Clone ID: PAT_TA_36271.pep
MALQLLPSTLSVPKKGSSMGAVAVKDTAAFLGVSSKAKKASLAVRTQVATAPSSVTTSPCSATAKPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFITKGFVSEAESGKRLAQVVAEPSLTKSGVYWSWNKDSASFENQLSQEASDPEKARKVWELSEKLVGLA

SEQ ID NO: 141854 - protein, 92 aa, Triticum aestivum
  Clone ID: PAT_TA_36272.pep
MAGKARVFMCVALVVLLLLVETTAPTGQAHAVDCGGACSYRCSKSSRPNLCNRACNTCCRRCNCVPPGTAGNEDVCPCYAHMTTHDGRHKCP

SEQ ID NO: 141855 - protein, 135 aa, Triticum aestivum
  Clone ID: PAT_TA_36273.pep
NPPKPTTEISSDGQGEDTTRHTTLLFRSTTRDTGRRRQATGGRTDLELAAVGDDDLLGAGAAAGAHLLDVLDDVHALDDLAEDHVLALQWILVKGFRLYSFQLPDTNAPGIVIYCHYLPVSGLGNLRACCLPWMW

SEQ ID NO: 141856 - protein, 171 aa, Triticum aestivum
  Clone ID: PAT_TA_36274.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGILSMANAGPNTNGSQFFICTVPCNWLDGKHVVFGEVVEGMDVVKNIEKVGSRSGTCSKQVVIADCGQL

SEQ ID NO: 141857 - protein, 221 aa, Triticum aestivum
  Clone ID: PAT_TA_36275.pep
RSRSPPAPLALVFVLATGLNRTGKSCRLRWVNYLHPDLKRGRMSPDEERLVVDLHARWGNRWSRIAKAMPGRTDNEIKNYWRTHTRKLHKDTRAASAASASTTTTTSTSMSAASPATTSSSSSSTIDNDNNSHHGHRDQETAASQEQADNQLLYTAGIGMDSHLLWNDAIMDSYAWGAAVPSMIVPPPSSPVWDYCCSDSLWGIGDDEVEYKKMLAVAGAS

SEQ ID NO: 141858 - protein, 699 aa, Triticum aestivum
  Clone ID: PAT_TA_36276.pep
AASKREEGGQGGVSLEEIGKFRAEAQQNSADAIRAAQERYNQNLQHGGGARGAVTVTQAPGATVVSYQEHKALPEGAQQGRTAHGHGANAPAGGTTASSRSTEKQNAAKHEEGRGHGTAHKEQKGSAAVTRAAEGGHDKQGKESAARGTVASSRGAEKQHHTKQEEGRGHGTGHKEQKGSAAVTHATEDRGKEGDSARSAKDAAMQALGITGDQTVAKGAGTKDAGAHGAQVRGHDTGHKDQKGSDTAARKLVSTGDYAAPKGAQAKDAGAHGAQVTAEGTEEATATAAEYAKQAAAKAKEVTLTTGEMTAEYAKQAAVKAKDVTVSTGGTAAEYAKTAAEKAREAALAAGKTTAEYTQQAAVKGKDVTVSTGGTAAEYAKTAAEKAKDTALAAGKTTADYTQQAAVKTKDVTLSTAAQAAQKAKEVTAVTAQKVAEYTKEMAEQGKNAAAQAEEKAKEAAARAADKAEEPSFDTSTQTKRSAAGAADKTRDMTEQTMNKAKDTTGAMAQKATDTAAYVKDSVMGAAGGTADKTRDTTEQTMGRAKEATGDAGNRTGSMAAQVKDATGAMAQKAGHTAAYIKDSVMGAAGGAVDKTRDATSQVAQKTGEATNRVVETGKSATGGGMTGTAKAKGEGTEDTKIVEDVLEVVGAGMEAVGATVYGIAQHTKGIVAGEEELIPVEGEAGKVAGAGEGRKKSE

SEQ ID NO: 141859 - protein, 500 aa, Triticum aestivum
  unsure (1)..(500): unsure at all Xaa locations
  Clone ID: PAT_TA_36277.pep
MGQRLLLLVTTCLWALSCAVPHHASSRDGLLRINLNKKSLTHESLGRSKXPRQHDALRLKSGNSXDSDIVPLVDYLNTQYYGVIGLGTPPQNFTVIFDTGSSNLWVPSAKCYFSIACYLHPKYKSSKSSTYKADGETCKITYGSGAISGFFSNDNVLVGDLVVKNQKFIETTRETSFSFIVGKFDGILGLGYPDISVGKAPPVWLSMQDQKLLADDVFSFWLNRDSDALSGGELVFGGMDPDHYKGNHTYVPVSRKGYWQFNMGDLLIDGHSTGFCAKGCAAIVDSGTSLLAGPTAIVAQVNHAIGAEGIISTECKEVVSQYGEMILXLLIAQTQPQKVCSQIGLCLFDGTHSVSNGIESVVGKENVGSDVMCTACEMAVVWIENQLRENKTKELILQYANQLCERLPSPNGESTVSCHEMSKMPNLAFTIASKTFVLTPEQYVVKLEQSGQTVCISGFMAFDIPPPRGPLWILGDVFMGAYXHTVFDFGKDRIGFAESA

SEQ ID NO: 141860 - protein, 178 aa, Triticum aestivum
  Clone ID: PAT_TA_36278.pep
GPFFFFFFGSNKWSHSLQEQESKYMITNTKNGTPAHVLDTPPTPPRPIHTHTHAPTPHAPTRTHAHTPRRRVNQAGQTKKGHLISSHATATDLAEEVTEGGGGEGGRCEGHGGRGVGGGRRGRGLGGGRGGDERGGHGGDGDELHPETGHWRLDLVPGGAGRRAGGVLAAAYSAVRSL

SEQ ID NO: 141861 - protein, 233 aa, Triticum aestivum
  Clone ID: PAT_TA_36279.pep
EKWVPVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKVEA

SEQ ID NO: 141862 - protein, 136 aa, Triticum aestivum; identical to SEQ ID NO: 116005
  Clone ID: PAT_TA_36280.pep

SEQ ID NO: 141863 - protein, 149 aa, Triticum aestivum
  unsure (1)..(149): unsure at all Xaa locations
  Clone ID: PAT_TA_36281.pep
MARTKQTARKSTGGKAPRKQLXATKAARKSAPTTXAGVXKKPHRYRPGTVALRGDSASTKKSTELLIXAKLPFQAPGSARFAQDFKNRPSGFPSPNARAGPSKEGGPKAYLVGAVXEDTNLVAPSNAQSGVTNHAQGHQLARRIRGEKA

SEQ ID NO: 141864 - protein, 373 aa, Triticum aestivum
  unsure (1)..(373): unsure at all Xaa locations
  Clone ID: PAT_TA_36282.pep
TPSDLLGDDEGDDPTQLLAKAAALAQKAEAKKAAAPAXAAGKGGARTVANLPTKPPPPGQAANESRGGGPLSRGGYGRGERGSGRGGRGGYGQNRDYASEDTNGYRGGYGARTGGEEGAQDRERAPRQPYQGGGRRGGYREGEFGDDSERPPRRNYERQSGTGRGYEIKREGAGRGNWGTTSDEIVAQETEALKQDEKAPAPEKQGAPEDAPQADENKATKDGAAVVEEEKEEDNEMTLDEFEKVMEEKRKALAALKKSEERKVEIDKDLQAMQLLSTKKGNDEVFIKLGADKEALKKKENAEREERAKKSVSINEFLKPAEGERFYGGRGRGGRGRGDRGGFRGGFGGGGYHGPPXAPAIQDQNQFPTLGGK

SEQ ID NO: 141865 - protein, 395 aa, Triticum aestivum
  Clone ID: PAT_TA_36283.pep
MALQAATSFLPSALSARKEGAAKDSAFFRVCLADGLKFDTTSLGLRTKRVNTSSVAIRAQAAAVSAPTATPASPSGKKTVRTGNAIITGASSGLGLATAKALAESGKWHVIMACRDYLKTARAARAAGMPKGSYTIVHLDLASLDSVRQFVKNVRQLDMPIDVVVCNAAVYQPTAKEPSFTADGFEMSVGVNHLGHFLLARELLEDLKASDYPSKRLIIVGSITGNTNTLAGNVPPKANLGDLRGLAAGLNGVGSAAMIDGAEFDGAKAYKDSKVCNMLTMQEFHRRYHEETGVTFASLYPGCIATTGLFREHVPLFRFLFPPFQKYITKGYVSEEEAGKRLAQVVSEPSLTKSGVYWSWNKNSASFENQLSEEASDTEKARKVWELSEKLVGLA

SEQ ID NO: 141866 - protein, 391 aa, Triticum aestivum
  unsure (1)..(391): unsure at all Xaa locations
  Clone ID: PAT_TA_36284.pep
MALQLLPSTLSVPKKGSRLGRXVPVKDTAAFLGVSSKAKKASLAVRTQVATAPSPGDDEPGLGPAAKPSGQEXTLRQGVVVITGASSGLGLASAKALAETGKWHVVMACRDFLKASKAAKAAGMADGSYTIMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGTSGSAMIDGDESFDGAKAYKDSKVCNMLTMQEFHRRYHEETGITFSSLYPGCIATTGLFREHIPLFRTLFPPFQKFITKGFVSEAESGKRLAQVVAEPSLTKSGVYWSWNKDSASFENQLSQEASDPEKARKVWELSEKLVGLA

SEQ ID NO: 141867 - protein, 161 aa, Triticum aestivum
  Clone ID: PAT_TA_36285.pep
MAAVATTTAVHGSQAAGAQRLLLLLALVIEAVNNGADIFTEDQQEIIKQFGRIKSETVPENKDAGSDDDDDDDEDEDDETGDADDDDADAGEDFSGEEGEDDDEDDDPEANGDDAGAGSDDDDGDDDDDDGEDGEDDDDDDEDEDEEDEEDEDQPPAKKKK

SEQ ID NO: 141868 - protein, 142 aa, Triticum aestivum
  Clone ID: PAT_TA_36286.pep
MADDDYNEVDMGYEDEPPEADIEEGVEEDPENNEDAPDDVVGGEGEEKEQEKTARPRNTTKYMTKYERARILGTRALQISMNAPVMVELEGETDPLEIAMKELRARKIPFTIRRYLPDGSYEDWGVDELIVEDSWKRQVGGD

SEQ ID NO: 141869 - protein, 318 aa, Triticum aestivum
  Clone ID: PAT_TA_36287.pep
MAASCTLTVPALFAASSSSSSTSARRYRRFGVVAMASAGQKVYAPGVAVSEGNGGLPKISLKSPHGSEAEIYLFGACVTSWKVPSGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFNSALHTYFSASIAGVSVKGLEGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELV

SEQ ID NO: 141870 - protein, 261 aa, Triticum aestivum
  Clone ID: PAT_TA_36288.pep
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPLRSVPEGGVICNVEHHVGDRGVFARASGDYAIVISHNPDNGTSRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKADKAT

SEQ ID NO: 141871 - protein, 279 aa, Triticum aestivum
  Clone ID: PAT_TA_36289.pep
MADRGGERGVGERGGDRGGFGRGFGRGGRGDRGGRRGGRRGPRQEEEKWVPVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGQPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 141872 - protein, 279 aa, Triticum aestivum
  Clone ID: PAT_TA_36290.pep
MADRGGERGVGERGGERGGFGRGFGRGGRGDRGGRRGGRRGPRQEEEKWVPVTKLGRLVKEGRFTKMEEIYLHSLPVKEHQIVETLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 141873 - protein, 92 aa, Triticum aestivum
  Clone ID: PAT_TA_36291.pep
LSPLPQTCCGLCSDLPRIQIQIQIQIQSAAEEARMIYRNWSLLSSTVVIWGSVGAAGLAGIFLFGGKEKFQGYLSREGERLRQQDRAMMGKN

SEQ ID NO: 141874 - protein, 278 aa, Triticum aestivum
  Clone ID: PAT_TA_36292.pep
MADRGGERGGDRGGERGGFGRGFGRGGRGDRGGRRGGRRGPRQEEEKWVPVTKLGRLVKEGRFTKMEEIYLHSLPVKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKGPYQEFTDILAKPTKALMLDAPVEKIEA

SEQ ID NO: 141875 - protein, 229 aa, Triticum aestivum
  Clone ID: PAT_TA_36293.pep
MPLWGTASGPPPPLAEGGGAEGSGGSSGAAAIRSLLPTRRRLRLDPPSKLYFPYEPGKQVRSAVRIKNVSKSHVAFKFQTTAPKSCFMRPPGGILAPGETIIATVFKFVEHPENNEKPLDQKCKVKFKIVSLKVKGPVEYVPELFDEQKDQVAVEQILRVIFLDAERPSAQLDRLKRQLAEAEAALEARKKPPEDTSPPIVGEGLVIDEWKERRERYLARQQVEEVDSV

SEQ ID NO: 141876 - protein, 389 aa, Triticum aestivum
  unsure (1)..(389): unsure at all Xaa locations
  Clone ID: PAT_TA_36294.pep
MALQLLPSTLSVPKKGSSMGAVAVKDTAAFLGVSSKAKKASLAVRTQVATAPSSVTTSPGSAVAKPGGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGXVNHLGHFLLAXLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPSLTKSGVYWSWNKDSASFENQLSQEASDPEKARKVWELSEKLVGLA

SEQ ID NO: 141877 - protein, 142 aa, Triticum aestivum; identical to SEQ ID NO: 141787
  Clone ID: PAT_TA_36295.pep

SEQ ID NO: 141878 - protein, 317 aa, Triticum aestivum
  Clone ID: PAT_TA_36296.pep
MAASCTLTVPAPFAAASSSSSTARRYRRFGVVAMASVGQKVYAPGVAVSDGNGGLPKISLKSPHGSEAEIYLFGACVTSWKVPSGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFNSALHTYFSASIAGVSVKGLKGSKTLNKDPDPKNPLEGKEERDEVTFPGFVDCVYLGAPTELTLDNGLGDKIVISNTNWSDAVLWNPHLQMEACYKDFVCVENAKIETVQLGPKESWVAEQKIELV

SEQ ID NO: 141879 - protein, 101 aa, Triticum aestivum
  unsure (1)..(101): unsure at all Xaa locations
  Clone ID: PAT_TA_36297.pep
YTIAVESQKKKKKNSRGGPVPNSPYSESYYNSLAVVLQRXRDWENPGVTQLNRLAAHPPFASWRNSEEARTDRPSQQLRSLNGEWQIVSVNILLKFALNFC

SEQ ID NO: 141880 - protein, 135 aa, Triticum aestivum
  Clone ID: PAT_TA_36298.pep
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKASSSKASTVDDDDN

SEQ ID NO: 141881 - protein, 135 aa, Triticum aestivum; identical to SEQ ID NO: 141880
  Clone ID: PAT_TA_36299.pep

SEQ ID NO: 141882 - protein, 185 aa, Triticum aestivum
  Clone ID: PAT_TA_36300.pep
AILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 141883 - protein, 142 aa, Triticum aestivum; identical to SEQ ID NO: 141868
  Clone ID: PAT_TA_36301.pep

SEQ ID NO: 141884 - protein, 138 aa, Triticum aestivum
  Clone ID: PAT_TA_36302.pep
MASGAVRPKLAYIVCYVEDVGKSAAFYAKAFNYSVRRVDDSHKWAELDTGSTTIAFTPRHQRETDALMGEVQLPKSPRERGPVEICFDYDDVDAAYRRAVENGAVPVSAPEQKNWGQKVGYIRDCDGITVRLGSHVRE

SEQ ID NO: 141885 - protein, 135 aa, Triticum aestivum; identical to SEQ ID NO: 141880
  Clone ID: PAT_TA_36303.pep

SEQ ID NO: 141886 - protein, 237 aa, Triticum aestivum
  unsure (1)..(237): unsure at all Xaa locations
  Clone ID: PAT_TA_36304.pep
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGXANAILAVSLAVCKAGASVKKIPLYQHIANLAGNKQLVLPVPAFNVINGGSHAGNKLAMQEFMILPTGATSFKEAMKMGVEVYQQLEXSLLKKKYGQDATNVXNEVVLLLNLRETKEGLELLNT

SEQ ID NO: 141887 - protein, 206 aa, Triticum aestivum
  Clone ID: PAT_TA_36305.pep
MVSGSGVSARRVVVDARHHMLGRLASIVAKELLNGQRVVVVRCEEMCISGGLVRQKMKYLRFLRKRMNTKPSHGPIHFRAPSRIFWRTVRGMIPHKTPRGEAALARLKAFEGVPPPYDRTKRMVIPDALKVLRLQPGHRFCLLGELSKEVGWNYHETIKELEEKRKEKAKVSYDRRKQLAKLRFKAEKAAEEKLGSQLDILAPIKY

SEQ ID NO: 141888 - protein, 142 aa, Triticum aestivum; identical to SEQ ID NO: 141787
  Clone ID: PAT_TA_36306.pep

SEQ ID NO: 141889 - protein, 142 aa, Triticum aestivum; identical to SEQ ID NO: 141868
  Clone ID: PAT_TA_36307.pep

SEQ ID NO: 141890 - protein, 261 aa, Triticum aestivum; identical to SEQ ID NO: 141870
  Clone ID: PAT_TA_36308.pep

SEQ ID NO: 141891 - protein, 432 aa, Triticum aestivum
  unsure (1)..(432): unsure at all Xaa locations
  Clone ID: PAT_TA_36309.pep
MAGTVPKLAAPRPAAAGPLPSQPLRSAALASAPSARRFRVSLAARARSPVIAMASAKEGNGAXRKRTTLHDLYEQQGQSPWYDNLCRXVTDLLPYIANGVRXGVTSNPTIFQKAISSSNAYDGQFKELISAGKDAESAYWELVIKDIQDACKLFEPIYDETDGADGYVSVEVSPRLANDTQGTVEAAKWLHKVVNRPNVYIKIPATAECVPSIKEVIANGISVNVTLIFSVARYEAVIDAYLDGLEASGLSDLSRVTSVASFFVSRVDSLIDKMLEKIGTPEALALRGKAAVAQAKIANQLYLKKFSGPRWEALVKKGAKKQRLLWASTSVKNPAYLDTLYVDPLIGPDTVSTMPDQALDAFIDHGTVARTIDANVSEAEGIYSALEKLGIDWEEVGKQLEHEGVSSFKGSFDSLLTSLEEKGNALKTAANL

SEQ ID NO: 141892 - protein, 460 aa, Triticum aestivum
  Clone ID: PAT_TA_36310.pep
PTAAAIAYGLDKRGGEKNILVFDLGGGTFDVSILTIDNGVFEVLATNGDTHLGGEDFDHRIMDYFIKLIKKKHGKDISKDNRALGKLRREAERAKRALSNQHQVRVEIESLFDGTDFSEPLTRARFEELNNDLFRKTMGPVKKAMDDAGLEKTQIHEIVLVGGSTRIPKVQQLLRDYFDGKEPNKGVNPDEAVAFGAAVQGSILSGEGGDETKDILLLDVAPLTLGIETVGGVMTKLIPRNTVIPTKKSQVFTTYQDQQTTVSIQVFEGERSMTKDCRLLGKFDLSGIPPAPRGTPQIEVTFEVDANGILNVKAEDKGTGKSEKITITNEKGRLSQEEIDRMVKEAEEFAEEDKKVKERIDARNQLETYVYNMKNTVGDKDKLADKLESEEKEKVEEALKEALEWLDENQTAEKEDYEEKLKEVEAVCNPIVSAVYQRSGGAPGGEGADGGVDDEDHDEL

SEQ ID NO: 141893 - protein, 206 aa, Triticum aestivum
  Clone ID: PAT_TA_36311.pep
MVSGSGVSARRVVVDARHHMLGRLASIVAKELLNGQRVVVVRCEEMCISGGLVRQKMKYLRFLRKRMNTKPSHGPIHFRAPSRIFWRTVRGMIPHKTPRGEAALARLKAFEGVPPPYDRTKRMVIPDALKVLRLQPGHRFCLLGELSKEVGWNYHETIKELEEKRKEKAKLSYDRKKQLAKLRIKAENAAEEKLGSQLDILAPIKY

SEQ ID NO: 141894 - protein, 318 aa, Triticum aestivum
  Clone ID: PAT_TA_36312.pep
MAASCTLTVPAPFAAASSSSSTSARRYRRFGVVAMASAGQKVYAPGVAVSEGNGGLPKISLKSPHGSEAEIYLFGACVTSWKVPNGKDLLFVRPDAVFNGQKPISGGIPHCFPQFGPGPMQQHGFARNVNWSITDSEVTEGDPTVTLELKDDSYSRSMWDFSFQALYKVVLHSTSLSTTLKIINTDDKPFSFTSALHTYFSASIAGVSVKGLKGSKTLNKDPDPKNPLEGKEERDEVTFPGFVDCVYLGAPSELTLDNGLGDKIVISNTNWSDAVLWNPHLQMEACYKDFVCVENAKIETVQLGPKESWVAEQKIELI

SEQ ID NO: 141895 - protein, 527 aa, Triticum aestivum
  Clone ID: PAT_TA_36313.pep
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 141896 - protein, 153 aa, Triticum aestivum
  Clone ID: PAT_TA_36314.pep
MADVDVDPEVAAAGPKKRTFRKFSYRGVDLDALLDMSTEDLVQLFPARPRRRFSRGLKRKPMALVKKLRKAKSEAPAGEKPEQVRTHLRNMIIMPEMIGSVVGIYNGKCFNQVEIKPEMIGHYLAEFSLSYKPVKHGRPGIGATHSSRFIPLK

SEQ ID NO: 141897 - protein, 206 aa, Triticum aestivum
  Clone ID: PAT_TA_36315.pep
MVSGSGVSARRVVVDARHHMLGRLASIVAKELLNGQRVVVVRCEEMCISGGLVRQKMKYLRFLRKRMNTKPSHGPIHFRAPSRIFWRTVRGMIPHKTPRGEAALARLKAFEGVPPPYDRTKRMVIPDALKVLRLQPGHRYCLLGELSKEVGWNYHETIKELEEKRKEKAKVSYDRRKQLAKLRVKAEKAAEEKLGSQLDILAPIKY

SEQ ID NO: 141898 - protein, 192 aa, Triticum aestivum
  unsure (1)..(192): unsure at all Xaa locations
  Clone ID: PAT_TA_36316.pep
IFATTTKICTGRPLRPGSRPGFCSGRRALLLIGAWRSPRWPGVGRALQRHPFSGLVDSAGELLHTPXRISTSMTTRAVGHRNPASGSSRIASSAYQKWPTWSTRFXMARLTEAAAPSYLFXSLRIGRGRCVPNASNHWLYLIELVMGSSYPEGNFGGNQLLDGSISLSPLYPSQTNDLHVSIASSLHKSFLW

SEQ ID NO: 141899 - protein, 142 aa, Triticum aestivum; identical to SEQ ID NO: 141787
  Clone ID: PAT_TA_36317.pep

SEQ ID NO: 141900 - protein, 194 aa, Triticum aestivum
  Clone ID: PAT_TA_36318.pep
PLRVRALSVFLIRLDASVRVQFHQYQVVGRALPTPGDEQPKIYRMKLWATNEVRAKSKFWYFLRKLKKVKKSNGQMLAINEIFEKNPTTIKNYGIWLRYQSRTGYHNMYKEYRDTTLNGAVEQMYTEMASRHRVRSPCIQIIKTATVNFKLCKRDNTKQFHNSKIKFPLVYQKVRPPTRKLKTTYKATRPNLFM

SEQ ID NO: 141901 - protein, 178 aa, Triticum aestivum
  Clone ID: PAT_TA_36319.pep
FGTRRSFPFLAAAAAPYPLEADPTMADVDVDTEVAAGAQPKKRTFRKFSYRGVDLDALLDMSTDDLVQMFPARARRRFKRGLKRKPMALVKKLRKAKKDAPAGEKPEPVRTHLRNMIIVPEMIGSLIGVYNGKTFNQVEIKPEMIGHYLAEFSISYKPVKHGRPGIGATHSSRFIPLK

SEQ ID NO: 141902 - protein, 261 aa, Triticum aestivum; identical to SEQ ID NO: 141870
  Clone ID: PAT_TA_36320.pep

SEQ ID NO: 141903 - protein, 668 aa, Triticum aestivum
  unsure (1)..(668): unsure at all Xaa locations
  Clone ID: PAT_TA_36321.pep
MDRLRGSALLLGVLLAGSLFALCAAKEEAKKLGTVIGIDLGTTYSCVGVYKNGHVEIIANDQGNRITPSWVGFTDGERLIGEAAKNQAAVNPERTVFDVKRLIGRKFEDKEVQRDMKLVPYKIVNKEGKPYIQVKIKDGETKVFSPEEISAMILGKMKETAEAYLGKKINDAXVVTVPAYFNDAQRQATKDAGVIAXGLNVARIINEPTAAAIAYGLDKRGGEKNILVFDLGGGXTFDVSILTIDNGVFEVLATNGDTHLGGEDFDHRIMDYFIKLIKKKHGKDISKDNRALGKLRREAERAKRALSNQHQVRVEIESLFDGTDFSEPLTRARFEELNNDLFRKTMGPVKKAMDDAGLEKTQIHEIVLVGGSTRIPKVQQLLRDYFDGKEPNKGVNPDEAVAFGAAVQGSILSGEGGDETKDILLLDVAPLTLGIETVGGVMTKLIPRNTVIPTKKSQVFTTYQDQQTTVSIQVFEGERSMTKDCRLLGKFDLSGIPPAPRGTPQIEVTFEVDANGILNVKAEDKGTGKSEKITITNEKGRLSQEEIDRMVKEAEEFAEEDKKVKERIDARNQLETYVYNMKNTVGDKDKLADKLESEEKEKVEEALKEALEWLDENQTAEKEDYEEKLKEVEAVCNPIVSAVYQRSGGAPGGEGADGGVDDEDHDEL

SEQ ID NO: 141904 - protein, 142 aa, Triticum aestivum; identical to SEQ ID NO: 141787
  Clone ID: PAT_TA_36322.pep

SEQ ID NO: 141905 - protein, 431 aa, Triticum aestivum
  Clone ID: PAT_TA_36323.pep
MAGTVPKLAAPRPAAAGPLPSQPLRAAALAFAPSARRFRVSLAGRARSPVIAMASAKEGNGAVTKRTTLHDLYEQQGQSPWYDNLCRPVTDLLPYIANGVRGVTSNPTIFQKAISSSNAYDGQFKELISAGKDAESAYWELVIKDIQDACKLFEPIYDETDGADGYVSVEVSPRLANDTQGTVEAAKWLHKVVNRPNVYIKIPATAECVPSIKEVIANGISVNVTLIFSVARYEAVIDAYLDGLEASGLSDLSRVTSVASFFVSRVDSLIDKMLEKIGTPEALALRGKAAVAQAKIANQLYLKKFSGPRWEALVKKGAKKQRLLWASTSVKNPAYLDTLYVDPLIGPDTVSTMPDQALDAFIDHGTVARTIDANVSEAEGIYSALEKLGIDWEEVGKQLEHEGVSSFKGSFDSLLTSLEEKGNALKTAANL

SEQ ID NO: 141906 - protein, 206 aa, Triticum aestivum
  Clone ID: PAT_TA_36324.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSKEVGWNYADTIRELEEKRKEKAKVSYDRRKQLAKLRVKAEKAAEEKLGTQLEILAPIKY

SEQ ID NO: 141907 - protein, 432 aa, Triticum aestivum
  unsure (1)..(432): unsure at all Xaa locations
  Clone ID: PAT_TA_36325.pep
MAGTVPKLAAPRPAAAGPLPSQSLRSAALAFAPSARRFRVSLAARARSPFIAMASAKEGNGAVTKRTTLHDLYEQQGQSPWYDNLCRPVTDLLPYIANGVRXGVTSNPTIFQKAISSSNAYDGQFKELISAGKDAESAYWELVIKDIQDACKLFEPIYDETDGADGYVSVEVSPRLANDTQGTVEAAKWLHKVVNRPNVYIKIPATAECVPSIKEVIANGISVNVTLIFSVARYEAVIDAYLDGLEASGLSDLSRVTSVASFFVSRVDSLIDKMLEKIGTPEALALRGKAAVAQAKIANQLYLKKFSGPRWEALVKKGAKKQRLLWASTSVKNPAYLDTLYVDPLIGPDTVSTMPDQALDAFIDHGTVARTIDANVSEAEGIYSALEKLGIDWEEVGKQLEHEGVSSFKGSFDSLLTSLEEKGNALKTAANL

SEQ ID NO: 141908 - protein, 142 aa, Triticum aestivum; identical to SEQ ID NO: 141787
  Clone ID: PAT_TA_36326.pep

SEQ ID NO: 141909 - protein, 153 aa, Triticum aestivum
  Clone ID: PAT_TA_36327.pep
MADVDVDPEVAAAGPKKRTFRKFSYRGVDLDALLDMSSEDLVGLFPARARRRFSRGLKRKPMALVKKLRKAKSEAPAGEKPEQVRTHLRNMIIMPEMIGSVVGIYNGKCFNQVEIKPEMIGHYLAEFSLSYKPVKHGRPGIGATHSSRFIPLK

SEQ ID NO: 141910 - protein, 248 aa, Triticum aestivum
  Clone ID: PAT_TA_36328.pep
SSGRPGRYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 141911 - protein, 142 aa, Triticum aestivum; identical to SEQ ID NO: 141787
  Clone ID: PAT_TA_36329.pep

SEQ ID NO: 141912 - protein, 178 aa, Triticum aestivum
  Clone ID: PAT_TA_36330.pep
MVAFRFHQYQVVGRALPTPGDEQPKIYRMKLWATNEVRAKSKFWYFLRKLKKVKKSNGQMLAINEIFEKNPTTIKNYGIWLRYQSRTGYHNMYKEYRDTTLNGAVEQMYTEMASRHRVRSPCIQIIKTATVNFKLCKRDNTKQFHNSKIKFPLVYQKVRPPTRKLKTTYKATRPNLFM

SEQ ID NO: 141913 - protein, 178 aa, Triticum aestivum; identical to SEQ ID NO: 141912
  Clone ID: PAT_TA_36331.pep

SEQ ID NO: 141914 - protein, 325 aa, Triticum aestivum
  Clone ID: PAT_TA_36332.pep
DSKTTAGYTQQAAVKTKDVTLSTAAQAAQKAKEVTAVTAQKVAEYTKEMAEQGKNAAAQAEEKAKEAAARAADKAEEPSFDTGTQAKDKAKGSAAGAVDKTRDTAAQTMDKAKDVTGDTGNRTGSMAAQVKDTTGAMAHKASGTAAYIKDSVMGAAGGTADKTRDTTEQTMGRAKGATGDTGDRTGSMAAQVKDATGAMAQKAGDTAAYIKDSVTGAVGGAVDKTRDATSQVAQKTGEATNRAVETGKSATGGGTTKAKGEGTEDTKIVEDVLEVVGATVEAVGATVTGLAQHTKGIVAGEEELIPVEGEAGKVAGAGEGREKSE

SEQ ID NO: 141915 - protein, 136 aa, Triticum aestivum; identical to SEQ ID NO: 116005
  Clone ID: PAT_TA_36333.pep

SEQ ID NO: 141916 - protein, 178 aa, Triticum aestivum
  Clone ID: PAT_TA_36334.pep
MVAHRFHQYQVVGRALPTPGDEQPKIYRMKLWATNEVRAKSKFWYFLRKLKKVKKANGQMLAINEIFEKNPTTIKNYGIWLRYQSRTGYHNMYKEYRDTTLNGGVEQMYTEMASRHRVRAPCIQIIKTATVDFKLCKRDNTKQFHNSKIKFPLVYQKVRPPTRKLKTTYKATRPNLFM

SEQ ID NO: 141917 - protein, 446 aa, Triticum aestivum
  Clone ID: PAT_TA_36335.pep
MAATIQSVKARQIFDSRGNPTVEVDVCCSDGTFARAAVPSGASTGVYEALELRDGGSDYLGKGVSKAVDNVNSIIAPALIGKDPTAQTELDNYMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 141918 - protein, 206 aa, Triticum aestivum; identical to SEQ ID NO: 141906
  Clone ID: PAT_TA_36336.pep

SEQ ID NO: 141919 - protein, 448 aa, Triticum aestivum
  unsure (1)..(448): unsure at all Xaa locations
  Clone ID: PAT_TA_36337.pep
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGXANAILAVSLAVCKAGASVKKIPLYQHIANLAGNKQLVLPVPAFNVINGXGSHAGNKLAMQEFMILPTGATSFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 141920 - protein, 206 aa, Triticum aestivum
  Clone ID: PAT_TA_36338.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYEGVPPPYDRTKRMVIPDALKVLRLQPGHRYCLLGQLSKEVGWNYADTIRELEEKRKEKAKISYDRRKQLAKLRVKAEKAAEEKLGTQLEILAPIKY

SEQ ID NO: 141921 - protein, 406 aa, Triticum aestivum
  Clone ID: PAT_TA_36339.pep
MASVGVAPSGHKNSRGTSMGAEKLPDQMNDLKIRDDKEVEATIINGKGTETGHIIVTTTGGKNGQPKQTVSYMAERIVGQGSFGIVFQAKCLETGETVAIKKVLQDKRYKNRELQTMRLLDHPNVVALKHCFFSTTEKDELYLNLVLEYVPETVHRVVKHYNKMNQRMPLIYVKLYTYQICRALAYIHGSIGVCHRDIKPQNLLVNPHTHQLKLCDFGSAKVLVKGEPNISYICSRYYRAPELIFGATEYTTAIDIWSAGCVLAELMLGQPLFPGESGVDQLVEIIKVLGTPTREEIKCMNPNYTEFKFPQIKAHPWHKVFHKRMPPEAVDLVSRLLQYSPNLRCTAVEALVHPFFDELRDPGTRLPNGRFLPPLFNFKPNELKGIPADVAAKLIPDHARKQGSHA

SEQ ID NO: 141922 - protein, 665 aa, Triticum aestivum
  Clone ID: PAT_TA_36340.pep
MDRVRGSALLLGVLLAGSLFALCAAKEEAKKLGTVIGIDLGTTYSCVGVYKNGHVEIIANDQGNRITPSWVGFTDGERLIGEAAKNQAAVNPERTVFDVKRLIGRKFEDKEVQRDMKLVPYKIVNKEGKPYIQVKIKDGETKVFSPEEISAMILGKMKETAEAYLGKKINDAVVTVPAYFNDAQRQATKDAGVIAGLNVARIINEPTAAAIAYGLDKRGGEKNILVFDLGGGTFDVSILTIDNGVFEVLATNGDTHLGGEDFDHRIMDYFIKLIKKKHGKDISKDNRALGKLRREAERAKRALSNQHQVRVEIESLFDGTDFSEPLTRARFEELNNDLFRKTMGPVKKAMDDAGLEKTQIHEIVLVGGSTRIPKVQQLLRDYFDGKEPNKGVNPDEAVAFGAAVQGSILSGEGGDETKDILLLDVAPLTLGIETVGGVMTKLIPRNTVIPTKKSQVFTTYQDQQTTVSIQVFEGERSMTKDCRLLGKFDLSGIPPAPRGTPQIEVTFEVDANGILNVKAEDKGTGKSEKITITNEKGRLSQEEIYRMVKEAEEFAEEDKKVKERIDARNQLETYVYNMKNTVGDKDKLADKLESEEKEKVEEALKEALEWLDENQTAEKEDYEEKLKEVEAVCNPIVSAVYQRSGGAPGGEGADGGVDDEDHDEL

SEQ ID NO: 141923 - protein, 178 aa, Triticum aestivum; identical to SEQ ID NO: 141916
  Clone ID: PAT_TA_36341.pep

SEQ ID NO: 141924 - protein, 136 aa, Triticum aestivum; identical to SEQ ID NO: 116005
  Clone ID: PAT_TA_36342.pep

SEQ ID NO: 141925 - protein, 261 aa, Triticum aestivum; identical to SEQ ID NO: 141870
  Clone ID: PAT_TA_36343.pep

SEQ ID NO: 141926 - protein, 178 aa, Triticum aestivum; identical to SEQ ID NO: 141916
  Clone ID: PAT_TA_36344.pep

SEQ ID NO: 141927 - protein, 171 aa, Triticum aestivum
  Clone ID: PAT_TA_36345.pep
MANPRVFFDMTVGGAPAGRIVMELYKDAVPRTVENFRALCTGEKGVGKSGKPLHYKGSSFHRVIPDFMCQGGDFTKGNGTGGESIYGEKFADEKFVHKHTKPGILSMANAGPNTNGSQFFICTVPCNWLDGKHVVFGEVVEGMDVVKNIEKVGSRSGTCSKQVVIADCGQL

SEQ ID NO: 141928 - protein, 446 aa, Triticum aestivum
  Clone ID: PAT_TA_36346.pep
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 141929 - protein, 136 aa, Triticum aestivum; identical to SEQ ID NO: 116005
  Clone ID: PAT_TA_36347.pep

SEQ ID NO: 141930 - protein, 80 aa, Triticum aestivum
  Clone ID: PAT_TA_36348.pep
MEFKPKATVCAVMLVLLLLSSYDGGGVGVAEARICTGKSQHHSFPCISDKSCTKTCLGEHGAKWTAGYCKFRRCTCQREC

SEQ ID NO: 141931 - protein, 171 aa, Triticum aestivum; identical to SEQ ID NO: 141856
  Clone ID: PAT_TA_36349.pep

SEQ ID NO: 141932 - protein, 248 aa, Triticum aestivum
  Clone ID: PAT_TA_36350.pep
QPCRCIQPFQLQSSRAQGPPFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEDLGAAAVYAGLKFRAPVEPY

SEQ ID NO: 141933 - protein, 81 aa, Triticum aestivum
  Clone ID: PAT_TA_36351.pep
MEFKPKATVCAVMLVLLLLSSYSGGGGIGVAEARICTGKSQHHSFPCVSDKSCTKTCLSEHGAKWTAGYCKIRRCTCQREC

SEQ ID NO: 141934 - protein, 171 aa, Triticum aestivum; identical to SEQ ID NO: 141856
  Clone ID: PAT_TA_36352.pep

SEQ ID NO: 141935 - protein, 262 aa, Triticum aestivum
  unsure (1)..(262): unsure at all Xaa locations
  Clone ID: PAT_TA_36353.pep
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPLRSVPEGGVICNVEHHVGDRGVFARASGDYAIVISHNXPDNGTSRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKADKAT

SEQ ID NO: 141936 - protein, 182 aa, Triticum aestivum
  Clone ID: PAT_TA_36354.pep
PRAEFGTRRSFPFLAAAAASYPLEADPTMADVDVDTEVAAGAQPKKRTFRKFSYRGVDLDALLDMSTDDLVQMFPARARRRFKRGLKRKPMALVKKLRKAKKDAPAGEKPEPVRTHLRNMIIVPEMIGSLIGVYNGKTFNQVEIKPEMIGHYLAEFSISYKPVKHGRPGIGATHSSRFIPLK

SEQ ID NO: 141937 - protein, 638 aa, Triticum aestivum
  unsure (1)..(638): unsure at all Xaa locations
  Clone ID: PAT_TA_36355.pep
MRSSWADSVANAEESAPATGAAPAPVANHQNSRPTRSSYVPPHLRGGGRSPENQVPAAAPTPAGAYPSGAVQPSGGYAAAVGGTRWAAPPGAPSAGVGVVRQGGGGRGAVGGGGGGWNSRPGGWGDRRDREPNPFGDSEPAAVDVDFESQQNTGINFDAYEDIPVETSGHDVPAAVNTFAEIDLGDALNENIRRCKYVRPTPVQRHAIPIVIGGRDLMACAQTGSGKTAAFCFPIISGILKSRPPQRPRARTAFPLALILSPTRELSVQIHEEAKKFAYQTGVKACVAYGGAPIHQQLRELERGVDILVATPGRLMDLLERARVSLQMVNYLALDEADRMLDMGFEPQIRKIVEQMDMPPRGVRQTMLFSATFPKEIQRLASDFLADYIFLAVGRVGSSTDLIAQRVEFVLEADKRSYLMDLIHAQKANDVPGKNSLTLVFVETKRGADALENWLYTNGFPATSIHGDRTQQEREYALRSFKSGATPXILVATDVAARGLDIPDVAHVINFDLPNDIDDYVHRIGRTGRAGKSGLAXTAFFNEGNMSLAXRPLCELMQEANQEVPXWLERYSARSXSFGGGGGGRNRRSGGGGGARFGGRDFRRDTRGGGGGGGGGXGVVGGYGGGGGYGGGASSSWD

SEQ ID NO: 141938 - protein, 341 aa, Triticum aestivum
  unsure (1)..(341): unsure at all Xaa locations
  Clone ID: PAT_TA_36356.pep
VGWRGCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVXRAAIKVKASVIICFTSSXGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 141939 - protein, 94 aa, Triticum aestivum
  Clone ID: PAT_TA_36357.pep
RETKSISLSIAYPLYAPFTYAHKTISRSSKSKPPENSRMFHLSLTIYAMTIIVFEAKARYAHWTSGSTHYGHHLRLVVIIQSRAHRTTLYLLMT

SEQ ID NO: 141940 - protein, 136 aa, Triticum aestivum; identical to SEQ ID NO: 106789
  Clone ID: PAT_TA_36358.pep

SEQ ID NO: 141941 - protein, 362 aa, Triticum aestivum
  Clone ID: PAT_TA_36359.pep
MASPQKLRTPITDLFKIKHPVLLAGMNVAAGPKLAAAVSNAGGLGVIGGVGYTPDMLREQIAELKSFLDDKNAPFGVDLLLPQVGGSARKTNYDYTKGKLNELVDIIIEEGAKLFVSAVGVPPKAVVDKLHANGIVYMNMIGHVKHVQKCLDLGVDIICAQGGEGGGHTGDIPTTVLIPAVVDICKKHKSPLTGGPVQVIAAGGIHNGQLLAASLMMGAGAVWVGTRFILTDEAGAPKAHKEAVRTSGHDDNIRTIIWTGRPMRVRNNDYINDWETNRQAEIKELVSKGVIPYEADLDKLAESTSESENDDDEDILDKYRPYLMGKCAAVVNEQKPAKAVVDEFVDDAVAWLQRGNKMIAKL

SEQ ID NO: 141942 - protein, 245 aa, Triticum aestivum
  Clone ID: PAT_TA_36360.pep
MPEINTLLFDCDNTLVLSEELAFEACAGLINEICESRKVDMRFTGETLIKEFVGQNFRGMLTTLQKNYNIDISAEDLESYVRKEEDAVIAKLKEALKPCVGVDEQLEKLAASGKYTMSVVSSSALRRVRASIEKVGQDKYFPGDVVFSAATSLEKPTSKPDPAIYLHALEKLGKEAEEAVAIEDSKSGTLSGTRAGIKVIGYVGPYAEDKQAEMEQVLRDAGAVVIMRDWSEFPAALQKIEAGEV

SEQ ID NO: 141943 - protein, 457 aa, Triticum aestivum
  unsure (1)..(457): unsure at all Xaa locations
  Clone ID: PAT_TA_36361.pep
MREIISIHIGQAGIQVGNACWELYCLEHGIQQDGTMPSDTTVGVAHDAFNTFFSETGAGKHVPRAIFVDLEPTVIDEVRTGAYRQLFHPEQLISGKEDAANNFARGHYTVGKEIVDLCLDRVRKLADNCTGLQGFLVFNAVGGTGSGLGSLLLERLSVDYGKKSKLGFTIYPSPQVSTAPLSVPEITKAVSGPSRVMPKCDPRHGKDMAGGYDVPCRCRSQGRQCGRLRAPKLRELVQVRSDLVTPSQITGRAINVAGRLLKTRLQPTPRFNSMISXNASVLSTYKTFHECLPVGYLTVPGLTSATLTAXVSLRMAKYTSCCLXYRVDVXPRTSNTAVAAIKTQENCPLXVDWCPTGFKCGINYQPPSVVPGGDLAKVQRAVCMISNNTAVAEVFSRIDHKFDLMYAKRAFVHWYVGEGMEEGEFSEAREDLAALEKDYEEVGAEGADDEGDEGDDY

SEQ ID NO: 141944 - protein, 342 aa, Triticum aestivum
  unsure (1)..(342): unsure at all Xaa locations
  Clone ID: PAT_TA_36362.pep
MKVLCFSEPLEKEGRHKHRGGCYVPCLAERLFAMTPFSACCSQPHIRDHSSLKADVYTYSSILEASASAQQWEYFENAYRQMTLSLHHLDQCLNSWLLIKACRAGXPYLVEHALDAILERGEIPDVELFTENICQTIADSDHARTLHLMNTMSASSVEMNEQQWSDLLQQNSHRFRVDALKDLIRHLSTSDAIKTDPGLGFVRALQSQCATMLTKDAEEPQADNCSHSNLMEQDELSCKDSLGSHELSDSSTDIPVSGVKAGSGGDIVLHGPHSEDEHRNLAHWGTQVSAIDKVLDSMNSFGNCSSYEKMPTALEILESWEQECVEDIFAPKKGSRETMRDK

SEQ ID NO: 141945 - protein, 136 aa, Triticum aestivum; identical to SEQ ID NO: 106789
  Clone ID: PAT_TA_36363.pep

SEQ ID NO: 141946 - protein, 105 aa, Triticum aestivum
  Clone ID: PAT_TA_36364.pep
LIVRIAGGLGELDVSAGWASYRPITPAHGPTMMKKSCRHDMSSPPMRGGEMGVYAGKGDWGLAVRAQARQRTVARSGGRIWGCEASRDLPDMGWSGDPHLDLRDD

SEQ ID NO: 141947 - protein, 313 aa, Triticum aestivum
  Clone ID: PAT_TA_36365.pep
MKFSSSAVLLAAAIGASAHPSGHAHQRAHAKRDFIVANKPVTVYETHVVTAPAAPATAVPEAPAAPAPVPSQPKADEAVPKSWATGPWTSDVPKLNKGKKHSSGSGYKPFCGGKKAKRATLEDIAATGNTGVPGDYGCNMMTVDSDVADKYTYTTTFKNDHSEDKECACWNKIGPLGKIDGFFAKNIPMHFTVGAKSSQVVAFDENSQGGCACSSKEVPTTINGLVAGTWLEFDFGSERNGGWSGADASCLVSAKEKLNIPGLRVCGHNTCSTINPGGTGTNAYLGGMEAEDGVGLNINDKEVRLTVDIDYEG

SEQ ID NO: 141948 - protein, 119 aa, Triticum aestivum
  Clone ID: PAT_TA_36366.pep
GSHGHTKHQQRTKNTEQNLLHHLPATARACFRERAACRPATCARSSCSRRKSSCRRRSCSSFIFFCFGRLSLLRSKNTPYDAAIGERESHQHEQSASKDRLKVTAGAGICHLLPMWRTR

SEQ ID NO: 141949 - protein, 174 aa, Triticum aestivum
  unsure (1)..(174): unsure at all Xaa locations
  Clone ID: PAT_TA_36367.pep
PYLAMVLLQVGFAGMYIVAVASLKRGMSHFVLVVYRNIVATVVMAPFALYFERGLRPKMTITIFIKIMGLALLEPVLDQNLYYMGANLTSAGFATALVNILPAVTFVLALILRMEKVRLRSSPAXAEANAGTVLTVPCAVLMHGHGSRSDQHARANGDGCDAFVGEAAAANGHY

SEQ ID NO: 141950 - protein, 184 aa, Triticum aestivum
  Clone ID: PAT_TA_36368.pep
MAGASAQPAWAQALAAVGLLVASRAATRLALWLYAAFLRPAKPLRRRYGAWAVVTGATDGIGRALAFELAAAGLGLVLVGRSPDKLATVSKEVSARFPGAEVRTFVIDFAADGLAASVAALAESIRGLDVGVLVNNAGHGYPYARYFHEVDEELRTNLIRLNVGGVTRRTHAVLPAMVGRKRGA

SEQ ID NO: 141951 - protein, 185 aa, Triticum aestivum
  Clone ID: PAT_TA_36369.pep
KVKKVDLPYGFFFVRKVVAHLVTFLFYCVVIPAYVLVGGQDVRLPKYVAMYVPAIITLLNAVCTPRSWHLLVFWILFENVMSMHRSKATIIGLVEASRANEWVVTEKLGSVTSTPAATTTMATNKGAMKKKKSQSSILAPEIVMGLCLLYCAVYDIFFGHDHFYVYLLMQSAAAFVIGFGYVGSQ

SEQ ID NO: 141952 - protein, 92 aa, Triticum aestivum
  Clone ID: PAT_TA_36370.pep
RGLQMMALMNNTRVLCWIAIILMSITSLSCHAAARSTHTMDFGPILGCVKTETKCSVVGCTKICSDLGWNTHRCYCADAGSCCHYADGRPLN

SEQ ID NO: 141953 - protein, 210 aa, Triticum aestivum
  Clone ID: PAT_TA_36371.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELR

SEQ ID NO: 141954 - protein, 156 aa, Triticum aestivum
  unsure (1)..(156): unsure at all Xaa locations
  Clone ID: PAT_TA_36372.pep
MATPERARAGRGNATATAIATNRWGPYSGAGDFAGNMAIILASLLAALALALALHAGVRCLLRRRRQRQGQGRGVDGAAEGDPEKPAVAEPAPPPPLPPLLVYSASGTRLAGAAAHECAICLAEFADGDAVRXLPACGHGFHARLHPALDARSPPS

SEQ ID NO: 141955 - protein, 138 aa, Triticum aestivum
  Clone ID: PAT_TA_36373.pep
PAGSGGRYSRLLPHASGYLPECGEGIHQEIQPCSSICSRSKVLEVVNDSDIPTEPLPLSCCGSACWYRAESTPVESYDGQICVVGAQREDSPQASSQSVGKMDPRAPVWARRYVRNQDIQSKKLVVQVGFSDCGHICD

SEQ ID NO: 141956 - protein, 146 aa, Triticum aestivum
  Clone ID: PAT_TA_36374.pep
SSYTLLKMSNNKIVPLTIIKGAGHEHIPIPEGECAIIADFHSVKSQSSHSTPYLTTGFYRVVPGPTRYGEYDYEETKYVLKGQIDITDEATGKTHHLVAGDWAFFHVGSKAQFSTKTEGVAFYAVTRPMNDGHPNLVGREESTSKL

SEQ ID NO: 141957 - protein, 77 aa, Triticum aestivum
  Clone ID: PAT_TA_36375.pep
DDASRCGRKGPDSATSLARILSELYKGEEEEFLHIKPQDGFAMYNPRSWVNCYLLFDSTRPYLLDHNYLPCCLKNRN

SEQ ID NO: 141958 - protein, 151 aa, Triticum aestivum
  unsure (1)..(151): unsure at all Xaa locations
  Clone ID: PAT_TA_36376.pep
MAAFLRSKCSSVGRAMLGSLGNNLYGGASSSIATVARQSRSDAVCKPIRTXIQLRTNLKVHADSEAKQGRWVQSLGERKGARLGAMRIGSDRGAEPRGXVKKGDVVYGGVVRAGIKMGGIDGSEAKLDETAMVVAKVQVEPISARRFREEQ

SEQ ID NO: 141959 - protein, 189 aa, Triticum aestivum
  Clone ID: PAT_TA_36377.pep
MAAARRVLLLLLAAAAAALLAAPPAAAARPCGRAQTLLISFSSFSRPNPDPADPSPLTTTVVTVLRVRRLGPHRFHAHDQNHLQIRRPAEPLPAAVATPDAASSFQERAKDILVVASGLLFGFGCAARPAASMYLLWSLVASAGAASPYEELYSEDDVSDDDDASDSPKKAGYVIIHGAEDVVAAAGKN

SEQ ID NO: 141960 - protein, 203 aa, Triticum aestivum
  Clone ID: PAT_TA_36378.pep
FPLLIPCRDLARPQLHAPLQLGSLVRRRRDHLRRLVFPRCMPPQSLMLVNGGRGAAWLVEMLHNGGEALVDLNWAVVVGVLRDRIGVVLVCDSQVGRTSYRCWPREFGASMFYRSSRQVAQFRRLILSPMAVALVVSRKHVRMVGPVVLISRYYRASLVLLLQMMVKLREVRCSPHGICDTQLRRLGHSLVRVLFLELFFRKT

SEQ ID NO: 141961 - protein, 187 aa, Triticum aestivum
  Clone ID: PAT_TA_36379.pep
MLKNVLSQSWRRGAHVLREGHPAEAMYACSSQFHSGQVLRSARSFFGVEDFMDEDNSKPYTYKKEKRSKNPHKHISFKQRTIAHMEPFTLDVFISKRFVSASLTHRSTCRQVAVAGTNSKDVKAALMSRSDVPACLSVGRFLAERAKEADVYACTYTPRERDRFEGKIRAVVQSLIDNGIHVKLYLD

SEQ ID NO: 141962 - protein, 119 aa, Triticum aestivum
  Clone ID: PAT_TA_36380.pep
KSSLLPSLPCSARFFHIHRDEMGLAAGCLRCRREHSGGCCRRAGDWPWDSLQPDDNGVGRQRRWPPWIFCWKFFSFCYNLREIVGCRCHDFFATSIFLLEPLLYFAAMSEDVCGRRRQC

SEQ ID NO: 141963 - protein, 249 aa, Triticum aestivum
  Clone ID: PAT_TA_36381.pep
GEQLKEVCRNTDSNRRELESKSSELLEVTVSMERMIQRFGYLAGKDALEDNKPASTQTLLPKLEKLIIASSMESGNAKSVKQELGSKLQAREKTVDELSAKVKMLEDLYHSQLVQPEVSQDRAFDASSSAIGSDISEIEDLGPMGKASVSSVPTAAHARVMRKGSSDHLVLNMGSESERLIAAHDLDDKGRIKSLHTSGLIPAQGKHIADKVDGIWVSGSQILMNRPRARLGLLAYWLFLHLWLVGSIL

SEQ ID NO: 141964 - protein, 118 aa, Triticum aestivum
  Clone ID: PAT_TA_36382.pep
APSRNQARIQKVSKLPWRTTHSPPPQPGRPRGARARLPAPASSPASARRPTTRAPSAAPATATRGGDHRRRRPAARRSSLLHREPARRCASRESSGAAPAAGQPPRAGPSCARTCCGW

SEQ ID NO: 141965 - protein, 201 aa, Triticum aestivum
  Clone ID: PAT_TA_36383.pep
LHCNNSLLSCSVFVASPSDYPIDKIPHPHWKKPINGAYHQSWPRTPPARSQVQLEVERRGRVGGQVPEEEAVDVGVGHAVVAAEEGLDVLREAALRRGAVVPGGLRRRRRGHGRRGRGGAALGGRRLLDHLLELGRLQQQAQRGRGGRVAQRGRPGRQHRELRRPRRGRRSLRGHAFLHALLVEVVLERHGLEVDRGELMR

SEQ ID NO: 141966 - protein, 107 aa, Triticum aestivum
  Clone ID: PAT_TA_36384.pep
ARAPRPREADYAKTSRGVVPRDCLPRSEDFYAGTPPHEAHDDVSHDNQGQAGTNGHRGNNFLLCAKEARTSAEGSSQRFPFRCNETKTTSSARRMSSPSPPLRHGHR

SEQ ID NO: 141967 - protein, 82 aa, Triticum aestivum
  Clone ID: PAT_TA_36385.pep
RDFTVARTYRPVQELLEEEKKGRVSSNSTHLRPLVLDDFIQAKAKVSPSVSYNATSMNELRKWNEQYGEDGSRTKSPFGFGN

SEQ ID NO: 141968 - protein, 166 aa, Triticum aestivum
  unsure (1)..(166): unsure at all Xaa locations
  Clone ID: PAT_TA_36386.pep
VRAAVRANGGEVTMQALAEMPLVKSAVYEALRIEPPGXQYGRAKRDMVVESHDYGYEVREGELLFGYQPMATKDPRVFPRAEDYVPDRFLGEDGERLLRYVVWSNGPESATPTLQDKQCAGKDFVVLIARLLVAQLFLRYDSFDVQVGSSPLGSSVTITSLKKATF

SEQ ID NO: 141969 - protein, 274 aa, Triticum aestivum
  unsure (1)..(274): unsure at all Xaa locations
  Clone ID: PAT_TA_36387.pep
MAHLLRRSILRPLVASKPFVTPIATHRITRLASHLSTAKMAPVPSTMKAVQINKNGGVEVLEHNDVPVPKVGEGQILVRNQIAGLNFIDTYFRSGLYKAPQFPLTLGREAAGTIVDIHSSVKGFENGSRVVFMGTVGAYAQYSVVNASDAVKIPDDVPTEQAVAAYLQGLTAWTFIREAGQVKEGQWVLVHAASGGVGTLLVQLLRTVGAKIIGTASTDEKLELAKKNGAEWVISSHDDVVAKVKEITGGHGCGWVSLMGVXKVTFDADLEXIA

SEQ ID NO: 141970 - protein, 192 aa, Triticum aestivum
  Clone ID: PAT_TA_36388.pep
KRGRKPANGREEPLNHVEAERQRREKLNQRFYALRAVVPNVSKMDKASLLGDAISYINELRGKMTALESDKETLHSQIEALKKERDARPAAPSSGMHDNGARCHAVEIEAKILGLEAMIRVQCHKRNHPAAKLMTALRELDLDVYHASVSVVKDIMIQQVAVKMATRVYSQDQLNAALYGRLAEPGTAMQIR

SEQ ID NO: 141971 - protein, 462 aa, Triticum aestivum
  unsure (1)..(462): unsure at all Xaa locations
  Clone ID: PAT_TA_36389.pep
ARGQEARMKLKQESFRLGNIGVMRAGTVISETWEDGQAIKDLNAHLKSLLETKEAVERHRKSLKKRQSSDKGDGSDAETSMSEEDFLLQDEICKSRLTSIKREEEQYLRERDRYELEKGRLIREMKRLRDEDGSRFNNFQILHHRYALLNLLGKGGFSEVYKAFDLVEYKYVACKLHGLNAQWSEEKKQSYIRHAIREYNIHKTLVHTNIVRLWDIFQIDHNTFCTVLEYCSGKDLDAVLKATPILPEKEARIIIVQVFQGLVYLNKKTTEGIHYDLKPGNVLFDEVGVTKVTDFGLSKIVEDDVGSQGMELTSQGAGTYWYLPPECFDLSRTXFISSKVDVWSAGVMFYQMLYGRRPFGHDQTQERILREDTIINARKVEFPSKPTVSNEAKELIRRCLTYNQSERPDVLSIAQDPYLSYATSESAHASARLHYKTKDFLEVGQPLPNGVTVHIVNFGLVS

SEQ ID NO: 141972 - protein, 317 aa, Triticum aestivum
  Clone ID: PAT_TA_36390.pep
MATLRTDLPGPIGDKKLEKKPIKFSNLLLGAGLNLFEVTTLGQPLEVVKTTMAANRGDSMAKSLGRVWARGGPLGFYQGLIPWAWIEASTKGAVLLFVASEAEYYARAAGASEFGGGILGGVTGGVAQAYATMGFCTCMKTVEITKHKLAASGVKPQSTFQTFGEIYRKEGIRGINKGVNAVAIRQMTNWGSRFGLSRLAEGWMKSLTGKKEHEKLSAGEKVIASALGGGLSAWNQPIEVIRVEMQSKKEDPNRPKKMTVGNTFKYIYESNGIKGLYRGIAPRISLGVWQTVCMVAFGDMAKAYVEKVTGEAVTAKH

SEQ ID NO: 141973 - protein, 80 aa, Triticum aestivum
  Clone ID: PAT_TA_36391.pep
RGLFFFFFSIYIYNNNVGCKKGLLFSLQVKATSFIYRLAGSSSQTVHITHLIVVERLYLIIYAKINNASNLHSEIATRPA

SEQ ID NO: 141974 - protein, 99 aa, Triticum aestivum
  Clone ID: PAT_TA_36392.pep
MSGAGEEDKKPAEAGGAHINLKVKGQDGNEVFFRIKRSTQLKKLMNAYCDRQSVDMNAIAFLFDGRRLRGEQTPDELEMEDGDEIDAMLHQTGGSVPGA

SEQ ID NO: 141975 - protein, 149 aa, Triticum aestivum
  Clone ID: PAT_TA_36393.pep
MSLVLELPAEYGYVLVAATSTFFINTLHVVLTSKARKQSGLKYPIPYASNDLAEKNAEAYKFNCAQRSHANFTENQISFLGALLISGLRYPVASAVLGAGWAVSRVFYAIGYSAGGPQGRMGGSIGSALCDVSLKFMAAYTSIMYAMGN

SEQ ID NO: 141976 - protein, 124 aa, Triticum aestivum
  Clone ID: PAT_TA_36394.pep
MAMAQGRGSAAQGFALGLLVLCLLLGADTAGAATYNVDWSFASGSWPIGKSFRAGDVLVFSYNPAVHNVVAVDAGGYNSCRGSGATHTYTSGSDRVTLVPGTNYFICSLSGHCGLGMKMAVTAN

SEQ ID NO: 141977 - protein, 223 aa, Triticum aestivum
  unsure (1)..(223): unsure at all Xaa locations
  Clone ID: PAT_TA_36395.pep
MGTEAKVKVFGPARSTCVARVLVCLEEVGAEYELVHVHLPAGEHKGPAHLARTXVFALQLFGQVPAFQDGDLILFESRAISRYVLRKGASDLLRENSLAESATVDAWLEAESHNFDRAMSAITFQCFVVPMFMGGTTDHKIVEENLEKLKVALGVYEERLSRFKYLAGDFISLADLSHCPMAHYLLASPCASVLDAYPRVKDWVXGMMDRPSVKKVMELMDAS

SEQ ID NO: 141978 - protein, 366 aa, Triticum aestivum
  Clone ID: PAT_TA_36396.pep
RVTRHEGPAPVWAPLIPPPHPSAAAGPPSPQSCHGLVVAFANKARPTLLHSPGTHPVGSDCSSTLARMSSCHQRRGWWSRFLLLLQGAWLQAFRDGPTNKVRARMSVASAIIFGSVFWRMGKTQTSIQDRMGLLQVAAINTAMAALTKTVGVFPKERAIVDRERAKGSYALGPYLSSKLLAEIPIGAAFPLMFGSILYPMAKLHPTISRFAKFCGIVTVESFAASAMGLTVGAGRPTTEAAMALGPSLMTVFIVFGGYYVNPDNTPVIFRWIPKASLIRWAFQGLCINEFKGLQFEHQHSYDVQTGEQALERFSLGGIRIADTLVAQGRILMFWYWMTYLLLKKNRAGYQQLLPPSEEDQSKQQTE

SEQ ID NO: 141979 - protein, 83 aa, Triticum aestivum
  unsure (1)..(83): unsure at all Xaa locations
  Clone ID: PAT_TA_36397.pep
MSSPAMATASSPSPGAAIAITAADDLADSIDALYRSEVTKAVLKXVSTLAHNNWMWSLDRSRHQLAAPRSRINLLSRPGGLRR

SEQ ID NO: 141980 - protein, 172 aa, Triticum aestivum
  Clone ID: PAT_TA_36398.pep
MRLSLLPLVAFVGCAFASGDTISTAIDNISNATLALDKSITNWPQTLVGILPITTKSTLLLTAIHDGTLAARDSEHLSVDETLQVAKATSELTTDVTQTIDTIIAAKPKFDKLMVSPVILLNLKLQRALSADFSEAILAKVPKDLQGNAKALVQGIDDSFAKAIKKYSSLRG

SEQ ID NO: 141981 - protein, 173 aa, Triticum aestivum
  Clone ID: PAT_TA_36399.pep
PAGSSCWYGGTDSILPYLEAVVKETMRLHPVVPLLIPRVSREHTSVAGYEIPVGTRVLVNVWAIGRDPTVWGETAAEFQPERFLGSKVDVKGHDLELLPFGAGRRMCPAHGLGLKMVQLVLANLLHGYAWRLPDGVAAEELSMEEKFGISVSRMHHLHAIPEPKLLDHLYFGP

SEQ ID NO: 141982 - protein, 95 aa, Triticum aestivum
  Clone ID: PAT_TA_36400.pep
RPGLGQYVMFTELSGHSGLRINTSPPSTLTWLLRMFDAELLIEDHDLHHRKGWKTSGNYGKQTLLWDKVFGTCIDRIELKKENLDWETRIDLPLF

SEQ ID NO: 141983 - protein, 257 aa, Triticum aestivum
  unsure (1)..(257): unsure at all Xaa locations
  Clone ID: PAT_TA_36401.pep
MSSAVSKRLEGKTVLITGASSGIGKSTAFEFARTSPKNLKLVLTARRIDSLKQIAEEIVKEVGDGVKVHPVQLDVSKPDEVRSFVSKLPAEFSEIDVLVNNAGLVKGVDKAPEIKEEDINVMFATNVTGLINMTQAILPGMLKRNNGEGAGDIINIGTIAGREPYPGGSIYCATKAAIHSFTESLRKELISKRVRVIRIDPGQVEAEFSVVRFYGDKSKADAVYAGCEPLTPDDIAXGIVFAAGRRGKCVIADTLIF

SEQ ID NO: 141984 - protein, 306 aa, Triticum aestivum
  Clone ID: PAT_TA_36402.pep
PSVRPRVRQETGTGRSGRWLRRRRWDGPTAGELKAAGAEAIPGGVRVKGWVIQTHKGPILNSASVSLYEDKLQTTHLPEMVFGESFVSIQNAQTGVKLHFNALDALKAWKQEALPPVQVPAAAKWKFRSNPADQVVLDYDYTFTTPYCGSDVVLNQDATQTSLDECSNLCWEDTDDRIDLVALSAKEPILFYDEVILYEDELADSGISFLTARVRVMPTGWFLLLRFWLRVDGALMRLRDTRLHCSFGSKEAKPVVLRELCWREATFAAMSAEGYPSDSAAYADPNLVARKLPVVMQKTQKLKIPS

SEQ ID NO: 141985 - protein, 98 aa, Triticum aestivum
  Clone ID: PAT_TA_36403.pep
VVPPMSLVAIFERDYGWLLFYRTSAMDERRGDTQHRWTQARRGVGFMQGLSLGLSLIRGLFFFFFCFDERAANSPVLWHDYINEQSWRSGKTRFGDRW

SEQ ID NO: 141986 - protein, 101 aa, Triticum aestivum
  Clone ID: PAT_TA_36404.pep
RPGSVPISSSPAVPLPLSLRPLAADLLHLLLLYFLASFAAAPLSSAPFCFSSCCCCPQPPAAISLYFPCYPSSLNLPTASLSLSEISVQLRCLRLCKVQTL

SEQ ID NO: 141987 - protein, 245 aa, Triticum aestivum
  Clone ID: PAT_TA_36405.pep
MRKAYRDSLKVLEADIQHANTLATEFPRVSDGACLQVRLSFSPAAHIFLFLVRWTDCSLAGALGLMRILIYKVYVDGTTTMSTHERKASIKEFYAVIFPSLLQLQRGITDMEDKKQKAVCMERYRRRDEDETSSLSDVDAEREEECGICMEMNSKVVLPNCTHAMCLRCYQDWNSRSQSCPFCRDNLKKTDPGDLWIHVHTYDDDDVVDMETVSRENLRRLFMYINKLPLIVPDVIFSVYDSHIK

SEQ ID NO: 141988 - protein, 147 aa, Triticum aestivum
  Clone ID: PAT_TA_36406.pep
MKSGLFALVIAAVAPLAMAAPFPPNGPPGGFFPSPPTNGSLPGAGPGAPGAGAPGAPGGPGGWMPPMPPMPPSPPVGGQPGGQPGGQPGSGSPAPPPVVPTPVPGAPVVTPVAPGAPVVTPPAAAPAPPVAPEQPVVVPTPSPVARI

SEQ ID NO: 141989 - protein, 134 aa, Triticum aestivum
  Clone ID: PAT_TA_36407.pep
MSQATSNAEEFRSLYQTYIESCNARDYEVMKSFYASPVNVMDKRQEPDDIIARCKLLFESFPDWKWEVRHMVIEGDYMTVRFKDSGTHQGEFRGYQATGRKVETTEVTLYHVVDGKFTEIWPLIDFDTVVEQIK

SEQ ID NO: 141990 - protein, 291 aa, Triticum aestivum
  Clone ID: PAT_TA_36408.pep
MRAAAIIALFASVAFAAPADSRSCSKAKNTCPVVFDGRVPANASLTDFDKENGGGWNPYNPGFVKGNNISWSEIIKLPQTTPSRFDVSGKTLPLEVTISDKSIFMKQLGFRRAGLQFSKDKNEGSPGSEGIKTLHFSLMQDKGRPLNLSHEYINVWHETADFSGNQFQFQSGTIIGQNHTAATWKLFDEKMKLLWETPMLEGKWQNFAITLNFDKNTIQAYYSEGSKALKAATQPIARDLSGQGQYQIGMLKKPTGTDDVANAGFQEANLNEGLIYGGIFLEDSKNNCVSL

SEQ ID NO: 141991 - protein, 154 aa, Triticum aestivum
  Clone ID: PAT_TA_36409.pep
KPSIYIPILVIMAPSEFHVRLQRGITSGFAPPTPNLIILIDASNNNLRISISKREDGSPDLAPSASNTVAIADHEAVIDELHGILKEVPTEQPPGSEDIYGLDTSIAWQSHDLEWWNGGPQGCGGGQSFVQAQDEEKKKFKRAVEIIKEIAGEK

SEQ ID NO: 141992 - protein, 157 aa, Triticum aestivum
  Clone ID: PAT_TA_36410.pep
TVDPRRLAQTLDPRRLALTDLMALRSALRKMPALGRSLGMAPRTGLVHALSLSLSPPACSRLMSHVPQPQEEELFYSDEARAKRREEFNRTEASFEQSMKDIQKDLDFLKELHSREWPDPEENFRKELRKFEKKCDIALLVLVPTTAVLFMSIPYYL

SEQ ID NO: 141993 - protein, 303 aa, Triticum aestivum
  unsure (1)..(303): unsure at all Xaa locations
  Clone ID: PAT_TA_36411.pep
MPAGGVCSFSPSISSRRRQLNPHPRDAEDGAVLVHRRHRLPQHRRGLPPLRDSTRTAASQPTSISPRRRQLTRTPAMQKTAQSWFTGGSASPSTAAESQPSLLADWNSYAATRSDVSSSSPLPFDIEAAVRSANDTVSGTFNVVSKGVRELPGSFQGATSSFPSGKALTYFGLFLATGIFFVFIAFTLFLPVMVLMPQKFAICFTLGCALIIASLFALKGPANQLAHMTSKERLPFTVGFTGCMVGTIYVSMVLHSYFLSVIFSILQVLALAYYTISYFPGGSSGXKFLSSSLLSPVSRIFSS

SEQ ID NO: 141994 - protein, 36 aa, Triticum aestivum
  Clone ID: PAT_TA_36412.pep
GPFFFFFFFFFFFFFFFSFFFFFFFYFLITISSHFY

SEQ ID NO: 141995 - protein, 53 aa, Triticum aestivum
  unsure (1)..(53): unsure at all Xaa locations
  Clone ID: PAT_TA_36413.pep
LKPAPPXXFFFFFFXFFFFFFFFFNFFFFFFFFFFFFFFFFFFFLITISSHFY

SEQ ID NO: 141996 - protein, 331 aa, Triticum aestivum
  unsure (1)..(331): unsure at all Xaa locations
  Clone ID: PAT_TA_36414.pep
MMVTYGELMRRSLILRGLQMARAITSVHAAPLGVGPAICVGPRISRFQWQDERMQLVLRAMRTFYFPALQXVPTKKNRRRHRLNKEIPYSLRRLIEMRRNKGEDSKNLLGLMLXSQQKLTMSLKWESEEIIDECKTFYFAGKETTANLLXTWGNRFCWQLHQEWQHKARDESLQRVWAKNEHPNAGTLSSLKIVNMVLKETLRLYPPALFVNRTATRDVKLGKLDIPAGTQVNLPIVDMHHDVGIWGANAEEFDPSRFADGKSYHLGAYFPFGIGPAICVGQNLTMVEAKLALAMVLQRFAFDVSPSYVHAPMMAMTLQPEYGAQVLVHKI

SEQ ID NO: 141997 - protein, 189 aa, Triticum aestivum
  Clone ID: PAT_TA_36415.pep
MATLRRCSGLLLAVVAVALAAGMAAAQGPAGAPAPAAGFSSECMTAVLNMSDCLPYVESGSKTRHPDTACCPELDGLLQSNPVCLCQLLAGGADSYGISVDYKRAMALPGVCRLTAPPLSACAAFGVPVGPSSAPLTGVSPSATGPQMPENPPSATPSKSKSHAPGRLTGRGLVALAAQPHVPPDSATV

SEQ ID NO: 141998 - protein, 217 aa, Triticum aestivum
  Clone ID: PAT_TA_36416.pep
THIIMTLPAVESSEDWCDPAKNYSMFLQGIVDNEMRFIDIVTGWPGSMTFSRLLKCSGFYKLCEAGKRLNGPVRTSGEDSEIREFIVGDMCYPLLPWLMTPYQGESLSTPMVNFNARQKTARMLGTRALARLKGSWKILHKVMWRPDKNKLPSIILVCCLLHNIILDCNDKLLPDIQLPDHHDNGYNEENCQQENPNGKVIREIITGYLPTYEETSN

SEQ ID NO: 141999 - protein, 224 aa, Triticum aestivum
  unsure (1)..(224): unsure at all Xaa locations
  Clone ID: PAT_TA_36417.pep
MASAEAPTARPILYSYWRSSCSHRVRIALNLKGIDYEYKAVNLLKGEQSDPEPXFMKLNPMKFVPALVDGDAVIGDSYAIALYLEDKYPQRPLLPQDLKKKALNIQIASIVCSGIQPLHNLTLVRFIEQKVGTGESIPWVKQQIDRGFTAVENMIKGCAGKFAMGDEVQLADVFLAPQIFAAVTRYQIDMSNYPTLARLYDQYMTHPAFEAALPDRQPDAPSSA

SEQ ID NO: 142000 - protein, 205 aa, Triticum aestivum
  Clone ID: PAT_TA_36418.pep
MAEDSGAILRHISSLKDMLDKVNEEIEQNIQRTRETESEIVKHSETEKDYLVKESELMKGVSVAEFELDGLMQVEAAGTDSLKAMEGNLEFRKATLNAIRKLFYDKMERFIAESRDFQVNMLGGSIEDLLLLLKERDSLENESENLRMKINAIQSSLKEYIAEILEEVNVENSVLESDVQYRISEYMEILKDINNLKILFSSSNS

SEQ ID NO: 142001 - protein, 187 aa, Triticum aestivum
  Clone ID: PAT_TA_36419.pep
MGSCISRSPASSAAAGSGRAVATKTAKVVDVDGSMAQFAAPVTAREALDSVQERRPGASVFLCSSDELRFDVPARALAGDEALQPGWLYFVLPMSTLRRSLSGPEMAALAARASSALAVASGVASPPRRKNGVGAPGANSKRRKAAARVAPLVVADEIAGPDGGSDHHHTYGKYAGDEPAAKAWKRQ

SEQ ID NO: 142002 - protein, 115 aa, Triticum aestivum
  Clone ID: PAT_TA_36420.pep
PAGSKFCVVVVPVYQSRAVLCPHTARSMRSGTAAVWWLLVAVAVPALLVSCAASARPPPVLPRGGGDAGLAGGRELGAMGAARRLGQRTPVNKPPSPNPHGASSMAVPPPPSITS

SEQ ID NO: 142003 - protein, 119 aa, Triticum aestivum
  Clone ID: PAT_TA_36421.pep
AGPISPTPCSLKLVDRSLCGLIWLIMRRTSISGSPPRVALLMKDLRHGCRREITRLGVDCSVGSNGDTYYMPPDTAQKLDDTVKEENLSGKTLLEKIWSFAKVGREEKFRLITPVSPLD

SEQ ID NO: 142004 - protein, 185 aa, Triticum aestivum
  Clone ID: PAT_TA_36422.pep
GPEFRGISNPVGIKVSDKLDSSELVKLCEILNPHNKPGRLTLITRMGAENMRAKLPHMIRAVRQAGLIVTWVSDPMHGNTISAPCGLKTRSFDAIRAELRAFFDVHEQEGSYPGGVHLEMTGQNVTECIGGSNTVTFDDLSSRYRTHCDPRLNASQSLELAFAIAERLRRKRDRTWTSLISKVEA

SEQ ID NO: 142005 - protein, 517 aa, Triticum aestivum
  unsure (1)..(517): unsure at all Xaa locations
  Clone ID: PAT_TA_36423.pep
PGRPRVRLDDFCSITIDRTRGQRLQSIVRQREELQQVEIDLRAQAIAHPQIIEVQRRFGEATKEHLVAAEKLKEQLHEREKYILELEMKLDDTHRELDALKIDHQTVWANQDLLREQTKEIASFRRERDNSEAERAQHLKQIHDLQEHLREKESQYLALEEQHRVAQDNILYKDEQLRDAHAWITRVQEMDILQSQSLQAELRERTDQFGQCWATFQQQYVEMQQGFLHTIQRLQLELIELRDRTGEQEDVSQAAQEGSAEASYVQSKGSNMAANXSALADGNQSTNDSFKGNNAHAVPVVPSLLGLSGFVPPGQMAGMHSYMLHPQGIPQSLASPNSGVPQFGTFQPTIQPTMHWPNQQEAQAASQTPDATNYHPSQSDQNALQPAALQPAASNNVELPSGQSQVTHPENLTAHGEQEQRSTSVVAESTQEPKVMESNVTEHFYNEEQKAHDSSSNASSTGKFERQEERSESKGEKVASGKQPVEHVPRKQNQASDSAGSTTQIHMNNMAPELKSN

SEQ ID NO: 142006 - protein, 517 aa, Triticum aestivum
  Clone ID: PAT_TA_36424.pep
ARRQGSEGRSAGTPPSARVPPGEILKILRRMSGCFRELPSKEKQALILQSAEQWRKAKSDVEKTLNQIAELQLQDPCFFYTVQKDEDGMLRSIFWTDARSTMDYEIFGDFVSFDTTFSTNRHNMPFVPITGMNNRGRTIVLGCALLQDRKAETYKWMLETFLQEMGGGQIPRSVITSQDEAMAKAIAEVMPQARHRFCRWNGKAQEKMAAFVAARGNMKAELDILVDSSLTETEFEQGWSALIQRHDASENEYLQLLWEMRKTWAPVYFMQDFFPFVVSARGSQGAFSLFKENVLPKDKIENLIEKYEEMQDKIKKTDEEDVLEAATEPSCFSLQPIERHASRVYTRQIFLKVQKELLHSTAFKVQEIERGTLYRLDKAYSYENPEYDRDSFEVSIEPGLTDTYTCQCAKFARDGILCCHVFRLFTQFGIDEIPEKYIVARWTDGFREEQLERREEGRLVVAAQREEDAARYAALMSKAAGIGREICGDGAKCDAFMLELDRIREKMATMAMANDHV

SEQ ID NO: 142007 - protein, 461 aa, Triticum aestivum
  unsure (1)..(461): unsure at all Xaa locations
  Clone ID: PAT_TA_36425.pep
MAFAGSGDGQSGSARAHFVLVPMMAQGHTIPMTDMARLLAEHGAQVSFITTPVNAARLEGFAADVKAAGLAVQLVGAPLPGSGSSAYQDGCENLDMIQSKNLFLNFMKACAALQEPLMAYLLEQQRLPPSCIISDLVHWXWTGDIARELGXPREQQEVMVTRDAVETAVNTLMXKGRLQRNENELITITGFPTPLELTKAKCPGNFCIPGMEQIRKKFLEEELKSDGEVINSFQELETLYIESLEQTTKKKVWAVGPMCLCHRDNNTMAARGNKASMDEAQCLQWLDSMKPGSVVFVSFGSLACTTPQQLVELGLGLETSRKPFIWVIKAGAKLPEVEEWLADEFEERVKNRGMVIRGWAPQLMILQHQAVGGFVTHCGWNSTIEGICAGVPMITWPHFGEQFLNEELLADVLGIGRGVGVKVLPPFGKKKKKFPGELGGEKGGVFFGGGKGLGEELIIER

SEQ ID NO: 142008 - protein, 190 aa, Triticum aestivum
  Clone ID: PAT_TA_36426.pep
MVAAAMQALFDQTDLSLSLSLAPTAAPALNKDDYLAICLAALAATGKGGQQQQDQASAWRPAPAPAQELRFSCAVCGKAFASYQALGGHKSSHRKPPPTGERCVVVAQASAGAGSEASAAASSGGSSGGPHQCTVCGRGFATGQALGGHKRCHYWDGTSVSMSMSVSVSASSSMLRNFDLNLLPMPETPG

SEQ ID NO: 142009 - protein, 216 aa, Triticum aestivum
  Clone ID: PAT_TA_36427.pep
MVAAAMQALFDQTDLSLSLSLVPAAAPALNKDDYLAICLAALAKSGQQVQGMEGQARVWRPAPAPAQELRFSCAVCGKAFASYQALGGHKSSHRKPPPTGERCVVVAQASAGTGSEASAAASSGGSSGGPHQCTVCGRGFATGQALGGHKRCHYWDGTSVSMSVSVSVSASSSVLRNFDLNLLPMPENVNAGLKRCAEEEEVQSPLPPRSSGFCCR

SEQ ID NO: 142010 - protein, 234 aa, Triticum aestivum
  unsure (1)..(234): unsure at all Xaa locations
  Clone ID: PAT_TA_36428.pep
TTRADRVRPPARPRRSAALHRETCHLNELELEPLEVKDALRCILHTIFFLRTLTLLRPQDVDCALVEITYLLCGLADLEREVDVKIDQFIAWAQVHPIRKSQVCLSFFDEKNKHPGWFSSKTERVYWEQWFINLHVXKPLKGKANHVAPKAPANTKGQALEETSSRRDALSLLIQEVLFQIINYANEKKDHIPPISDRIFNHEILVPSSSDSVFGWNADVLRRALSSGHSYSLN

SEQ ID NO: 142011 - protein, 119 aa, Triticum aestivum
  Clone ID: PAT_TA_36429.pep
IRSNNQTHATQHYIHTSLHTFQGPGADRSGHAVEVGCSSDRGAACAFCLAASSVVAAAASASLNTPHKDLADPDEEHPREHDSRDEQHTGKKAIKKTLVVRRHRHRYRRRWRWPDEWRV

SEQ ID NO: 142012 - protein, 104 aa, Triticum aestivum
  Clone ID: PAT_TA_36430.pep
MATSIKSIRALAPLLDRVLVQRIKAETKTASGIFLPESSVEKLNEAKVLAVGPGALDKKGNRLPMGVTVGDRVLIPQFGGSPVKAGEEEFQLFRDSEILAKINE

SEQ ID NO: 142013 - protein, 295 aa, Triticum aestivum
  unsure (1)..(295): unsure at all Xaa locations
  Clone ID: PAT_TA_36431.pep
MDAGVGLRPRPGAAWAGRRKPQGFPPATVPAARLDQNPARRPLVLRTDAGSRSTDPIRGASLKGLCCHKSAGTEKVHYSADEALVLKQKAEDVLPYLNDRCVYLVGMMGSGKTTVGKIIAEVLGYSFFDSDKLVEQSVGXRPVAEFFRSTVKHSSRDNESEVLRDLSSMHRLIVATGGGAVIRPINWSYMKKGLTIWLDVPLDALARRIAAVGTASRPLLHQESGDPYAKAYAKLTALFEQRMDSYANADARVSLENIALKQGHNDVNVLTPSAIAIEALLKMESFLTEKAMVRN

SEQ ID NO: 142014 - protein, 96 aa, Triticum aestivum
  unsure (1)..(96): unsure at all Xaa locations
  Clone ID: PAT_TA_36432.pep
MNNNKSNSAAGNVGDTVGGAANFLTSTLGNTVGGLGRTVGNVTGAATRGVGDTVTAATGSAGQPIGDAVGNIGTGVQGGLDSIXQGVEDAGQWKKQ

SEQ ID NO: 142015 - protein, 281 aa, Triticum aestivum
  unsure (1)..(281): unsure at all Xaa locations
  Clone ID: PAT_TA_36433.pep
PAPGPFEKLWEKFFEGHEGRYTIYVHASREKPEHVSRLFIGRDIHSDKVQWGQISMVDAERRLLANALQDIDNQHFVLLSDSCVPLHKFDYVYDYLMGTNLXFIDSFYDPGPHGNFRYSQNMLPEVRXSDFRKGSQWFSVKRQHALMTIADSLYYAKFKXLYCKPGMEGGCNCYADEHYMPTLFNMMDPNGIANWSVTHVDWSEGKWHPKAYRAQDVTYGLLKNITSIDMSHHVTSDIKKVVTQNPCLWNGVKKPCYLFARKFYPESMNNLMYLFSNYTLF

SEQ ID NO: 142016 - protein, 168 aa, Triticum aestivum
  Clone ID: PAT_TA_36434.pep
MTSETVAPDNSTISSPPAKRVKTTTMEAPPTLQIKKLSEKGRLPTRGSEFAAGYDIYSAHDTTIPARGKALVDTDISMAVPAGTYGRIAPRSGLASKHFIDTGAGVIDADYRGQVKVLLFNHNDSDFQIKEGDRIAQLILERIYTPEVVEVQELEESVRGAGGFGSTG

SEQ ID NO: 142017 - protein, 100 aa, Triticum aestivum
  Clone ID: PAT_TA_36435.pep
EYRQYGCHKQDQESNLLSEIHDNVALQVVLVTIPLNFLVATVSQMRRFNPLESHRISGCCPPGPRSPRLVPVSSLADRQAYYASADDLGDASLPLDLRET

SEQ ID NO: 142018 - protein, 60 aa, Triticum aestivum
  Clone ID: PAT_TA_36436.pep
SLHLTRPNRLLLKLLSNKFFLVVGQQLNRGRQEKSRSTLQQTNQRHGRKRCTLPAAGRGG

SEQ ID NO: 142019 - protein, 161 aa, Triticum aestivum
  Clone ID: PAT_TA_36437.pep
SAVGVPVPGPARRRSTYPTDLAAAAAPRPVGGVGFRVAPGGPGAQDKPTHQGLHALSPAGEPRPAFFKGRGFLCGTPGAPRRWRHKPDAGRSSHELCEARESGTAFIMGHSHVKAKPGSSLLRRLAIGYGYNFLRRNCRGPDVVLRVPPASLLEVGMVYVL

SEQ ID NO: 142020 - protein, 107 aa, Triticum aestivum
  Clone ID: PAT_TA_36438.pep
RPDVATLTTQCPQSGASQPVAMDPVTPNTFDTNYYANVAANRGLLASDQALLADNSTAAQVLGYTLGHASSPGTFQTDFASAMVAMGAIGVLTGNQGTIRTNCRVVG

SEQ ID NO: 142021 - protein, 47 aa, Triticum aestivum
  Clone ID: PAT_TA_36439.pep
GWMELELGEFVCEGDEDGDVSFGLAETKRLNGKGGLIMQGIEIRHKN

SEQ ID NO: 142022 - protein, 99 aa, Triticum aestivum
  Clone ID: PAT_TA_36440.pep
SPSSYKAILHWFQRMRSTSIGFRMYPSARGGAARWSAGWRPSSSAPVCRSASASGAASRAPATASSAGSTSNETHTSSIHYLLARSSSRHYHYSLRSII

SEQ ID NO: 142023 - protein, 109 aa, Triticum aestivum
  Clone ID: PAT_TA_36441.pep
GTLSQTRILMKPAPKIGFRHPYFMQGGDPVHVRVTPSLWCPLSSLLSLWLSVRLRRDSYRSMRLGDGAAHRAVCGLVTYVRLPVLVGYRFPFFSILFQWICYPVIGGEK

SEQ ID NO: 142024 - protein, 151 aa, Triticum aestivum
  Clone ID: PAT_TA_36442.pep
ETSDRYSYLISKTSIVGESFFCLEERGRYSIGEALPPLPRWTGGLSILTRQLFMHTAAHKCRRPTAFLQQLQHSPVHRQKLISQTHSPEGAAIFSVGTRPLSDRARVARKTDRRSRVTARPAALLVSIVAHDDEEKRRRADGGHVPCPSWV

SEQ ID NO: 142025 - protein, 198 aa, Triticum aestivum
  Clone ID: PAT_TA_36443.pep
MASHDDDTMPEETQGYKFSQPKQSLAEYQQMDAGDESLQRYKESLGLGGGTDISDPNDPRVCIILSLTMDSPGRPPVTIDLSTPGSETTLKDKPFNIKEGAKFTMSAKFKVQHEILSGLHYVQVVKRKGIRVSKDSEMIGSYAPSTDKQPTYIKKFQEEEAPSGMLARGHYNAISSFVDDDKKKHLEFEWSFDIAKDW

SEQ ID NO: 142026 - protein, 441 aa, Triticum aestivum
  unsure (1)..(441): unsure at all Xaa locations
  Clone ID: PAT_TA_36444.pep
FAGSCLSNKRNILINLFAASSAANNEPEIVFNFLLRTLHLQSSLKMVDLFKLGAGAMPASFKVDRHVNRNTETLVADFGESAIGRVAPXVDSGFWWIILLRAYTKYTGDASLSESPDCQKXMRLILNLCLSEGFDTFPXLLCTDXGCSMIDRRMGIYGYPIEIQALFYMALRCALQMLKPDGEGKDFIEKIGQRLHALTYHMRNYFWLDFPHLNNIYRYKTEEYSHTAVNKFNVIPDSIPDWVFDFMPCRGGYFRASVSPAMMDFTWFALGNCIAIISSLATPEQSSAIMDLIEERWDELVGEVPLKIVYPALENHEWRIITGCDPKNTRWSYHNGGSWPVLLWLLTAACIKTGRPQMAKRAIELSEARLLKDGWPEYYDGKLGKFVGKQARKFQTWSIAGYLVARMMLEDPSTLMMISMEEDRPVKPTMRRSASWNAKEG

SEQ ID NO: 142027 - protein, 407 aa, Triticum aestivum
  Clone ID: PAT_TA_36445.pep
MATAASASASPAALRAKTPAPGAHPSPKSSLAFPWPSPGASASASAAASGRLHASLHLGGVRGVGTANGTGLHVLHPDVKPLAVPKMAGGAGAQKSILLYHCEEMRDLAQQVAARNDDIELCTISWRKFPDGFPDLFIPNAQNIRGRHVAFLASFSSPGVIFEQISIIYNLPKLFIASFTLILPFFPTGTSERMEDEGDVATAFTLARSLSHIPISRGGPTSLVIFDIHALQERFYFGDAILPCFESGIPLLKSRLQELPDSDNIAIAFPDDGAWKRFYKQLQHFPMIICNKVREGDQRIVRIKEGDARGRHVVIVDDLVQSGGTLIECQKVLAAHGAAKVSAYVTHGIFPNKSWEKFKPDNGEGPEHALSHFWITDSCPLTVEAVKDRRPFEILSLADSIASALQI

SEQ ID NO: 142028 - protein, 93 aa, Triticum aestivum
  Clone ID: PAT_TA_36446.pep
RRNDWLIIHSSIQSFGAQLLKKAHTDGVVPNKNVIAHVLPLSPSISPSLVVTHTRPRTARPGEKTEQWCSVRIEEDTRLGFRNQCLHIFFSFN

SEQ ID NO: 142029 - protein, 219 aa, Triticum aestivum
  unsure (1)..(219): unsure at all Xaa locations
  Clone ID: PAT_TA_36447.pep
MLAVGPPAAAKPTSYEALAAYDLRPGIIPLRVVSYILHNATGDFTAHINXSSTCEISLQRSYSLPSTTAIXGRISVARLTNHQGVAVKVLFSSLIIVEVTRTXASRLDFSVGIPSARFGLDIFLHSPTCVRRLDCPDLALPVARTPTASRACSCEVRSSIPTERSDKSQRPLQNSASAWMDYPCFLLLEVTKWLLVFSCAVPVLEGPTISRLDFDGYRV

SEQ ID NO: 142030 - protein, 215 aa, Triticum aestivum
  Clone ID: PAT_TA_36448.pep
PVRNSRVDPRVRAPEAVNHALRAVLRSRFLPKDWRQPIVAETGHPVLKKVLRYIPDTLDGSNENARANEGWRRKFGWYKPRLLDSLCIFPRQVNEHAKSKEELELEKQQGVENEPMNSLSELDLLTSHYLQDDLPIILEVLLRSDHLMTDELWKWLEEVLEVYSRPEVLGRGTWGLRRCVFGGGWNLGRRAYCRRGRARGFGHRGHGRARGFGHR

SEQ ID NO: 142031 - protein, 98 aa, Triticum aestivum
  Clone ID: PAT_TA_36449.pep
LAASPGGSHGPKGIFFPDTRYNLRTDDGVDIYIQTQGPTQPDGRTLLRGTFQTGHPDYDWLNYILAVGVLQRPPAESKGKYVVIDMWQMVLPDCNGAC

SEQ ID NO: 142032 - protein, 104 aa, Triticum aestivum
  Clone ID: PAT_TA_36450.pep
MFSCGKPTSPPGPKPKPPPAPTPTPPPGPTPTPPEPPAPTPTPPAPPAPKPKPPPAPKPKPPPPKPTPPYPPPAPPPPPSPPPYADQLRRQLPCMIPVILVQYG

SEQ ID NO: 142033 - protein, 105 aa, Triticum aestivum
  Clone ID: PAT_TA_36451.pep
MAKSNALAATLLLVMVVSLATLEGVHGVCGMSNDEFKLCQPAAAVNNPTESPSAECCAALGKANLSCICRYKGIAGIWLKMYHIDAKRAMALPGKCGLTMPNNCS

SEQ ID NO: 142034 - protein, 208 aa, Triticum aestivum
  unsure (1)..(208): unsure at all Xaa locations
  Clone ID: PAT_TA_36452.pep
MRTSFSTVLALAAALPTAFAHYNFEALIVNGEVTEPYQYVRKTTNNNSPITDVTSKDIVCNAGGLDKDIRAATKTMKVSPGDEVGFTVASEMGHPGPPSVYLSKAPDGTEASDYLGDDEWFKVYEMTWKKIGADGVEWANYMNGQSGGIKNFTFTLPKDTPKGTYLMRAEHVGLHGAGEKNGAQFYIGCAQITVDXQRCWQAFSHGQA

SEQ ID NO: 142035 - protein, 363 aa, Triticum aestivum
  unsure (1)..(363): unsure at all Xaa locations
  Clone ID: PAT_TA_36453.pep
MPLPSPPARLAVPAAVLLVLLHLAATATATNFTCRAPRGTTCQSAIGYRVPNATTYGDLLARFNTTTLAGLLGANGLPVATSPKKRVAAKQTVRIPLPLPLRRQPASARSDHAPVYTVQPRXDGWNAIARNSFRALSSPTTEIATANKIADVNLITIGQKLWIPLPCSCDPVDGAXVVFHLAHIVDGGESTYGIAATFGVTEDTLLKLNKIADPKTLQKDQVLDVPLPVCSSSISNTSDDHDLRLPNGTYTLTAQDCIQCRCSSNTFQLNCTAVQGKKGCPAVPPCSEGLNLGQTSGAGCDFKMCAYSGYSNSSSLSIQTTLFKNQTAPACEKAGSLRSAFAGSMWRISAISFHMVLILVCFL

SEQ ID NO: 142036 - protein, 83 aa, Triticum aestivum
  Clone ID: PAT_TA_36454.pep
APLQYYRGLWWRGAPHTAKRTMINCCVSRCPPAPVYKGARGTRPALGGAHQGGEVLLPLGVGLPSFPSPSRRGKGKGKRETER

SEQ ID NO: 142037 - protein, 114 aa, Triticum aestivum
  Clone ID: PAT_TA_36455.pep
GEKYRQHDGVVTILMFYRRSASPKHRYIIIQDYSGGGTAHGSENIDQLLRHWGAPLPSYINDHGGRIRYRSRARHGGTPTMTEVEYGGGGHRTRLRNDHEDQLVCLEVPPCPRI

SEQ ID NO: 142038 - protein, 134 aa, Triticum aestivum
  Clone ID: PAT_TA_36456.pep
NPPGAVWALVGFSGKEKGQPWTGGAPRRRRRPAAQRGLRPSPSPSPIRTRRRWPAPLSLFPPSGILVGLGLGGSPTPGRSRTPPAPLSLGRPPPPPLLLYIRRQGHPKDTQVDPRDLFLSRVRCPLPPYSSIIL

SEQ ID NO: 142039 - protein, 126 aa, Triticum aestivum
  Clone ID: PAT_TA_36457.pep
RPLEAAGGRLLFLHLVYTSLLYQTTSSLTPKPSSKCPRLPLPRFLPLSARTEVSSSPSRLAMPVTSAFFRTAPSMSARRLPARTLLTLSPLPSLPRLRSLPTKSELEDYGIMAPWPITSTLNQACL

SEQ ID NO: 142040 - protein, 413 aa, Triticum aestivum
  unsure (1)..(413): unsure at all Xaa locations
  Clone ID: PAT_TA_36458.pep
METARKPHFVLVPWIGSISHIVPMTDIGCLLASHGASVAIITTPANASLVQSRVDRVTLDGAVLAVTTIPFPAAEAGLPEGCERLDLITSPAMVPGFFEANKKFGEAVEQYCLRDAPRRPSCIVSGMCHTWTLPMTRNLGVPCYIFHPRVRFALLCIEHLYRQGRHEAIASADELVDISVLQPFECKILGGQLPPHFLPSTSMGSGLMQEVREFDMAVDGVVVNSFDELEHGSTALLAAAAGRKVLAVGPVSLCCAPSLDPQSDDARRCMSWLDGKKAKSVVYVSFGSAGCMPPAQLMQLGMALVSCGWPVMWVIRGADSLPDDVKVWLRENTDGDGDADSKCLVVRGWAPQVAILAHPAVGGFMTHCGWGSTLESVAAGVPMVTWPLFAEQFVNEKLIXVDVLXIGVSVGVT

SEQ ID NO: 142041 - protein, 206 aa, Triticum aestivum
  Clone ID: PAT_TA_36459.pep
GPRRLSSLLATLLSRSQPMKLSLSLPLMPTFQLNMPGLEASTLGLDALTSRDHHLSSVVEELLGIVVERLRLSPLPRRGAAKVGGGAALVRDEARRRSAAVPGLSLAGWAVRSRPRRWWVAHAVSGPGGYWAGAGGLALFGRSVQTRGVQCPPRASGGEYRFCLRQTVIDSVHVLRVWNKMFIRKKKKKTAPCIRLYVFIKFILNG

SEQ ID NO: 142042 - protein, 267 aa, Triticum aestivum
  unsure (1)..(267): unsure at all Xaa locations
  Clone ID: PAT_TA_36460.pep
PAGSGLRSDPIQSSPPTISPGNLRSERSEGSLVLLLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADXNIQKESTLHLVLXRLRGGQ

SEQ ID NO: 142043 - protein, 253 aa, Triticum aestivum
  Clone ID: PAT_TA_36461.pep
MLFKSIFISSLATSALAIYLPEDHYLVRDNAAAPGAKCDCSGDNVRYNSTLAKDYICGDKRLGPSRLPTKLPLGTFVTGYDRFGGLSPNSFLGKWYNSTEGPDGREAGWIYPEKYGFELDEEKLPIKANVDLMPGTLVDRFGYNTGRYISPATAPFSQRALHPQNLDNDVNKQFPNNYHVYNVSRMFTVQAGPIRPWFGQPGFGVQFFLGNGISVKDYLDNGHLVELKPSDLLKDGTGCGFAREGDDSVSDEL

SEQ ID NO: 142044 - protein, 222 aa, Triticum aestivum
  Clone ID: PAT_TA_36462.pep
MDHGFHGALQLPPGFRFHPTDEELVMYYLCRKCGGLPIAAPVIAEVDLYKFEPWRLPEKAAGGGPDAKEWYFFSPRDRKYPNGSRPNRAAGTGYWKATGADKPVGSPRPVAIKKALVFYAGKPPKGVKTNWIMHEYRLADVDRSAAARKKSNNALRLDDPSLCRIYNKKGVIERYDTADSDVACHYKGSTGFNNGFNLKNWKVLWQKKGGQLNPIAFETLFG

SEQ ID NO: 142045 - protein, 432 aa, Triticum aestivum
  Clone ID: PAT_TA_36463.pep
MKKSSDDATFNDRSHLKKPSDGATLDDRSHLKKPSDGAIVDDTSYSKKSSDHDNSSSSGVLPPSIFRMLLPPQKVLPGTEGKAKKKSGWSSDDSDGCCSADSSDGPLCKQGGHVDYPERPGRPEYHHPKQSKDKEEVNYPERPGKPDCPFYMRFGDCKFASACNYHHPKDKYPAARPDEPECPFLMKRGYCKLGAQCKFYHPEASSPTDAKRSVTTDEHHPSTRITLQDYMLPQQPQYPERPGQPECRYYLQFGKCKYLSACIFHHPKDRLAAHSDQIGPGMHGMPDCPFYMKAGKCQFGSACEFRHPKDIHSSSTTEEAFGQRTGSGAYDNLARSDNGVEQQEESIMYPERPGEPECAHYMRQGYCKFQMNCKYHHPGDRLSKKHEVIRTDPLEQSRDTLVTARMLPTESIVLMCRQVLLEQAVWLKCECV

SEQ ID NO: 142046 - protein, 164 aa, Triticum aestivum
  Clone ID: PAT_TA_36464.pep
MANSLLPVVALLALLFGASRAADFEVGGDAGWVVPAAGDSGTYNDWASKNRFLVGDSVHFKYKADSVMEVTQEEYDKCGSTHPIFFSNNGDTEVRLDRPGPFYFISGVTGHCERGQKMVVKVIGQNEPPPAPPAPPSGAAPAGIGSAGAVVTAALLPALIVLGV

SEQ ID NO: 142047 - protein, 192 aa, Triticum aestivum
  Clone ID: PAT_TA_36465.pep
MASKSVSLLVLAALVAAACLAGLGSAARDMPAEKPAEDAVKRPETFQEGTVLIPGIGRYGLGTHYIPHSAQLPPVPVTAIGMASKSASLHTLAALVAAACLTELGSAARGVPAEKPAEDDVKRPDTFQEGTVLIPGIGRYELGTHYIPDIGGLDHSIPAAASGQFIPGADDTWVPNPGFEIPNPFRPRSDSP

SEQ ID NO: 142048 - protein, 111 aa, Triticum aestivum
  Clone ID: PAT_TA_36466.pep
MASKSASLLILAALVAAACLAGLGSAARSVPAEKPAEDAVKRPDTFQEGTVLIPGIGRYELGTHYIPDIGGLDHSIPAAASGQFIPGADDTWVPNPGFEVPNPFRPRSESP

SEQ ID NO: 142049 - protein, 99 aa, Triticum aestivum
  unsure (1)..(99): unsure at all Xaa locations
  Clone ID: PAT_TA_36467.pep
SRGRGRERAGTPDDIPGHRPRLSPGAARRPPGKPALRWPGGGATPRACPGPAPWRVRNTRPAARSRRTRXPEPPGRPPALRRFRPRPPPQACPPSAWDA

SEQ ID NO: 142050 - protein, 151 aa, Triticum aestivum
  Clone ID: PAT_TA_36468.pep
KGHQAMISSGKATNRVRFSFRMALTSDDAYSGVRGKEDHLSGVFARGLFFFFFSHRNQQFTYITSIIIRLEPSIYLQKGKHDRIARDMRKPNAARLGDDPTTSTTAGPNLQRHAQEGSYVLLCLYVEVQSIYISPKLTTESTTVRSNVIPG

SEQ ID NO: 142051 - protein, 161 aa, Triticum aestivum
  Clone ID: PAT_TA_36469.pep
MALVLTAMLLLLPLPLLLRRPPSTSSPSPRTSPPLFPARSSSPAPSSPLPLFTLPLFPLSPSSTTTLVRPLRTLLLSSLVLSPPSPESWPLPPTLATTLLPLTAALMLLLPATRRPVLFPPTRFPTMEPFLLRFPSLPEPLLSVLAACCSLSLWPSPLSCK

SEQ ID NO: 142052 - protein, 196 aa, Triticum aestivum
  Clone ID: PAT_TA_36470.pep
MASRALLLCSLVALALAAGSDARDHVVGGGKDGAWRVPPPAQPDALNDWAGKARFHVGDNLVFKFDAATDSVLEVTRADYDRCNTASPIATYKASGAVVPLPPKGERFRHFISGAPGNCQKGERVIVLVMSEKHGSRVPPAAPAPAHSPSSSAGLVEAPAHAPAPAPATGAAWRTASGSGSVVLGALLGALLVVGF

SEQ ID NO: 142053 - protein, 103 aa, Triticum aestivum
  Clone ID: PAT_TA_36471.pep
LRKTKCGRDCRILCLGDIQQSIVQNSRVHWKTASNIRGASSSISALYLAIELVSGLDPDVLALSEVEYGLGELDGAALPLQLEVLLCEKAALDVEAKEAVIGE

SEQ ID NO: 142054 - protein, 317 aa, Triticum aestivum
  unsure (1)..(317): unsure at all Xaa locations
  Clone ID: PAT_TA_36472.pep
TWSTYTPEDTTLAPIRLRRWEPISPTTPSTWSSSTPPLTALATACRGGISSTTPARTPSPPSVASTFLPSSSGSCQDSPEPASGCGSRQGNYRLAGLVSGPPHPSHAALWLSVHSCFSFGGSFLCWVDLHRGMVLCDLRQGLQLXFIELPQGPPNYDASDYPHGLCAEEFRSVACVHGSVKFLAFNKFVEREPGETFGLAVWTLSPDHSAWSRSYKCSVGDIWANANYQSAGLGQLAPSFPVLSIHQDGVVYLVVNDTSVVGRRLVFKDQYLLRVDMGNNNDVQVYQQKTTRIYSQLFASEFSAHRRQEHPPERDGI

SEQ ID NO: 142055 - protein, 137 aa, Triticum aestivum
  Clone ID: PAT_TA_36473.pep
MALSRSMRTCLHSGRLAALAILVSGGIVLQILACALYNNWWPMLTVLMYLILPMPLIFFLGSDSPSIMSNENDGWVNFTKFLTGASIVGSIAIPSILKHAGVIGWGALTMELSSFAVFGLAIVWFLQMNSEDEYSAF

SEQ ID NO: 142056 - protein, 370 aa, Triticum aestivum
  unsure (1)..(370): unsure at all Xaa locations
  Clone ID: PAT_TA_36474.pep
YSRGHARYRTTIAPLWLRLXECNLLALEMGFLTASGATSCKDEIEIYVVGSGKWRHLVISPVNSGSHLSDFGSSGEHENLISLRFARQCLLNAQLLMDASEQKKMAISDTEECNQGSQCQKSSGRSTMSVESKVHSGPTTNANGEQKGAASLNATLQSSLAMYDDIIRKENLKIRQAILGDLAFVELCLENPLKALSIANSLLQVPDCSRMYLFLGHVYAAEALCLLNRLKEAVDQLTVYLRDDNAIELPYSVENREKAPVEKDSDGEDSVTPAMTKLTSEESQHSMSLKPEEACGVLYVDLGMTAAVQGELEQANYLVSRGFAMLPNSPRALLASIYVDLLQGKVQEAIGKLRRCRNVRFKTSSVAASR

SEQ ID NO: 142057 - protein, 217 aa, Triticum aestivum
  Clone ID: PAT_TA_36475.pep
PAVPRSLSCIRSPFTQTLAPAPPPPRTPSAPVLLSSGRHPPMATKSQKKKLSAPNPSVDAKKPKPQKPVEERETAVAAKKPKPKKQKEGKEASAKKPKEQKEVSAKKTKKQKESNEIDEIFEATKKRKLQEQEEDEEGSEGGKKPRKGKAEGASKKKSKKETGGRGWEPGHDDEVEEKRPRRRTNDGLTIYSADELGFGKADAGGTALCPFDCDCCF

SEQ ID NO: 142058 - protein, 273 aa, Triticum aestivum
  unsure (1)..(273): unsure at all Xaa locations
  Clone ID: PAT_TA_36476.pep
MSDIETVSSFVEGAPPGELADVIADIKSLTLETNPDIVNSLTPAFEKYNEEQFVTVKLPGSSQPVIISSYNSLGDGRYFDVESSSSFTFDHTTQKASAVQSHVLKGAQADLVKSTLKSIGPYVDEHFANAAHGVYPIESDSKIAIVIVGNKYSPNNFWNGRWRSLYILDPSSGALEGSLKVDVHYYEDGNVRLLTNKPVSSTISSANGAGIVREISXNGKRYQEELNKGFVSLSEGAFKGLRRQLPVTRQKIEWDRVTSYRLGQDIGNGGSRR

SEQ ID NO: 142059 - protein, 131 aa, Triticum aestivum
  Clone ID: PAT_TA_36477.pep
MLFFKSIVSLAALVGAAVASPIETRQSATRCGSTSYSAAQVKAAANAACQYYQNDDTAGSSTYPHQYNNREGFDFPVNGPYQEFPIRTSGVYTGGSPGADRVVINTNCQFAGAITHTGASGNNFVGCTGTS

SEQ ID NO: 142060 - protein, 242 aa, Triticum aestivum
  Clone ID: PAT_TA_36478.pep
PPLSLCFSDDHGNLLLPSLVILLHLEEGGSGLELEPGHVSMPHPPAQLEPLTHLGVGHVNVFVRAVVRLVRHVVHLVRLRHTRAPLSRQRHERRVIRLGLGLDDERLLLLLLGLDDESLLLHIRLGLLLRPGLEDRRHLLRLRLGLEDRRLRLRLRLRPDPDERLVLRRLRPGGPDEQLRLLLLRLERGEVKSLVAGGHRHGKLHLLNRHRRVSLADLSWWVRDWWIGDFSSSLAGSSRTGR

SEQ ID NO: 142061 - protein, 103 aa, Triticum aestivum
  unsure (1)..(103): unsure at all Xaa locations
  Clone ID: PAT_TA_36479.pep
SGDAALGEGGSTSGGSASSVCPTASTASDGGTTIAMGMNSSDGSSFIATSCCGASSSTSSCCGSGXASSPSSSPSSSSFCCCCCCCCNFSCSSISKSASCTTE

SEQ ID NO: 142062 - protein, 76 aa, Triticum aestivum
  Clone ID: PAT_TA_36480.pep
MGQCGCFGAAQKEQRAEADRLEAQEARARAAEAAQKRQQEYEKSAAGRAARAQIKAMKEAKTSSNQGEPVLKWQMG

SEQ ID NO: 142063 - protein, 108 aa, Triticum aestivum
  Clone ID: PAT_TA_36481.pep
LLAAIIIYIQEEIDRDHQQARVPTQGSFTGPMGQAAPRTECHAGPPATGPSTAHAMQHRHTGDAEGPAPLIADRQTGSTSPSAAAASQASTSFKSARCLLGIKGYSYL

SEQ ID NO: 142064 - protein, 289 aa, Triticum aestivum
  unsure (1)..(289): unsure at all Xaa locations
  Clone ID: PAT_TA_36482.pep
RAAARAGTPMKAIVSLSSLLLETALTAEQRLMIETILKSSDFLVTLTNDVLDISKLGNGSLELDIAPFNLHAAFTDVVNLIKPVAACKRLSVMVSLAPELPSCAIGDRKRLMQIMLNVAGNSIKFTKEGHISIAASIARPVPRRDPYASYLHPVPSDGSFXLGCQVKDTGCGIGPEDMAHTFRKFAHGENATTKLHNGNGLGLALSRRFVGLMQGDIWLESEGVGKGCTATFFVKLGTPKKPNVNANPRRMMAPLQPSKGAGGHGADALSISIMDSDARGPRARYQSSG

SEQ ID NO: 142065 - protein, 173 aa, Triticum aestivum
  Clone ID: PAT_TA_36483.pep
EKPNPPREDGPKPSRPPPRRRLSPPPLPPRPAPHPVTNATPPPSSSAPDPPRPTPRLLVGTGQGHGRGEAKLHFGEGGDGSGDGQERQGDGVLQRGGRLRARRGRPWPSAPSDVLGSGASPPPDAAALRGFNGGCRWAITKGRAHSSSLGAIFWQRMLLIEYVFKRDFFYSDS

SEQ ID NO: 142066 - protein, 82 aa, Triticum aestivum
  Clone ID: PAT_TA_36484.pep
PPPWPLPFSHPLKGCARLSLTCRPIHDSPIRLPLRRSVSLPHPSFTKACIIGSLLIKRYRVACRKGVLCNKMGSRSEPDPAG

SEQ ID NO: 142067 - protein, 159 aa, Triticum aestivum
  Clone ID: PAT_TA_36485.pep
RPGLRKEHNRIQRYRRLLLTWASFRSQLSGPDGEQGGSGGGGGGSGAGEGVDVVLQEHGGGGRVAPGEGQGPVQAVHGGAGGRALGVPQEQGQLHVRRPHPLLWRRRQGPRLHQQHAAVRRVTLNRRRRRRLDGLSLLLLYYYYSMRITSWLGLIFSSG

SEQ ID NO: 142068 - protein, 138 aa, Triticum aestivum
  Clone ID: PAT_TA_36486.pep
MAPKAEKKPTAEKKPVETEKKPKAEKRVPGKDGGAGADKKKKKAKKSVETYKIYIFKVLKQVHPDIGISSKAMSIMNSFINDIFEKLAGESAKLARYNKKPTITSREIQTAVRLVLPGELAKHAVSEGTKAVTKFTSS

SEQ ID NO: 142069 - protein, 342 aa, Triticum aestivum
  Clone ID: PAT_TA_36487.pep
MTKVLLTGGSGFIAAHTLEQLLEKDYSIVTTVRSEDKAQKIRNAFPDKVKDGKLEIVIVTDIAKPDAFDQVAKTPGLDAVIHVASPFHFNITDPKKDLIDPAVIGTTGILKALHASAPNVKRVVITSSFAAIIDEAKFTDGSHVFSEKTWNPVTIDDITRSDTTAYRASKTLAERAAWDFVAEKKPSFDLVTVCPPLVLGPVSKHLATLESINTSNARIVNLLRGEWKDEIPPCTPVPLWIDVRDAARAHVRGLEEPSAGGKRLFTTAGLFSHREIVDIIAEKFPEFKDRLPGPEVKGGELPPKDQIFGIDNKETNELLKIDWLTVEKSMTDLVESLKEIGI

SEQ ID NO: 142070 - protein, 334 aa, Triticum aestivum
  Clone ID: PAT_TA_36488.pep
MHSKVVIIGSGPAAHTAAVYLARAELKPVLYEGFMANGIAAGGQLTTTTEVENFPGFPKGIMGGELMDNMRAQSERFGTEIITDTVATLDLSSRPYKYTTEFSPEETHTAETVILATGASARRLNLPGEDKYWQNGVSACAVCDGAVPIFRNKPLFVIGGGHSAAEEATFLTKYASHVTVLVRRDVLRASRTMANRLLNHPKCTVLFNSGATEIRGGEDGLMSHLVVKNNKTGEEKVHEANGLFYAIGHDPATTLVKGQVDMDEDGYIKTIPGTTYTNVEGVFAAGDVQDKRYRQAITSAGTGCMAALEAEKFLADHEMTSEPTSDPTPTKKSK

SEQ ID NO: 142071 - protein, 103 aa, Triticum aestivum
  Clone ID: PAT_TA_36489.pep
SAVPSHAPRRHKLLEGGAVRRFVLRRRSSRRQGGRGRRRSLHRRRHQQKGRRRSRHTGRPWRLLPASSELKMRSTCFYLVYTFGPAGLLALRVLYLVSFQPLV

SEQ ID NO: 142072 - protein, 122 aa, Triticum aestivum
  Clone ID: PAT_TA_36490.pep
HMEMACNLLTHRIFQEIVPSNAGNVLGTEDNVLTKKRVSLIDHQVMNILVGMQEMYHIFHHSHMAIVLQHLWKKMMSSQILLVPIVNKAKEVLWQRCRPQDQTKPSMSLSFFEALTDKLRLS

SEQ ID NO: 142073 - protein, 189 aa, Triticum aestivum
  Clone ID: PAT_TA_36491.pep
MAPSQTQEDNATGSKSSDLLKHSKEESVLTDKDRKALVFTDKHSSPDVYISYNKDTLWYPWVTTLEVKPLRFETRSGSFVIALRTPVDAWLGKHRHRGTVTAVTLAGNWGYKEYDWTAGPGDYVVENPGTIHTLFMGAGSEVVFTITGSLEFFHDDDSLKETMDIFSFSQLYYDHCEEKGVEPNAGLWY

SEQ ID NO: 142074 - protein, 111 aa, Triticum aestivum
  Clone ID: PAT_TA_36492.pep
MDGDSPVMTDSERRAYRYVQAPKVQGLGGIKNSWSNDSLFSLSYAGAGGRAVVHSCVCAPTTHPGSFRCKHHRQSAAHLGVAGHAQAQPTAEAKRNEVHGEMSTADDEKAS

SEQ ID NO: 142075 - protein, 240 aa, Triticum aestivum
  unsure (1)..(240): unsure at all Xaa locations
  Clone ID: PAT_TA_36493.pep
MRTPPEMPLGLPFTVDTWGPSRRHRCHRFITHAHTDHIAGAWAGPGDTVYATQLTMRLALERYPQLERVKFVEMEVGKRWVVDDPDGAFSVTAYDANHCAGAVMLLFEGPFGTILHTGDCRLTSHCVQKLLLKLEANLCRLDTVYLDLTFPKFLEFPSKESAIQQVIACISKHSRAPFIYLGCQRLGQENILXEVSGSFRSXIYGDKGXTLDWFNTLSHTVXXIITDDPTGRFQVLPVRS

SEQ ID NO: 142076 - protein, 351 aa, Triticum aestivum
  Clone ID: PAT_TA_36494.pep
AGRFGSESPSHKKWKRQADDESWYDEFHNYEDHIDYFRDLHAQFPNNSKLVSSGKSYQNRNIYGLHLWGEAGPGKPAVLYHGTVHAREWISAPTVEYITLQLIKGFKGGDKDVQTILNKYDFYIFPFVNPDGFVYSTTADRLWRKNRQPPPTSAPNQTCLGRDINRNWEFGWDSNKRGASTNPCSQTYRGEKPADSPENAGLDKFVRQLRDTVGIALYIDWHSYGQYILSPFGYKEDLYAPELGPWREAAALVSEAIRDSSDDKTTYTFGPSGAVLYVTTGAAPDHVYSVGQAKFSYTIELRDTGETGFVLPPAQIRPNVEEQWAGQKVLLSLLDETFFDGSGPALYQGQT

SEQ ID NO: 142077 - protein, 92 aa, Triticum aestivum
  Clone ID: PAT_TA_36495.pep
MGWVQDPHIQELLLKQTDNARAAAREKAKLDQLEIDAVTPLYEGCRPEDTRLKVTLMALEMKVKHKMTDACFDENMSFWHERLPKGNKCPTS

SEQ ID NO: 142078 - protein, 260 aa, Triticum aestivum
  unsure (1)..(260): unsure at all Xaa locations
  Clone ID: PAT_TA_36496.pep
MGWVQDPHIQELLLKQTDNARAAAREKAKMDQLELDAVTPLYEGCRPEDTRLKVTLMALEMKVKHKMTDACFDENMSFWHERLPKGNKCPTSLEEAKKIVCPLDLPHVKYHVCMNNCIIYRDEHSESTICPVCGVTRKHTSTKAPRKGVXYFPITPRLQRYFAGPKVAKLMRWHTDRKEKKREDDGNDPEINXKDKMLSHPKDASQWQVLNFEYPEFGKEPRDLMVGASTGWVKPFCHPGSDVCRVIWNDRALLPSSTRE

SEQ ID NO: 142079 - protein, 90 aa, Triticum aestivum
  Clone ID: PAT_TA_36497.pep
SWPPPGPAAQTTGAGGTQEGRIRTREDAEGRRPTTSRSQGTSIGSDISGTKAQDTFGTTARRQSVAQSRSSPEGGRLQSGRTLQSGRTED

SEQ ID NO: 142080 - protein, 649 aa, Triticum aestivum
  unsure (1)..(649): unsure at all Xaa locations
  Clone ID: PAT_TA_36498.pep
MTSSSAARNQHLDELRALMASHSPPIHALLIPSEDAHQSEYVSERDKRRQFISGFTGSAGLALITTKEALLWTDGRYFLQATNQLSDRWRLMRMGEDPPVEVWIADNLSDEAVIGIDSWCISVDSAQRYEQAFLKKNQTLFQLSSDLVDEVWKDRPPNDATPVIVHPVEFAGRSVAQKMKELREKLQHEKASGIIITALDEVAWLYNVRGNDVHYSPVVHSYAIVTLHVAFFYRARDATVAAAGGDRVDYVDGEGXHAREQLDVISAPSAARKQPPVKGSLPMEKDINPADASKIWIDSNSCCLALYSKLRPHQALMLQSPIALPEAVKNPMELTGLRRAHIRDGAAVVQYLAWLKNLRQENYGASGYFSEATGSPKKEHLEIKLTEVSAXSDKLEAFRAEKEHFKGLSFPTISSVGPNAAIIHYSPEANTCAELDADKIYLCDSGAQYLDGTTDITRTVHFGKPSEHQKLCYTAVLKGHIALDAAVFPNGTTGHALDILARTPLWKSGLDYRHGTGHGIGSYLNVHEGPHLISFRPSARNVPLQASMTVTDEPGYYEDGNFGIRLENVLIVKEADTKFNFGEKGYLSFEHITWAPYQTKLINTALLTPAEIEWVNLYHSDCQKILESYLNVQEKEWLRKATEPITASS

SEQ ID NO: 142081 - protein, 222 aa, Triticum aestivum
  Clone ID: PAT_TA_36499.pep
MAAPTVLALALAVLLPPAAAAAAPGRAGRAPPGASPLVTTCNEGPFPAHCVKELGPRLLDIQTALASVSPRGALIAGAPGTVDFSALVAVAMEAATEAGAVATTIFEGKLPGFNTSVPDFKVCLSNCSVTMKSAMKKIHGATAALKVHAHLVAKVLADRAIADVSACTISCRNLTGDVRLILEASLVEFQKMIRIAVNFLTKIAAKTPPGPLPPLAPPLRRP

SEQ ID NO: 142082 - protein, 230 aa, Triticum aestivum
  Clone ID: PAT_TA_36500.pep
MRASLDSSLLLILANALTAKAQAQSCPDIHIFGARETSVAPGFGSTGALIDMIKADHPGATSEAIDYPACGGQASCGGVEYGVSAKQGTEAVTTAVNELNKRCPNTKIVMIGYSQGGQIMDNNICGGPDNGASISASNVPLSASAVEQVKAVIMMGDPRFIHGLAYGVGTCDAGGFDARPEGFVCPNAGKIQSYCDSQDPYCCNGNDAAHHQQYVNIYGKEALKFVNSKL

SEQ ID NO: 142083 - protein, 118 aa, Triticum aestivum
  Clone ID: PAT_TA_36501.pep
MAKSSRASTKKANNRRLVKNVFGPAEAARNERLSAKLLEVAKQPKPESSDVNMNTEEETNESNEDAQEETTMDVDSVKKPSSGRIEKKRPDKRKQQSSKITFKSYGSRSKGKGKKKSA

SEQ ID NO: 142084 - protein, 153 aa, Triticum aestivum
  Clone ID: PAT_TA_36502.pep
GRFLFLTKNASNTQQFQDHRNIFDAMDIQLSTPTRGKRSAGSKIAASLDKPVDWPVRMSKGGPRAGLYEFCKKLQWPAPNFDCAKVEQSVPTPQGQGFTFASTIKLHIPNSDVISLTGDCFADKKSAMDSAALLMLYELQQRGRLQVQEIHVS

SEQ ID NO: 142085 - protein, 78 aa, Triticum aestivum
  Clone ID: PAT_TA_36503.pep
MASSHKFFPAVLLLLLLVVAMEVAPAQAEEPRVCETDSTRFKGICMVGTNCANICLTEGFTSGKCSGLKRKCICTKPC

SEQ ID NO: 142086 - protein, 168 aa, Triticum aestivum
  Clone ID: PAT_TA_36504.pep
MAGMKTIVLLAVISAAALGTASAATHRVGEPGGAWDLTTDYGSWASSREFHPGDELIFRHQPGAHNVLEVSEVDYDSCNATSPITTLGSGFFTYVALPAVGTRYFICGFPGHCTTTGTGGMKLKIDVVPGSPSSSPAPAMPPPSSAAASAGATIGSGLVVLLAAGLMA

SEQ ID NO: 142087 - protein, 533 aa, Triticum aestivum
  unsure (1)..(533): unsure at all Xaa locations
  Clone ID: PAT_TA_36505.pep
RPVRDEVEWYLFQGLTDHFAVMALITSLQDVRLDMLAHFVAFLVVVSVVRKKLAPQPSAYLLNPRRWYEFTDARAVSEVLHTTRQTLEEWFHKHPTTPVRLTTDFGEMTFLPPTLADEIKSDKRLSFIKAANDSAFHTEIPGFEPFREGGRNEAALIKEVIHGQLKKTLNKMTFPLAQETQLAVEHYLGANKEWHKIRLRDALLPLVTRISTRIFXGXDLCQNDKWISITSEYAANSLEVANRLGLWPSXMRYVVSYFSPGCGILRNQVKNARELITPIVERRRSEEKGKEYNDSLGWFEKTAKQAYNPAATQLFLSAVSVHTTTDLICQCLEDIAAHPEIIKPLQEEIRRVIAEEGWNTKAMYKMFLLDSVFKETQRLKPIQVASMVREAQSDITLSDGTFIPKGHQIAVSCHNMRDGRIYENPEKWDGYRFFRERQQSAREDKVQLSSTSVEHMGFGYGEHACPGRFFAAKQVKIVMMYLLLNYEWKIPEGPEPQLMAWCTTWVTDPDYEVLMRRKDKDDPCLRLELVQDD

SEQ ID NO: 142088 - protein, 194 aa, Triticum aestivum
  Clone ID: PAT_TA_36506.pep
MAATLSSVSASSKHCSVVRAQHSSLPSILSTSPAKKTAFRGVSLVDSRWLRRGGARRRLVQVNAKTAGAAKNIEVEVDKPLGLTLGQKSGGGVVITGVESGGNAARAGLKSGDQVLYTSSFFGDELWPADKLGFTKTAIQAKPDSVYFVVSRGGGDIDVKRLPKRPAPPRFGRKLSDSQKARATHICLDCGYIY

SEQ ID NO: 142089 - protein, 260 aa, Triticum aestivum
  Clone ID: PAT_TA_36507.pep
MAATLSSVSASSKHCSVVRAQHSPLPSTLTTAATLSSVSASSKHCSVVRAQHSSLPSILSTSPAKKTAFRGVSLVDSRWLRRGGARRRLVQVNAKTAGAAREHRSGGRRASQATKCSRQRSFFGDELWPADKLGFTKTAIQAKPDSVYFVVSRGGGDIDVKRLPKRPAPPRFGRKLSDSQKARATHICLDCGYIYFLPKAFEEQPDEYGCPQCNAPKKRFARYDVESGKPIGGALPPLTVIVSLVIGIAGIGALLVYGLQ

SEQ ID NO: 142090 - protein, 159 aa, Triticum aestivum
  Clone ID: PAT_TA_36508.pep
RPNRRHPQYLRPHRPPAPSPPPPLLRPPRRPRRPKAHCSFPFPSRPGSGDGGGRRRGHGGLASCLRSPTSPITAGLQPPGQGRRPSTSSSITSGSPQCLWAASPSPSYAPPSPLQILAENRLSLFPFQSVAQAESLVVCGGDGAPPLRLIRLDVAPPRP

SEQ ID NO: 142091 - protein, 123 aa, Triticum aestivum
  Clone ID: PAT_TA_36509.pep
LPRVREDLEMGVVYATFPMKHIGTKLAAADMARLAAAATREARRSAKVSSVGAAAAAAAQPEPAITFVPAAEEAPSPRARLDEMVDDAVAAEIDVLKHRLSSARSRRPNLETIHEENHLLCRR

SEQ ID NO: 142092 - protein, 171 aa, Triticum aestivum
  unsure (1)..(171): unsure at all Xaa locations
  Clone ID: PAT_TA_36510.pep
PAGPGKKPAVANPAPPPNPGRAPPVPHPTSQQAHPXPPTSSPGAPSHWPRRSPRRPPAPARPRHRRRKQPLDPSSVLLLLPDTEFYRPDPQAPPPTSSPSSCPTLAPSTSSSSLAAYLVFQLPAGRRFGSLLVAARSPPQSSPRACPPRLGGEKLCVRLCIHCNEQQVKDT

SEQ ID NO: 142093 - protein, 106 aa, Triticum aestivum
  Clone ID: PAT_TA_36511.pep
AGRARGPSPGETSTHQQVGEETLELERRPTGSTPPPLPRFSLGLPGATPRRAAPPRSCPPATSTTPVVIVLHPLSSTQSQSSSSLGRRRRRQRQRDIPLPTATKVS

SEQ ID NO: 142094 - protein, 104 aa, Triticum aestivum
  Clone ID: PAT_TA_36512.pep
MSLVAGVRASLLSSPASSSSRPCQALAHQVRAYRSLISPAASRGGRRSTRLRVRAARLESTGVSVGFRAPQFELPEPLTGKIWTLDDFEGSPALLVMFICNHCP

SEQ ID NO: 142095 - protein, 247 aa, Triticum aestivum
  Clone ID: PAT_TA_36513.pep
MSLVAACAAGARASLLSSSAISSSRPCPALARHSRAYRPLVSPAASRGGRPSTRLRVRAARLESTGVSVGFRAPQFELPEPLTGKIWTLDDFEGSPALLVMFICNHCPFVKHLKKDIAKLTSFYMEKGLASVAISSNSIVTHPQDGPEYMAEEAKLFKYPFPYLYDESQEVAKGFRAVCTPEFYLFKKDGRRPFELFYHGQFDDSRPSNNVPVTGRDLSRAIDCALSGQELPFDQKPSVGCSIKWHK

SEQ ID NO: 142096 - protein, 74 aa, Triticum aestivum
  Clone ID: PAT_TA_36514.pep
LPGFWAIYEVMGTALFWALLLAVIVVGMIPHFAARPIREHFMPNDIQIAREMEKSQDSRDVNHPEVQMSTSTRA

SEQ ID NO: 142097 - protein, 135 aa, Triticum aestivum
  Clone ID: PAT_TA_36515.pep
PAGTRSLSSPLPLLSGAFPSSRDEMLRSWRNLDRVCRSAYGPFAMARNIAVHGQTNRGKPNQTSHLPCGSAFFCTPSEQFATTKGKNRAKMRKETKKVNVRSSFIIDNSTHRDGSIYKNSFLQKICSVTNRDESK

SEQ ID NO: 142098 - protein, 134 aa, Triticum aestivum
  Clone ID: PAT_TA_36516.pep
TGFTLPLCRLKGMEVSFGPASLDLVSLDWEPLGSLSLDIRACWLRAVKTRVPVETWARRRSCRGRRGRCVLMVVQGGIREALSRTARAVVSQICDDSRGGDRVVHRRRMPTVGDEGSRRVEHRGCEEEAAGAVG

SEQ ID NO: 142099 - protein, 210 aa, Triticum aestivum
  Clone ID: PAT_TA_36517.pep
MTSVADGVSGDHRADEQQQKQAAQGNQEEAPATSIGSQAMVATPSTDYVTPYGHQEACHAMGQIAYPTVDPFYGSLYAAYGGQPMMHPPMVGMHAAAIPFPTDAIEEPVYVNAKQYNAILRRRQSRAKAESERKLIKGRKPYLHESRHQHALKRARGAGGRFLNAKSDDNEEHSDSSSKDKQNGVASRSSGQSSQSPKGATSADKSANHE

SEQ ID NO: 142100 - protein, 334 aa, Triticum aestivum
  unsure (1)..(334): unsure at all Xaa locations
  Clone ID: PAT_TA_36518.pep
LGLSDGSWAWCAGACHGPRQAACSGRVGGRDGHGVLRGLRRFEPIVRGFAAVVPSYGFGTCRVTRPLGPLGARGPLAGLRLSHRPLRILQSVPVRNTPCRFLATAYLKEPWKMGVHKRNGVVYLDVHNLPERPQSEIDRRXCFWGYSFENLATENSIDEEXSGIDANVEYCSVIKTKLGAHRIVMGAEMDCCDSTDDGGRFYVXELKTSRELEYHTVEKFEREKLLRFWIQSFLAGVSYVVAGFRNDAGVLIRTERLRTKDITQKVKAKSYWQGGVCLAFADEVLCWLYGTVKENEDYVLQFAHPFHLLELLKAQSPCPDAITLHVEQLTGATN

SEQ ID NO: 142101 - protein, 126 aa, Triticum aestivum
  unsure (1)..(126): unsure at all Xaa locations
  Clone ID: PAT_TA_36519.pep
PAGLGQXKLPHNSTLARTSGPSKSSQRTRAASQTSQKSLILLLDEHQTNSSRWEVRATKNYSRMMTRAFTPQVTMARRSRQQRPSDKPTVLQFSSRMFGFGWLVRYRCWVFVFILSWYILFTAEFS

SEQ ID NO: 142102 - protein, 320 aa, Triticum aestivum
  unsure (1)..(320): unsure at all Xaa locations
  Clone ID: PAT_TA_36520.pep
MFAASRIQRRAFSATARDLSKVTVLGAAGGIGQPLSLLLKMNPRVTDLALYDIRGGPGVAADISHVNTKSSVKGYEPNAAGLKEALSGAEVVLIPAGVPRKPGMTRDDLFNTNASIVRDLAKAAAEAAPKAKLLIISNPVNSTVPIVKEVYKAAGVYNPKTLFGVTTLDVVRASRFVSEIKGTDPKDENITVVGGHSGVTTVPLFSQSNHPDLSSNAELVKRVQFGGDEVVKAKDGAGSATLSMAMAGARMADSVLRAVQGEKGVKEPAFVESPLYKDQGXIEFFSSQVELXPRGVEKDHPSRKLDANEEKLVDAALVDL

SEQ ID NO: 142103 - protein, 141 aa, Triticum aestivum
  Clone ID: PAT_TA_36521.pep
MGIGEHFEGVKQHWARNFAFLDYFKKVYGRDQPLPKWSDADVEEFIASDPVYGPQLKALRESRKFALGGALAGAAHLGGVAFKYSKSPHGVVLATGFGALTGAVLGSEVAEHWYELYKMDKQGANLRFIYWWEDKVSGQKN

SEQ ID NO: 142104 - protein, 86 aa, Triticum aestivum
  Clone ID: PAT_TA_36522.pep
MTSTDPKTTDDKPVEQKPEQKPAALGEDDGFEDFPVDDWPEDQTEAAKGSGETKHLWEESWDDDDTSDDFSQQLREELKKVEAKRR

SEQ ID NO: 142105 - protein, 77 aa, Triticum aestivum
  Clone ID: PAT_TA_36523.pep
PNEAASTQFSSFTSWFVIVTGSWTKIIAWRSSESTDELDEHQQQQHCDRTLLPACRHLQNQGSKEVYLRHTIPTLPA

SEQ ID NO: 142106 - protein, 160 aa, Triticum aestivum
  Clone ID: PAT_TA_36524.pep
KAGRAGTPPIPANRLKQIATDACNSAIGNAEFYDHAKTEQWNSTIISSVLKAVISESTPEGASAPSFKFACNSTIVQHLVPTSALNKPRGGTETQAQEPHISTSSEATATDGKPHVGRRGMHSATGAYWDEKKDGMWTFKYDGGEGKGLDVVVMLIWVAI

SEQ ID NO: 142107 - protein, 222 aa, Triticum aestivum
  Clone ID: PAT_TA_36525.pep
PAGHFDTNTQFTRLATQLPAMLSLVAYALLASATLSVAVDPRFEYPDTVPLVKRQQPGTPQYACHEDCGLLITLARENENFCDSQEWNNHYDKCMECAETYGIWKYYGSGVSKVAGQCDLSPTPSPSGAATKETATSSSDGSGTTAPGKITTEAPTEVPSTTIAIESTVIATPSAMTTTDVSSVNTATSTPEPSSVAVNGAAKHFEFTTAIVFAAFAIFNLY

SEQ ID NO: 142108 - protein, 187 aa, Triticum aestivum
  Clone ID: PAT_TA_36526.pep
MLAQRVGVNALRSGAAKPFFAQNISKSALAAGISTSSPTRATGSVKVSQEDGHQILVNQRLNRPVSPHLAIYKLEQTWFGSSAWNRITGCTLSATLYGFSIAYLAAPVVGLHLESLSIASFVAGLPLAVKGGLKFTLGFPFVYHAISGVKHLLYDAGKGFAKSTIIQADKYVWAASVLGAIGLVAFL

SEQ ID NO: 142109 - protein, 220 aa, Triticum aestivum
  Clone ID: PAT_TA_36527.pep
MLLATAPPRTLSTTSSSACTPTLRTTTPLPRLFPSSRVSALLMSRRTLVSPLVPTLSLSTSPSLAPPSSPLPTTPPSSLLLPSLSLASLAVPPLRDPPPSRPLRLRSSFPRLASLTALAATAPSLPRLSPLMSPLPVLRLLPRPATRLPVLVRPSSPTSPLLVPAVFPPLPPPLAFPSLLVPLATAWALPPPSWLLPSPCKGHVFCTTLFFLVYRLGLGT

SEQ ID NO: 142110 - protein, 73 aa, Triticum aestivum
  Clone ID: PAT_TA_36528.pep
MGNGAKAQQKRERAAKDKNTAKSQLKVNEKACDIQCQICKSTFLKTTKAPALKEHAENKHSKTIADCFPTYQE

SEQ ID NO: 142111 - protein, 239 aa, Triticum aestivum
  Clone ID: PAT_TA_36529.pep
MLRQIALTALSVLPLTLGQVAEDFESGWDQVAWPTYAPDCDQGGKVVLDKTTGHSGTNSIKVTGGPNGFCGHKFFGTDAIPSGDVYVRAWMKSEKTLDDSHVTFITMPDAAQGKGKHLRIGGQSKILMYNHESDDATLPDLSPEGIAASKNIPANQWQCLEYHLSPDGTIATWLNDSPVKGLVYKPNDPASYSNGWKNSKPKPKIQGVYFGWESYSGASNTFWYDDIAVSSKRIGCSTK

SEQ ID NO: 142112 - protein, 122 aa, Triticum aestivum
  Clone ID: PAT_TA_36530.pep
MAGKFEPKTAVTLDPPKDDIISKEELAKANGATEGGKCYVAIKGKVYDVTGNKAYLPGASYNVFAGKDASRALAKSSTKQEDALPEWQDLDDKEKGVLNDWITFFSKRYNIVGVVEGATNQE

SEQ ID NO: 142113 - protein, 135 aa, Triticum aestivum
  Clone ID: PAT_TA_36531.pep
AGRYSHKILTEPTNFNHNTIYRHIIKRMSSKQKRPEPATLIRPPPISQRKTLLRPSNPKLRPSMIHLLHHRRREKGHQCRGHQGQGGHAGGRAGVRRRSGGRGRRREVLRRRRGEEDGHGQEQHGDAWSHHDLAL

SEQ ID NO: 142114 - protein, 211 aa, Triticum aestivum
  Clone ID: PAT_TA_36532.pep
THNKKNVGQTRGKSQQHSSTAHRRRDKGHQCRGHQGHCGHAGGRANVTQQPTSFIHKAHNMDRQYIIEKECRTNKRGQSQQRPSNHRLFLKGKTLCAQPSNQNPQPSIYCIIAAARRDTSAEETRAKADTLRSGGRGRPHEVLRRRRGKEDGHGQEQHGDAGSHHDLALWACETMRGRARVDRRIGEEGSELKSGGLARWDGSLAAKGGRA

SEQ ID NO: 142115 - protein, 214 aa, Triticum aestivum
  Clone ID: PAT_TA_36533.pep
MATIASPREGARRRPRGAPRRRRSRSRVIADIDDAAGEALAAALGGACCSYVHCDVSVEADVERAVGCCVARHGRPAARCDGAGGLARRAPPAAFGARTRGCPSLVPPQCVRLPPGITRAAALGRLPPARARRQRRRGGGPAGSPVAVASVAGVLGGMGPHAYTASKHALVGLTKNAACELGEHGIRVNCVSPFGVATPMLVNAWRHGEDDQRG

SEQ ID NO: 142116 - protein, 83 aa, Triticum aestivum
  Clone ID: PAT_TA_36534.pep
RPVYCLPRKMPKLLPSQDNKHLLNLESLCKRYEISVEGPSHIAMQDVMALCHVFQKMSFDLQLTHEGLMNEAINASYFSKYLN

SEQ ID NO: 142117 - protein, 136 aa, Triticum aestivum
  unsure (1)..(136): unsure at all Xaa locations
  Clone ID: PAT_TA_36535.pep
PAGPGFCFXITFSFLGMQRRRAKSPHRVAAASWTNPLDFLQLADGGGGPDPVPSWAIAPSGDPDPAPDHLVTGGLIAPADLPCSELRPCADKFSKVLSSDVHRTTLPHPLSYPNQPIPHVARTPAHLAPPPGNGGE

SEQ ID NO: 142118 - protein, 204 aa, Triticum aestivum
  Clone ID: PAT_TA_36536.pep
MSMTPKDAAKRPNSRSRTSRPTTPLRPSSRSSFRDSARSARHHDAPFPLNAFEPAFAELSDAMADLETNMMHFQLMHESLARFSESFASFLYGLNMNAFCVDFPEGPVPESFRRDRTRQEQPAVTPSKSEADAEMTFMTTDGSFVENPPTTAKTSKFTTPEPPKRQSRLPAAPGRGTTARGRSTRGVGRGRPSGLARARGRGVR

SEQ ID NO: 142119 - protein, 402 aa, Triticum aestivum
  Clone ID: PAT_TA_36537.pep
MQSGMEQTTGVSGHEHVIDIPRDSGPSASASHSVGRENHEELNPVDRPSTRAATSALQPPAAIGPPHAENTSGTRRRDNYGRRHRSPLNSGLWISVEVIVNVSQIVAAIVVLSLSRKEHPQAPLFEWVIGYTVGCFATLPHLYWRYIHRNIVNGENEPAHSLQGSSQNNSTEPTPASVSERRRNAARNAVLANPRINALFDHFKMALDCFFAVWFVVGNVWIFGGRSSAVDAPNLYRLCIVFLTFSCIGYAMPFILCAMICCCLPCIISVMGFREDTNNTRGATSESINTLPTYKFKTKKRRHGSGNEAEGQEGGIVAAGTDKERSLSAEDAVCCICLAKYAHNEELRELPCTHCFHKECVDKWLKINALCPLCKAEIASSSGTSDTRHIDHTVPTQEIEMH

SEQ ID NO: 142120 - protein, 201 aa, Triticum aestivum
  Clone ID: PAT_TA_36538.pep
SSFLIQDKHKEEGKNKATRFDRIMLSVSNHEMKHKHQHFNTFYALASRRVDLFCKRIIPFREPVISVFQEPQGPAVDDEVVVYLVQVLVLVLEPLLEELVRPRRTSSAWPGGDDRGGRWIRTRGSTAASAAGRRARAAGTLVHTMDGGAPATTAAGHTGARLGPYSAANARRRTSPGAPSRQGTAQVPVLVDLRGAPTGPG

SEQ ID NO: 142121 - protein, 99 aa, Triticum aestivum
  Clone ID: PAT_TA_36539.pep
MAEAPSQIESMRKWVVDHKLRAVGCLWLSGISSSIAYNWSRPNMKTSVKLIHARLHAQALTIAALGSCALVEYYEQNYGSSGPKVDKYTRHYMSHSHKD

SEQ ID NO: 142122 - protein, 165 aa, Triticum aestivum
  unsure (1)..(165): unsure at all Xaa locations
  Clone ID: PAT_TA_36540.pep
MATPTVEKPDGVEIREVWAENLEAEFAVIREIVDDYPYVAMDTEFPGVVCRPLGTFKSNADFNYATLKANVDMLKLIQLGLTFSDERGGLPALGPDGRXPCVWQFNFRGFAPRTDGAAADSIDLLRRSGIDCARPGGSGAAIRRAPILCSPRSPSTSSRSRTSAD

SEQ ID NO: 142123 - protein, 56 aa, Triticum aestivum
  Clone ID: PAT_TA_36541.pep
EKYLVHPSHIVLLKCLKNSEKKLSHSHNINAGCHKISNQNLKHNSKKMTNSTLNNT

SEQ ID NO: 142124 - protein, 262 aa, Triticum aestivum
  Clone ID: PAT_TA_36542.pep
DSWARGFHAATFTLPMSDIVSYNVGGKAEKNVEMLSEHLGDWVREEDGKKIVFHTFSNTGWLCYGVILENLQRQDPSAVEKIKGSIIDSAPVAVPDSQVWALGFSAAGPCIMKKHSVATKGTAPNTRSDVVVVESHKDIRPAATEAVLLSALEKFFDLVLNYPAVNRRLSGVMELLSSNQPSCPQLYIYSSADRVIPAKSVESFVERQRKAGCEVRSCDFVSSPHVDHYRSNPGLYTSQLTNFLEDCVLARREDSSSRSPSA

SEQ ID NO: 142125 - protein, 87 aa, Triticum aestivum
  Clone ID: PAT_TA_36543.pep
MGSRWIRPEVYPLFATTGVAVGICVMQLVRNITTNPEVRVTKQNRAAGVLENHDEGKRYSQHGVRRFWLSKRPDYMHELDNPPTDRK

SEQ ID NO: 142126 - protein, 147 aa, Triticum aestivum
  Clone ID: PAT_TA_36544.pep
RAQHFPSIEKAIEWSVKGGPLRNIDSARISIPSTLKYDESKECYTYRTPLEKTEKYWKGWYEGLSDKFLSCPVQKILLLAGTDRLDRALTIGQMQGKFQMIVVRHTGHAIQEDVPEEFASHILNFISRNKIGPNGVEIPGLIKKWQH

SEQ ID NO: 142127 - protein, 158 aa, Triticum aestivum
  unsure (1)..(158): unsure at all Xaa locations
  Clone ID: PAT_TA_36545.pep
MAVVGVLALQGSYNEHMSALRRIGVKGVEVRKPEQLQGLDSLIIPGGESTTMAKLANYHNLFPALREFVGAGKPVWGTCAGLIFLANKAVGQKLGGQELVXGGXLHCPTGNFFGSQLQSFETELSVPMLADKEGGSNTXRGVFIRAPAILEVRSDVEI

SEQ ID NO: 142128 - protein, 243 aa, Triticum aestivum
  unsure (1)..(243): unsure at all Xaa locations
  Clone ID: PAT_TA_36546.pep
MEIMHKATESAYDEDNGKGKDVSSTEENDPWNPSYRCAPRPCKDLTDNVKLMKEVLREKHVLFAVSRATQTIVPDRTPQSVNDAFVNKLPRLVPILEKDSVRLFLNLFKHDSVGLAWGFVMTPQTFNQMIVQNALRCAKVALEGKAPELNGHRANPNYMNSRGYFPLHQAAEMFSADMIKLLFHYGASANLRTSGPEVIEGLLPLHVAVENACHHKFLERKPGTRQKXTDYVYRLIQLXCLPE

SEQ ID NO: 142129 - protein, 183 aa, Triticum aestivum
  Clone ID: PAT_TA_36547.pep
TSRSSIPSDPDASPTPPVACKRRRAQPGVRGGEGRVGGEHRGDPPSPMAAWVVVRESCVVFPAVTERSRGTGWLKRRRRALVQLLLRFELRCAPVYLHAAAALLTNSCHGKGGGGPAGVPGGARPPRWRQARAGATRSGGQAPPRICRQHRRACGRGGAMACSSGCRCGPITTTIMETSARSM

SEQ ID NO: 142130 - protein, 83 aa, Triticum aestivum
  Clone ID: PAT_TA_36548.pep
DRPIPQTWHTLFHSASCAACVPPPLSYIMQKRGLETHSVKGYARPFTDRYTKTYLAYAMSSKKAVKQTCILLLSRQMSRTNSS

SEQ ID NO: 142131 - protein, 281 aa, Triticum aestivum
  unsure (1)..(281): unsure at all Xaa locations
  Clone ID: PAT_TA_36549.pep
HETADKNYTXKPSKEKEITTMSWLFALRALKDMKKTPSSPAPSPPLLHTSVQSSTTPPGTTPLGARCREPTALKQRGLHNGIEARRLMFTCKRRPKRTDAKEEGGNGHPSTILDGSQQRASMISLPGAASILPPPDPAPADARATDKRPPDHQDQITQFVGHGHQHQIRRRSQPYCKRRDPHRKEEEHWDATDLAREICRFSPGTAPTTSIKPRPKPKPTTSMYRDAGVSPLPSSTGYSGERGSGLTRSSMGDTQGRRRTRREGGRYPSTQNSMQVLLGMH

SEQ ID NO: 142132 - protein, 71 aa, Triticum aestivum
  Clone ID: PAT_TA_36550.pep
NLGMQRHYAGARFGRRTAMGCHGCFCITLQTPQSQICPHLKPHHFETLGHYGLLGLNFNPCKRVQGHFFGY

SEQ ID NO: 142133 - protein, 156 aa, Triticum aestivum
  Clone ID: PAT_TA_36551.pep
IISDTTKHSNNSSLNPTQSNKPPNMHALSTLTTLTMSLFAAQTANAWLLEFWGTQNVCSKPKGSAADSSAGGQPGEGNDCMMAYYDLEAMLVKDWDEGCTVRLYNGKGFNCDGDLILEYTKEKAAEEEKLSDDGTYMCLADLAGEPGPYQASYTCE

SEQ ID NO: 142134 - protein, 112 aa, Triticum aestivum
  Clone ID: PAT_TA_36552.pep
LAPSAFLNFAKYRYGSLLQQRLHTFSRVTYIYMLDTTIFYTSPLLQNRLRSQVPSPTNHQCHNFVVVILNSCRCLPLRLVREKRRPIEHALLYARQEISALHHAPPTTMPCP

SEQ ID NO: 142135 - protein, 74 aa, Triticum aestivum
  unsure (1)..(74): unsure at all Xaa locations
  Clone ID: PAT_TA_36553.pep
MSCICESGCNCHSNCLCDNMYPXISTQQASAVAQVAAVNVLSVSSENKTRAVLGXSSSQTAYACTCPNHCKCNP

SEQ ID NO: 142136 - protein, 247 aa, Triticum aestivum
  Clone ID: PAT_TA_36554.pep
MASKFLAVALVAAVPALARTDLAGCTTYDTVVSNADGMYATRIWYVPDSGEICDILDCGGGRAPPKTTVPGCPAYEGTETYSPLFIDPKTLGGAAPEKTGDAQGTVSVSATITSAPATETNASGTATETEAATETETASETESKSETASESTVRPIISNTRKANDTGMSTAMTTPGRATLTTTASSGAGSGTGTASSGSDSGSASDSESKPASGTGSAVSVFTAGAAMPTAGAFLALAGAAIYAGIL

SEQ ID NO: 142137 - protein, 192 aa, Triticum aestivum
  unsure (1)..(192): unsure at all Xaa locations
  Clone ID: PAT_TA_36555.pep
MAFRACLSSHKASPSPSVAQRRASNGAPPVVAMASTMNEVKIAKKPYAPPREVHLQVMHSLPAQKQEIFDSLQSWARDNLLNLLKPVEKSWQPQDFLPEPSSEGFYDEVKELRERAKEIPDDYFVCLVGDMVTEEALPTYQTMLNTLDGVRDETGASPTXXAVWTRAWTAEENSHGDLLNKYMYLSGRVDMR

SEQ ID NO: 142138 - protein, 418 aa, Triticum aestivum
  unsure (1)..(418): unsure at all Xaa locations
  Clone ID: PAT_TA_36556.pep
QCPPPSSSSTGPARGQLVSSGLGRPGLPPGPLAPAPACRPAAVRPAKERRRWGAVAASMDVLKDGKKPYQPPRHPPPRGVHPMHAXQQEIRHSLLDSPRAWARNNLMPLLKSWQQPGHPPXLLPSPSSMGLYNEGKELREPAKATSVGFFGGLVGDKVADASHPTYKTLLNCLGGIXDEPNASRTAWADRTRAWSNEESRHGDLLNKYMYLSGRVDMRQIEKTIQYLIGSGMDPGTENNPYMGFLYTSFQERATFISHGNTARHAKQFGDLKLAQICGTIAADEKRHETAYTKIVEKLFEIDPDYTVLAFADMMRKKISMPAHLMYDGEDNNLFEHFSSVAQRLGVYTAKDYADILEFLVQRWKVADLTGLSGEGRRSQDYVCTLATRFRRLDERAQARAKQGPVVPFSWVYDRKVQL

SEQ ID NO: 142139 - protein, 107 aa, Triticum aestivum
  Clone ID: PAT_TA_36557.pep
DGQADQISFHVGLTTAESGEQDESTKNPSLVQCPPGPPGEQKRESVQRDVGQCFLGKRISIRTQTFAARSPVHILIHAKTSSKKVGNKAVESVALSDYAYDFHLGRK

SEQ ID NO: 142140 - protein, 135 aa, Triticum aestivum
  Clone ID: PAT_TA_36558.pep
PSSTKPLLLRDVLVAPALIKNLISVRQFTCDNLVSAEFDPFGLSVKDYLTKAEIARFNSSGDLYSLNGVPAATPPTSMLASVDLWHRRLGHPNPAVLASMLSEFTIPCNRDSHNSVFCESGRVGNMCAPFSPLVL

SEQ ID NO: 142141 - protein, 43 aa, Triticum aestivum
  Clone ID: PAT_TA_36559.pep
KNESYTYTYVNYVHTTAQIMHAYTAKTVEIPSEYGSLQRNSYS

SEQ ID NO: 142142 - protein, 182 aa, Triticum aestivum
  Clone ID: PAT_TA_36560.pep
WQLRTVVYTTHTYIHQNDPNHCEATDSTCSPKAAELQRNSIQPEKTKMLFPSNTPYLTSDPDPQSPTPISRSKRTTAAILDSFLQRSSYIHPSPSPGTCRARPDQPPGATRRPPLPPSLALALPSFRSALRKRHGKRHANMLAFTCPRLGRGRLESPCRSIAGCWRLLAPKARKKKGRERSV

SEQ ID NO: 142143 - protein, 79 aa, Triticum aestivum
  Clone ID: PAT_TA_36561.pep
TVYIILRRESRKKEIITNHLTLTVVLCCWRVSLMVNVAIDACQTRLGCAGNQHLDAAKRSADTIACQKMNELHMQAARN

SEQ ID NO: 142144 - protein, 205 aa, Triticum aestivum
  Clone ID: PAT_TA_36562.pep
QRPAPSGRDRGPLGGLCPGAAATPAGALSGGEGASPAQCGGLVDAFLPVAADLLAFPMPTVAAVTGHDYSTDFLPALCHDYRLMRADRAVLYMSEADTVLCPPLYFVHVLRTTNSHTHALPVLGLRGMNLTPPEAREMGIVDVVCPGAPETAAEALKLAEGRAGRKWDGAVYASIRMSMFPDACRAVGIAVESDEEKSRHFASRL

SEQ ID NO: 142145 - protein, 140 aa, Triticum aestivum
  unsure (1)..(140): unsure at all Xaa locations
  Clone ID: PAT_TA_36563.pep
RHEDLSLPALSPETPSSPPXPPARPGRTWRRAIHPATTPSSTPSSPPAAASAASPPRTIAPSITISSTVVAHHPSPYPAPPQPSSTPPTATLLFLTSVVSPLNPNSFSISKLHDAPLMKLSLNPLLLLSSPCPRCCFFFL

SEQ ID NO: 142146 - protein, 215 aa, Triticum aestivum
  Clone ID: PAT_TA_36564.pep
MFNLDWNDLLPLAYVAVLGGSLMAFSTIYRKRQAAESANLAPWFGPHLQRNVYLSLLHLDDGSEKSPKVPESVLRAALLRRAVEDIRRLIQVKSAKQACGSLLAKGSVGDDLWQRFQRAEKEMEEELRDVVTEANALAPNWGQSIFQSAHEMTANAAMRSSIEEILAQADSEKQWWEKRRGQIQTEFMKELDSEQSSSAKATSEEDAVLVEDPSN

SEQ ID NO: 142147 - protein, 33 aa, Triticum aestivum
  Clone ID: PAT_TA_36565.pep
LHDTFCAVLRELVTLYFNEIQLHLAKKKKKKGP

SEQ ID NO: 142148 - protein, 98 aa, Triticum aestivum
  Clone ID: PAT_TA_36566.pep
CAARAGRSGLSPSDRPLLPSLSPSMACPNLTIDGADELAHFGIPVTSDVRLPSRWRLSAAGVPVLPLPDVCSHLFMRAVRLYRARLPVDMSGPEPRAY

SEQ ID NO: 142149 - protein, 162 aa, Triticum aestivum
  Clone ID: PAT_TA_36567.pep
AGRAGNWQRKDRLRNGYEATPRMRMQRRCQPKIAAPRLNCLPRFCQSYLRILHRMHRINTREPGLFETLCKCRLIRLTKVWETTKLRQICLITQIRDGRLSIRGRQQFSRSSISQPDTNGKKAGRVNTVGLINSLSHNLASCSMLDGCDLGILALQIYNDGM

SEQ ID NO: 142150 - protein, 99 aa, Triticum aestivum
  Clone ID: PAT_TA_36568.pep
RPGRGEMGSLPSPPPPVRRRLLLHPCPPCSFDPPAHLPSSPPPSIEIRPSSPLTFRVASQVQRYVPPPSGSLLRLPPLPNTSGAEPSLDGHQPKLQKGS

SEQ ID NO: 142151 - protein, 135 aa, Triticum aestivum
  unsure (1)..(135): unsure at all Xaa locations
  Clone ID: PAT_TA_36569.pep
DPSPKPNHPNPNSDPLPLQPPLPPRSNPSRPRSNPSSGARRPPSLALSINRTRATMTHTRAAEIRVPAPARKMVILSPPTRHPPVSSPLARRTHASNLPQARWWWFREPRRGRGRWAIYCTAAAAXVXXGXTGQW

SEQ ID NO: 142152 - protein, 117 aa, Triticum aestivum
  unsure (1)..(117): unsure at all Xaa locations
  Clone ID: PAT_TA_36570.pep
RPRQEDSLTANNTKSVGAFPTVLKVKKKDRQVIRVRLRHFNVYSLISHPPYELQMLAAVTAVLPLWTCNLSVVVLLIFVPFQSNTKKKRRLLSFGWEEGCSSCLKKYKSVXIFKKKK

SEQ ID NO: 142153 - protein, 139 aa, Triticum aestivum
  Clone ID: PAT_TA_36571.pep
GPFFFFFFFFFNLQYSYLSPLISRILHSLATATNLLGVGEASSLSISTREALGGDLFAGILPLVSSDLSFGVFLGASTRWSVVLDTSPLVVCIIVDGACIHSHAIVVAVAIVAGAVVVEFCRSDREEENNAKDLGQHDE

SEQ ID NO: 142154 - protein, 173 aa, Triticum aestivum
  unsure (1)..(173): unsure at all Xaa locations
  Clone ID: PAT_TA_36572.pep
GLINEAARYRAPSCLLAYLSTKPAKKPRRNINVHSAYLHVIGDSIQSIGVMIGGALIWYKPEWKIIDLICTLIFSVIVLFTTIKMIRNILEVLMESTPRXIDATRLESGLRKMEGVIAVHELHIWAITVGKVLLACHVTITQDADADKMLDKVIGYIKAEYNISHVTIQIERE

SEQ ID NO: 142155 - protein, 421 aa, Triticum aestivum
  Clone ID: PAT_TA_36573.pep
MDSHNSTSPHVPEVTMDISSASGAAGNKACRGAACDFSDASNTSKDSKERSASMKKLLIAVILCVIFMAVEVVGGIKANSLAILTDAAHLLSDVAAFAISLFSLWAAGWEATPQQSYGFFRIEILGALVSIQLIWLLAGILVYEAIMRLINESGEVQGSLMFAVSAFGLFVNIIMAVLLGHDHGHGGHGHSHGHGHGHSHDHDHGNSEDDHSHHGDHEQGHVHHHEHSHGTSITVTTNHHSHSSTGQHQDVEQPLLKHDGDCESAQPGAKPAKKPRRNINVHSAYLHVIGDSIQSIGVMIGGALIWYKPEWKIIDLICTLIFSLIVLFTTIKMIRNILEVLMESTPREIDATRLESGLREMEGVIAVHELHIWAITVGKVLLACHVTITQDADADKMLDKVIGYIKAEYNISHVTIQIERE

SEQ ID NO: 142156 - protein, 243 aa, Triticum aestivum
  unsure (1)..(243): unsure at all Xaa locations
  Clone ID: PAT_TA_36574.pep
SIHSLLQFILHSFHYKLFKMFASLPMYLVTLLAATSTVTNAAAVSPVFTGLGTRYGDGCTEENCWQDGACSFVGYDLPPGIDGSTCVSDEIWNKGANCGGCIQVTYKSKTIKVMVTNRTGGDKNHLDMTPATWNKLTNNMKGGGVDGIKWKWIECPLRSAPLQVHMHGGASKYWFAATIENMTHRVKAVQVSSDSGKTWKSCYLKDPNMWMLDGTLPSDSAXVRVTSVTTSMXLSRTSLSRVV

SEQ ID NO: 142157 - protein, 150 aa, Triticum aestivum
  Clone ID: PAT_TA_36575.pep
MPGSTVVLIGAFVAALLGVSLSTVVLCSNRRQAHHASPSPLPSQRSVVDLEHGLRRPCGIDKAVLSPYPTMVYSSAASRRGQGQSQMAAAAATASVEHGQAQGDTTCAVCLAEYADGDELRWLPGCRHAFHRSCVDEWLRRRPSCPLCRT

SEQ ID NO: 142158 - protein, 121 aa, Triticum aestivum
  Clone ID: PAT_TA_36576.pep
FPWYRIPRILPVYPKMLCPYLRRLKKARMSNVIKNAQREEGVCVCMCVRGRSLEVFLWSMPSLVRWLPVYCRRPRMLKRLVLGFSMAPSNVLARAASLSVVLYFAKERSNLADVVASWELT

SEQ ID NO: 142159 - protein, 190 aa, Triticum aestivum
  unsure (1)..(190): unsure at all Xaa locations
  Clone ID: PAT_TA_36577.pep
PGHRGPGPGSRRRRTAAAGPATSARRRRPTGSSRRGRRRRPRSTRSSSRPPPPRRTSWWPPHRSSRPRPRPRRRSPTRRRRRSSRWRCARRXTSFPRERRRRMSTCSLPSRLXASRAPPAPRPAAPTSPQAAPRGSAPGTAPLRPPASSPRPPPSWLLARLCPETSHVISWCTRTRDRGGKARGEAGASC

SEQ ID NO: 142160 - protein, 166 aa, Triticum aestivum
  unsure (1)..(166): unsure at all Xaa locations
  Clone ID: PAT_TA_36578.pep
TRHEGRTGPRTRSGGLRRAVSWLGSKPSSESTKRDEYHLGNGVLSVDINAPRKLCAYAHFSKRHTGVMLLLFNLSDSTGYNVTLXMTSSPRPGLRKKKRPLEAXGGPRRAVSWLGSKPMEXSTKRNEYHLNTKGGDHQSRTMLLKGVQLELAGDGCIPVMNHVWRR

SEQ ID NO: 142161 - protein, 267 aa, Triticum aestivum
  Clone ID: PAT_TA_36579.pep
MAARSRARRLLPLLTFVALGMVLGSLLQLAFFRRLDDHSHTGHFDNDQEAADLRLGYVKPEVISWKPRIIVFHNFLSSEECDYLREIARPRLEISTVVDVATGKGVKSDVRTSSGMFVNSEERKFPVIKAIEKRISVFSQIPVENGELIQVLRYEPSQYYRPHHDYFSDTFNLKRGGQRVATMLMYLTDGVEGGETHFPQAGDGGECSCGGRMVRGLCVKPNKGDAVLFWSMGFDGNTDSNSLHSGCAVVKGEKWSATKWMRQKMTF

SEQ ID NO: 142162 - protein, 146 aa, Triticum aestivum
  Clone ID: PAT_TA_36580.pep
AGRAGSSQTLPMDAYDGLAHLVVNETEAAILAECNEPELDTPAGLERVGRVFIDRGVHNVIITLGGRGVYFVNKQGQSALLPATKTTVVDTTAAGDTFVGSYSLAAVAARGGQFDIEAAVTAANRAAALTVARKGAQISIPWKDEL

SEQ ID NO: 142163 - protein, 255 aa, Triticum aestivum
  Clone ID: PAT_TA_36581.pep
MGGRQIRPARVFQTVTEELNHNILGKKSVPTPPWYNIMQKVPPAETLVRNVTPLIKPSRESTTKIKNIFRPLPIRYLEDELRGIFYRDHPWELARPRVILELDGKDYQHCDWSKGLKQPNTPLTGESVVQYWMWLLENGKETVGNGRRKRKVKWTRVRAYDHVRHQFYRLRQEEQIEKRVAQEEARYVGAYFGQTRIDVSHGLEDREFENWKLWAGKETERQEQNRNGEIDDFGLEDEAEGVIGDAEATPRVKGE

SEQ ID NO: 142164 - protein, 367 aa, Triticum aestivum
  Clone ID: PAT_TA_36582.pep
MERLISRTAVSPAQPRIHLPGRSPFLPTRRAAPASAGAGSAAPWTRLCAQPPRLGAAVCAAVRHDGASAPAPVEEVAAAAAAAAGPPLKLLGSLLPKASTAALVLLMTLTASALHSSIPHPAYASVQPVIKSGGLLSAELLSSGWAGFFAGCLHTLSGPDHLVALAPLSIGRSRLESGLVGALWGCGHDAGQIIFGLLFLLLKDRLHIEVLRIWGTRVVGLTLLMIGATGIREASEVQESGLILEGVDMSGSEPLQQAPAVAPRKKKVGFTTFATGVVHGLQPDALLMVLPALALPSRFAGAAYLGMFLVGTVFSMGSYTAFVGSCSEALKDRIPKITEKLTWAASLVAVCMGLALLVGQFFGFTLY

SEQ ID NO: 142165 - protein, 54 aa, Triticum aestivum
  Clone ID: PAT_TA_36583.pep
GCCNNQKTNALPSRRLDCNNAMSKCLIQSATMQCLNVLITSQINIEFGKIRTQP

SEQ ID NO: 142166 - protein, 57 aa, Triticum aestivum
  Clone ID: PAT_TA_36584.pep
RNGYMNKGLCSTSFSGQSAWARYTLDLVTQLRKGGILAKKMYMVYEQSPENQNLSCH

SEQ ID NO: 142167 - protein, 119 aa, Triticum aestivum
  Clone ID: PAT_TA_36585.pep
WRPARKAGRVRDSQSRHQRHQSLPYNYSHQLTNSSTHQRNHSIKINHCKTTKMVPAAAYSQVGPKVLPIILTVGGATVASRSVIKTNQYREPVRAKTFQNTSPQPRSQYFEKVLESIFA

SEQ ID NO: 142168 - protein, 174 aa, Triticum aestivum
  Clone ID: PAT_TA_36586.pep
EKSRAVSSRPKHVGSNGTRSWKESEETVQTPDAPILCVNNCGFFGSSMTNNMCSKCYRDFIKATTMAAPVVEKVFSVASSSSVTLEQAEADEVPAAAVADSQAAQEPPKPPSNRCLSCRKKVGLTGFQCRCGGTFCAMHRYADSHECTFDYKKAGREQIAKQNPVVIAEKINKI

SEQ ID NO: 142169 - protein, 144 aa, Triticum aestivum
  Clone ID: PAT_TA_36587.pep
MVVPSVFAAFDEDGDGKVSASELQRCMEATLGDSVSEEEAAAVLAAVDADGDELLDQEKFSRLAAGAHEKDDADVKQRCLREAFGMYASSSAEDTITPASLRRTLSRLGSHELGVEQCTAMICRFDLDGDGKLSFDEFRVMMIA

SEQ ID NO: 142170 - protein, 155 aa, Triticum aestivum
  Clone ID: PAT_TA_36588.pep
MNSHSIMAVPSVFAAFDKDGDGKVSTSELRRCMEATLGEYVSEEEAVAALAVVDADGDGLLNQEEFSRLAAGAHEEDLRDVKRRYLREAFGIYASSSVEDTATTTMITPASLRRTLSRLGSHELGVEECRAMICRFDLDGDGKLSFDEFQVMMMA

SEQ ID NO: 142171 - protein, 287 aa, Triticum aestivum
  Clone ID: PAT_TA_36589.pep
MAEAQLNDFPSLFSLKGKVAVVTGGSRGLGLHAASAFLQAGASKVFISSRKASACEEACKALNALPNLQPGAVAISVPADSAKFEGVESLLAQVKKHTDRVDILFANAGATWGESFDTHPDSAFAKVMDLNVKAVFNTIRLFTPLLEKSATIQDPSRVLITASVAGLAVGTIGKQGTYGYSASKAAVLHLGRNLAMELGPRHITVNSICPGFFPSKMSNGLLEMSGGADQFAAANPMRRLGQPEDIAGVVVYLASRAGAHVNGETVAIDGGALWQRGELMIAEKAKL

SEQ ID NO: 142172 - protein, 406 aa, Triticum aestivum
  Clone ID: PAT_TA_36590.pep
MNWLCNVGGGNTSFGICPLGPHAPCSRLCCSGPGVVCPAGALPLHKGSRAVLALSGEGDACSSPGLLGMEDGLAAFEPPPPVLNEGLGNVTNRVDGQAHTNEVSKGKPLDWVSGQPVTDEHGRLQIIKNDDLEELQELGSGTFGTVYHGKWRGSDVAIKRINDRCFAGKPSEQEKMRNDFWNEASNLADLHHPNVVAFYGVVLDGPGGSIATVTEYMVNGSLRTALLKNSKSLDRRKRLIIAMDTAFGMEYLHNKNIVHFDLKSDNLLVNLRDPQRPICKVGDLGLSKVKCQTLISGGVRGTLPWMAPELLNGSSSLVSEKVDVFSFGIVLWELLTGEEPYADLHYGVIIGGIVSNTLRPQVPDSCHPAWRSLMEQCWATEPSERPSFTQIAVRLRAMAASQKVQS

SEQ ID NO: 142173 - protein, 259 aa, Triticum aestivum
  unsure (1)..(259): unsure at all Xaa locations
  Clone ID: PAT_TA_36591.pep
MSNGTNGTNGAEAQSKFDPNFTDHVIGLMSPETEPRQREILTSLIRHMHDFCREVELKQEEWIIGVNYINSLGQAYKKNRNETWRVCDILGIESLVDEINHKVVTEGGKAPTSSSILGPFWSPETPFRDLGGSVVQDMPKDGQLTFFHGVIRDVDTGKGIPNAVFDMWQASTNGKYDAHDPENQSRHNLRGKFRTDQDGKFWFYCLKPTEYAIDTSGPSAELLRIMGRHPYXPAHIHIMVTHDDYXGVTAQLYPSDDPY

SEQ ID NO: 142174 - protein, 209 aa, Triticum aestivum
  unsure (1)..(209): unsure at all Xaa locations
  Clone ID: PAT_TA_36592.pep
NFRLVLAVLKTREIRAAVRLNALQWLLQASERILAMFXQHLDLTILLVIPASSLIIAAEGIAHVKRHLLENASQNIVTVEQKLSRGWGGENAYHVGGYRYILSDPNRKVSRASPPGKVITLSKDSLLALNRLRGEIDLEKSRAKRSDPTHDKDYEVCIRAKNNAWIIAKISRGKELYMAIEKGGETLLYASTAVEKFSNRYCEGAFSTD

SEQ ID NO: 142175 - protein, 183 aa, Triticum aestivum
  Clone ID: PAT_TA_36593.pep
MGLAFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDAILLVFANKQDLPNAMNAAEITDKLGLHSLRQRAWYIQSTCATSGDGLYEGLEWLANTLRKAGHQ

SEQ ID NO: 142176 - protein, 78 aa, Triticum aestivum
  unsure (1)..(78): unsure at all Xaa locations
  Clone ID: PAT_TA_36594.pep
FFXXLEKDXIFXXGNFPXNREYCCXPGVQSATXHSHNIDWTNCAQSHLCAGYYFIIPSAWMKETVIREKKSVGSPITG

SEQ ID NO: 142177 - protein, 269 aa, Triticum aestivum
  Clone ID: PAT_TA_36595.pep
MKLSAVTLLTLATGIIAAPVADVSKEVRSYASYEPPKDTYEQPKTPKQEKPKKPEYNQPKAPKPHHEKPKAPKPHHDKPKHYAPPHHEKPKAPKPHHEKPKTPSYEKPKAPKPHHEKPKKPETPKKPEYNQPKAPKPHHEKPKKPETPKKPSYEAPKAPKPHHEKPKKPETPKKPAYEQPKAPKPHHEKPKKPETPKGPSYEQPKAPKPHHEKPKKPETPKKPEYNQPKAPKPHHEKPKKPETPKGPSYEQPKTPKPHHEKPKKPETPR

SEQ ID NO: 142178 - protein, 155 aa, Triticum aestivum
  Clone ID: PAT_TA_36596.pep
GPLSASPPPSAACQLAPATSCPRRPSSRRSPAAPPSSHAPSRSLTSPPPSVVSRTKGVKDSSKAPPPVLSKGLSSFIRARSFPHWVPRGAWLTPSVRFVLILLTDRKSLGFGGSYIGYIWLLGMKANATQALSSSPVGSSSILGALTSRAYARLT

SEQ ID NO: 142179 - protein, 261 aa, Triticum aestivum
  Clone ID: PAT_TA_36597.pep
MADAGAPRGGGGFGSRGDRGGDRGRGRGRGRGRRGGKSEEKEWQPVTKLGRLVKAGKIKSMEEIYLHSLPVKEYQIVDFFLPKLKDEVMKIKPVQKQTRAGQRTRFKAIVVIGDSEGHIGLGIKTSKEVATAIRAAIIIAKLSVVPIRRGYWGTNLGEPHSLPTKESGKCGSVTVRLIPAPRGTGLVASPAVKRLLQLVGVQDIYTASAGSPKTLENTLKATLVAVANSYGFLTPNLWAETKLIRSPLEEFSDVLREGKRY

SEQ ID NO: 142180 - protein, 128 aa, Triticum aestivum
  Clone ID: PAT_TA_36598.pep
KNRGSTRRFTQPGNIKRTPPFYQSHCFFSIRCAHSCLAAGSLAGISCTTSIGLMVPSPSSCPADCLTSTVCTVFVTAGSLPAAAAAGALLAGVGASLGELVSVVDMPLISQRKDGWRLESGPRVREEV

SEQ ID NO: 142181 - protein, 94 aa, Triticum aestivum
  unsure (1)..(94): unsure at all Xaa locations
  Clone ID: PAT_TA_36599.pep
MAAERVKDAGVLAMDIYFPPNCVLQEELETHDGVSKGKYTIGLGQDSMAFCTEVEDVISMSLTVVKTLLKNYNIXDPKCIGRLEGGRETVIDKS

SEQ ID NO: 142182 - protein, 226 aa, Triticum aestivum
  Clone ID: PAT_TA_36600.pep
RPRTRGASSSIPPSLPRPGRLRPDLSLLLLGLGLLLLLPPSLVKPDGCGEGQGRRHPRGRHLLGDTIEGWASPLYDTKVQPTTLIPKQLGNMYTASLYAAFASVVHNKHDALVGQRIVMFSYGSGMTSTMFSFKINEGQHPFSLSNIASILDISNKLESRHVVPPKKFVEALKLMEHRYGAKDFVTSQDTRLLVPGTYYLTHVDSMYRRFYAVKGDTAATPVTNGH

SEQ ID NO: 142183 - protein, 297 aa, Triticum aestivum
  Clone ID: PAT_TA_36601.pep
MLSHGTGFLVQDLLQKGRFALAEHPTSSSHPPAQSTQSDTMADRGTSRGGGFASRGGDRGRGRGRGRGRGRGKNEEKEWQPVTKLGRLVKAGKINSMEEIYLHSLPIKEYQIVDNFLPKLKDEVMKIKPVQKQTRAGQRTRFKAIVIIGDSEGHVGLGIKTSKEVATAIRAAIIIAKLSVIPVRRGYWGTNLGAVHSLPTKESGKCGSVTVRLIPAPRGTGLVASPAVKRFLQLAGVEDAYTSSAGSTKTLENTLKATFVAVSNTYGFLTPNLWKETKLIRSPLDEFADTLREGKRY

SEQ ID NO: 142184 - protein, 133 aa, Triticum aestivum
  Clone ID: PAT_TA_36602.pep
AGRAGNCLILCMSISKSDTQFVQNMKGGSVVYMIAFLFIGCLLMVGQCRPEPPSTYGDGHANATMAVSSIDESKVTVKFCVIRNCKTKGEFWGWNGGCYCCLNAPGIPCFEHQYQCNQNCPPIRNKVVQFENI

SEQ ID NO: 142185 - protein, 184 aa, Triticum aestivum
  Clone ID: PAT_TA_36603.pep
AGRSGDDETWVDDGFQYYLALRKWYAGLRPESEFRCFVRGRKLVGVSQRDPSAYYPSLPGWSAGVQPKIEDFFEEFIEPQFASENYTFDVYVRADGRVKLIDFNPWGGYTLPLLFTWEELEEEQRAEDELEFRVVMQQGAVRPGLMTAIPYDMLDWGDGSGWDVFLKKAGNELDRQMASLGVDS

SEQ ID NO: 142186 - protein, 62 aa, Triticum aestivum
  Clone ID: PAT_TA_36604.pep
PPAPKPKPPPAPKPKPPPAPKPKPTPPYPGPAAAPTPPAPPTHPARRLTRMDTSNYGDNYLA

SEQ ID NO: 142187 - protein, 54 aa, Triticum aestivum
  Clone ID: PAT_TA_36605.pep
ETDMRVARASLPRFGALRRDNTLTLTCLSIYLGCTSGSTKCSWSCIGLRVVAMS

SEQ ID NO: 142188 - protein, 106 aa, Triticum aestivum
  Clone ID: PAT_TA_36606.pep
GLSSSSSPAASRSPTQTLEPGELAADDSQDVSRRDAPEAEQGGGVQGAALASQHHGGLHRRHPRRPLHPPLPHPRARHDGAQARALGATGMVKLLSGADFEVPCQT

SEQ ID NO: 142189 - protein, 133 aa, Triticum aestivum
  Clone ID: PAT_TA_36607.pep
AARGASCSGLKKKQRKKKIPNPKKKKPRNRNELGFKQQQQQPRRLQIPNPNPRTLESGEELAADDSQDVSRRDAPEAEQGGGVQGAALAPQHHGGLHRRHPRRPLHPPLPHPRARHDGAQARALGRPRCPPAP

SEQ ID NO: 142190 - protein, 290 aa, Triticum aestivum
  Clone ID: PAT_TA_36608.pep
MNAFRCMRPVAARVPFQRSTLPRVARAYSSKTYEYIQVSQPKPGVGQVTLNRPKALNALCTPLIKELNQALLEFNAADDTSVIVLTGSQKAFAAGADIKEMAPLTFAEAYTNSFIESWSDLTTQIKKPIIAAVSGHALGGGCELAMMCDLIYCTENANFGQPEIKLGTVPGAGGSQRLTRAIGKSKAMELILTGKNFSGVDAEKWGLAARTFPTHEALMEETLKLAETIAGYSKVAVQAANEVVNKSHDLPLRDGVEFERRVFHSLFGTQDQKIVMNAFAQKKKAECSHS

SEQ ID NO: 142191 - protein, 83 aa, Triticum aestivum
  Clone ID: PAT_TA_36609.pep
EPLRAISGQHDNNSDPKLILATFCTQQAPICTQSHQRKQKLITPSHVNAGALNSTELAPPHKRAGRAYTNDWAVRGLGASASP

SEQ ID NO: 142192 - protein, 341 aa, Triticum aestivum
  Clone ID: PAT_TA_36610.pep
MDMIDSIECVSSSDGMEDDDAMSSNLPRPFLKASAAAIAAASIGVVPGGVGGASGAGAAGGIAGPLIPPATSVHELLECPVCTNSMYPPIHQCQNGHTLCSTCKARVHNRCPTCRQELGDIRCLALEKVAESLELPCKYYSLGCPEIFPYYSKLKHESQCNFRPYSCPYAGSECSVVGDIPFLVSHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 142193 - protein, 228 aa, Triticum aestivum
  unsure (1)..(228): unsure at all Xaa locations
  Clone ID: PAT_TA_36611.pep
MRFTATAATLAMATTVSAHAQVYGLWVNGKDLGDGRNTYIRSPENNNPVKDLTSPDIVCNVNGGKAAPKFATAAAGDEVTFEWYHNTRGDDIIDGSHKGPIITYIAPYTETDGTGAIWTKIAEDGLEGGQWAVDKLIKDKGKATFTLPSSLKAGKYIVRQEIIAGHEADVAFKDNSARGAQFYPSCAQVEITGSGTAVPDENFDFQTGYTYTDXGIVFDVYTPNPTLS

SEQ ID NO: 142194 - protein, 283 aa, Triticum aestivum
  unsure (1)..(283): unsure at all Xaa locations
  Clone ID: PAT_TA_36612.pep
MSVPAFSDIAKPANDLLNKDFYHLSATTFEFKDTAPNGVAFKVTGKSSHEKATSAAIEGKYTDKPTGLTLTQTWNTANALDTKIEVADSLAKGLKLEGLFNFLPATAAKGAKFNLHFKQPGFHGRAFFDLLKGPVANVDAVVGHEGFLAGASAGYDANKAALTAYSAAVGYAAPQYSAAITASDNLSVFAASYYHKVNSQVEAGAKATWNSKTGNAVGLEVASKYRIDPVSFTKVKINDRGIAALAYTVLPREGVTLGLGGSFDTQKLDPATXQLGASFTFEG

SEQ ID NO: 142195 - protein, 130 aa, Triticum aestivum
  Clone ID: PAT_TA_36613.pep
IRHQGKRGSKAKGAPAPAAAAAARAAGGEFPGCLRLMPPSTVAISVHAKPGSKMATITEIGEEAVGVQIDAPARDGEANAALVDFISSVLGVKKREVSIGSGSKSREKVVLVQDATLKGVFEALKKACGP

SEQ ID NO: 142196 - protein, 271 aa, Triticum aestivum
  Clone ID: PAT_TA_36614.pep
STWANNLEAEFAVRGIVCDDYPYIAMDTEFPGIVCRPLGSFRSNDEYNYATLKGPTSTCPSLIQLGLTLSDENGALPARGNGGRPLRAWQFNFRGFDPRSDPANADSIDLLRNSGIDFDRFTTEGADTGHFAELLMSSGVLLNAELQWVTFHSGYDFGYLLKLLTGRNLPDTMPGFFDLIRIYFPVLYDIKHLMKYCGSLHGGLSKLGELLGVQRVGICHQAGSDSLLTLRCFQKLKEAYFRGSTENYAGVLYGLISDGGENRPPAALLIE

SEQ ID NO: 142197 - protein, 555 aa, Triticum aestivum
  unsure (1)..(555): unsure at all Xaa locations
  Clone ID: PAT_TA_36615.pep
MERLHLAVSHRPALPLPTPHNHLRRRHLQLQPSTSSLSLCRPISPHISLAPRRHLHPLLASASATQASSPNTEPAPAPAPAAASSGAKLLPLIASIAVGLAVRFLAPRPPEVTPQAWQPVXVFLNCSLLHQKPMCLTIWSELIFLRRCLVKCIIREGCSPLRTLNMLHLXERSTQKGSHSFPSTALYLYIAEXMQCRDEFRLGLSYGLTISEACIAPAMPSTTARAGGVFLPIVKSLSLSAGSKPNDPSAKKLGAYLVQSQLQASGNSSALFLTAAAQNLLCLKLAEEAGVKIASPWISWFKVASLPAIISLLATPYLLYKIFPPEIKDTPEAPALAAQKLKKMGPVTKNEWVMVATMILAVSLWIFGDAIGVSSVVAAMIGLSILLLLGVMNWDDCLNEKSAWDTLAWFAILVGMAGQLTDLGIVSWMSNCVAKVLQSFSLSWPAAFGVLQASYFFIHYLFASQTAHVGALYSAFLAMHLAAGVPAILSALALTYNSNLFGALTHYSSGQSAVYYGAGYVDLPDVFKLGFTAAAINALIWGVVGTFWWKFLGLY

SEQ ID NO: 142198 - protein, 187 aa, Triticum aestivum
  Clone ID: PAT_TA_36616.pep
VRRSRRPGGQPQGDHPVVQPPHPGNGTYNPPKPQPPKETYPVPVPVPSKPVEPEHPEQPQQPEKPQHPQEPEKPQQPTPPKETKPVVQPPVESHPTYPVPPQPEHPQEPEKPEQPQPPKETKPVVQPPTPSKPVESAPPAVTKPVETYPAPPVSTPTEPAQVVNAGGRVAGSIQATLFAAGIVAFFL

SEQ ID NO: 142199 - protein, 267 aa, Triticum aestivum
  Clone ID: PAT_TA_36617.pep
MAAAAGRGGGPRRTTRVGPYELGKTVGEGSFAKVKIAKDTRNAATCAIKVLDRNHVLRHKMVEQIKREIATMKLIRHPNVVQLHEVMASKSKIYMVLEFVEGGELFDKIVNSGKLGEDEARRYFHQLINAVDYCHSRGVYHRDLKPENLLLDSYGALKVSDFGLSAFSPQTKEDGLLHTACGTPNYVAPEVLADKGYDGMAADVWSCGIILFVLMAGYLPFDDPNLMTLYKLITRANVSCPPWFSTGARNLIKRILDPNPHTRITIS

SEQ ID NO: 142200 - protein, 74 aa, Triticum aestivum
  Clone ID: PAT_TA_36618.pep
RDLELGEYKKAIADCSKVLEQDKDNVSVLVQRALLYESSEKYRLGAEDLRLVLKIDPGNRLARSMIHRLNKMAD

SEQ ID NO: 142201 - protein, 452 aa, Triticum aestivum
  unsure (1)..(452): unsure at all Xaa locations
  Clone ID: PAT_TA_36619.pep
RNIQPTAGRLHEVMASKSKIYFLSLLMEASNVFDKIVNSGKRRIDEAGRYFHQLINAVDYCHSRGMNHRHLKQXLFPDSYIAHKNSGLLFDSITPQPNEGGLPHTSCXSSRCLQPEGLADKGYDGLAADAWFCRIIIFVLMASTQPSISPNMSPPPLLAAEAVGADAHXMNHRVKMILDRVHGRSHNTRXTTAQILADEWFIKEYKPPHSEHNEDVSLXDVETALASSQEHTVAVRGEKPESMNVFALISRSQGCNLGNLFEKEMMGMVKRETSFASQRTPQEIMSKIEEACGPLGFNVRKQNYKMKVKGDKTGRKGHLSVATEVFEVAPTLHMVELRKTGGDTLEFHSCYKIFSSELKDIVWETESNTIANTAMIETFRNGTIRRGCMDGPPLQVMPLGAGYCIFLRHRIDGPVRRLLLKTAPSFYRARLYTYMYNEALPDKLLVILQRGA

SEQ ID NO: 142202 - protein, 304 aa, Triticum aestivum
  Clone ID: PAT_TA_36620.pep
RLRGGTLVGRLVSRNIPAQVAHSPGCAQSAGVGHVAIWGAPADRSPRLPPPRVFYSPPFCSDQLPDAAWYEKMEACITPLPEVSDIKEVAGGELKKWPQRLTAVPPRIASGSIEGVTAEMFNEDTKLWKKRVGHYKSVISQFGQKDRYRNLLDMNARFGGFAAALAGDPMWVMNMVPTVGNSTTLGVIYERGLIGNYQDWCEGMSTYPRTYDLIHADSVFSLYKDRCEMDAILLEMDRILRPEGTVIIRDDVDLLVKIKSVADGMRWNSQIVDHEDGPLVREKLLLVVTSGWSLGVASLEQHPK

SEQ ID NO: 142203 - protein, 473 aa, Triticum aestivum
  Clone ID: PAT_TA_36621.pep
TPPQTTMATTVTLKSFTGLRQSSTEQTNFVSHVPSSLSLPQRRTSLRVTAARATPKLSNRKLRVAVIGGGPAGGAAAETLAQGGIETILIERKMDNCKPCGGAIPLCMVGEFNLPLDIIDRRVTKMKMISPSNIAVDIGRTLKEHEYIGMVRREVLDAYLRERAEKSGATVINGLFLKMDHPENWDSPYTLHYTEYDGKTGATGTKKTMEVDAVIGADGANSRVAKSIDAGDYDYAIAFQERIRIPDEKMTYYEDLAEMYVGDDVSPDFYGWVFPKCDHVAVGTGTVTHKGDIKKFQLATRNRAKDKILGGKIIRVEAHSIPEHPRPRRLSKRVALVGDAAGYVTKCSGEGIYFAAKSGRMCAEAIVEGSQNGKKMIDEGDLRKYLEKWDKTYLPTYRVLDVLQKVFYRSNPAREAFVEMCNDEYVQKMTFDSYLYKRVAPGSPLEDIKLAVNTIGSLVRANALRREIEKLSV

SEQ ID NO: 142204 - protein, 90 aa, Triticum aestivum
  Clone ID: PAT_TA_36622.pep
MARATTLVLVAALAVLLLLASGPAGATAAWTSPKDVATASPNEKVAAAAAEDHECEMRAGEKQRDECMARRTLAAHTDYIYTQDIKWFVG

SEQ ID NO: 142205 - protein, 140 aa, Triticum aestivum
  Clone ID: PAT_TA_36623.pep
MSWKAYVDDHLCCEIDGQNLTSAAILGHDGSVWAQSPNFPQFKPEENAGIVKDFEEPGHLAPTGLFLGGTKYMVIQGEPGVVIRGKKGTGGITIKKTGMALILGIYDEPMTPGQCNLVVERLGDYLIDQGYCGSHHHHHH

SEQ ID NO: 142206 - protein, 244 aa, Triticum aestivum
  Clone ID: PAT_TA_36624.pep
FYQWNPDGVTWGNGNLSWGHSVSVDLVNWFALDAALQPSRPFDANGCWSASATILPDGGSPVMLYTGIDHPDINYQVQNVAFPKNASDPLLVEWVKPSVNPVIPVPADIKRDDFRDPSTACSARRPVAHRRRGPRPHCWGRTLIYRSKDFLRWERNADPLYLAHAAGMWECPDFEPEWRFGSGERRRGEARAQDERHGHGPGLLRGRELRRHGGHLRAGGRRRLPELRLDYGHVYASKTFFDSR

SEQ ID NO: 142207 - protein, 833 aa, Triticum aestivum
  Clone ID: PAT_TA_36625.pep
MLCLTASSSPSPSPSLPPRPSRPAADRPGPGISGGGNVRLSAVPAPSSLRWSWPRKAKSKFSVPVSAPREYTMATAEDGFGDLPIYDLDPKFAGFKDHFSYRMKKYLEQKHSIEKYEGGLEEFSKGYLKFGINTENDATVYREWAPAAKDAQLIGDFNNWNGSGHRMTKDNFGVWSIRISHVNGKPAIPHNSKVKFRFHRGDGLWVDRVPAWIRYATFDASKFGAPYDGVHWDPPTGERYVFKHPRPRKPDAPRIYEAHVGMSGEKPEVSTYREFADNVLPRIKANNYNTVQLMAIMEHSYYASFGYHVTNFFAVSSRSGTPEDLKYLVDKAHSLGLRVLMDVVHSHASSNMTDGLNGYDVGQNTQESYFHTGERGYHKLWDSRLFNYANWEVLRYLLSNLRYWMDEFMFDGFRFDGVTSMLYNHHGINMSFAGNYKEYFGLDTDVDAVVYIMLANHLMHKILPEATVVAEDVSGMPVLCRSVDEGGVGFDYRLAMAIPDRWIDYLKNKDDLEWSMSAIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLSDIDHLRYKYMNAFDQAMNALDDKFSFLSSSKQIVSDMNEEKKIIVFERGDLVFVFNFHPSKTYDGYKVGCDLPGKYKVALDSDALMFGGHGRVAHDNDHFTSPEGVPGVPETNFNNRPNSFKVLSPPRTCVAYYRVEEKAEKPKDEGAASWGKAAPGYIDVEATRVKDAADGEATSGSKKASTGGDSSKKGINFVFGSPDKDNK

SEQ ID NO: 142208 - protein, 492 aa, Triticum aestivum
  Clone ID: PAT_TA_36626.pep
MDPYKHRPTSGANSAYWTTNSGAPVWNNNNALTVGHRGPILLEDYHLIEKLAQFDRERIPERVVHARGASAKGFFEVTHDVSQLTCADFLRAPGVQTPVIVRFSTVVHERGSPETLRDPRGFAVKFYTREGNFDLVGNNMPVFFIRDGMKFPDMVHAFKPSSKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRVDPTRHAEKDPMPPRVLSGCREKCIIDKENNFKQAGERYRSFDPARQDRFLQRWVDALTDARVTHEIQSIWVSYWSQCDASLGQKLASRLKIKPNM

SEQ ID NO: 142209 - protein, 125 aa, Triticum aestivum
  Clone ID: PAT_TA_36627.pep
LLAIVVPFTQTRTQSARDKAAMAEDAGPLVGGIKDSPMGQENDLDVIALARFAVSEHNNKANALLEFENVVKLKKQTVAGTMHYITIRVTEGGAKKLYEAKVWEKPWENFKQLQEFKPVEDAAIA

SEQ ID NO: 142210 - protein, 78 aa, Triticum aestivum
  Clone ID: PAT_TA_36628.pep
LARFAVSEHKNKTNALLEFEKVVRLKQQVVAGMTYYITIQVNEGGAKKMYEAKVWERPWMDFKKLMEFRPAERASASA

SEQ ID NO: 142211 - protein, 824 aa, Triticum aestivum
  Clone ID: PAT_TA_36629.pep
MEVVTGAMSTLLPLLGDLLKEEYNLQKSTKGEIKFLKAELESMEAALIKISEAPLDQPPNIQVKLWARDVKDLSYEIEDGIDKFRVHLECRQQKKPHSFMGFIHKSMDMLTKGKIRHKIGIDIKDIKSRIKEVSDRRERYKVDSVAPKPTGTSTDTLRQLALFKKAEELIGTKEKSLDIVKMLTEGDEVFKKHLKMVSIVGFGGLGKTTLANVVYEKLRGDFDCAAFVSVSLNPDMKKLFKCLLHQLDKGEYKNIMDESAWSETQLISEIRDFLRDKRYFILIDDIWDKSVWNNIRCALIENECGSRVIATTRILDVAKEVGGVYQLKPLSTSDSGQLFYQRIFGIGDKRPPIQLAEVSEKILGKCGGVPLAIITLASMLAGKKEHENTYTYWYKVYQSMGSGLENNPGLMDMRRILHVSYYDLPPNLKTCLLYLSLYPEDYNIETKELIWKWIGEGFIHEEQGKSLYEVGEDYIAELINKSLVQPMYINIANKASSVRVHDMVLDLITSLSNEENFLATLGGQQTRSLPRKIRRLSLQSSNEEDVQPMPTMSSLSHVRSLTVFSKDLSLLSALSGFLVLRALDLSGCEEVGNHHMKDICNLFHLRYLSLEGTSITEIPKEISNLRLLQLLVIRSTKMKKFPSTFVQLGQLVFIDMGNREVSRLLLKSMSTLPSLSSLAIGIGELREEDLQILGSMPSLHDLSIDVGYWERGRDKRLVIDSGSPFRSLTRFSIKGCGFIDFMFAQGTLQKLQILELSIFGKAIKDRFGDFQFGLENLSSLEHVYVDARGRGIIPSQEAELSGALEKELDINPNKPTLTVKVTPR

SEQ ID NO: 142212 - protein, 88 aa, Triticum aestivum [sequence omitted]

SEQ ID NO: 142213 - protein, 183 aa, Triticum aestivum
  Clone ID: PAT_TA_36631.pep
MSDADDYRCFVGSLSWNTTDVDLKDAFGKFGRVTETKVVLDKFSGRSRGFGFVTFDDKKAMEEAVEAMNGIDLDGRNITVERAQPQGSGRNRDGDRDYRGGGDRYGGGRDFGGGRGGGRGGGGDCYKCGKPGHFARECPSGDGGDRYGSRDDRYSSRDDRYSSRDDRYSSRDDRYWWQGWCKG

SEQ ID NO: 142214 - protein, 507 aa, Triticum aestivum
  unsure (1)..(507): unsure at all Xaa locations
  Clone ID: PAT_TA_36632.pep
MEVQAGSHADAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLXKKGDMAKDKFSKVLWGXVTNYRTWIFVLLYGYCMXVELTXDNVIAEYYYDHFHLDLRXXGTIXAXXGMANXVARPMXGYLXDLGARYFGMRARLWNIWIXQXAGGAFCIWLGRASALPASVTAMVLFSICAQAACGAVFGVAPFVSRRSLGIIXGLTGAGGNVGXGLTQLLFFTSSQYSXGRGLEYMGIMIMACTLPVALVHFPQWGSMFFPASADATEEEYYASEWSEEEKNKGLHIAGQKFAENSRSERGRRNVILATSATPPNNTPQHV

SEQ ID NO: 142215 - protein, 768 aa, Triticum aestivum
  Clone ID: PAT_TA_36633.pep
MATFAVSGATLGVARPPAAAQPEELQIPEDIEEQTAEVNMTGGTAEKLESSEPTQGIVETITDGVTKGVKELVVGEKPRVVPKPGDGQKIYEIDPTLKDFRSHLDYRYSEYRRIRAAIDQHEGGLEAFSRGYEKLGFTRSAEGITYREWAPGAHSAALVGDFNNWNPNADTMTRDDYGVWEIFLPNNADGSPAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQMTFTGNYGEYFGFATDVDAVVYLMLVNDLIHGLHPDAVSIGEDVSGMPTFCIPVPDGGVGFDYRLHMAVADKWIELLKQSDESWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYHGMQEFDQAMQHLEEKYGFMTSEHQYVSRKHEEDKVIIFERGDLVFVFNFHWSNSFFDYRVGCSRPGKYKVALDSDDALFGGFSRLDHDVDYFTTEHPHDNRPRSFSVYTPSRTAVVYALTE

SEQ ID NO: 142216 - protein, 514 aa, Triticum aestivum
  Clone ID: PAT_TA_36634.pep
MEEWLLSLCFIALSTATVLAFWFLKLSGGKADPHKKQLPPGPWTLPVIGSLHHVISALPHRTMMQLSCRHGPLMLLRLGEVPAVVVSTADAAALVMKTHDLVFVDRPRSPTMDIASSGGKDIVFAPYGGHWRQMRKICVVQLLSSTQVSRMEGVRAEEVGSLLRDITAAASTGATINVSEKVMALTNDIVTRAVFGGKFARQCEFLREMDKAFKLVGGFCLADLFPSSRLVRWLSNGERDMKRCHGLIHHIIAEVVENRKAARASGVGRSIPGDEDMLDVLLTLQEDDSLEFPLTTETMGAVLHDVFAGATETTGNTLAWVISELMHNPHTMAKAQHEVRDVLGEGRSVITNSDLGELHYMPMILKEALRLHPPGPLIPRMAREDCTVMGYDIPKGTNVYINIFAISRDPRYWINPEEFMPERFENNNVNYKGTYFEFIPFGAGRRQCPGIQFSSSITEMALANLLYHFDWMLPDGANLASFDMSEKFGFAVSKKYDLKLRAIPHVWSNAMTLK

SEQ ID NO: 142217 - protein, 184 aa, Triticum aestivum
  Clone ID: PAT_TA_36635.pep
KYPYIAGMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDKNRSI

SEQ ID NO: 142218 - protein, 764 aa, Triticum aestivum
  Clone ID: PAT_TA_36636.pep
SGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFKGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNKKYNLPNGENNRDGENHNLSWNCGEEGEFARLSVKRLRKRQMRNFFVCLMVSQGVPMFYMGDEYGHTKGGNNNTYCHDSYVNYFRWDKKEQYSELHRFCCLMTKFRKECEGLGLEDFPTAKRLQWHGHQPGKPDWSENSRFVAFSMKDERQGEIYVAFNTSHLPAVVELPERAGRRWEPVVDTGKPAPYDFLTDDLPDRALTIHQFSHFLYSNLYPMLSYSSVILVLRPDV

SEQ ID NO: 142219 - protein, 534 aa, Triticum aestivum
  Clone ID: PAT_TA_36637.pep
MAKDDGYPPARTLPETPSWAVALVFAVMIIVSVLLEHALHKLGHWFHKRHKNALAEALEKMKAELMLVGFISLLLAVTQDPISGICISQKAASIMRPCKVEPGSVKSKYKDYYCAKEGKVALMSTGSLHQLHIFIFVLAVFHVTYSVIIMALSRLKMRTWKKWETETASLEYQFANDPARFRFTHQTSFVKRHLGLSSTPGVRWVVAFFRQFFRSVTKVDYLILRAGFINAHLSQNSKFDFHKYIKRSMEDDFKVVVGISLPLWAVAILTLFLDIDGIGTLTWVSFIPLIILLCVGTKLEMIIMEMALEIQDRSSVIKGAPVVEPSNKFFWFHRPDWVLFFIHLTLFQNAFQMAHFVWTVATPGLKDCFHMNIGLSIMKVVLGLALQFLCSYITFPLYALVTQMGSNMKRSIFDEQTAKALTNWRNTAKEKKKVRDTDMLMAQMIGDATPSRGTSPMPSRGSSPVHLLQKGMGRSDDPQSAPTSPRTMEEARDMYPVVVAHPVHRLNPADRRRSVSSSALDADIPSADFSFSQG

SEQ ID NO: 142220 - protein, 131 aa, Triticum aestivum
  Clone ID: PAT_TA_36638.pep
MERMGVGKSGKPLHYKGSAFHRVIPDFMCQGGDFTRGNGTGGESIYGEKFADEKFVHKHTKPGILSMANAGPNTNGSQFFICTVPCNWLDGKHVVFGEVVEGMDVVKNIEKVGSRSGTTAKQVVIADCGQL

SEQ ID NO: 142221 - protein, 71 aa, Triticum aestivum
  Clone ID: PAT_TA_36639.pep
AQKFYQLLVRCVIARINVASHWIDIVSHSMHLCCLKIQLHEKKQNINVILKDDLSTFLIHASYLPLHNHFF

SEQ ID NO: 142222 - protein, 507 aa, Triticum aestivum
  Clone ID: PAT_TA_36640.pep
MEVESSAHGDAAASKFTLPVDSEHKAKSFRLFSFANPHMRTFHLSWISFFTCFVSTFAAAPLVPIIRDNLNLAKADIGNAGVASVSGSIFSRLAMGAVCDLLGPRYGCAFLVMLSAPTVFCMAVIDDASGYIAVRFLIGFSLAAFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLHLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPITLVHFPQWGSMFFPASADATEEEYYASEWSEEEKGKGLHIAGQKFAENSRSERGRRNVILATSATPPNNTPQHV

SEQ ID NO: 142223 - protein, 93 aa, Triticum aestivum
  Clone ID: PAT_TA_36641.pep
MEHQGHGTGEKKGIMENIKEKLPGGHQQTAGTHGQQGHTGMTGTEMHDTTATGGTFGQQGHTGTTGTGTHGTAGTGEKKSLMDKVKEKLPGQH

SEQ ID NO: 142224 - protein, 94 aa, Triticum aestivum
  unsure (1)..(94): unsure at all Xaa locations
  Clone ID: PAT_TA_36642.pep
SAACILPVCNRRFLGFPTGGLAALSPKLTIVRKHPSSGVSSLNTSGVTDAADDDLPSVMTCANYLKLPPYSTKEVMRKKLXYAILEGRGSFDLS

SEQ ID NO: 142225 - protein, 440 aa, Triticum aestivum
  Clone ID: PAT_TA_36643.pep
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAP

SEQ ID NO: 142226 - protein, 377 aa, Triticum aestivum
  Clone ID: PAT_TA_36644.pep
MMAAQPTANPGVRLGWKAPGALASPPRLALSRSAAAPLASHRVGRGKFSAAAITTDDYLPMRSTEVKNRTSVDGIKSLRLITAVKTPYLPDGRFDLEAYDSLINTQINGGAEGVIVGGTTGEGHLMSWDEHIMLIGHTVNCFGTNIKVIGNTGSNSTREAIHASEQGFAVGMHAALHVNPYYGKTSTAGLISHFDEVLPMGPTIIYNVPSRTGQDIPPAVIEALSTYPNMAGVKECVGHERVKCYTDKGITIWSGNDDECHDSRWKYGATGVISVTSNLVPGLMRSLMFEGENAALNEKLLPLMKWLFSEPNPIGLNTALAQLGVVRPVFRRPYAPLSLEKRTEFVRIVEAIGRENFVGQKEVRVLDDDDFVLISRY

SEQ ID NO: 142227 - protein, 219 aa, Triticum aestivum
  Clone ID: PAT_TA_36645.pep
QQPPFSQQQQPVLPQQPPFSQQQQPILPQQPPFSQQQQQPVLPQQQILFVHPSILQQLNPCKVFLQQQCSPVAMPQSLARSQMLQQSSCHVMQQQCCQQLLQIPQQSRYEAIRAIIYSIILQEQQQVQGSIQTQQQQPQELGQCVSQPQQQQSQQQLGQQPQQQQLAQGTFLQPQQVAQLEVMTSIALRTLPTMCRVNVPLSRTTTSVPFGVGAGVGAY

SEQ ID NO: 142228 - protein, 262 aa, Triticum aestivum
  Clone ID: PAT_TA_36646.pep
MKTFLILALLAIVATTATTAVRVPVPQLQPQNPSQQQPQEQVPLVQQQQFLGQQQPFPPQQPYPQPQPFPSQQPYLQLQPFLQPQLPYSQPQPFRPQQPYPQPQPQYSQPQQPISQQQQQQQQQQQQQQQQQQQIIQQILQQQLIPCMDVVLQQHNIVHGKSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLARK

SEQ ID NO: 142229 - protein, 168 aa, Triticum aestivum
  Clone ID: PAT_TA_36647.pep
MATAPARRASSSRSSSEISRTTPSMGFQLGFVDDSNVFEWQVTIIGPPETLYDGGYFNAIMSFPQNYPNSPPTVRFTSEMWHPNVYPDGRVCISIHPPGDDPNGYELASERWTPVHTVESIVLSIISMLSSPNDESPANIEAAKDWREKQDEFKKKVRRAVRKSQEML

SEQ ID NO: 142230 - protein, 167 aa, Triticum aestivum
  Clone ID: PAT_TA_36648.pep
MRRRCNLSTTNKLSMASNHRRFLLSGAVLLSVLAAVAALESVEDECQPGVAFPHNALATCHTYVIKRVCGRGPSRPMLVKERCCRELAVVPDYCRCEALRVLMDGVRAEEGHVVEGRLGDRRDCPREAQREFAATLVTAAECNLPTVSGVGSTLGATGRWMTIELPK

SEQ ID NO: 142231 - protein, 175 aa, Triticum aestivum
  Clone ID: PAT_TA_36649.pep
IKILNRRKIKNMEMEEKVRREIKILRLFMHPHIIRLYEVIETPSDIYVVMEYVKSGELFDYIVEKGRLQEDEARNFFQQIISGVEYCHRNMVVHRDLKPENLLLDSHHNVKIADFGLSNIMRDGHFLKTSCGSPNYAAPEVISGKLYAGPEVDVWSCGVILYALLCGTLPFDDEN

SEQ ID NO: 142232 - protein, 35 aa, Triticum aestivum
  Clone ID: PAT_TA_36650.pep
DCVPIRGSICSVLSWSLLPWCLLQIDCKHCYSGLI

SEQ ID NO: 142233 - protein, 151 aa, Triticum aestivum
  Clone ID: PAT_TA_36651.pep
MSTATAPGVSFAKSGAGSRAVAPAIRSASFIGYAKQPPNLSCLRMSNKFRVSAAAVHKVKLISPDGEEHEFEAPEDTYILEAAENAGVELPFSCRAGSCSTCAGKMTTGEVDQSEGSFLDENQMGEGYLLTCISYPKADCVIQTHQEEELY

SEQ ID NO: 142234 - protein, 347 aa, Triticum aestivum
  Clone ID: PAT_TA_36652.pep
MSSRVAGSVLLRHLGPRVFGPTTPAAQRPLLAGGEGGAVAVAMWARPLSTSAAEAAREEATASKDNVASTAAATAEAMQAAKAGAVQAAKEGKSPAASSYWGIVPAKLVNKDGAEWKWSCFRPWEAYTSDTTIDLSKHHKPKVLLDKIAYWTVKSLRVPTDIFFQRRYGCRAMMLETVAAVPGMVDGMLLHLRSLRRFEQSGGWIRALLEEAENERMHLMTFMEVANPKWYERALVLAVQGVFFNAYFLGYIVSPKFAHRVVGYLEEEAIHSYTEFLRDLEAGRIENVPAPRIAIDYWRLPADARLKDVVTVVRADEAHHRDVNHFAADIHFQGLELNKTPAPLGYH

SEQ ID NO: 142235 - protein, 522 aa, Triticum aestivum
  Clone ID: PAT_TA_36653.pep
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGYILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDMHGYIQHAITASKEIKIVSLALFAFLGVPLAILYSVPFAVTAQLAANRGGGQGLCTGVLNIAIVIPQVIIAVGAGPWDELFGKGNIPAFGMASAFALIGGIVGIFLLPKISRRQFRAVSGGGH

SEQ ID NO: 142236 - protein, 523 aa, Triticum aestivum
  Clone ID: PAT_TA_36654.pep
MARGGGNGEVELSVGVGGGGGGAAGGGEQPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAAKRGGGQGLCTGVLNIAIVIPQVIIAVGAGPWDELFGKGNIPAFGMASAFALIGGIVGIFLLPKISRRQFRAVSGGGH

SEQ ID NO: 142237 - protein, 148 aa, Triticum aestivum
  Clone ID: PAT_TA_36655.pep
MSMRTRGTFTRAPPPPPPASPLSFSSRLAACTARRDSRPPRPHLLSPVWVFGEARTPTFCFDLQAKLWAHEVRELSYNMEDVVDKFLIRVDSDGIQQPHDNSSRFKELKNKIIGLFKKGKNHHRIADAIKEIKEQVQEVADRRDRNKV

SEQ ID NO: 142238 - protein, 124 aa, Triticum aestivum
  Clone ID: PAT_TA_36656.pep
MEHQGHGAGEKKGVMESITEKLPRGHGDHQQATGGTYGQQGHTGVTGTGTGTGEKKGVVENIKEKLPGGHGDHQHTTGMSGSKTHATTATTDGNYGKSGHTGTDSTGENKSMMDKIKDKLPGQH

SEQ ID NO: 142239 - protein, 332 aa, Triticum aestivum
  Clone ID: PAT_TA_36657.pep
MAEASPRTETSTDDTDENLMLEPGNAALAVVSDSSDRSRDKNGDQKTMRRLAQNREAARKSRLRKKAYVQQLENSRLKLTQLEQELQRARQQGIFISSSADQSHSMSGNGALAFDTEYARWLEEHNRQVNELRAAVNAHAGDTELRSVVEKIMSHYDEIFKQKGNAAKADVFHVLSGMWKTPAERCFLWLGGFRPSELLKLLSTQLEPLTEQQLSGICNLQQSSQQAEDALSQGMEALQQSLAETLAGSIGSSGSGSTGNVANYMGQMAMAMGKLGTLENFLSQADNLRQQTLQQMQRILTTRQSARALLVISDYSSRLRALSSLWLARPKE

SEQ ID NO: 142240 - protein, 101 aa, Triticum aestivum
  Clone ID: PAT_TA_36658.pep
EKLGQGQQPRQWLQPRQGQQGYYPTSPQQSGQGQQLGQGQQGYYPTSPQQSGQGQQGYDSPYHVSAEHQAASLKVAKAQQLAAQLPAMCRLEGGDALLASQ

SEQ ID NO: 142241 - protein, 237 aa, Triticum aestivum
  Clone ID: PAT_TA_36659.pep
MAAANAPFALSRLSPAARLPFRAWRAARPAPVWTGRTRPLSVASAAQENRDNSVDVQVSQAQNAGNQQGNAVQRRPRRAGFDISPFGLVDPMSPMRTMRQMLDTMDRLFDDAVGFPTARSPARRAKTPRMPWDIMEDEKEVKMRFDMPGLSREEVRVMVEDDALVIRGEHKKEAGEGQGEGGDGWWKERSLSSYDMRLALPDECDKSQVRAELKNGVLLVSVPKRETERKVIDVQVQ

SEQ ID NO: 142242 - protein, 143 aa, Triticum aestivum
  unsure (1)..(143): unsure at all Xaa locations
  Clone ID: PAT_TA_36660.pep
MARAQVLLMAAALVLMLTAAPRAAVALNCGQVDSKMKPCLTYVQGGPGPSGECCNGVRDLHNQAQSSGDRQTVCNCLKGIARGIHNLNLNNAASIPSKCNVNVPYTISPDIDCSRXFTERRSVKLVLSSSIHVELKRAASVPM

SEQ ID NO: 142243 - protein, 61 aa, Triticum aestivum
  Clone ID: PAT_TA_36661.pep
RGACHLRPEKAKLSPQPPSPLPTWNGQASKVTSQAQANKPHQASTPPQCPHMGDKLPQLAR

SEQ ID NO: 142244 - protein, 507 aa, Triticum aestivum
  Clone ID: PAT_TA_36662.pep
MVDTLSEENIIGYFKNKSILITGSTGFLGKILVEKILRVQPDVKKIYLPVRAVDAAAAKHRVETEVVGKELFGLLREKHGGRFQSFIWEKIVPLAGDVMREDFGVDSETLRELRVTQELDVIVNGAATTNFYERYDVALDVNVMGVKHMCNFAKKCPNLKVLLHVSTAYVAGEKQGLVQERPFKNGETLLEGTRLDIDTELKLAKDLKKQLEADVDSSPKAERKAMKDLGLTRARHFRWPNTYVFTKSMGEMVLSQLQCDVPVVIVRPSIITSVQNDPLPGWIEGTRTIDTIVIGYAKQNLTYFLADLNLTMDVMPGDMVVNAMMAAIVAHSSSSLEKTKSHPKQHAPAVYHVSSSLRNPAPYNVLHEAGFRYFTEHPRVGPDGRTVRTHKMTFLSSMASFHLFMMLRYRLLLELLHLLSILCCGLFGLDTLYHDQARKYRFVMHLVDLYGPFALFKGCFDDVNLNKLRLAMTSNHGSLFNFDPKTIDWDEYFYRVHIPGVIKYMLK

SEQ ID NO: 142245 - protein, 522 aa, Triticum aestivum
  Clone ID: PAT_TA_36663.pep
MVGTLDEGKIVDYFRNKSVLITGATGFLGKIMVEKILRVQPDVKRIYLPVRAADAAAARRRVETEVVGKELFCVLRERHGAGFDAFVADKVVGLAGDVMREGFGVDPATLRDLRLADELNVIVNGAATTNFYERYDVALDVNVVGVKHMCDFARRCPNLEVLMHVSTAYVAGEKQGLVPERPFRDGETLRDDGTQLDIDAEMRLAKDLRKQMEADDDVDPKAQRKAMKDLGLTRARHFGWPNTYVFTKSMGEMMLAQMMRGGDVPVVIVRPSIITSVQNDPLPGWIEGTRTIDAILIGYAKQSLSCFLADLDLTMDVMPGDMVVNAMMAATVAHASSTQTSEPEKKPPPQQQHPHSVPAAPTVYHVSSSLRHPAPYAVLYRTGIRYFEEHPRVGPDGRPVRTRKVRFLGSIAAFHLFMVLKYRVPLELLRLLSILCCGLFGLAALYHDLARKYRFVMQLVDLYGPFSLFKGCFDDVNLNKLRLAMADGDHADSAFNFDPKTIDWDDYFFKVHIPGVMKYVHK

SEQ ID NO: 142246 - protein, 201 aa, Triticum aestivum
  Clone ID: PAT_TA_36664.pep
MALRLWASSAANALKISSSGARAAAPAYSISRYFSTVIDGLKYTSSHEWVKNDGSVATIGISDHAQGHLGEVVFVELPEAGTKVSQGGAFGNVESVKATSDVNSPISGEVVEVNSKLSETPGLVRTANTSPPSISNPFSLSRPCSDPNELCCCDCAVAWQINSSPYEEGWMIKVKPSSPAELEGLLDSAKYTKHCEEEDAH

SEQ ID NO: 142247 - protein, 365 aa, Triticum aestivum
  Clone ID: PAT_TA_36665.pep
MVQPVFDAAVLSGRADIPSQFIWPEGESPTPDAAEELHVPLIDIGGMLSGDPRATAEVTRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPMETLGTGPHCDPTSLTILHQDNVGGLQVHTEGRWRSIRPRADAFVVNIGDTFMALSNGRYKSCLHRAVVNSKVPRKSLAFFLCPEMDKVVAPPGTLVDAANPRAYPDFTWRSLLDFTQKHYRADMKTLEVFSSWIVQQQQGQLLPPLASH

SEQ ID NO: 142248 - protein, 365 aa, Triticum aestivum
  Clone ID: PAT_TA_36666.pep
MVRPVFDAAVLSGRSDIPSQFIWPEGESPTPDAAEELHVPLINIGGMLSGDAAAAAEVTRLVGEACERHGFFQVVNHGIDAELLADAHRCVDNFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPLETLGTGPHCDPTSLTILHQDNVGGLQVHTEGRWRSIRPRADAFVVNIGDTFMALSNGRYKSCLHRAVVNSRVPRKSLAFFLCPEMDKVVAPPGTLVDASNPRAYPDFTWRSLLDFTQKHYRADMKTLEVFSSWIVQQQQGQLALQPAMT

SEQ ID NO: 142249 - protein, 686 aa, Triticum aestivum
  Clone ID: PAT_TA_36667.pep
MLCLSSSLLPRPSAAADRPLPGIIAGGGGGKRLSVVPSVPFLLRWLWPRKAKSKSFVSVTARGNKIAATTGYGSDHLPIYDLDLKLAEFKDHFDYTRNRYIEQKHLIEKHEGSLEEFSKGYLKFGINTEHGASVYREWAPAAEEAQLVGDFNNWNGSGHKMAKDNFGVWSIRISHVNGKPAIPHNSKVKFRFRHHGVWVEQIPAWIRYATVTASESGAPYDGLHWDPPSSERYVFNHPRPPKPDVPRIYEAHVGVSGGKLEAGTYREFPDNVLPCLRATNYNTVQLMGIMEHSDSASFGYHVTNFFAVSSRSGTPEDLKYLIDKAHSLGLRVLMDVVHSHASNNVIDGLNGYDVGQSAHESYFYTGDKGYNKMWNGRMFNYANWEVLRFLLSNLRYWMDEFMFDGFRFVGVTSMLYNHNGINMSFNGNYKDYIGLDTNVDAFVYMMLANHLMHKLFPEAIVVAVDVSGMPVLCWPVDEGGLGFDYRQAMTIPDRWIDYLENKGDQQWSMSSVISQTLTNRRYPEKFIAYAERQNHSIIGSKTMAFLLMEWETYSGMSAMDPDSPTIDRAIALQKMIHFITMAFGGDSYLKFMGNEYMNAFVQAVDTPSDKCSFLSSSNQTASHMNEEEKGSALTKGYTHLRSGCFDPSLPSTSSCAFLGPSNQSPFSKPFIGFPGCIFCCGLFKGE

SEQ ID NO: 142250 - protein, 82 aa, Triticum aestivum
  Clone ID: PAT_TA_36668.pep
MASTRRMAAAPAVLLLLLLLVATEMGTMKTAEARTCLSQSHKFKGTCLSNSNCAAVCRTENFPDGECNTHLVERKCYCKRTC

SEQ ID NO: 142251 - protein, 423 aa, Triticum aestivum
  Clone ID: PAT_TA_36669.pep
MHRRICPSVFARKHETTRPSRAIMSMLACALQTMGSSCSRPHSVNEAEAADNTRSADIDRRILQETKADQHVHKLLLLGAGESGKSTIFKQIKLLFRTGFDEAELKGYTPVIHANVFQTIKVCQYWERILYDGAKELAQLETESLKHVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAVIFCAAISEYDQLLFEDETQNRMMETKELFDLVLKQRCFEKTSFMLFLNKFDIFERKIQKVPLTVCEWFKDYEPIAPGKVQDVEHAYEFVKKKFEEVYFQSSKPERVDRVFKIYRTTALDQKLVKKTFKLIDESMRRSREGTGT

SEQ ID NO: 142252 - protein, 599 aa, Triticum aestivum
  Clone ID: PAT_TA_36670.pep
MAALVTSQLATSGTVFSVTDRFRRPGFQGVRPRSPADAPLGMRTTGASAAPKQQSRKAHRGTRRCLSMVVRATGSAGMNLVFVGAEMAPWSKTGGLGDVLGGLPPAMAANGHRVMVISPRYDQYKDAWDTSVVSEIKVADEYERVRYFHCYKRGVDRVFVDHPCFLEKARGKTKEKIYGPDAGTDYEDNQLRFSLLCQAALEAPRILDLNNNPYFSGPYGEDVVFVCNDWHTGLLACYLKSNYQSSGIYRTALVAFCIHNISYQGRFSFDDFAQLNLPDRFKSSFDFIDGYDKPVEGRKINWMKAGILTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEILKEEDVQIVLLGTGKKKFERLLKSVEEKFPSKVRAVVRFNAPLAHQMMAGADVLAVTSRFEPCGLIQLQGMRYGTPCACASTGGLVDTIMEGKTGFHMGHLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 142253 - protein, 62 aa, Triticum aestivum
  Clone ID: PAT_TA_36671.pep
DRVVGCDRVLSETDFPNLPYLQAVVKESLRLHPATPLMLPHRASAAVNVAGYNIPKGASVTV

SEQ ID NO: 142254 - protein, 146 aa, Triticum aestivum
  Clone ID: PAT_TA_36672.pep
GIPCMDVVLQQHNIARGRSQVLQQSTYQLLQELCCQHLWQIPEKLQCQAIHNVVHAIILHQQQKQQQQLSSQVSFQQPQQQLGQQPQQQQQQVLQGTFLQPHQIAHLEAVTSIALRTLPTMCSVNVPLYSATTSVPFGVGTGVGAY

SEQ ID NO: 142255 - protein, 365 aa, Triticum aestivum
  unsure (1)..(365): unsure at all Xaa locations
  Clone ID: PAT_TA_36673.pep
MIQERGEYKSLDPADILERLNTHEFQLAEKRDLYGPRYGGSRALKAKAVSESEGEDSGSSLGDPEELSQELAILVRKFQKFSRRGRFGKSSRNDDVRSDSSSRDYKKRTCHKCKKPGHYIQDCPLWEKESNKKKYKDYSSDDSKKKKKSSKSSSSKSSKSSSHKKSSSKKARAFIVKEMDSEAESEENEEEEASEEXESGVTSLALATAFVTKSIFNSEENGFPNKADDGDDDYAPTYCFMAKGAKVLKYPSPKSSEDESDENLMPSYSKLAKIAVKQQKAFEKVQNMLDKSDNLLGEEMDRTQTLSYNLQRLQSKFDNLQSHHNTLLSDHEKLSYEFLQRKQDLEKLRESFEDLQKERDSLLAQ

SEQ ID NO: 142256 - protein, 127 aa, Triticum aestivum
  Clone ID: PAT_TA_36674.pep
TRGVPPGGLSPLKGQAAGTPSSRSPSSLRPLRAGSCPLHHAPRRAARSPCSGVVIREDFSRTFAERLVIDIEKVLHELDALPSRSSGPALQHPNGDTVSEKDLARQREVVSVWKRAVAARKKTQGVC

SEQ ID NO: 142257 - protein, 150 aa, Triticum aestivum
  Clone ID: PAT_TA_36675.pep
LGNADGISHVNIDKSVEQDMAKRIVLDAKVDYPAACNVMETLLVHKDLNKTEGLDDLLMELAKEGVVIYGGPVAQDTLKVPKVDSFHHEYSSMACTLEFVDDVQSAIDHINRYGSAHTDCIITTDKKSADTFLQQVDSAAVFHNASTRFR

SEQ ID NO: 142258 - protein, 124 aa, Triticum aestivum
  Clone ID: PAT_TA_36676.pep
SGPWMCYPGQAFQVPALPACRPLLRLQCNGSQVPEAVLRDCCQQLAHISEWCRCGALYSMLDSMYKEHGAQEGQAGTGAFPRCRREVVKLTAASITAVCRLPIVVDASGDGAYVCKDVAAYPDA

SEQ ID NO: 142259 - protein, 211 aa, Triticum aestivum
  Clone ID: PAT_TA_36677.pep
MASNQNQASYHAGETKARTEEKTGQVMGATKDKAGQTTEATKQKAGQTTEATKQKAGETAEATKQKAGQATEATKQKAGETAEATKQKAAEAKDKTAQTAQAAKERAAETKDQTGSYLGEKTEMAKQKAAETTEAAKQKASETAQYTKESVAGKDKTGSVLQQAGETVVNAVDGAKDAVANTLGNGPDNATKDTSTGATTKDTTTTTTRNH

SEQ ID NO: 142260 - protein, 374 aa, Triticum aestivum
  Clone ID: PAT_TA_36678.pep
PRLRVVRCMAASEAAQLKSAREDIKEILKTTYCHPILVRLGWHDSGTYDKNIEEWPQRGGADGSLRFDPELSHGANAGLTNTLKLIQPIKDKYPGITYADLFQLASATTIEETGGPKLSMKYGRVDITAPEQCPPEGRLSDAGPRIPAEHLREVFYRMGLDDKEIVALSGAHTLERSRPDRSGWGKPETKYTKDGPGEPGGQSWTAEWLKFDNSYFKDIKEKRDQELLVLPTDAALFDDPSFKVYAEKYAEDQDAFFKDYAEAHAKLSNLGAKFDPPEGFSLDDDKGAAVTNEKVVADPAPASDTNGAGPQPEPFVAAKYSYKKRELSDTMKQKIRAEYEGLGGSPNKPMKSNYFLNIMIVIAGLAFLTSLVGN

SEQ ID NO: 142261 - protein, 364 aa, Triticum aestivum
  Clone ID: PAT_TA_36679.pep
PRLRVVRCMAASEAAQLKSAREDIKEILKTTYCHPILVRLGWHDSGTYDKNIEEWPQRGGADGSLRFDPELSHGANAGLTNALKLIQPIKDKYPGITYADLFQLASATAIEEAGGPKLPMKYGRVDITAPEQCPPEGRLPDAGPRLPAEHLREEIVALSGAHTLGRSRPDRSGWGKPETKYTKDGPGEPGGQSWTAEWLKFDNSYFKDIKEQRDQELLVLPTDAALFDDPSFKVYAEKYAEDQEAFFKDYAEAHAKLSNLGAKFDPPEGFSLDADKGAVATEEKAVADPAPTSDTNGAGPQPEPFVAAKYSYKKRELSDTMKQKIRAEYEGLGGSPNKPMKSNYFLNIMIVIAGLAFLTSLVGN

SEQ ID NO: 142262 - protein, 102 aa, Triticum aestivum
  Clone ID: PAT_TA_36680.pep
VNTGTLAGTNYNVNDNAFNPGHVNLPIFPATLTNDLVLYDDGAPDTSDACEVPVNAAALNGKIAVIRRGTCSFVIKVKNAQDAGAVGVIVVNNVAGGISMAG

SEQ ID NO: 142263 - protein, 527 aa, Triticum aestivum
  Clone ID: PAT_TA_36681.pep
MALEAAFHYLQLAGIHGTSTPAVLLTILLLLIIRLAWVRTTTASTRFGKQQQLPPSPPGKLPIIGHLHLLGSQTHISIRDLDAKHGRNGLLLLRIGAVPTLFVSSPSAAEAVLRTHDQIFASRPPSMAADIIRYGPTDIAFAPYGEYWRQARKLLTTHMLSAKVVHSFRHGRQEEVRLVINKIHEAATRGTAVDMSELLSGYTNDVVCRAVLGESHRKEGRNRLFSELTEINVSLLGGFSLENYIPPNMVMADVLLRLVSVKARRLNKRWDELFNEIIEEHLHPSKPSSGDQQAVDFIDLLLSLKEEYGLTTDNIKAILVDMFEAGIETSYLTLEYGMAELMNNRHILKKLQEEVRSQGKKLDMITEEDLGSMAYLRATIKETLRLHPPAPFLLPHFSTADCKIDGYLIPSNTRVLVNAWALGRDPSSWERPEDFLPERFLQDQDGDVDTQMRGKDLRFLPFGFGRRICPGMNFGFATMEVMLANLMYHFDWDVPNMVGTGAGVDMAESFGLTLRRKEKLQLVPRIP

SEQ ID NO: 142264 - protein, 171 aa, Triticum aestivum
  Clone ID: PAT_TA_36682.pep
MQSLQDKASEWSGVAAADAFAIDEVNVFEALGGTPQPFVDLSTNFYTRVYEDEEEWFPEIFSGSRKEDAIQNQYEFLVQRMGGPPLFSQRRGHPALIGRHRPFPVTHQAAERWLHHMQQALETTESINPDTKTKMMIFFRHTAYFLVAGNEMTRQTQSVPPCKHATSKPAE

SEQ ID NO: 142265 - protein, 90 aa, Triticum aestivum
  Clone ID: PAT_TA_36683.pep
GMGGVGKTTLVKNVYDREKTNFPDAHAWIVVSQAYDVVDLLKTLLTKIHDTQESPPPSPLRAGAKPDVYELTGAIKKILQDRKSYLCLMM

SEQ ID NO: 142266 - protein, 74 aa, Triticum aestivum
  Clone ID: PAT_TA_36684.pep
PAHEPPLGVRPHYPALLDHAAPRPSIPPMRPLRNPRTHHLPCTRSPTRAPATHPLCLIPLSDLLHPLLMKKKKK

SEQ ID NO: 142267 - protein, 273 aa, Triticum aestivum
  Clone ID: PAT_TA_36685.pep
MAAQLFNRIGQLGLGLAVAGSVANTALYNVDGGHRAVIFDRFTGIKNTVVGEGTHFLIPWVQKPIIFDVRSRPRNVPVITGSKDLQNVNITLRILFRPLPEQLPKIYTILGVDYDERVLPSITTEVLKAVVAQFDAGELITQRENVSRKVSETLIERAGQFGVVLDDISITHLTFGKEFTQAVELKQVAQQDAERARFLVEKAEQQKQASIISAQGDSEAASMLAKSFGDAGEGLVELRRIEAAEDIAYQLSRSRQVSYFPPGQNILLNLPTQ

SEQ ID NO: 142268 - protein, 169 aa, Triticum aestivum
  Clone ID: PAT_TA_36686.pep
GMGGVGKTTLAAAVYNSIADHFEALCFLENVRETSKKHGIQHLQSNLLSETVGEHKLIGVKQGISIIQHRLQQQKILLILDDVDKREQLQALAGRPDLFGLGSRVIITTRDKQLLACHGVERTYEVNELNEEHALELLSWKAFKLEKVDPFYKDVLNRAATYASGLPLA

SEQ ID NO: 142269 - protein, 95 aa, Triticum aestivum
  Clone ID: PAT_TA_36687.pep
MASGAQKKMVAVGMMLAILFIAAAHAEPAPAETCIDKTEKVGLVTDCICSKNCACAGKCILEGGEGGEIQKCFVECVLKNDCNCNAKHHSAAAPQ

SEQ ID NO: 142270 - protein, 391 aa, Triticum aestivum
  Clone ID: PAT_TA_36688.pep
MENQAHIAGEKKGIMEKIKEKLPGGHGDHKETAGTHGHAATATHGAPATGGAYGQQGHAGTTGTGLHGAHAGEKKGVMENIKDKLPGGHEDHQQTGGHYGQQGHAGTATHGTPATAGTYGQQGHTGTATHGTPATGGTYGEQGHTGVTGTGTHGTGEKKGLMENIKEKLPGGHGDHQQTAGTYGQQGHVGTGTHGAPATGGAYGQHEHAGVAGAGTYGTGEKKGVMENIKDKLPGGHGDHQQTGGTYGQQGHTGTATHGTPAGGGTYEQHGHTGMTGTGTHGTGEKKGVMENIKEKLPGGHGDHQQTGGAYGQQGHTGTATHGTPAGGGTYGQHAHTGMTGTETHGTTATGGTHGQHGHAGTTGTGTHGTDGVGEKKSLMDKIKDKLPGQH

SEQ ID NO: 142271 - protein, 122 aa, Triticum aestivum
  Clone ID: PAT_TA_36689.pep
MSMASSSSSSLLAMAVLAALFAGAWCVPKVTFTVEKGSNEKHLAVLVKYEGDTMAEVELREHGSDEWVAMTKGEGGVWTFDSEEPLQGPFNFRFLTEKGMKNVFDDVVPEKYTIGATYAPEE

SEQ ID NO: 142272 - protein, 238 aa, Triticum aestivum
  Clone ID: PAT_TA_36690.pep
MAAANAPFALSRLSPAARLPIRAWRAARPAPVWTGRTRPLSVASAAQENRDNSVDVQVSQAQNGGNQQGNAVQRRPRRAGFDISPFGLVDPMSPMRTMRQMLDTMDRLFDDAVGFPTARRSPAAASEMPRMPWDIMEDDKEVKMRFDMPGLSRKEVKVMVEGDALVIRGEHKKEAGEGQVEGGDGWWKERSVSSYDMRLALPDECDKSQVRAELKNGVLLVSVPKRETERKVIDVQVQ

SEQ ID NO: 142273 - protein, 74 aa, Triticum aestivum
  Clone ID: PAT_TA_36691.pep
GKSCYIRQVALITIMAQVGSFVPASSATLHVVDGIYTRMGASDSIQQGTSTFYEEMNEASSILQNCSSRSLVII

SEQ ID NO: 142274 - protein, 74 aa, Triticum aestivum
  Clone ID: PAT_TA_36692.pep
GKSTFIRQVGVNVLMAQVGSFVPCDQASISVRDCIFARVGAGDCQLRGVSTFMQEMLETASILKGASEKSLIII

SEQ ID NO: 142275 - protein, 447 aa, Triticum aestivum
  Clone ID: PAT_TA_36693.pep
MREILHIQGGQCGNQIGAKFWEVVCDEHGIDPTGRYTGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPTGLSMASTFVGNSTSIQEMFRRVSEQFTSMFRRKAFLHWYTGEGMDEMEFTEAESNMNDLVSEYQQYQDATSDEEGEYEDEDQEPEEDM

SEQ ID NO: 142276 - protein, 239 aa, Triticum aestivum
  Clone ID: PAT_TA_36694.pep
MSKRATRSVSGGLDKEPRLPTSQKQKTLLSADVGHFSLVRALHMADLITLMNGFCGVMSVFSSLRYCLGAPDNHSNVWLALYFLPFGLFFDFFDGKVARWRNKSSLMGQELDSLADLISFGVAPAMVAFSIGLRTFADTVGLTFFVLCGLTRLARFNVTVAVLPKDATGKSKYFEGTPIPTSLVLDGVMAYWVYNGLILDNVPFGVLAEGTMLEVHPAVLLFMIHGCLMTSKTIRIPKP

SEQ ID NO: 142277 - protein, 432 aa, Triticum aestivum
  Clone ID: PAT_TA_36695.pep
GTRDFGREQMAIRERAFSIITSVFKMHGGVALDTPVFELRETLMGKYGEDSKLVYDLADQGGELCSLRYDLTVPFARYVAMNNISAIKRYQIAKVYRRDNPSKGRYREFYQCDFDIAGVYEPMEPDFEVVKVLTELLDKLDIGVYEIKLNHRKLLDGMLEICGVPAEKFRTVCSSIDKLDKLTFEEVKKELVEEKGVSNETAENIGSLVKTKGPPLEVLLELRKEGSKFMENEGSVVALNELEILFKALEKANALDRISFDLSLARGLDYYTGVIYEAVFKGVTQVGSIAAGGRYDKLVGMFSNKQVPAVGVSLGIERVFAIMEQQEKEKNQVIRATETEVLVSILGKDLILAAELVNELWSAGIKAEFKLTTRVQNHIKYATQTGIPWMVLVGESELRDGKVKLKDIRANQEEEVPRKDFVEVLKQRLSNP

SEQ ID NO: 142278 - protein, 176 aa, Triticum aestivum
  Clone ID: PAT_TA_36696.pep
MAAMKITLLAVAAMAALLGTASAVTYNVGEQGGWTLNTDYSSWVSGKKFNVGDEIVFKYSSAAHDVVEVSKAGYDSCSIDGAINTFKSGNDVIPLSATGTRYFICGITGHCSPTAAASMKVMIDVASGSSSPSSPMPAAGPGASNSPPAPPSSAATSVGATAGFGLVALLAAGLMA

SEQ ID NO: 142279 - protein, 598 aa, Triticum aestivum
  Clone ID: PAT_TA_36697.pep
IKKIKNRMHTMLATTPSSSGVKLQPWGSCRRRAASPALLPATATGRIIVDSGRMPPSPLPLRAVASESAQTSRAPQPQPPPMDVDEEKMLANYVPVFVMLPLEAITAENKVGDAEGLRAQLRRLREAGVDGIMADVWWGIVEGAGPGRYEWRAYRELFRLAQEEGLKLQVIMSFHACGGNVGDAVNIPIPAWVRDVGEADPDVYYTSPGGARNQEYLTIGVDDRPLFHGRTAIQLYADFMESFRENMADLLECGLIVDIEVGLGPAGELRYPSYPESQGWAFPGIGQFQCYDKYLEEDFRAAATDAGHPEWELPDDAGEYNDAPDDTRFFTADGAGATYLTEKGRFFLTWYSSKLIDHGDRILDEANRVFLGCTVKLAAKVSGIHWWYRHPSHAAELTAGYYNVDGRDGYRPIARMLARHDGAVLNFTCAEMRNSEQAEEAMSAPEELVQQVLSAGWREGTEVACENALPRYDRRAYNQMLKNARPNGVDLGGVPARRVAAVTYLRLTDELLAGSKYRAFKTFVRKMHADQDYCADPAQYHRPLKPLERSRPAVPMDRLLDATTPEAYPFDPETDMSVGGDLAGLIDRVFDKIEWILG

SEQ ID NO: 142280 - protein, 97 aa, Triticum aestivum
  Clone ID: PAT_TA_36698.pep
NYLYILSIRISQSMPVHGKESRRRAPPTGGARVLRREGAEPEGSGTSNGTRCRCWWCCRRVQSTRAARPAACRNRYRYQHHYRPAGGASWDPCSRPM

SEQ ID NO: 142281 - protein, 574 aa, Triticum aestivum
  Clone ID: PAT_TA_36699.pep
MAALVTSQLATSGTVLGITDRFRRAGFQGVRPRSPADAALGMRTVGASAAPTQSRKAHRGTRRCLSMVVRATGSGGMNLVFVGAEMAPWSKTGGLGDVLGGLPPAMAANGHRVMVISPRYDQYKDAWDTSVVSEIKVVDKYERVRYFHCYKRGVDRVFVDHPCFLEKVRGKTKEKIYGPDAGTDYEDNQQRFSLLCQAALEVPRILNLDNNPYFSGPYGEDVVFVCNDWHTGLLACYLKSNYQSNGIYRAAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAWKVSR

SEQ ID NO: 142282 - protein, 807 aa, Triticum aestivum
  Clone ID: PAT_TA_36700.pep
MLCLTAPSCSPSLPPRPSRPAADRPGPGISAKSKFSVPVSAPRDYTMATAEDGVGDLPIYDLDPKFAGFKEHFSYRMKKYLDQKHSIEKHEGGLEEFSKGYLKFGINTENDATVYREWAPAAMDAQLIGDFNNWNGSGHRMTKDNYGVWSIRISHVNGKPAIPHNSKVKFRFHRGDGLWVDRVPAWIRYATFDASKFGAPYDGVHWDPPSGERYVFKHPRPRKPDAPRIYEAHVGMSGERPEVSTYREFADNVLPRIKANNYNTVQLMAIMEHSILCFFWYHVTNFFAVSSRSGTPEDLKYLVDKAHSLGLRVLMDVVHSHASSNMTDGLNGYDVGQNTQESYFHTGERGYHKLWDSRLFNYANWEVLRYLLSNLRYWMDEFMFDGFRFDGVTSMLYNHHGINMSFAGNYKEYFGLDTDVDAVVYMMLANHLMHKILPEATVVAEDVSGMPVLCRSVDEGGVGFDYRLAMAIPDRWIDYLKNKDDLEWSMSAIAHTLTNRRYTEKCIAYAESHDQSIVGDKTMAFLLMDKEMYTGMSDLQPASPTIDRGIALQKMIHFITMALGGDGYLNFMGNEFGHPEWIDFPREGNNWSYDKCRRQWSLSDIDHLRYKYMNAFDQAMNALDDKFSFLSSSKQIVSDMNEEKKIIVFERGDLVFVFNFHPSKTYDGYKVGCDLPGKYKVALDSDALMFGGHGRVAQYNDHFTSPEGVPGVPETNFNNRPNSFKVLSPPRTCVAYYRVEEKAEKPKDEGAASWGKAAPGYIDVEATRVKDAADGEATSGSKKASTGGDSSKKGINFVFGSPDKDNK

SEQ ID NO: 142283 - protein, 263 aa, Triticum aestivum
  Clone ID: PAT_TA_36701.pep
MASSSATSGDDRPPAAGGGGGTPAQAHAEWAASMHAYYAAAASAAGHPYAAWPLPPQAQQHGLVAAGPGAAYGAPVPFPMYHHPAAAYYAHAHASMAAGVPYMAGESASAAGKGKRAGKTRRVPSGEINSSSGSGDAGSQGSSEKGNAGANQKGSSSSAKRRKSGAANTEGEPSQATTVQNAVTEPPLEDKERSASKLLVLAPGRAALTSAAPNLNIGMDPLSASPSSLVQGEVNAAASSQSNASLSQMDERELKRERRKQSN

SEQ ID NO: 142284 - protein, 174 aa, Triticum aestivum
  Clone ID: PAT_TA_36702.pep
PSDITSLDAVISLNLSSNHLSGMIPNDIGALHSLESLDLSMNKLTSEIPSSLSSLTSLSYLNLSYNNLSGRIPSSRQLGTLNVDNPALMYIGNSGLCGPPLQKNCSGNDTGTSHVGSNNHEEFELMTFKFGLVLGLVAGLWSVSCALLFKKAWRTAYFQLFDEMYDAESMYTWL

SEQ ID NO: 142285 - protein, 138 aa, Triticum aestivum
  Clone ID: PAT_TA_36703.pep
MAPKAEKKPVAEKAEKTTAAKKTKAEKRPPASKEGGDKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 142286 - protein, 913 aa, Triticum aestivum
  Clone ID: PAT_TA_36704.pep
MNPDKFTHKTNEALAAAHEMASEAGHAQLTPLHLAAALAADRSGILRQAIAHASGGNDAAAESFERVASAALKRLPSQSPPPDTVPASTSLVKAVRRAQSAQKSRGDSHLAVDQLLMGLLEDPQISDALKEAGISAARVKAEVEKLRGGDNRRVESASGDTNFQALKTYGRDLVEVAGKLDPVIGRDEEIRRVVRILSRRTKNNPVLIGEPGVGKTAVVEGLAQRVVRGDVPSNLLDVRLVALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVPDTVSILRGLKEKYEGHHGVRIQDRALVIAAQLSSRYIMGRHLPDKAIDLVDEACANVRVQLDSQPEEIDNLERKRIQLEVELHALEKEKDKASKARLVDVRKELDDLRDKLQPLQMKYRKEKERIDEIRSLKQRREELQFTLQEAERRMDLARVADLRYGALQEVDAAIAKLEGETGENLMLTETVGPDQIAEVVSRWTGIPVTRLGQNEKARLIGLADRLHQRVVGQYEAVNAVGEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGNSMKVARDLVMQEVRRHFRPELLNRLDEIVIFDPLSHEQLRKVARLQMKDVAVRLAERGVALAVTDAALDVILSLSYDPVYGARPIRRWIEKRIVTELSKMLIREEIDENSTVYIDAAPSKDELTYGVDKHGGLVNARTGHKSDILIQVPSGAVGGDAAHAVKKMKIMQDSGEVDDMEEE

SEQ ID NO: 142287 - protein, 363 aa, Triticum aestivum
  Clone ID: PAT_TA_36705.pep
MEEIGHHFGLGATAHGQHHSQLPWGSSPLSAVIAPPPQQQQQQQQSAGYLAHSPLSLNTAPPSGSHGGGSGCSNPVLQLANGSLLEACAKAAKEPSSSSYAADVEAIKAKIISHPHYSSLLAAYLDCQKVGAPPEVLARLTAVAQDLELRQRTALGSLGTATEPELDQFMEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 142288 - protein, 221 aa, Triticum aestivum
  Clone ID: PAT_TA_36706.pep
SLFLLAVLLALVSWQATAYDPSPLQDFCVADMKSPVRVNGFPCKDPMAVNPEDFFNPAMLDQPRDTKNSKVGSNVTNINVINFPGLNTLGISLARIDYGPLGVNTPHIHPRATELLTVLEGTLYLGFVTSNPNRLFSRVVKKGDVFVFPKAMIHFQMNLAHDKPAAALSSLSSQNPGVISIANAVFGSNPPISDDVLATAFQVEKKLIDWLQSQFWENNHY

SEQ ID NO: 142289 - protein, 221 aa, Triticum aestivum
  Clone ID: PAT_TA_36707.pep
RRQAEGVGPGEGDVEEVALLGPRRPLAVLVGPHGPRRPPRHGPLVLGQVVALLPVAGLVRPPRPVVDDVRPRRVGPGREEAAGRVGVAVGVPEAPAEAAVALRHLPLQVAAVLVLPVVAGVLAVRPPLGGVDVVAVGQEEKKQANASPLALRGGGPEAAIRAVPDYASHMCHTTQPCRNLRTTGQPQASAICNNYLLFSTARDSTAQYVLDLDQPRPYQVV

SEQ ID NO: 142290 - protein, 236 aa, Triticum aestivum
  Clone ID: PAT_TA_36708.pep
LSAGDLLGGLPSSGAPARGAGGPGGGEGPGPSPPAPPAPRGLGRPAAAAAGGAVAGPRAERQGAEARRQALLDVPAPPRARVREAEVPVGGGARGRGLRAGQAARAPVVQEAGVGPAQGGLEGPGVLQGRQQGRPLPAQPRAARAGGVAAGGAPEADLPGAAAAGAVLGPKHAQHDQQVAQAPQPPSVDGPVPVLPPREARRRPADAGTHAGSSWTKYATTYVTTQLLKSEIDRQL

SEQ ID NO: 142291 - protein, 270 aa, Triticum aestivum
  Clone ID: PAT_TA_36709.pep
MVRVPMPQLQPQDPSQQQPQEQVPLVQQQQFLGQQQPFPPQQPYPQPQPFPSQQPYLQLQPFPQPQLPYSQPQPFRPQQPYPQPQPQYSQPQQPISQQQQQQQQQQQQQQQQEQQILQQILQQQLIPCMDVVLQQHNLAHGRSQVLQQSTYQLLQELCCQHLWQIPEQSQCQAIHNVVHAIILHQQQKQQQQLSSQVSFQQPQQQYPLGQGSFRPSQQNSQAQGSVQPQQLPQFEEIRNLALQTLPAMCNVYIPPYCTIAPFGIFGTNYR

SEQ ID NO: 142292 - protein, 265 aa, Triticum aestivum
  Clone ID: PAT_TA_36710.pep
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGLRLVGTFVLVYTVFFRHRRQSASARRLPTSPFWRPPAAKASPSATRTTWTGARGSARGRSWAAPGTRGGSRCCSSSAPCW

SEQ ID NO: 142293 - protein, 101 aa, Triticum aestivum
  Clone ID: PAT_TA_36711.pep
MAKCLAAALLLLAVLASCDGRELNEKVAATRGAGVGESKAMGLPDLPAVTLPTAPTLPTLPTLPTLPTLPTLPTLPLVGAITGTSTITGPAVALPAIPAHP

SEQ ID NO: 142294 - protein, 647 aa, Triticum aestivum
  Clone ID: PAT_TA_36712.pep
MAATGVGAGCLAPSVRLRADPATAARASACVVRARLRRVARGRYVAELSREGPAARPAQQQQLAPPLVPGFLAPPPPAPAQSPAPTQPPLPDAGVGELAPDLLLEGIAEDSIDSIIVAASEQDSEIMDAKDQPQAKVTRSIVFVTGEAAPYAKSGGLGDVCGSLPIALAARGHRVMVVMPRYLNGSSDKNYAKALYTAKHIKIPCFGGSHEVTFFHEYRDNVDWVFVDHPSYHRPGSLYGDNFGAFGDNQFRYTLLCYAACEAPLILELGGYIYGQNCMFVVNDWHASLVPVLLAAKYRPYGVYRDSRSTLVIHNLAHQGVEPASTYPDLGLPPEWYGALEWVFPEWARRHALDKGEAVNFLKGAVVTADRIVTVSQGYSWEVTTAEGGQGLNELLSSRKSVLNGIVNGIDINDWNPTTDKCLPHHYSVDDLSGKAKCKAELQKELGLPVREDVPLIGFIGRLDYQKGIDLIKMAIPELMREDVQFVMLGSGDPIFEGWMRSTESSYKDKFRGWVGFSVPVSHRITAGCDILLMPSRFEPCGLNQLYAMQYGTVPVVHGTGGLRDTVETFNPFGAKGEEGTGWAFSPLTVDKMLWALRTAMSTFREHKPSWEGLMKRGMTKDHTWDHAAEQYEQIFEWAFVDQPYVM

SEQ ID NO: 142295 - protein, 78 aa, Triticum aestivum
  Clone ID: PAT_TA_36713.pep
ASKAPKPPLPHPPSQITPFLLARHAAPSGLPPLLRLRQMVASIQEVASNAQHAADAAGRADTETASGQRLVAHTSQSL

SEQ ID NO: 142296 - protein, 104 aa, Triticum aestivum
  Clone ID: PAT_TA_36714.pep
MFISDKVSSMTKLQPNTVIRAALDLLNEVGVDGLTTRKLAERLGVQQPALYWHFRNKRALLDALAEAMLAENHTHSVPRADDDWRSFVVGNARSFRQRLLAYAG

SEQ ID NO: 142297 - protein, 146 aa, Triticum aestivum
  Clone ID: PAT_TA_36715.pep
MFISDKVSSMTKLQPNTVIRAALDLLNEVGVDGLTTRKLAERLGVQGHRRTSHLCRSARSRLTFINHTIQTKLPNGLQIYVWALLDALAEAMLAENHTHSVPRADDDWRSFLIGNARSFRQALLAYFFLYAKTSRVFVFVGLPCGR

SEQ ID NO: 142298 - protein, 81 aa, Triticum aestivum
  Clone ID: PAT_TA_36716.pep
HYCPLRPSARESARRRAAKPFDGMPRRGQMEIQETQAGRQRRRRRQRGIACYKCAPRRRGRCCCWGCCCVVVGAMKCVHSW

SEQ ID NO: 142299 - protein, 95 aa, Triticum aestivum
  Clone ID: PAT_TA_36717.pep
VRPEARRGGVRRNAAPRRRDGDPGEAGRRRRRRQRGIACYKCAARRRGRCCCVVVGAMMKCVHSWRSWGREGGGRWGVWSRRGRRVVGPHGPAWA

SEQ ID NO: 142300 - protein, 97 aa, Triticum aestivum
  Clone ID: PAT_TA_36718.pep
ARPTRAMRPNYPSSPSRPRPPPAPPHPTPNSSMNARISSLQPQRSSPSTSGLGDAARIYTTQFHLDLHLAAARVSSSLPARHSVERLGGAPPDGPTR

SEQ ID NO: 142301 - protein, 78 aa, Triticum aestivum
  Clone ID: PAT_TA_36719.pep
HRPPFGQTAQMQCSSKRQCHQRCVNPRSWNLGGGGGGRADACWALARGGADEGLDLSGGGGAHGAGDGGRVERGRISR

SEQ ID NO: 142302 - protein, 59 aa, Triticum aestivum
  Clone ID: PAT_TA_36720.pep
SPHSPCRFPPGQVRSGQARSAARSASAPGGSKTWGLHTFDGTVSLKNTASALFVQREDD

SEQ ID NO: 142303 - protein, 36 aa, Triticum aestivum
  Clone ID: PAT_TA_36721.pep
RVIFPSIVLGFLNLLKLARFAESCHRSPRVSRRLEA

SEQ ID NO: 142304 - protein, 115 aa, Triticum aestivum
  Clone ID: PAT_TA_36722.pep
RSVNSAAYLSIHIAMPIAVLRNVLVGQLHPVRACPLSPVSNHQYDIVEYVTHLTCSVLQSILNQCPSRSTVQGDPSLSKPASNIKLSPMSSRKSKLWPFSYKDHTGKNLALTNLN

SEQ ID NO: 142305 - protein, 72 aa, Triticum aestivum
  Clone ID: PAT_TA_36723.pep
SCSFLNSSLLPPIRSFSFILAMMLAMAVMLSAIFFSGKSYEFAFDVMMPVWWSMRVGVFVAPRSSCPSSLCG

SEQ ID NO: 142306 - protein, 51 aa, Triticum aestivum
  Clone ID: PAT_TA_36724.pep
GLPRSNGITLRLYRCTSSIATGCNLEDSSCDKRFTSIDIVTTCASCTRLCI

SEQ ID NO: 142307 - protein, 100 aa, Triticum aestivum
  unsure (1)..(100): unsure at all Xaa locations
  Clone ID: PAT_TA_36725.pep
AYARVESFQSATMDNVPHTNTTYCNNXMCKKHTLHSVTQYRARNDSLSAHGNRRYDRNQSGYRGQTKPVFHKNATTTYNIVLNLQCQSFMHYSQRAIMRC

SEQ ID NO: 142308 - protein, 75 aa, Triticum aestivum
  Clone ID: PAT_TA_36726.pep
GSTCHLRPRLLLNHHHLRRIHPLGQPHLLQLAILLHVRHLHLLRLIHRVRLLHLHLLDHRGGPLLHKLLLTHASL

SEQ ID NO: 142309 - protein, 42 aa, Triticum aestivum
  Clone ID: PAT_TA_36727.pep
VHRCTINMPMEVVNLIDHWKSPDEFTNDLFKSCVAKNHITRG

SEQ ID NO: 142310 - protein, 69 aa, Triticum aestivum
  unsure (1)..(69): unsure at all Xaa locations
  Clone ID: PAT_TA_36728.pep
SKIFTICLVDQMANVVLNFNAFLEKTKLKDDGSNYTYWVRNSRIILIAAKKDYVLKASLXDTPIPQDQG

SEQ ID NO: 142311 - protein, 48 aa, Triticum aestivum
  Clone ID: PAT_TA_36729.pep
GSTGQPKLRLIYIAKCPLGIDFHMFLSHISHHRLRLSTIPRRSGVSVL

SEQ ID NO: 142312 - protein, 40 aa, Triticum aestivum
  Clone ID: PAT_TA_36730.pep
PDVRFQQVTYQRHTSMCKSRHVHVLTFVRFYMRRATHGQQ

SEQ ID NO: 142313 - protein, 136 aa, Triticum aestivum
  Clone ID: PAT_TA_36731.pep
VRRQVPCRGSRVEGKKPKAEKRLPAGKSAAKEGGDKKGKKKAKKSVETYKIYIFKVLKQVHPDIGISSKAMSIMNSFINDILEKLAGEAAKLARYNKKPTITSREIQTSVRLVLAGELAKHAVSEGTKAVTKFTSS

SEQ ID NO: 142314 - protein, 59 aa, Triticum aestivum
  Clone ID: PAT_TA_36732.pep
YRTCLVRYVHPTNVHNSMMLRTGNNGKRRTDFTTPTARFAKLRSPRLHVCKGRLQRIRI

SEQ ID NO: 142315 - protein, 144 aa, Triticum aestivum
  unsure (1)..(144): unsure at all Xaa locations
  Clone ID: PAT_TA_36733.pep
AGRRDRGVLLFLPARDPTPPPHLDLLCSSTAAALRSARAARARRRASRRPSRDPPSPPCHGILLLDHDPVLPPDLEIACSSIIAPQLRQELAGATLQHPFLLTSPSPELLSAMIKSAQGHRPPPRARRSRSDLAAGKGQCVTFX

SEQ ID NO: 142316 - protein, 34 aa, Triticum aestivum
  Clone ID: PAT_TA_36734.pep
CDINLGKIAGAEAGPDQRWREAEHGRRQRATLIC

SEQ ID NO: 142317 - protein, 86 aa, Triticum aestivum
  Clone ID: PAT_TA_36735.pep
APRPSSCVPPPVLCSLSVLDSSLLPPIWSVSFILRMTPAMAVMLPVISFRGTSLSAHSMRCSRSVGQFASPLFVLLLLLVFFHFVV

SEQ ID NO: 142318 - protein, 42 aa, Triticum aestivum
  Clone ID: PAT_TA_36736.pep
NCRGCQLIGYYCASIKSEGAKDTLGQPSNFLEMRLNYILLCN

SEQ ID NO: 142319 - protein, 85 aa, Triticum aestivum
  Clone ID: PAT_TA_36737.pep
MTNTTLLTSNIRCAFKHTLHSVTHYRERNDSLSAHGKRHYDRYQSGYRGQTKPVFHKIATTSLNIVLKLQCHSCMHYAQRAIMRC

SEQ ID NO: 142320 - protein, 116 aa, Triticum aestivum
  Clone ID: PAT_TA_36738.pep
TNLVSVCLGWSPAFALRTVSVFNLTAPVIVGPFRILHSLLSYEVLQGSRLVYAASVIIIICNLLECTLISGGHRHNTYAAVVVTTFMPLPCVAIHKKKIKKKKKKKKNQHTREKQT

SEQ ID NO: 142321 - protein, 148 aa, Triticum aestivum
  unsure (1)..(148): unsure at all Xaa locations
  Clone ID: PAT_TA_36739.pep
FSKCEFLLKEVGFLGHXISEEGIAVDPTKVVSVTNWEAPTSFGEIWSSLGIARYDRRFIENLSKIVKPVTELLKKDTKFKWTEECEASFQELKKPLVTAPVLILPDQHKDYQVYCDASHRGLGGVLMQEGRVVSYASRQLKPHELNYA

SEQ ID NO: 142322 - protein, 92 aa, Triticum aestivum
  Clone ID: PAT_TA_36740.pep
PLTLGTYVQRVMLLTPHPYLGLIAVSTTLVSALIHIKAISQQTLRDSPSDTINGKTLSSTAHTIMQRESSTQFIKLNAYHVQNLISIFKGHQ

SEQ ID NO: 142323 - protein, 41 aa, Triticum aestivum
  Clone ID: PAT_TA_36741.pep
FAHVDSVVTCPSSELHSRSRGAYRGSPNFLCNIKDFPVTIS

SEQ ID NO: 142324 - protein, 83 aa, Triticum aestivum
  Clone ID: PAT_TA_36742.pep
YLSRTGELRPRPMIANLQCLLKQRTQASFLKTMTLWSSHLWDQSQCQNRRISSTVCCSGLPDQRLLDTRHMSFTRTIGRSPGT

SEQ ID NO: 142325 - protein, 91 aa, Triticum aestivum
  Clone ID: PAT_TA_36743.pep
WPLGKSIKYKTCYPFTMLESLEDQRCLLVSEEDDSVFPLIVAIGEARAGRCQISLVCVRGDATDADTDRRPMYGCVITITTPRRYVRSDTG

SEQ ID NO: 142326 - protein, 61 aa, Triticum aestivum
  Clone ID: PAT_TA_36744.pep
HTTHHTHQQQQQHQYFRAAAAAASAVAYSKLKTADAGDDHSRSERTTDHRGVWMQGRVWGV

SEQ ID NO: 142327 - protein, 91 aa, Triticum aestivum
  Clone ID: PAT_TA_36745.pep
PSVPSLSTESGILANGDDTMVTTLMGSISVSEPADFQYGMSLRTSRLTVASSKTFEFHIHDWAITRYAISATCYRKGNHVANTSMALPSDD

SEQ ID NO: 142328 - protein, 101 aa, Triticum aestivum
  Clone ID: PAT_TA_36746.pep
ESTGDTRVSRLSTRGVQPQTNISIHRHQERRHRQNLRLKGSHQRIQLNNSGSQKDSKQTEQRNSNGEGNRIRLLIWTYVKFYSSKNLFRLIKQKEGLGTKI

SEQ ID NO: 142329 - protein, 121 aa, Triticum aestivum
  unsure (1)..(121): unsure at all Xaa locations
  Clone ID: PAT_TA_36747.pep
GTPKLILVSNRRARRKATITLKTYKFNTFKVLNQVNPKIGISSKAISIINSFINNIFXKLAGEAAKLARYNKKPTITSREIQTSVRLVLPGELAKHAVSEGTNAVTKFNSSYSAPAPVSRS

SEQ ID NO: 142330 - protein, 103 aa, Triticum aestivum
  Clone ID: PAT_TA_36748.pep
KALLDKAYMNAKTLLTNHNKVLHALANALLKHETLSGDPIRELVSTGRQGDGPSSSQQNQGTPSPGDEFSKLVSTEQQEDGHNNSQDQVTPSPTGDEIKESAR

SEQ ID NO: 142331 - protein, 52 aa, Triticum aestivum
  unsure (1)..(52): unsure at all Xaa locations
  Clone ID: PAT_TA_36749.pep
MHVFQGGIXPANILIGDNLCPKIYDFGLSQMFXEEETERIVENVAGTFGYMA

SEQ ID NO: 142332 - protein, 98 aa, Triticum aestivum
  Clone ID: PAT_TA_36750.pep
THTFCVSDQMLESDWRHESRVRSAHKRGTWSITTEPCSRYMHSAGRGQKRGQRRNNAHWTSQEVKELVDGIAVYGFPHWIKLRIERFPTFFGAPEHLR

SEQ ID NO: 142333 - protein, 68 aa, Triticum aestivum
  Clone ID: PAT_TA_36751.pep
NYHLHISKQSSSNNLLIVFNALHMKVFNTSLMDAYQSKTKFITKENRNRDIPPWANKCLYGKSEKNTN

SEQ ID NO: 142334 - protein, 97 aa, Triticum aestivum
  Clone ID: PAT_TA_36752.pep
SSIAQTTSTAHNDTTVTKNHGTTDRVDSSTSDGPDTTTSILDVDAGSHQEGSTVPAATNVHVRNTPVSSDQAVSNEQRDIVSELNIFYIPHLRGTSQ

SEQ ID NO: 142335 - protein, 45 aa, Triticum aestivum
  Clone ID: PAT_TA_36753.pep
VTEVFESYRLLQIVLFLTDSIFRVLFAYFDESMSRGMNHGEHGMQ

SEQ ID NO: 142336 - protein, 117 aa, Triticum aestivum
  Clone ID: PAT_TA_36754.pep
GWGLDYLTISTKPHNKKKGRRQGRPAARRRVAGDEATLQEEGSPVRRRRFKKKVHRRGGGAARRRVAGEEAELPVSTSEGLNLESDTSILHHAFISIFIALWAVITHYVTILMHIPA

SEQ ID NO: 142337 - protein, 49 aa, Triticum aestivum
  Clone ID: PAT_TA_36755.pep
PDNPRKMELGSRASRGETLTSVARVFHLTPSWCIRKVKLRGNPRCPSPS

SEQ ID NO: 142338 - protein, 97 aa, Triticum aestivum
  Clone ID: PAT_TA_36756.pep
SDIRKALAELHTIKLIILSGIPFQDDFGELRTIMRLLLPANDEAMVLLNPLTLDNMAYRRVDEIMKNMDHFLHIQNDTILLNPLKVKRILYDSESYS

SEQ ID NO: 142339 - protein, 146 aa, Triticum aestivum
  unsure (1)..(146): unsure at all Xaa locations
  Clone ID: PAT_TA_36757.pep
RGSTGCLDSLNRIISRLGEKALPLYXLMKKSTHFEWNDQADQAFHELKKMLTTPPILAAPTEKEPMLLYIAATSRVVSTLVVVQRPEEGRAQLVQRLVYYLSEVLSSSKQNYPHYQKMCYGVYFAAKKLKPYFQEHPITVVCTAPL

SEQ ID NO: 142340 - protein, 98 aa, Triticum aestivum
  Clone ID: PAT_TA_36758.pep
MAGNDCESQMFANVLEGFVKLFSFIVQVAMGPSVRPVFTLYPHKINDSLTMHQAAVQFKRGRAKIRRFLFLGRAMPTERHAMQMAAREAIARIRSHHA

SEQ ID NO: 142341 - protein, 74 aa, Triticum aestivum
  Clone ID: PAT_TA_36759.pep
SMIGKDNDAELLQVLKVACSCVLSAPKERPTMFEVYQLLRAVGEKYHFSAADDELALRPQDADSKKLDELIVAK

SEQ ID NO: 142342 - protein, 105 aa, Triticum aestivum
  Clone ID: PAT_TA_36760.pep
VKNYHPYSYLQVLLVFQLRTGDIAHNVSKVRCFFFEHVKSEMLIISKDKKKKERDVDSFMHPRSQSEAGRNLLFLLLWTKTGDGRPRVQSHAGAKHSSREVLPVR

SEQ ID NO: 142343 - protein, 63 aa, Triticum aestivum
  Clone ID: PAT_TA_36761.pep
GVALNLHFCLGLEETTEGDCSVQGSPEADASFRSHLRSSCPRCWCKSPAPWAGSRVHSRPCLS

SEQ ID NO: 142344 - protein, 43 aa, Triticum aestivum
  unsure (1)..(43): unsure at all Xaa locations
  Clone ID: PAT_TA_36762.pep
SRDEGDGGLISRVLKVEGLKCKKSNVLXPRHYFQDGGSSSIIS

SEQ ID NO: 142345 - protein, 67 aa, Triticum aestivum
  Clone ID: PAT_TA_36763.pep
IGASSAKSLNMSTFCQEHFIATRTARLTQVMVLYSCKQIHVRIDEHNIDSALLLINISRCTGHDDTT

SEQ ID NO: 142346 - protein, 64 aa, Triticum aestivum
  Clone ID: PAT_TA_36764.pep
SILASDAILSRVSQYPFHTLFQTSNDYLTTWNFLLYLVLALDVFLEIPLERFIYASFTEMTLGA

SEQ ID NO: 142347 - protein, 142 aa, Triticum aestivum
  Clone ID: PAT_TA_36765.pep
TVYFHLHELDLRYHLSRQTGALNRIIDRGSRAINYILTVMVFNVVPTILEIGMVSSILAYQFGSTFAWITSVSVATYIVFTLAITQWRTQFRTAMNKADNASSTVAVDSLLNYETVKYFNNEQFEVQKYDKYLKSYDDAALK

SEQ ID NO: 142348 - protein, 58 aa, Triticum aestivum
  Clone ID: PAT_TA_36766.pep
PGKIQFLSRIKGLPYPANYDDTTGRIQALIIVKSLNTSEIIKLASRSNLLACKNNETS

SEQ ID NO: 142349 - protein, 75 aa, Triticum aestivum
  Clone ID: PAT_TA_36767.pep
QPTRVSNPGARIIPGFISGFPAMRFQWEETFSSMMRRLRWLRKSQDDMPAQSLGGAHKGRVCVCAFIGVSVCACI

SEQ ID NO: 142350 - protein, 120 aa, Triticum aestivum
  Clone ID: PAT_TA_36768.pep
CFHRCCLRPLHRQPSLSIRSNPTAPDIADDAIGRVVSTRIISPFSHGRARPLRRSPAMTEGFSPSLLSLPSLASPNDQADLADFFHVLCRCRCAAQLPRPRALALSAATTELRPSLLSSP

SEQ ID NO: 142351 - protein, 81 aa, Triticum aestivum
  Clone ID: PAT_TA_36769.pep
RNYVKPIEGFIYHGKLNENHAIFYGFAFLHPDSLRFLANRLGLKGSSMCLTCIFYVFKTLRKHLVEHTKSFTHKSKCVDSL

SEQ ID NO: 142352 - protein, 62 aa, Triticum aestivum
  Clone ID: PAT_TA_36770.pep
SVLYTETFVTLLPVYSFVLEPLGNLQGRTDAVLHGHVLDYHVLDAVPIHKSFHCCGEHGSGL

SEQ ID NO: 142353 - protein, 105 aa, Triticum aestivum
  Clone ID: PAT_TA_36771.pep
RHVHEEATECVVFIERQRNASCSSGGNGTHGSQPAWTEHPMETRPGVPHNEGNGLLFDRPRLKRDPVHREGSSVPQNGGKGLVLDLLQSKQGPVDQEGRGVPQNG

SEQ ID NO: 142354 - protein, 53 aa, Triticum aestivum
  Clone ID: PAT_TA_36772.pep
GDIIDLIFACIHVLLLLYLFVLRFLLFYRVRRRRYTPLPITSTRGGVDIPPPR

SEQ ID NO: 142355 - protein, 68 aa, Triticum aestivum
  Clone ID: PAT_TA_36773.pep
NSNGRSFYFFFFTKTKTLACDSASRIQYNTQQKKKICTEMAGFGLVSSYYLPEGISEPFSDPRVRGCV

SEQ ID NO: 142356 - protein, 121 aa, Triticum aestivum
  unsure (1)..(121): unsure at all Xaa locations
  Clone ID: PAT_TA_36774.pep
KSTAKEGGDKKGKKNAKKSVETYKIYIFKVLKQVHPDIGISSKAMSIMXNSFIKDIFKKLPGKAAKLARYTRKPAITSREIQTSVGLVFPGNLAKHAVSDGTKAVTKFTSSYAVRLPVSRS

SEQ ID NO: 142357 - protein, 47 aa, Triticum aestivum
  Clone ID: PAT_TA_36775.pep
GSLHVRTASYNSGLCFQTHGVICPNTLRIALPSKDGQLCIGSISAGV

SEQ ID NO: 142358 - protein, 62 aa, Triticum aestivum
  Clone ID: PAT_TA_36776.pep
PLDVNLTDVLLLQYLIFLLQPPKPAPVGLPAPASHGRLCCRTGRTAPPYFIVGQAIPLLSHT

SEQ ID NO: 142359 - protein, 72 aa, Triticum aestivum
  Clone ID: PAT_TA_36777.pep
SSIRISITGPMFKVCLPQLVTLTQLRQNVTHILYAWDSLTIRTQSLQAYNIIVHVSLLKIKHKFSEKIGQPL

SEQ ID NO: 142360 - protein, 71 aa, Triticum aestivum
  Clone ID: PAT_TA_36778.pep
ASRAHTYVLIFLPVTNGEFLTAGPQSETSDRGLSRTRTWAAHVSPRGCAYISVRCLLTLATTNRSHLLTPI

SEQ ID NO: 142361 - protein, 89 aa, Triticum aestivum
  Clone ID: PAT_TA_36779.pep
KKYFLEFKLIFHVRLKKRTSYSTPTVPTACPSPRFDWSVGYRCPHNSGRFSVRFLLSAGEEQRVTFSRMIRWNQKINELLAGCYIQWTR

SEQ ID NO: 142362 - protein, 90 aa, Triticum aestivum
  Clone ID: PAT_TA_36780.pep
HMLITTKQVRIHNLFNHHTSLAYRTCKRPPLVSLSKNAKHRGYFTGCFPPSRVAPSTALDHPSTVYCHVMLCDASNALLITVFPLRYLFP

SEQ ID NO: 142363 - protein, 80 aa, Triticum aestivum
  Clone ID: PAT_TA_36781.pep
SCLCNESLGLPYHTGYLVTNIINMVITSGSRTKPTLGFQHQPSSRFQHYHRIISVICMTLLCKINLLLLIHGVTYYELCP

SEQ ID NO: 142364 - protein, 118 aa, Triticum aestivum
  Clone ID: PAT_TA_36782.pep
SVRYGRRPAHPHVPLARLFHPIRLDLLHPATNARSQPILLARVSSPEWLGRIVSIPCHLLDGAPGTGPRRGPPAVGCADAARMQRLFGMSTGTTALSPVDDGGDALSSHFLHKDTHGN

SEQ ID NO: 142365 - protein, 98 aa, Triticum aestivum
  Clone ID: PAT_TA_36783.pep
MEEEEEPQVLRKLKLKIPDDDDNHPVVDNMKKRKHVGLILWRHSDPYALRRRTIVDYMFHTKEQQDFYEIVLLDKKPIVCDMKWVDWKYIENNEDHFP

SEQ ID NO: 142366 - protein, 34 aa, Triticum aestivum
  Clone ID: PAT_TA_36784.pep
PGGYLKARPKWAKAENDMLDKRIEPETADRRANQ

SEQ ID NO: 142367 - protein, 139 aa, Triticum aestivum
  unsure (1)..(139): unsure at all Xaa locations
  Clone ID: PAT_TA_36785.pep
PRVNNXPPQQFLTPSSHYSNPLDNMIVAAIRLAALPLEGESPSAVETRRARELLQTALEQQAAYSYSREWIHSTPRPSRSYSRHIDSPAVSSTEQHRNQPRGHDPTRNGANAQSLVDQGRARREAKLAAQLAAHQHASA

SEQ ID NO: 142368 - protein, 85 aa, Triticum aestivum
  Clone ID: PAT_TA_36786.pep
GSPSELYNSKSLHVRATLAQLLCALLHYKRRYGGWVAKMQPNQIVKTIAVAIHFGAPSIFASQAFVFAVFGASFGAPSVHEKSAR

SEQ ID NO: 142369 - protein, 40 aa, Triticum aestivum
  Clone ID: PAT_TA_36787.pep
MGQKSRGRMAAVGDRLLPHALDLIMAKSVPGAGQNTHCFL

SEQ ID NO: 142370 - protein, 75 aa, Triticum aestivum
  Clone ID: PAT_TA_36788.pep
LTSYFLSPRNTQRAVYKMYYNYGSELTYEEKGSLVTLINDVEIFKTNYQISQNYSGYMPLVYELHDGNFIAENMV

SEQ ID NO: 142371 - protein, 48 aa, Triticum aestivum
  Clone ID: PAT_TA_36789.pep
FCMALAQNCGMGFHSSVLWILFIILCNSRQLEIPPIFIIIASRLKNPC

SEQ ID NO: 142372 - protein, 82 aa, Triticum aestivum
  Clone ID: PAT_TA_36790.pep
ENSKVPYRLVVVPISALTLSTIIANSVLSSSHTNVSVRTFRYLQTYIIHVGLVSAQRSSKESPRQMMRSLLFITKTHVRRTC

SEQ ID NO: 142373 - protein, 94 aa, Triticum aestivum
  unsure (1)..(94): unsure at all Xaa locations
  Clone ID: PAT_TA_36791.pep
QTETVHFDKITVRLKKLSYGLIQEHCDPVLVAQKVCVXVCVRVYMGVTTSQLDELAAETVAELTASQPDYASLAARIAVSNLPPSGNSLCGARK

SEQ ID NO: 142374 - protein, 50 aa, Triticum aestivum
  Clone ID: PAT_TA_36792.pep
FTQVVIVLRMLWENRDMFDLVISDVHMPDMDGFKLLELDMDLPVIRVMEC

SEQ ID NO: 142375 - protein, 69 aa, Triticum aestivum
  Clone ID: PAT_TA_36793.pep
GKDDDSILGGQTSNKIGSTISRRFKMTDWELNIYMITCCIGSVVVWEFVRDVLKTSAPGNPWRLIYDLP

SEQ ID NO: 142376 - protein, 66 aa, Triticum aestivum
  Clone ID: PAT_TA_36794.pep
LWLVRILVLRFVILEACTIVSRYAIKLEHDLLLIVFLMNGGRGRVLVFSYQSIPPGACIVVLCFKG

SEQ ID NO: 142377 - protein, 113 aa, Triticum aestivum
  unsure (1)..(113): unsure at all Xaa locations
  Clone ID: PAT_TA_36795.pep
ESSNIKWLLNSLIGKPEPDKVSVEHAYPFAQGKLFVLTITVGLESYHVNVHXRHGTSFPXRTGYNLEDATGLSLNGDLDIDSVSAAHLPKSHPSFDPQRYLEMSEQWKASPLP

SEQ ID NO: 142378 - protein, 127 aa, Triticum aestivum
  Clone ID: PAT_TA_36796.pep
VHTILASDARNLEHLYIIGNVNRTKHLLGAVYKPGKQLPRPCGKQVKVHKDIAAHAHLSDDDLGTRPDTSAGVLDVEPDHLVLLLGKQQLHDVDGVLHPDRVVGVHHRELREHSVGVQHGMHCELLL

SEQ ID NO: 142379 - protein, 133 aa, Triticum aestivum
  Clone ID: PAT_TA_36797.pep
SGDYLVARPKWSKTENDLVDKGIEPETINWPDRCRTWFFGAGGTLDPVTGKCIWTNDQMDIPVRKLKQYIKVAQEGTFFPDRENDELTMALGNPDHPGRTRGTPGPIPWKVGFPEAGGYKSHEKTKKVQQAQM

SEQ ID NO: 142380 - protein, 57 aa, Triticum aestivum
  Clone ID: PAT_TA_36798.pep
YLTLPSLILCSVVSRNRLGSYQIYYQTLRCTSNIFSDNHIISKSHETSLHYSSYYIL

SEQ ID NO: 142381 - protein, 108 aa, Triticum aestivum
  Clone ID: PAT_TA_36799.pep
HGSTGIAEIRRQKSTGSIWALLGHTGIEERDQKEGGMCPPSGPNWTRGAAPFSFFLSPSFPFSYSNKEGGSPTGSRTLLGAPLLGRPPPPPLLLYIRGEGGTSRHNNN

SEQ ID NO: 142382 - protein, 38 aa, Triticum aestivum
  Clone ID: PAT_TA_36800.pep
DELDIWGGDAQRAALPKSGLNMLKINTSITSVIPAVQL

SEQ ID NO: 142383 - protein, 64 aa, Triticum aestivum
  Clone ID: PAT_TA_36801.pep
YTICASRTSFELYTFCSSASVISFRARRWICFIETFVLARVTYINLRVQQNIMEIFSNYLKHSR

SEQ ID NO: 142384 - protein, 76 aa, Triticum aestivum
  unsure (1)..(76): unsure at all Xaa locations
  Clone ID: PAT_TA_36802.pep
LRSWMEAMISSRSLLPXTLRVCRQDRGEHEELWPPPWSPHRRGWSTPSAYSLWRSLLLFRSRGDRILPICPSPSTR

SEQ ID NO: 142385 - protein, 51 aa, Triticum aestivum
  Clone ID: PAT_TA_36803.pep
MWGTGSRSGGYHVRHPTTVKVTDKIKKSAGGRVWSPIQYALRELCHDHMPA

SEQ ID NO: 142386 - protein, 81 aa, Triticum aestivum
  Clone ID: PAT_TA_36804.pep
VTCMKNSARWLCHKYDVSYMIMQWHYDKSPACHNDKWNDGTLHGNVSRNGYRNAIIGTCGGCSEEDIRRFMTARFSLPRRP

SEQ ID NO: 142387 - protein, 42 aa, Triticum aestivum
  Clone ID: PAT_TA_36805.pep
GSTKQSNVKLQRRRSLLLIIPCLCYLRLEVVVVIVLLPNGRS

SEQ ID NO: 142388 - protein, 60 aa, Triticum aestivum
  Clone ID: PAT_TA_36806.pep
EILLFTACSLPGIPSYFVDYGTAFILLKLCILPELKWPDQLKSFGTLVWLPTCILNEFLV

SEQ ID NO: 142389 - protein, 44 aa, Triticum aestivum
  Clone ID: PAT_TA_36807.pep
QLATNAYGLSIPSRSLTRVRSDRDNIFGIFDRYIQKKKKKSKKT

SEQ ID NO: 142390 - protein, 72 aa, Triticum aestivum
  Clone ID: PAT_TA_36808.pep
GRQSKKHPMLQICHTTVTIRACYGTCKPQHKCLYNPLSPTSITLISPSLYRKTIARNQTYHIQRSTSLCRIL

SEQ ID NO: 142391 - protein, 45 aa, Triticum aestivum
  Clone ID: PAT_TA_36809.pep
RLIVFLHDMCNRYISTNTINTHYILLCHTEHTRHDGDRRKAHAYP

SEQ ID NO: 142392 - protein, 94 aa, Triticum aestivum
  Clone ID: PAT_TA_36810.pep
MSRGGSAGGGQSSLGYLFGDGEPAKPAAAPAAKPAPAEKPAPAAADVPKQIRAGIPCSRANNYYRADGQNTGNFLTDRRSTTVHAAPGGGSSLG

SEQ ID NO: 142393 - protein, 51 aa, Triticum aestivum
  Clone ID: PAT_TA_36811.pep
IDNTCVVFDLLAHISASKNVARIQPIFSEFTVFFCAVKFTVNLIFFFELQQ

SEQ ID NO: 142394 - protein, 130 aa, Triticum aestivum
  unsure (1)..(130): unsure at all Xaa locations
  Clone ID: PAT_TA_36812.pep
MICTRXDKSIAAYIQELNQHIRRQENQMCASMIYLKKVMTRNMELEEELKSTRDEYEEEIAVLLEKNEDLKKKLGVFMGDPMPGGDDHPEDYIIIDDTDSDPDNDDDYEDEAGADIMESSSDGNLSSTRE

SEQ ID NO: 142395 - protein, 99 aa, Triticum aestivum
  Clone ID: PAT_TA_36813.pep
HAIYQCSVGPNLPDKWIGLLVGPFLKLRLEIGLLKLIWKVVQGFCELTALDQLFLMNWIVLMHMHVRRNTSRVNNKVTCTSSNLITCSLTNQPKNIDQG

SEQ ID NO: 142396 - protein, 53 aa, Triticum aestivum
  Clone ID: PAT_TA_36814.pep
KKTLLLFFFLLLLCGLLFFLFSNGILTVFNISTLLHDHNIDVLILSNSFVENS

SEQ ID NO: 142397 - protein, 95 aa, Triticum aestivum
  Clone ID: PAT_TA_36815.pep
YKNNKYPLVSARPASLRLTQQTLAILSARIPLYSLETTVATHTCSQNWIVQVKSWCYMGKSVPDTPSPPDRGYKQCFFRIGFTCSIKTYLLAYYS

SEQ ID NO: 142398 - protein, 139 aa, Triticum aestivum
  Clone ID: PAT_TA_36816.pep
KGVVPKNSSSSEHLDHRRPGGNVPLGQRGKGVRAIWTPSDDHSRASKAPNSTGSFQLGGGREPMPVPNTSAWAAVDWPDTLEELVSNSVIVEWHRTLMGAVMQSVRSVQSVLNDDVQGLLTCFEVSQVMIFPHNVVIVV

SEQ ID NO: 142399 - protein, 124 aa, Triticum aestivum
  unsure (1)..(124): unsure at all Xaa locations
  Clone ID: PAT_TA_36817.pep
GDALVKQHAKVAEEAVSGWEKAEAEASALKVQLETVTLSKLAAEERAAHLDGALKECMKQVRTVKEEGEQKLHDVVFAKTKQWEKIKAELEEKLXEFXHELIRAGAENDALSRSLQERADLLMK

SEQ ID NO: 142400 - protein, 106 aa, Triticum aestivum
  Clone ID: PAT_TA_36818.pep
RKRMRVQGLGIKWSNSSTAAPCHPFISTLVLFHRKHWREGLAHNGNFHGGQGCSLSLEKVVFTFKDTVHDALVGSGMISTLHAHRHGHLAPIGQYLGLLLEPACCP

SEQ ID NO: 142401 - protein, 97 aa, Triticum aestivum
  Clone ID: PAT_TA_36819.pep
KLDLFYLVLFFISFYLFFKENTNATNSFLTKKLLLFENYTIICLFFHIKKVQLVSKLCANFVVVCFRFVIFYFFLNVILMSLIDSSLSNLYTRVPWT

SEQ ID NO: 142402 - protein, 142 aa, Triticum aestivum
  unsure (1)..(142): unsure at all Xaa locations
  Clone ID: PAT_TA_36820.pep
ELKNLKMQLDIQEKMGLIRPSSSPWGCGVLFVKKKDGTDRLCVDYRPLNKKTIKNKYPLPNINEEFEQLKGAQVFSKLDLHMGYHQIRIREQDIPKTAFRTSYGSYEYTVMSFGLVNAPPTFSRMMNFIFNAYTNDFVLXYP

SEQ ID NO: 142403 - protein, 137 aa, Triticum aestivum
  Clone ID: PAT_TA_36821.pep
LLCFEYLSGGSIDKLIYKGSGYVLDWSGRYKIVQGICSGLHYLHHELDHEQNIVHLDLKASNVLVSRGDGGDITCVKIADFGLSKFFKADLTHSYTEQVVGLLAYMAPEYVCKGRISPKADIYSFGILILEIVTGRC

SEQ ID NO: 142404 - protein, 61 aa, Triticum aestivum
  Clone ID: PAT_TA_36822.pep
FPFHQGYPFFREETVRLILQVVPDESFAYRKSDICLKTMSMLSRSMSVVIQFSISAFEAQC

SEQ ID NO: 142405 - protein, 48 aa, Triticum aestivum
  Clone ID: PAT_TA_36823.pep
SNYFLVIFCIVFFLFCIISFLLFPVCTRSASNFCRDPLYSFAHAMRVK

SEQ ID NO: 142406 - protein, 134 aa, Triticum aestivum
  Clone ID: PAT_TA_36824.pep
MLDPAPHVVPEKKATGTRRSSRRQVLSDSSSDDSEADSSREDEEEEKEASPPAGIEKKRKAAPTGEAGGSKKGRTPPLRTTPPTPTTARRSGHQGLSPWRNRKRPGTRITHGVSFVAQNLLTPNITLQPAQGPA

SEQ ID NO: 142407 - protein, 29 aa, Triticum aestivum
  Clone ID: PAT_TA_36825.pep
RAYVYIFNQFICTGACACSSNLNYAHKIN

SEQ ID NO: 142408 - protein, 34 aa, Triticum aestivum
  Clone ID: PAT_TA_36826.pep
VVNLFYVHDYNVPYRDMVQCMSLGCNVNKTSCEC

SEQ ID NO: 142409 - protein, 148 aa, Triticum aestivum
  unsure (1)..(148): unsure at all Xaa locations
  Clone ID: PAT_TA_36827.pep
VWMSEGTRYQSTVDEXAKLINAPETHEDDLDVYAKMKKDHNSMDNMYKEIPDEDLETHKFGSVKHLLAGLSTTNTILRHTLFPKSGDHRMITGHSINLLHIFDVPQKFKVMSLIVETIKRTATDQKRSCGYAPHIQVLINSMMGSRGP

SEQ ID NO: 142410 - protein, 92 aa, Triticum aestivum
  Clone ID: PAT_TA_36828.pep
SPTAHERSRLRRLTTCHMAGDVSTMCNHLVDRSALPIVPCPDCSMNVYTIHCYVCVHPTSAFLQMPDSHHFSGRILIRSVLAKPCRASRQSP

SEQ ID NO: 142411 - protein, 80 aa, Triticum aestivum
  unsure (1)..(80): unsure at all Xaa locations
  Clone ID: PAT_TA_36829.pep
EAFFIVFVELFNCHVDTISTTEYLSQGRGLCPSGFFSCIFFFCFPLFYAKSLFVDLFMYAFCFLCLHNAGNVFSSMSGDX

SEQ ID NO: 142412 - protein, 69 aa, Triticum aestivum
  Clone ID: PAT_TA_36830.pep
NLSAPHVPNYLVLGKNLEFFDFISSICFELFFNAGADESGHQIAALVLTGSSAYDSLIARCMAASPNPA

SEQ ID NO: 142413 - protein, 141 aa, Triticum aestivum
  unsure (1)..(141): unsure at all Xaa locations
  Clone ID: PAT_TA_36831.pep
HKHVPTVILEAVASPDLWIWHSFFGLPGSHNDINVLHRSPMFANLVEGHAPEANYTINGHNYKHXYYLADGIYPQWATFVKTIPNPNGEKNKNFSRFQEACRKDVERAFGVLQARFIIVRGPARYWDLETLGEVMTACIIL

SEQ ID NO: 142414 - protein, 47 aa, Triticum aestivum
  Clone ID: PAT_TA_36832.pep
PAGPYAKSKKIKLPLNCIIPKRTSIQVFLYITDISNHSSVEIENFRI

SEQ ID NO: 142415 - protein, 95 aa, Triticum aestivum
  Clone ID: PAT_TA_36833.pep
GSKEHEKDSLVHLAEAIIDPYYRDMKDSCNKDKRAWHLACMEKLDKAHVVYAANEEYTSYDMYKRIVDMRKCLLPQNIQGSSPKQSNGKRHHNNN

SEQ ID NO: 142416 - protein, 147 aa, Triticum aestivum
  Clone ID: PAT_TA_36834.pep
VLKLTQPSIMPSTGQSMKRKLIYGDYFPAELPEAAAKKVIMINTKGAEEQYDPASLRLCSVEADVPDKFCSGKLAGEHQAPAEPQVLDVEADVPAAADVPLVVVVEPQAPARAQQIVRFLQTGELPEEQEEAERVARQLSLYQDVDP

SEQ ID NO: 142417 - protein, 39 aa, Triticum aestivum
  Clone ID: PAT_TA_36835.pep
GHPKLSLMKSPCNVATTPSLFKSGRYLLQCSSWIMLLNE

SEQ ID NO: 142418 - protein, 117 aa, Triticum aestivum
  Clone ID: PAT_TA_36836.pep
NEQMAEWAELHRLSGLAMKAVLDHLWMKEPSLDSYFGLVQRFICDVPHIDAVKRSACIEGARMDLAHVKTYWAKMEATDIATSVPPRGQDSPEHYFEEVLEGARFIEAQCSKNIMFQ

SEQ ID NO: 142419 - protein, 73 aa, Triticum aestivum
  Clone ID: PAT_TA_36837.pep
VDGKPEHQSHTKHIELDIHFLHDHVAPGRVRVLHVLTSQQFADVMTTGLPSSVYEEFRSSLSVSGDASTAMGV

SEQ ID NO: 142420 - protein, 64 aa, Triticum aestivum
  Clone ID: PAT_TA_36838.pep
HIHVHGWNTDPRWTKASHSCHSTFEHHNKSCKTIWTQQTSISTPTYSLVSTERHLYPSPNAVDP

SEQ ID NO: 142421 - protein, 66 aa, Triticum aestivum
  Clone ID: PAT_TA_36839.pep
PIVVEEERWGANRGIPKLRRLRLLEILSWDALGIHKLEILCLLNSSHITVSLNLKSFIHTKLNKDS

SEQ ID NO: 142422 - protein, 52 aa, Triticum aestivum
  Clone ID: PAT_TA_36840.pep
AHIDTDKQNLLTDRTFSQLGNQDCSVSVHDHTKQFSRWRIRKRKLQTDPNQA

SEQ ID NO: 142423 - protein, 68 aa, Triticum aestivum
  Clone ID: PAT_TA_36841.pep
IRWQFFTVDHAKDQVQGHRCYVFHCSHEEQTSKGAQCSLQRAACASLSSVTANNGADRWWRKEISNSI

SEQ ID NO: 142424 - protein, 142 aa, Triticum aestivum
  Clone ID: PAT_TA_36842.pep
RVDGEQELHRLVQAPWPIGSDIGVTVLERTIDILQKMCDEQFAIHHAKDPDVLDGMIDDPPEEPPSPELIESLMPCKEWVEDLRNPVKRQEACSFIIARGGRVNLDPDDVVARLEHILGGADVADEVEHRQRDILRMQVMDG

SEQ ID NO: 142425 - protein, 69 aa, Triticum aestivum
  Clone ID: PAT_TA_36843.pep
KKCSVDKRMIVFLPQIEPNFDSHRASHFPSTALLINLISNKFKPILQALMPVSTFSAGYQMQSSRCPHM

SEQ ID NO: 142426 - protein, 50 aa, Triticum aestivum
  Clone ID: PAT_TA_36844.pep
KLKEDDRSDGHGKAIKRVGWAYLWCIARLVTVGSVYTLAHCKACEMLALP

SEQ ID NO: 142427 - protein, 139 aa, Triticum aestivum
  Clone ID: PAT_TA_36845.pep
WAEKHYSPPAPDSTHWRMHFDGSKMRTGLGAGVILTSPKGDKLRYTLQIHITASNNVAEYEALIHGLRLAKELGIRRILCYGDSDLVVQQSSGDWDANDANMASYRFLVQQISGYFEGCEFLHVPRTHNEPADALAPIS

SEQ ID NO: 142428 - protein, 97 aa, Triticum aestivum
  unsure (1)..(97): unsure at all Xaa locations
  Clone ID: PAT_TA_36846.pep
ERPLFFVLSQFFFWLLEVVFGFPDKFRHEKLTFHIAPFTNSYQELLXREAFARFNAIPHYVSLTLKMPSPRGIISLKGNIECFSSAEDCAPALTTTH

SEQ ID NO: 142429 - protein, 77 aa, Triticum aestivum
  Clone ID: PAT_TA_36847.pep
HAWLWRITCLKFAEATNHFVSLYFLHMLQDLTKVGYLATRFGGSYARSTKISSFLPNKNRLLINHVVSLRASCNWGD

SEQ ID NO: 142430 - protein, 69 aa, Triticum aestivum
  Clone ID: PAT_TA_36848.pep
QLAKEGVNRGNVAYAKERGSEIDIAADAENLELLHRKSWRAMYPQTRSVVQSDIRYVNISSGSDSPTHV

SEQ ID NO: 142431 - protein, 60 aa, Triticum aestivum
  Clone ID: PAT_TA_36849.pep
HGMRNQAFSDAMRAFVGMHGRLRVPYPIPHPIRVVIHTYPELGSLVQGDHHSIFYLQGPV

SEQ ID NO: 142432 - protein, 82 aa, Triticum aestivum
  Clone ID: PAT_TA_36850.pep
LVTRIVMVSAMIKLIMYDDNQTSSSRIVMTSTDLLYYKVQPSLVQGNGGARRRSTDSVIFCNEYPVKEPRARPQVHLTRRVA

SEQ ID NO: 142433 - protein, 113 aa, Triticum aestivum
  unsure (1)..(113): unsure at all Xaa locations
  Clone ID: PAT_TA_36851.pep
GPGRTSKLQEAVADSNPPPPTPTVLVTVAVLAIEEITAPSWAQPILKFLVNRELPTDEISARQVLRXAGAYAIVNKELVRHSVTGVFQRCVXARKGVAILKEIHQGECGHHGG

SEQ ID NO: 142434 - protein, 113 aa, Triticum aestivum
  Clone ID: PAT_TA_36852.pep
TDWENMMNKELHDKFQQMMSEQVQDVVNRFEEAMEKIDGMEKTFETKLDNKFNELLARLPPPPQAAPNAPLQQQQEQQEQQQQQRRFPNQVGRAHRVPIDPKQTSGVAVDASN

SEQ ID NO: 142435 - protein, 49 aa, Triticum aestivum
  Clone ID: PAT_TA_36853.pep
TCYGLVRLEGFMDSKVQLNVYPCAHFQRCQMHYLFFHTSSTYTAECIIS

SEQ ID NO: 142436 - protein, 127 aa, Triticum aestivum
  unsure (1)..(127): unsure at all Xaa locations
  Clone ID: PAT_TA_36854.pep
QFGAFSHTVTLHSYDRDTMLNPNKIIAARWRWRAPLVLLSSMTPLFKSLSQPRMFLTWKQRPCRREIDRRGAGGQHLAVLRSSGRWRHPTTLRGLHARARPRWVQANTRGLVSRWVQWSGRTXAGAL

SEQ ID NO: 142437 - protein, 67 aa, Triticum aestivum
  Clone ID: PAT_TA_36855.pep
GRWRWLPSLYDGTFRACPWTRASPRPQSCMRPRIRDPTRQLTVKGIDPTATSVITSYEGFGQGSGEK

SEQ ID NO: 142438 - protein, 103 aa, Triticum aestivum
  Clone ID: PAT_TA_36856.pep
MLRSTYHNIDRHEHLSSLGTEEAAVLFNHRGACGLAFPWRPARAATSSSFCQPHHARADLCVCTRGRRRHLIHTNNRQGSHSPQRISHAFSVVHRFNQWGSAD

SEQ ID NO: 142439 - protein, 123 aa, Triticum aestivum
  Clone ID: PAT_TA_36857.pep
RVDGPYCKIHRTKGHDLREYYQVEQFVKRQRAECEKRDKDKGQNAADGKGRGGEANRPGKPFRSKGKPARRQVKEACDHESDGGDEEETSEQEFQKANDALCIDGSASLHTTTGIRHFAVSHG

SEQ ID NO: 142440 - protein, 72 aa, Triticum aestivum
  Clone ID: PAT_TA_36858.pep
IYLLSRQVIPNGGSRRQVFKFDQRLLKALFTYERRARLPGRSIFSRECQTRPTGYCSGSCGRQFRGGAKQRQ

SEQ ID NO: 142441 - protein, 50 aa, Triticum aestivum
  Clone ID: PAT_TA_36859.pep
WTHMKMHIAYHQYLILGTQQCGIIGYGAGLQFHADYTGSSHLRVSYLACK

SEQ ID NO: 142442 - protein, 74 aa, Triticum aestivum
  Clone ID: PAT_TA_36860.pep
STVSRGDSQRWQDVAISLVMHNGIDADVNITSSQRYDTSDHVPGCNLDWAKPTIARLIVQTCTSVICTPQATSS

SEQ ID NO: 142443 - protein, 109 aa, Triticum aestivum
  Clone ID: PAT_TA_36861.pep
DCRSRSRIPIHQHELDVFVLCSSLMTCPSFPNPCFSVRVFVHNDHLYSSSLLVVILLFYFFFLENLLFFCRVSYTHWNSVQASHNCNIVMHLGATELFHSVTPTGSGYI

SEQ ID NO: 142444 - protein, 55 aa, Triticum aestivum
  Clone ID: PAT_TA_36862.pep
AYNLIVKLLWLSESDKAAWSDCLVRRTNTSFKDQIIGLNVLLCCSEHPHSIYVRG

SEQ ID NO: 142445 - protein, 42 aa, Triticum aestivum
  Clone ID: PAT_TA_36863.pep
FSDFFLSFFYSSSASVAWKSLLLALTSIDGHLHSPSTRIIRT

SEQ ID NO: 142446 - protein, 65 aa, Triticum aestivum
  Clone ID: PAT_TA_36864.pep
NFICDVIKPSSSSTSKNHSSQVILGTMNFVIYAYDMLFLILPSLSLSVAQLYMLHIIDSCDDAGA

SEQ ID NO: 142447 - protein, 113 aa, Triticum aestivum
  Clone ID: PAT_TA_36865.pep
FWKGNWFGPFWFYPHLRKGDFLQSDLIWLPQGFSHYDLFKRRPLNLILVTLLKSFYLSFTRNLTLILLSRPFFFFFFFFFFLFFFFFFFFFFFFFFFFFFFFFFFFFFFLRLY

SEQ ID NO: 142448 - protein, 109 aa, Triticum aestivum
  unsure (1)..(109): unsure at all Xaa locations
  Clone ID: PAT_TA_36866.pep
RVDAIHYEITGHQYNKGHYLPDGIYPQXSTFVKAISKPQGEKRKRFAQMQESATKDVERAFGVLQSRWGIVRYPALXWDESKLWEVMTACVIMHNMIVKEERDETIFDQ

SEQ ID NO: 142449 - protein, 60 aa, Triticum aestivum
  Clone ID: PAT_TA_36867.pep
SPGLFVFYYVYGKEIMILYTHIFLNKSLCIFLLKHSHRKAHIFSMRKKKKKKKKRPLKKL

SEQ ID NO: 142450 - protein, 70 aa, Triticum aestivum
  Clone ID: PAT_TA_36868.pep
HSCSFRQSKPDGRRAHAEKCLNTCLGLQSIVGNSVPRHSIFLIAGFTGAGACLHRLHRAMLTPHESISHL

SEQ ID NO: 142451 - protein, 55 aa, Triticum aestivum
  Clone ID: PAT_TA_36869.pep
PNMRHGPDHPNWAPLLIMREIHVVSLRVLVELPLELKRVTWSGIIRPCIRFGSNL

SEQ ID NO: 142452 - protein, 59 aa, Triticum aestivum
  Clone ID: PAT_TA_36870.pep
LICVGHLVLRERGIILGLGTSGDIHTKNCGRRFDRKAMMHGPCILIYPLPCEICYSTQN

SEQ ID NO: 142453 - protein, 47 aa, Triticum aestivum
  Clone ID: PAT_TA_36871.pep
ITLVNMPMRCDGKNLYIPSTISTTEDPSTGAHYQFEHGAKSVLSLNL

SEQ ID NO: 142454 - protein, 136 aa, Triticum aestivum
  Clone ID: PAT_TA_36872.pep
FTKFFMVYGAEAVLPCDIIHDSPRVRMYEEREAELDRQDSLDALEEEGNVAKARSAFYQQQARRYQSREVWAKTYNVGELVLRLPDKKMDKLKPKWEGPFIIDQVLTGGAYRLRGASDNRLEPNPWNAARLRRFYA

SEQ ID NO: 142455 - protein, 130 aa, Triticum aestivum
  unsure (1)..(130): unsure at all Xaa locations
  Clone ID: PAT_TA_36873.pep
CLHTCFGPEGKLVKVVSNLSCHTRPLSYVESXACFPRERERLFRLIDSSKRHGVLIISGDVHFGEIARFDCGVQYPLYDITSSGPTQSVENSVPAIFQSVMRLLAWLTTTPMPVLSPNCRHKSCSYGQPN

SEQ ID NO: 142456 - protein, 109 aa, Triticum aestivum
  Clone ID: PAT_TA_36874.pep
LLIVSYCFFFFFFFFFFFFFFFFFFFFFFFFFFFFDRKYMLMSLEKENYNNRSKNTLVQERKKRPKNLNFTSMSRRTLSYSTTSTTPTKRWPLLSGGHTPTRGLPSIRS

SEQ ID NO: 142457 - protein, 37 aa, Triticum aestivum
  Clone ID: PAT_TA_36875.pep
NCSLSDISLHVADMLSPYHTVTLATNLRPPENLSRLS

SEQ ID NO: 142458 - protein, 85 aa, Triticum aestivum
  Clone ID: PAT_TA_36876.pep
KILKKKPLKLKLGENLKRFKISLKGKKKLKPLRAPLFFFFFFFFFKFFFFFFFFFFFFFFFFFFFFFFFFFFFFFFFKTTYFSDT

SEQ ID NO: 142459 - protein, 59 aa, Triticum aestivum
  Clone ID: PAT_TA_36877.pep
VALKLRRVKIDAMVPLMIPAEDICNLKCYTSLLLCQCVIMCFHDFCKPLIYPRVPFLLC

SEQ ID NO: 142460 - protein, 49 aa, Triticum aestivum
  Clone ID: PAT_TA_36878.pep
LIGRSIDALGKTSYNDLASHMYSGRSVGVHPFVRGKQGPVRWIDRENGA

SEQ ID NO: 142461 - protein, 97 aa, Triticum aestivum
  Clone ID: PAT_TA_36879.pep
AASMLQGSHPIESPRTLRLGNLKNFKVPFFVSHISISSTIIRVHNLGDILCWLPVACTPRIHCAAVVDKSCNWLLSDLPTWYGSIKHMYQYQALPHK

SEQ ID NO: 142462 - protein, 87 aa, Triticum aestivum
  unsure (1)..(87): unsure at all Xaa locations
  Clone ID: PAT_TA_36880.pep
TGGCYHEGTNATKAHPILSLRQHHQGVSQPLVVNLGWSPNPHKLSGGNHNGRFLAGALXLPRSLQPPRVTRCTTKTREESTFALVNV

SEQ ID NO: 142463 - protein, 105 aa, Triticum aestivum
  unsure (1)..(105): unsure at all Xaa locations
  Clone ID: PAT_TA_36881.pep
SQPTPXYSKITTRAKTPTSCEISTREMPVIPLNRKNRLAQIGRGNFVTYPTFQISASISHVSPLPSHPPTHSYTKAHSKPENYYKNVLAGARLVASQCTKDLALE

SEQ ID NO: 142464 - protein, 119 aa, Triticum aestivum
  Clone ID: PAT_TA_36882.pep
APMNKFSVHRIKTSEFIQKLHPWYIHPPQGGHPQEHSWNNSPALQCSFPGGGPSFTSFSPSSLPQCTFARAKGPTAPFDADGVLDDLKPWTGLHQPPHHPEVAPKQGLSGPQLNYEAFH

SEQ ID NO: 142465 - protein, 67 aa, Triticum aestivum
  Clone ID: PAT_TA_36883.pep
MCDEWEVHVSAYDDDDVSSLLCIFSDSFKKKKKKKKKKKKGKKKKKKKKKKKGRPKRIKAKVSVKAT

SEQ ID NO: 142466 - protein, 63 aa, Triticum aestivum
  Clone ID: PAT_TA_36884.pep
EYFPHKKGLHLTQERNQILDKLCELQKSIEPLKNVVGNLHRMNTLITLCNKAVGCSRSKNLRA

SEQ ID NO: 142467 - protein, 119 aa, Triticum aestivum
  Clone ID: PAT_TA_36885.pep
PQMFGAQRVGLGSYVVVSRRSDVTILRLFRAVGIGPMDCPINGYTVISISETLGFGHPTWEWTFCCFFRSLGQSSSTFTLDTTFESILYSYTTLYQSFYVYLYIFTMMTAMYSTVIYEY

SEQ ID NO: 142468 - protein, 127 aa, Triticum aestivum
  Clone ID: PAT_TA_36886.pep
CTLASASSDDFTNDDFFPDVGNLFLNGMGDNLNANGAAPVARYVCLSFLFEIVVEFMCIVCVLDLMCSSTMLVRMISLIYVIAVMIYIVVNLVVTCSYIQLSERPVQPLPFHGRLVRCLQGALCLLL

SEQ ID NO: 142469 - protein, 89 aa, Triticum aestivum
  unsure (1)..(89): unsure at all Xaa locations
  Clone ID: PAT_TA_36887.pep
MFKQAGKLSAEDKDKGLHSDDEEEPRQPNTRGQKRFPQQVRTVNMIYATHIPKRERXRALRDVYVLEXSRPKVQPMVLLSDHLQSGPSH

SEQ ID NO: 142470 - protein, 52 aa, Triticum aestivum
  Clone ID: PAT_TA_36888.pep
NRSFGPLKFGINVAGKNRFSKLKSSSSTNVRTLYDMLPDSCSFTKTCIRINY

SEQ ID NO: 142471 - protein, 56 aa, Triticum aestivum
  Clone ID: PAT_TA_36889.pep
FRGVYWFQVCISIGELKCLIICQIFQSNIFSTIVYTSLDIIICICVVLQHAKVLTG

SEQ ID NO: 142472 - protein, 82 aa, Triticum aestivum
  Clone ID: PAT_TA_36890.pep
MIFHIKKLFHRRSYAKVTAILPKHAAFCKKIQNSCLLIFLTNRTHNTWASIFLNFFNLLSFPFIFLKPKRRSRGGVFVCVRR

SEQ ID NO: 142473 - protein, 91 aa, Triticum aestivum
  Clone ID: PAT_TA_36891.pep
HMSHDADSKLLRSSMKSNQSMRYIMGSQRQSMMYEVLDLRFGVNMQLYVCRKRSGFFPDMNEHYMTLKCIVAISGEQFKFELHARAAVLIT

SEQ ID NO: 142474 - protein, 136 aa, Triticum aestivum
  unsure (1)..(136): unsure at all Xaa locations
  Clone ID: PAT_TA_36892.pep
AEMLVMAYARSYNLPVITTRGNNVYGPNQFPEKLIPKFALLAMRGLPLPVYGNGSNARSYLYCEDVAEAFDVVLHRXEVGHVYNIAAANERGVVDVARDICEILGVDPEKAIKFVDDRPFNEHRYFVDGEKMTRLG

SEQ ID NO: 142475 - protein, 57 aa, Triticum aestivum
  Clone ID: PAT_TA_36893.pep
LLIARFLSCPQERMYLLTKHIHVHNQRDNNMHIGSEHMIFHQLNQLAPITRCLLATY

SEQ ID NO: 142476 - protein, 76 aa, Triticum aestivum
  Clone ID: PAT_TA_36894.pep
FTKPSPTSIVTSVSVSVPLHSVLILTRNAPALISTVESLCRFLTLRYQRPPGQSTLTIVSALQLGNPVSMSPAGWS

SEQ ID NO: 142477 - protein, 77 aa, Triticum aestivum
  Clone ID: PAT_TA_36895.pep
YIYQKYSCSLTARWRADPLAGSAVRTPSGAGPPDEGFFPRLETLVSKSSEAVLFHPWGEGILDSSPQLSSFTKTLIP

SEQ ID NO: 142478 - protein, 117 aa, Triticum aestivum
  Clone ID: PAT_TA_36896.pep
LYLQETMKRRFSPSFFSKIDPYGTFDWNWIPSIGKAGGLLCAVKRQHLEVFFVVLGEILAFMLLSSMLKKQCVWSLLNVYGAAHDESIHEFLEELANYCIHLSMPYIVGGDFNILRH

SEQ ID NO: 142479 - protein, 122 aa, Triticum aestivum
  unsure (1)..(122): unsure at all Xaa locations
  Clone ID: PAT_TA_36897.pep
SLFTHRNRGNDPPVPWPPMTLWQPSRASPTFSLVDKSNPWPPLXLPRTVAVPLSLHSPLFRSGPEPSAAVTVAPAYPRPPXPPRAMPWCAGRPPXSSSSFPSMRTSRMPPQRGPCYRILRRL

SEQ ID NO: 142480 - protein, 124 aa, Triticum aestivum
  unsure (1)..(124): unsure at all Xaa locations
  Clone ID: PAT_TA_36898.pep
KFDNEKDLDAIRSAVLRYNVTHPVVNDGDMYLWRELGVNSWPTFVVVAPNGKVLAQISGEGHRKDLDDVVGAALEFYDERKLLQNNSLPLALENDRDNRLITSPLKFPXKLAIDVQNNRLLISD

SEQ ID NO: 142481 - protein, 133 aa, Triticum aestivum
  unsure (1)..(133): unsure at all Xaa locations
  Clone ID: PAT_TA_36899.pep
DGGNSISCEEFNVSLDTLKTSMTTEVKDMFKEFLEGLKLSTAPVKVGDPANTVTDANPKKGEATSEKAPLSSGKNGTGIFAHVEPPIYGGPIPSTHLNHAGPPPKYEKHEDFDSWVYRFKRHLXHVNTNLWRI

SEQ ID NO: 142482 - protein, 97 aa, Triticum aestivum
  Clone ID: PAT_TA_36900.pep
HEWNKQLRRWRVRHRVRPRAAEEGAWAQLNGCLSAAYDGGNCGHLDRYQPGVHMEVRCSPGSMAVMVRTTRCCNLAGIAFRWGDGSSVLQNVFVLGS

SEQ ID NO: 142483 - protein, 110 aa, Triticum aestivum
  unsure (1)..(110): unsure at all Xaa locations
  Clone ID: PAT_TA_36901.pep
EVYHSEWLANVVMVPKKNNSLRICIDFKHINRACPKDHFHLPRIDQIVDSTAGLERLSFLVAYSGYHQVRIYGPNEIKTAXPFGCFCYITMPFGLKNVGAMIQPMIQKYH

SEQ ID NO: 142484 - protein, 91 aa, Triticum aestivum
  Clone ID: PAT_TA_36902.pep
VSASTGSIHFCVRNKDALPCVRRYSWWVRAVSGGNIFFAKYRRPFGGSQMLRGGIIILRIIMMHVLACSRGPSCQPLHVQSTSDACRSLTT

SEQ ID NO: 142485 - protein, 42 aa, Triticum aestivum
  Clone ID: PAT_TA_36903.pep
RHVFGYLVNRWHHIIHSRCYINPQLVSFIAFVWNLISELFCH

SEQ ID NO: 142486 - protein, 117 aa, Triticum aestivum
  Clone ID: PAT_TA_36904.pep
VAVLCCNTATAVARRLIARASDVCSLGRARESPSSPVARHRRAALQHYQCCGWTEPPASAAAQLPDPAGNRCGNHQGLLHGNTGRDAPDEASLQLRRKLQCSSDEASLQPWWSPFRP

SEQ ID NO: 142487 - protein, 66 aa, Triticum aestivum
  Clone ID: PAT_TA_36905.pep
EGELVDFLRENRNIFAWSPKDMLGVPTDFAEHKLHVRPDAKPVRQPLPRLSEEKRRVVGDEIARRP

SEQ ID NO: 142488 - protein, 62 aa, Triticum aestivum
  Clone ID: PAT_TA_36906.pep
IPVPTGALDCAAVDASEEARARDLRLSAGGMEDLHIVDVHPSSVRSHIVSGSVFTISHSIQS

SEQ ID NO: 142489 - protein, 47 aa, Triticum aestivum
  Clone ID: PAT_TA_36907.pep
IHQSRQTTHEKQNLSKTEQSVVIWIRRILMDLQKLVNKLMDVWYLSI

SEQ ID NO: 142490 - protein, 94 aa, Triticum aestivum
  Clone ID: PAT_TA_36908.pep
FRMSLGLPVVPTVNCANNTGAKNLYIISLNGIKGRLNHLPSACFSHMVMATINNGNPDLTNKVMPAVIVLQRRPWHQKDDVLMYFEYNAAGDCE

SEQ ID NO: 142491 - protein, 108 aa, Triticum aestivum
  Clone ID: PAT_TA_36909.pep
DGPFQGSSYRSALHAPHGTPPCRGTITGLSAGNRFPLSPGLPVAATVNCADNTGSINLFIISVNGIDGRLNHLPLGCVSDMVIVTINNGNPDLTKRVMPTIIVLQPQA

SEQ ID NO: 142492 - protein, 85 aa, Triticum aestivum
  Clone ID: PAT_TA_36910.pep
STGQEIDLHITDRKGVENPVADNLSRLENILDDPQPINDSFPDEQLAAINVSHNTCSDPTSDGQVSVLKCHPWIGMLTHTVLEDL

SEQ ID NO: 142493 - protein, 62 aa, Triticum aestivum
  Clone ID: PAT_TA_36911.pep
TWNIAMQTYSLWKQTKSSMLFLVTIQQHLSYLSLMTIFKTCQILQLINTCCSTHAIPCSNSG

SEQ ID NO: 142494 - protein, 89 aa, Triticum aestivum
  Clone ID: PAT_TA_36912.pep
QMVFVGGPTKPLELPAFAIVPGGKGIAGNCVGGMRDCQAMLEFAAKHGITAEVEVIKMDYVNTALERLAKNDVRYRFVIDIAGSLGSTS

SEQ ID NO: 142495 - protein, 67 aa, Triticum aestivum
  Clone ID: PAT_TA_36913.pep
LAIETCDDADRDRREFRHKDSILEHLTNTSKYHIDLMHDPVIGRQFLKASKILHSAETLKEAVALST

SEQ ID NO: 142496 - protein, 131 aa, Triticum aestivum
  Clone ID: PAT_TA_36914.pep
AGADCNSIHEQGPCYNPNNVVSHCSWAATSYFQKKRAMGATCDFGGTALVVSTDPSSSGCSYPSSASAAGTSTTPTGTGTGIGGTTGGTPGTFTPGAGTSTGGMGGTGTGTDTTTGFGGLGPTGTSNMDTA

SEQ ID NO: 142497 - protein, 98 aa, Triticum aestivum
  Clone ID: PAT_TA_36915.pep
VKRDTSSTLGKCNLVLFISFPTHLCSSLVMDRQSTPPSVYNNNDKFDAMKYNLDAKMDAQLEEIKALIKAYKRSSSSSRRRSSAHTSELPSLARSHWH

SEQ ID NO: 142498 - protein, 75 aa, Triticum aestivum
  Clone ID: PAT_TA_36916.pep
NFLSFFTTIAPLHHSSLLFIFVDIKFIPYVPFVVCMIFIVWFLNSWKSWVWRQMDLSYEILACIHDQNRFPIAQL

SEQ ID NO: 142499 - protein, 119 aa, Triticum aestivum
  unsure (1)..(119): unsure at all Xaa locations
  Clone ID: PAT_TA_36917.pep
ENNAYSVYIINTFYGHAPNMNGLLNLGCSDTHVHNVDAKRXRVDNDSTTFLWHCRLGHIGVKRMRNLHADGLLKSLDFESLDTCEPCLIGKMTKTPFFGTMERASDLLEIIHAGVCLSC

SEQ ID NO: 142500 - protein, 126 aa, Triticum aestivum
  Clone ID: PAT_TA_36918.pep
LQKKSFHFLCLFVSKKKLSLFICLNQIFSVYYFSFYTLVLKHFRFYNVSFLLFPRSVFLPSPLAPSPSVLFHPAPPLVSVLASCPDVVSPPPLLRRSSYPLLCGYCVLRRLASTVLFVVQCFQFLF

SEQ ID NO: 142501 - protein, 57 aa, Triticum aestivum
  Clone ID: PAT_TA_36919.pep
VMDLIEEVYRWSQTYISMDVIERNTPCFKFATQRSSYVNATRHANLDTSVYPIHIHY

SEQ ID NO: 142502 - protein, 147 aa, Triticum aestivum
  Clone ID: PAT_TA_36920.pep
GSTGIKRPRGRPRKERPPEEMSTETGDAMPAPETGDAAPDENGAAMPGEAGDASPTGFKKLRGRPRKERPPASISAETEDATPAEAGDARPAETGAATPAEAGNAASTGIKRPLGRPRKVKKLGKPRKEKPEAAISGENGDDAAAAI

SEQ ID NO: 142503 - protein, 107 aa, Triticum aestivum
  unsure (1)..(107): unsure at all Xaa locations
  Clone ID: PAT_TA_36921.pep
HHNTFGKKYKYSFDKFTKTLQWDYMSLKHNILRALGLYRRSAFKNFFKIVLGCHSAYGRTXHRDSGGIHLHPVCFDTGKGHPRAFYARRPLLRIKTWHHTKELLHQG

SEQ ID NO: 142504 - protein, 77 aa, Triticum aestivum
  Clone ID: PAT_TA_36922.pep
LSFCLLRQPHMVGSSKLLPLKFFVGQKTLTTQFKKKKRKLSPSPHHKNPHPARHPSGPHSHLHKLLRVYAWHRLLWW

SEQ ID NO: 142505 - protein, 146 aa, Triticum aestivum
  Clone ID: PAT_TA_36923.pep
ADKKNELNKKCYWAGPLQRLFRREDGIVRLGAGLAGPHRALTWPAWHEKPSWSPRASRHRLGFAPYRWKTRRRLLPSLNRPESEARVRKGPSFSAGSSEEVAATMPTRRGGEKGFSKAAERKPSRRGGQKAGSQEKEAAIMPARRP

SEQ ID NO: 142506 - protein, 98 aa, Triticum aestivum
  Clone ID: PAT_TA_36924.pep
DFLYNTKILQWNYVPSSTPGKIHLVPQLNAKQRLEKKIEKKSENTKSYWAHGLRVIQYMGQPTLRPSLGAHCGAHPRLHGRGYRRVDHLQTPLSRIRA

SEQ ID NO: 142507 - protein, 81 aa, Triticum aestivum
  Clone ID: PAT_TA_36925.pep
RRGVQRGARERPPRRPIALAALRLERDYGFTKLTAFSHASLLFEYKMTSDGEVYDNFTIHRDYRDVLGCVHDSCFPTTLAT

SEQ ID NO: 142508 - protein, 60 aa, Triticum aestivum
  Clone ID: PAT_TA_36926.pep
RRHIIYLKNVERVSEKCLTSALKMHILYREIVIKQHTYINKRSNQITRETNSKETRIIKV

SEQ ID NO: 142509 - protein, 59 aa, Triticum aestivum
  Clone ID: PAT_TA_36927.pep
KQKVCALKNNFHFLPESDKIPIPTAVDQYTNYLGPSNFFIIFGVTEVFETSRFLQTIMF

SEQ ID NO: 142510 - protein, 126 aa, Triticum aestivum
  Clone ID: PAT_TA_36928.pep
MKLFILAAALIVATSANLGAFEKWTSFKATHNKSYNVIEDKLRFAVFQDNLKKIEEHNAKYESGEETYYLAVNKFADWSSAEFQAMLARQMANKPKQSFIAKHVADPNVQAVEEVDWRDSAVLGVK

SEQ ID NO: 142511 - protein, 108 aa, Triticum aestivum
  Clone ID: PAT_TA_36929.pep
ESTQTSANASAHASAHASVCVSSSVRGADLTLTLFYEGRCPACHEFILTQLYPSYAKLTDSLKLDLVPFGWSESSRSANGRVSFTCQHGDEECYINRIHACVLDQNPT

SEQ ID NO: 142512 - protein, 49 aa, Triticum aestivum
  Clone ID: PAT_TA_36930.pep
AKRQSAREGAHIPGHVNLLWFWGSSGQLANLDGLPTFLFLSSEYLPNPV

SEQ ID NO: 142513 - protein, 141 aa, Triticum aestivum
  unsure (1)..(141): unsure at all Xaa locations
  Clone ID: PAT_TA_36931.pep
CDDLTVEIEHVDAVALEKLEKQGVVCEPKASTIAIIQDKYRQKGHFSKFGIPIADFVEVDTLSSIENAGEMFGYPLMVKSKRLAYDGRGNAVAQNKEELSSGVSSLGGFXHGLYVERWTPFAKELSVIVARSRDGCTVCYP

SEQ ID NO: 142514 - protein, 85 aa, Triticum aestivum
  Clone ID: PAT_TA_36932.pep
TLEIRGGNSRPSHPNLAPPLNATNSMCCYLVKRSWEKKMHHVAWAALRGGGCRRGGPPSISGAAEQTMRLDLESGNRNLASYISL

SEQ ID NO: 142515 - protein, 122 aa, Triticum aestivum
  unsure (1)..(122): unsure at all Xaa locations
  Clone ID: PAT_TA_36933.pep
MCEDDGKKKVEPDDWEDAADMSTPKLESSDSGNQASAVQLPDSDMTEANGRKKYSRDFLLTFAHQYSSLPVGIQMDTVTSTLFKDLAGKSYVIDREPHPSSARGSDXTTSRGDRRGPAMDDD

SEQ ID NO: 142516 - protein, 125 aa, Triticum aestivum
  Clone ID: PAT_TA_36934.pep
ERAKIIKTTEYHKIITQEPNYNLPNSGFGKHNIIQAKNLTQSLRCNAPKSGAATIRSIYTMSGSYFSTSKILPLATRIVQQMQCLVPTSSNPINFDCSGVNKLLSTIEKRSSHDKSLPCLKLHAL

SEQ ID NO: 142517 - protein, 130 aa, Triticum aestivum
  Clone ID: PAT_TA_36935.pep
SRVDTRVYTDTTDPVKYPSIMAEGQLLLSDIIDESNEIIKSENVMSMERLPINNNSGQSYGYIVYRQYNLYLAANSVLTISGYVRDTVLVLLNGELVSPAPVNEKSIEGFGFWKLYNSTLSLRNKELQNA

SEQ ID NO: 142518 - protein, 110 aa, Triticum aestivum
  unsure (1)..(110): unsure at all Xaa locations
  Clone ID: PAT_TA_36936.pep
MLLDHDKPTNYEEAMMSPDSAKWLEAMKSEIGSMDAMLWTRPIVYSTNSDLGVDHWALVKNILSRXKDMFLDYGGDKRFVVKGYVDTSFDTDPDDCKSQSGYILKVGAIS

SEQ ID NO: 142519 - protein, 67 aa, Triticum aestivum
  Clone ID: PAT_TA_36937.pep
LEYRKRFILATHLCSHCHRSQSFLVLPKTRQILGTGAFQADSRQIPGMEDLRCLAHHKQFMIINRIR

SEQ ID NO: 142520 - protein, 104 aa, Triticum aestivum
  Clone ID: PAT_TA_36938.pep
MGKEKIHINIVVIGHVDSGKSTTTGHLIYKCGGIDKRTIEKFEKEAQEMGKGSFKYAWVLDKLKAERERGITIDIALWKFETAKYYVTIIDAPGHRDFIKNMIT

SEQ ID NO: 142521 - protein, 127 aa, Triticum aestivum
  Clone ID: PAT_TA_36939.pep
DIRQRESNERAFLFGVNSGAYGEGTTSAILLGGHLLSLRWSCHCLLTLAGGARWCVLDGSAALQGGALAGVGIRALTGLGLLLPKCPPFCCSCCFPVDLVGTNKSILLVAKDRYDTYWPWHFQYVVR

SEQ ID NO: 142522 - protein, 106 aa, Triticum aestivum
  Clone ID: PAT_TA_36940.pep
HESTVIRASLVGGLGLTPSGNIGLNGALFESVHGTAPDIAGQDKANPTALLLSAVMMLRYMGLNNHATKIENACFETIKEAKYLTGDLGGKAKCSEFTNSICEKIA

SEQ ID NO: 142523 - protein, 104 aa, Triticum aestivum
  Clone ID: PAT_TA_36941.pep
MNVVMEEKLLEFPNIICVDGTHGTNKKGLDLTILLVKDDRNAGFPVAFLLSNRLDQRIQEVFLDALKNKIQTEVNAEYFMSDDDPKYYNAWKKIMRHEPKRLLC

SEQ ID NO: 142524 - protein, 83 aa, Triticum aestivum
  Clone ID: PAT_TA_36942.pep
GRNAGRALVHLASSDWSFVLLPVSWCPSSLLKLTKGLFHERARQRSIRFVQLESVSISDVFLSNSFFSELYYYSHSCFHLSEW

SEQ ID NO: 142525 - protein, 41 aa, Triticum aestivum
  Clone ID: PAT_TA_36943.pep
SCRYTCTSNFWPLYFFTFENIINKYITKNNLLTSLKNVMNF

SEQ ID NO: 142526 - protein, 106 aa, Triticum aestivum
  Clone ID: PAT_TA_36944.pep
MKYLAVFVIFAYLYAAHASVYLEEKFSDDSWEKNWIYSIHPDKEFGKFVRTAGKFFNDDEEDKGLQTSEDARFYALSRKFKSFSTEGKDLVIQFTVKHEQNIVCGG

SEQ ID NO: 142527 - protein, 44 aa, Triticum aestivum
  Clone ID: PAT_TA_36945.pep
CGRKRLNYELPVTLDINTDPPRDGEYDDFQVQCHTNFKQMNSNL

SEQ ID NO: 142528 - protein, 61 aa, Triticum aestivum
  Clone ID: PAT_TA_36946.pep
KYLSKQISSKGNDKTICKKRLLIRSNGVTMVGHDQAPDRRSYGSSQPGPQMKQWHYADQKA

SEQ ID NO: 142529 - protein, 69 aa, Triticum aestivum
  Clone ID: PAT_TA_36947.pep
HERLDKQHVKCASKDAYTSYEMDTRIIDMMKHVIPAPDEGPRHCAVAGASHEIDDTTIGSHSLDGIQFL

SEQ ID NO: 142530 - protein, 121 aa, Triticum aestivum
  Clone ID: PAT_TA_36948.pep
MAPKRNNMIPNGHFHKDWQRFVKTWFNQPARKIRRRNNRIKKARAIAPRPAAGPLRPVVRCPSIRYHTKVRAGRGFTLQELKAAGLNPRFARTVGIAVDHRRRNKSVESIQLNAQRLKEYK

SEQ ID NO: 142531 - protein, 58 aa, Triticum aestivum
  Clone ID: PAT_TA_36949.pep
LIWGRTNSLRYVSDLRIYPITCIGVLGRTLDMWFIQSLMRYIVTSILVLRARLRYLHV

SEQ ID NO: 142532 - protein, 105 aa, Triticum aestivum
  unsure (1)..(105): unsure at all Xaa locations
  Clone ID: PAT_TA_36950.pep
MMKKPLCSPLALSVGSDSNGSGAVALLKIARIFSQIYSSLKTRSKFNLLFGLTSGXPYNXNGTSKFLEXDLWMHVSKPPEKPYIKQIFEDFSDVSKEMGISVAQD

SEQ ID NO: 142533 - protein, 88 aa, Triticum aestivum
  Clone ID: PAT_TA_36951.pep
IITNLAAPRITRSGHIGIAARSLHQAGIDHVTSCDLHRHGRTIASSSRCPSRRTTSTPRLTWKLQRLLTDLLRHLVWTRGFAIPSSTY

SEQ ID NO: 142534 - protein, 72 aa, Triticum aestivum
  Clone ID: PAT_TA_36952.pep
FFWLLVKLWSNYVQIWSNCGQTMFKLLIQEILVLITNYLSFFDFWSNCGQTMVKSGQTMVKLCSNYGQTTYS

SEQ ID NO: 142535 - protein, 115 aa, Triticum aestivum
  Clone ID: PAT_TA_36953.pep
AGRYTRLDHSIPYPTFATNEAIHMTEIYEYACGLNDSAFVLPHFQVYKYLIATKLVDRGLVEKSLAYLENIASVIVANPSLVEISFVDNVYNLADRLKYYDLVGEVEDESQFGGM

SEQ ID NO: 142536 - protein, 143 aa, Triticum aestivum
  unsure (1)..(143): unsure at all Xaa locations
  Clone ID: PAT_TA_36954.pep
GSTGNSHNTIGIQFKILGPSNHTPAAQFTWKSRAALRCRFFAWLALRNRCWTSDRLARHGLDHQEACPFCDQAEETIDHILAQCVFAREVWYXLDLHGNEQTRVDTNXDTRLIEWCPNKGGNNGDGKDVRALVLLVKWELWKH

SEQ ID NO: 142537 - protein, 77 aa, Triticum aestivum
  Clone ID: PAT_TA_36955.pep
FSLDGLQPYYFCVIVFFIRTRCNKCVIELFYNSSSTVCVSIIDPGMTLKHRDFGSLGSWSLQDGIRAYADCRTRPLE

SEQ ID NO: 142538 - protein, 75 aa, Triticum aestivum
  Clone ID: PAT_TA_36956.pep
VAQEMLHKDKEELRNKSSGAYKASCEAPTSSSEKQTFNEELILMVKNFNKFYKSRSKERSSKSKAYNDRRSSTPQ

SEQ ID NO: 142539 - protein, 67 aa, Triticum aestivum
  Clone ID: PAT_TA_36957.pep
ARLSPCYPWDLRLGTSTLSTVGISVADFLHIGVVIARRYHATRLEEGCPFANCLITDEGRTDSTITM

SEQ ID NO: 142540 - protein, 100 aa, Triticum aestivum
  Clone ID: PAT_TA_36958.pep
SSLFIIHDHVFVTATVTQPGCSVYKEKTAGEVHHGLTQQYFCLHGIRRHLTNVNLFLLSHGFRAGGYHRRHRASLSRQPSHVEGTVPRIPAHLQSPWHRI

SEQ ID NO: 142541 - protein, 58 aa, Triticum aestivum
  Clone ID: PAT_TA_36959.pep
SSMAQATIISKCHYKYAYFIIADSGTMDHHIYKNKRGRVHTSFSHPNKSIIYHHYCLS

SEQ ID NO: 142542 - protein, 114 aa, Triticum aestivum
  unsure (1)..(114): unsure at all Xaa locations
  Clone ID: PAT_TA_36960.pep
VVTIMLIRNMQTGQSMGYRFANIITHTSTDTSLQNFNGHVNLTTDPTLIIYWTTXTKQCTSSSVVSHDATLGGHLTADVTHHMIIELFANMSLSVNGPHINSHTNTGCSKGHGL

SEQ ID NO: 142543 - protein, 51 aa, Triticum aestivum
  Clone ID: PAT_TA_36961.pep
TFWGPRFFFFFFFFVVLFFFFFFFFFFFFFFFFFFFFFFFWFSIYIYFIWQ

SEQ ID NO: 142544 - protein, 115 aa, Triticum aestivum
  unsure (1)..(115): unsure at all Xaa locations
  Clone ID: PAT_TA_36962.pep
PVTVGIHNSRNWANLANKARDIFVKKATKRDEENTEYPLNENSKHFSYRHYSTKMSNGEVRDRKWFVFSKHAKRVXFSCNLFNSDKCTNAMRNDGFCDWRHINVRLLDFESNVDP

SEQ ID NO: 142545 - protein, 60 aa, Triticum aestivum
  Clone ID: PAT_TA_36963.pep
TSELTYHLTTESLTELPPQLKPPLEELHLRKQLPAIWLFLLPVYTVTIALACNGRVQNVA

SEQ ID NO: 142546 - protein, 130 aa, Triticum aestivum
  unsure (1)..(130): unsure at all Xaa locations
  Clone ID: PAT_TA_36964.pep
DEDHTTHEQLEVYMQTHSLVRDDSLXQLHVAVIKAITAHVCHIVLHDPLGSNADQRLRAKXLRSLRKTFYGVKLTIGDGEGSHMKNIDNIDDTAGSSPDSSSKRESSFTPIPNPPLTQSLYLDAPHFGGT

SEQ ID NO: 142547 - protein, 44 aa, Triticum aestivum
  Clone ID: PAT_TA_36965.pep
DIFCIEFTLHREGPNMGKSSCPLPHVTIRHRRIVSDPLPEINWC

SEQ ID NO: 142548 - protein, 74 aa, Triticum aestivum
  Clone ID: PAT_TA_36966.pep
SYLLYDSRSAFRSQCSEAISAHARLVKFNLSILLVQNWLAPVVCERRAYHTRSSRVVSARRTVATVHTQGEHLY

SEQ ID NO: 142549 - protein, 125 aa, Triticum aestivum
  Clone ID: PAT_TA_36967.pep
MLQGPRPKVAALKEAVSKSENSGALERTVRDVPEARMAEVRQELQALMEKHESLERDSKTRASELALALVSTKNAKAEAQKALQEIEAIKKIAADKAFFMQSRHVKENYLLLTRIRSSPGAFVDL

SEQ ID NO: 142550 - protein, 127 aa, Triticum aestivum
  Clone ID: PAT_TA_36968.pep
GSTPCTNASRGTRCEVQQKGNSHGEEAWHEELELGVHGELKEATTLAPADDRRGGHEVQRDRDGRILRAGVGEGRIWCPEASGSSGVKGELQDAGARWRRPLHGRASSYTIRRPGGMRGTRVVGRGG

SEQ ID NO: 142551 - protein, 126 aa, Triticum aestivum
  Clone ID: PAT_TA_36969.pep
LQNAEHQSFTQNVEGVEAISRVYPLAGTTRAPASTEATDSTNAPRPKKRARVLTDRELLVALHQKQDRHHDWLKRQMKSLLVDVNRLRNLATKNAFVTHETCCRTWKGLSMICTEAKLEEDGFTER

SEQ ID NO: 142552 - protein, 143 aa, Triticum aestivum
  unsure (1)..(143): unsure at all Xaa locations
  Clone ID: PAT_TA_36970.pep
GRLITQNILLAYESIHTIKNKKKGKCGYCTVKLDMHKAYDXVEWNILRRMMTRLGFHVEFVNLLMACVRSVKXKVRFNNQETDYFIPERGLQQXDPLSPYMFLICAEGLSSLMAHREEVPGIEGVTVCRNAPTISHFFFADEL

SEQ ID NO: 142553 - protein, 137 aa, Triticum aestivum
  Clone ID: PAT_TA_36971.pep
FGHDVETYRDERGRVRVSRVRGMGIRMTRDIQRNLDFIKEHEQSKSMGQANIGKGSTSNEEPPDFPEHLFENDGLQSSVDLSEDFAETIGDNHHTSSLVGGSDDISEGSCHGSKETIEISFVDDQIGVKDNDDKLFL

SEQ ID NO: 142554 - protein, 136 aa, Triticum aestivum
  Clone ID: PAT_TA_36972.pep
SPDYCGKISRYLDTDKKRFSGMKSHDCHVMMTQILPVALRGIMDKHVCDTLIGLCNFFDVISRKSISVKQLRRLQEEIVVILNELEMYFPPAFFDVMVHLCVHIVDDIIDLGPSFLHNMMPFERMNGIIKGFVRNM

SEQ ID NO: 142555 - protein, 135 aa, Triticum aestivum
  Clone ID: PAT_TA_36973.pep
SLDRCWTAERRARQGLTHNTVCILCHQEMESIDHLLAGCVFARDTWHEILAWCRLISPPMDSTTTFFAWWVLAADTSPSGLRKGLNSVITLTAWAIWKHRNIVIFDGLHPSTYGLVLSLQDDARLWANASAKGLA

SEQ ID NO: 142556 - protein, 79 aa, Triticum aestivum
  Clone ID: PAT_TA_36974.pep
RKDTTTSRREQRPLRSCRVEAEKMGSTSCPSTKSGHKAGNSNEAGIEAPMPNKSYIVPKSGRSARAFGLGSRSLQLGPS

SEQ ID NO: 142557 - protein, 106 aa, Triticum aestivum
  Clone ID: PAT_TA_36975.pep
ASSKEASPPPEAAVDNATGFYQSDLIEHHLPDSPYASLRHITDAAAGSSSAQPHLTRLIMNTLSIPHLVPSTLFPPTPSAHELAPYNTCDRPSAQLSHLTIDPSSI

SEQ ID NO: 142558 - protein, 131 aa, Triticum aestivum
  Clone ID: PAT_TA_36976.pep
WVPTVRGRKHLLGLIRRNFPCVQPWTLWVPAIRLSTYSPLPMTLFVDHATSSAARPWTSARPRTGTTRRWEDAAVESQIERSTRVISGSGVAWGCSRWRITRGVEVWPGRRWGSTSQRCMLSRAASRRRPD

SEQ ID NO: 142559 - protein, 85 aa, Triticum aestivum
  Clone ID: PAT_TA_36977.pep
EKDHRSSPTASDKEDRSNNTSYVKSVTQLLPYVHATGLANFNTSIFNFHIYSTIITLISLSPYLKTIIKYQTSLSIQCTLYGSFY
